United States Patent 9,303,079 (MODIFIED POLYNUCLEOTIDES FOR THE PRODUCTION OF CYTOPLASMIC AND CYTOSKELETAL PROTEINS) - sequence listing, part 10

SEQ ID NO: 17159 - DNA, 1803 bp, Artificial Sequence
  Description of Artificial Sequence: Synthetic coding sequence
atggtccttatcctcggcaggaggctgaatcgtgaggatctgggagtgcgtgatagcccagctacgaagcggaaggtctttgaaatggaccccaaaagcttgacaggccacgagttctttgacttcagttccggaagctcccatgccgagaacattctgcagatatttaacgagttccgagattcccggctttttactgacgtgatcatatgcgtggagggcaaagagtttccatgtcaccgcgctgtgctctcagcttgtagctcttatttcagggccatgttctgcaatgatcaccgggagtccagggaaatgctggtggagattaatggtatcttagccgaagcgatggaatgtttcctgcagtacgtgtacacaggtaaggtgaagatcactactgagaatgtacagtacctgttcgagacatcttcactctttcaaatctccgtattgagggacgcttgcgcaaagtttctggaggagcagctggacccgtgtaattgcttaggtatacagagattcgctgatacccattctcttaagacgctgtttacaaaatgtaagaatttcgcgctgcagactttcgaggacgtgtcacaacacgaagagtttctagagctcgataaagatgagctcattgattacatttgcagtgatgagctggtgattggtaaggaggaaatggttttcgaagcggtgatgagatgggtgtatcgggccgtggacctgcgccgacccctgctgcacgaactacttacccacgtgagattaccgcttcttcatcctaattattttgtccaaactgtcgaggtagatcagttgattcagaattccccagaatgctatcagttgcttcatgaggctagacgatatcacattcttggcaatgagatgatgtccccaaggacccggccgcggagaagcactggttacagtgaggtgatagttgttgtggggggttgtgagagggtgggaggtttcaatctcccttacactgagtgctacgaccctgtgacgggcgagtggaaatctctcgccaagctgcctgaattcacgaaatctgaatatgccgtgtgtgccttgaggaatgatatcttggtctcaggcgggagaatcaactcccgtgatgtgtggatatacaatagtcagctgaatatttggattcgtgtcgcgtctctgaataaaggcaggtggcgtcataaaatggctgtgctgctgggcaaggtttatgttgtcggcggctacgacggccaaaaccgtctgagttccgtggagtgctacgatagcttctccaaccgatggaccgaagttgctcctttaaaagaggcagtctcctcccctgcagtgacatcatgcgtggggaaattgttcgtaataggcggtggcccagatgataacacctgctcagacaaggttcagtcttacgatccagagacgaactcatggcttcttcgggcagcgatccccatcgctaagagatgtatcactgcagttagccttaacaatctcatctacgttgctggcggtctaaccaaggcgatatattgttacgaccccgttgaggattactggatgcatgtgcagaacaccttcagtcggcaggaaaattgcggtatgagcgtgtgcaacggaaaaatatacattttgggtggacgcagggagaatggggaagcgaccgataccattctttgttacgatccggcgacctcaatcatcactggggtcgccgctatgccaagacctgtttcttaccacggttgtgtcaccattcatagatacaacgagaaatgttttaaactgtag

SEQ ID NO: 17160 - DNA, 1620 bp, Artificial Sequence
  Description of Artificial Sequence: Synthetic coding sequence
atggctacttcagcacctctccggtccctggaagaggaagtaacctgctcaatctgtcttgactaccttcgggaccccgtaacgattgactgtgggcacgtgttctgccggagctgtaccaccgatgtgaggcccatctccggcagccgcccggtgtgtccactatgtaagaagcccttcaagaaggagaatatccgtccagtatggcagttagccagcctcgtcgagaatatcgagaggctgaaggtggataagggcagacagcccggcgaggtgactcgcgaacaacaggacgcaaaattatgcgagcggcacagagaaaagctccactactactgcgaggacgacggaaagctgctctgcgtcatgtgccgagaatcacgcgaacaccgcccccacaccgcagtgcttatggaaaaggctgcacagcctcaccgcgaaaagattctcaaccacctgtccacattgcgcagagatagagataaaatccagggcttccaggccaaaggagaggccgacattcttgctgccctgaagaaactccaagaccagaggcaatatattgtagccgaattcgagcaagggcaccagtttttacgtgagagagaggagcacttgcttgagcagcttgcaaaactggaacaggagctaactgaggggcgcgaaaaattcaaaagtcgaggcgttggtgaattggcgcgtttagcactggtcatctctgagctggaaggaaaagctcagcagccggctgccgagctgatgcaggacacgcgcgacttcttaaatcgctacccgaggaagaaattctgggtcggaaaacctatcgctagggtcgtcaagaagaaaaccggcgagtttagcgataaacttctaagtttgcagagggggctgagggaattccagggaaagcttctgagagatctggagtacaaaaccgtgtcggtcactctggacccccaaagtgcatctggctatcttcagctgtccgaggattggaaatgtgtaacctacactagtctttataaaagcgcgtacctgcatccgcagcagttcgactgtgagccgggcgtcttgggctctaaggggttcacttggggcaaggtttattgggaagtggaagttgaaagagagggatggtctgaagacgaggaagagggagatgaagaggaggagggtgaagaggaggaggaggaggaagaagctggttatggtgacggatacgatgactgggaaacagacgaagacgaggagtctcttggagacgaagaagaggaagaggaagaggaggaggaggaggtgctggagagttgcatggtcggagttgcacgcgacagtgtcaagcggaagggcgatctgtccctgaggccagaggacggcgtctgggccctgcgactgagctccagtggaatttgggccaacacctcacctgaagcagaactgtttcccgccctgcggcctcggagggtgggaatcgcattggattacgaaggtggcactgttactttcaccaacgccgagtcgcaggagctcatttacacatttaccgcgaccttcactcggaggctggtcccattcctgtggctgaagtggccgggcacccgtctcctcttgcgaccatag

SEQ ID NO: 17161 - DNA, 567 bp, Artificial Sequence
  Description of Artificial Sequence: Synthetic coding sequence
tgatatgtcaacgctgtggactctagatggtcaagctacggaaacgaagccacttcttctgcccattacgtcgaacgcgaccggtttatcgtgaccgatctgagcggccatcgtaagcactcctccactggcgacctgctgtcattggagctgcagcaagctaaaagcaactctctgttgctccagagggaagcaaacgcactggcaatgcagcagaagtggaatagcctcgacgagggacggcatttgacactgaaccttcttagcaaggaaatcgaattaagaaacggcgagctgcagtccgattataccgaagatgctactgacacaaagccagacagggatattgagctggaactgtcagctctcgacactgatgagcctgatgggcagtcagagccgatcgaagaaatccttgatatacagctgggaattagcagccagaacgaccagctgctgaacgggatggcagtagaaaatggccaccccgtgcaacaacatcagaaggagccccccaagcagaagaagcagtctcttggcaggagtaagaagcagttctgtaggtag

SEQ ID NO: 17162 - DNA, 1806 bp, Artificial Sequence
  Description of Artificial Sequence: Synthetic coding sequence
atggaggaaacgatgaagctcgctactatggaggatactgtcgaatactgtttgttcttgattcccgatgagagtcgagattcagataagcacaaagagatcctccaaaagtatattgagcgcatcatcacccggttcgctcctatgctcgttccatacatttggcaaaatcaacctttcaatcttaagtataaacctggcaaaggtggcgtaccagcacatatgttcggggtaacaaagtttggtgataacatcgaggatgagtggtttatagtctacgtcattaaacagatcactaaagagttccccgagctcgtggctaggatcgaagacaatgatggcgaattcctcttgattgaggcagctgatttcttacccaagtggctggaccccgaaaactctaccaaccgagttttcttctgtcatggagagttgtgtatcatacccgccccccgaaaaagtggagccgaatcttggctccccacaacaccacctactatccctcaagctctgaacattattacagcacacagcgagaaaatacttgcatccgagtccatcagggccgcggtgaacaggcgcattcgcggctacccagagaagattcaggcttctctccaccgtgcccattgcttccttccagccggaatagttgctgtgctgaagcagagaccaagactggtggctgctgcggtgcaggcgttctacctgcgggatccaatcgacctaagggcttgccgcgtgtttaagacttttttgccggaaaccagaatcatgacctccgcccacgggtttgaaatcctatgcagtaaatgttccccccatttctccgattgcaaaaagtccctggttacggcatcccctttatgggccagcttcttagagagcctgaaaaagaatgactacttcaagggactgatagaggggagcgcacagtacagagagcgtttggaaatggccgagaattatttccagctgtccgtggactggccagagagttcactggcaatgtccccgggggaagaaattctgacgttgctgcagacgataccattcgacattgaagatctgaaaaaggaggctgctaacctgccccccgaggatgacgaccagtggctggacctgtcacccgaccagttggaccaactcttgcaggaagcagtgggaaaaaaagaaagtgaaagcgtctccaaggaagagaaggaacagaattacgacctgaccgaggtgagcgagtccatgaaggcattcattagtaaagtcagcacccacaagggtgcggaactcccaagggagccttcagaggccccaattaccttcgatgcggactcatttctgaactattttgacaaaattctggggcccagacccaacgaatccgattctgacgatcttgatgatgaagactttgagtgcctggacagtgatgacgacctggacttcgagactcacgagcccggagaagaggcatcgttgaagggaactctagataatttaaaatcatatatggcccagatggatcaggagctagcccatacctgcatctctaagtctttcactacccgaaatcaggtcgagccagtgtcccagaccaccgataacaatagcgatgaagaggatagcggaactggggaaagcgttatggcgccagtggacgttgacctgaaccttgtgtccaatatcctggagtcctactctagtcaagcggggctggccggaccagctagtaacctcctgcagtctatgggcgtgcagctgccggataataccgaccataggcccactagtaagcctactaagaactag

SEQ ID NO: 17163 - DNA, 405 bp, Artificial Sequence
  Description of Artificial Sequence: Synthetic coding sequence
atgaaaaagaagcatgatggtattgtatacgagactaaggaggtattgaacccgagcccgaaagtgacacattgctgcaaaagtctctggctgaaatacagcttccaaaaggcctatatgacccagctcgtgtctagccaacccgtgcctgcaatgtcccgaaatcctgaccataacttactgagtcagcctaaggagcactcgatcgtgcagaaacatcatcaggaagagatcattcataaactggctatgcagctgaggcatatcggcgataatattgatcatcgtatggtccgtgaggatcttcaacaagacggtcgggatgcgctcgatcactttgtgttttttttctttcgcagagtgcaagttctcttgcacttcttttggaacaatcacctactctag

SEQ ID NO: 17164 - DNA, 1791 bp, Artificial Sequence
  Description of Artificial Sequence: Synthetic coding sequence
atggaggatgctccccagcgccttagatggcaggcccatctggagttcacacataatcatgacgtgggggacctgacctgggacaagatcgctgtgagtcttcctaggtccgagaagctccggtcactggtgctcgcgggcattccgcatgggatgcgcccccaattatggatgagactttccggcgccctacaaaaaaaacgaaactccgagctctcataccgagagatcgtgaaaaactctagtaacgacgagaccattgcagctaagcagatcgaaaaagacctgttgcggaccatgccctccaatgcatgttttgcatccatgggatctattggggtgccaaggttaaggcgcgtgctacgagctctggcctggctttacccagaaatagggtactgtcaaggaaccggaatggttgcggcttgtctgttattatttctggaggaggaggacgctttctggatgatgtcggcgatcattgaggacctgctaccagcgtcctacttctctacaactctgctcggagttcagactgaccaacgggtactccggcatttaatcgtccagtacctgccccgattggacaagctgttacaggagcacgacatcgagcttagtcttatcaccttgcattggttcctcacagccttcgcctccgttgtagacattaagctcttgctccgcatttgggacctcttcttttatgagggatcccgagtgctgtttcaactgaccctcgggatgttgcacctgaaggaggaagaactgattcagagtgaaaacagtgccagtatatttaacactctttccgacatcccgtcgcagatggaagacgctgaattactgctcggggttgctatgaggctggcaggctcgctgacagatgtggcagtcgagacacaacgcaggaaacacttagcctatctgattgcggatcaaggccagctccttggcgccggtacactaaccaacctgagtcaggtggtcaggcgccgaacacaacggagaaagagcaccatcaccgccctgttgttcggggaagatgacctagaggccctcaaagccaagaatatcaagcaaacagagttagtagccgaccttcgcgaagcaatacttagggtggccagacacttccagtgcactgatcccaagaactgcagcgtcgagctgactcccgactattccatggagagtcaccagagggaccacgagaattatgtcgcctgcagccgcagtcacaggcgccgtgctaaagcgctgctggactttgagcgacacgacgacgatgaactgggatttcggaaaaacgacatcataaccattgtctcccagaaggacgaacactgctgggtcggtgagttaaatggcctccgcggatggttcccagccaaatttgtagaggtcttggacgaacggtcaaaggagtattcaatcgctggggatgactcggtgaccgaaggcgtcacagacctggtgaggggcacgttgtgccccgccctgaaggctctattcgagcacgggctaaaaaaacctagccttctaggaggtgcttgccatccatggctttttatcgaagaggcggcgggtcgggaagtagagcgggacttcgcaagcgtgtactcacgactggtgctttgcaagaccttccggttagatgaggacggaaaggtgctgacccctgaagagcttctctacagggccgtacagagcgtgaacgtcacccatgatgccgtccatgcccagatggacgtgaaactaaggtcgcttatttgtgtaggcctcaaatag

SEQ ID NO: 17165 - DNA, 399 bp, Artificial Sequence
  Description of Artificial Sequence: Synthetic coding sequence
atggagtctcgggttgctgatgccggaacaggcgagactgcacgcgctgctggcggatccccagccgtagggtgcaccactcggggccctgtggtatcagctcctctgggtgccgcccgctggaaactactgcggcaggtgctgaagcagaagcacctggacgattgtctgagacacgtgtccgtgcgccgctttgaaagttttaatcttttcagcgtgacggaaggcaaagaacgcgagacggaagaggaagtgggagcatgggtacagtacacctcgatcttctgtccagaatattctatatccctccggcacaacagcgggtctttgaatgtggaagatgtgcttacatccttcgacaatacgggaaatgtctggtctttttcgcgaggcaagtag

SEQ ID NO: 17166 - DNA, 1620 bp, Artificial Sequence
  Description of Artificial Sequence: Synthetic coding sequence
atggcaaccagtgctccactccgatcgttggaggaggaagtgacgtgcagcatatgtctagattacctacgggatcccgtgacaatcgactgtggacacgtgttctgcagatcctgtactacggatgtcagacccatcagcggcagtagaccggtgtgtccactgtgcaagaaacccttcaaaaaggagaacatccgccccgtgtggcaacttgcttcacttgtggaaaacatcgagcgtctgaaggttgataaaggtagacagcctggagaggtgacacgcgagcaacaagatgccaaactttgcgagcgccaccgagagaaactgcactattactgcgaagacgatgggaaactgctgtgtgtgatgtgccgggaatcacgtgagcatcggccgcacactgccgtcttaatggaaaaagccgctcagccccatagggagaaaatactcaaccacctgagtacgttgagaagagatcgggacaaaatccagggatttcaggccaagggggaagccgacattctggccgcgctgaaaaaattacaggatcaacggcaatatatcgtcgcagaattcgaacaaggccatcagttcttgagggaaagagaggagcacctgcttgagcagctggccaagctcgagcaagaactgactgagggcagggaaaagttcaaatctcggggggttggggaattagcaagacttgcgcttgtcatcagcgaattagagggcaaggcccagcagccagctgccgaactgatgcaggataccagagactttctgaaccgttacccccgtaaaaagttctgggtggggaagcccattgccagggtcgtgaagaaaaagacaggtgagttctccgacaaactgctgagcctgcagcgtggtctcagggaattccagggtaaacttcttagagaccttgaatataagaccgtctctgttacactcgatccacaaagcgcttccggatatctccaactgagtgaagactggaagtgcgtgacctacacttctctgtacaagagcgcatatcttcatccccagcagttcgactgtgaaccaggagtcctgggaagtaagggttttacatggggaaaagtgtactgggaggtagaggtggaaagggaagggtggagcgaagacgaggaagagggagatgaagaggaggagggtgaagaagaagaggaggaagaggaagcaggatacggagatggatatgatgattgggagacggacgaagacgaggagagcctgggcgatgaggaggaggaggaagaagaagaagaggaggaggtgttagagtcttgtatggttggtgtggcaagggatagcgtcaagcgtaaaggagatttaagtctgcgccccgaggacggggtgtgggctctgcgactgagcagttccggcatctgggcgaacacctcccctgaagctgaactctttcccgccctgaggcctaggcgcgtgggcattgctctagactacgaaggtggcaccgtgacctttactaatgccgaatcccaggagctgatatacacattcacagcaacattcacccgacgcttggtgccatttctgtggctgaaatggccaggtacccgtctcttgctaagaccatag

SEQ ID NO: 17167 - DNA, 2193 bp, Artificial Sequence
  Description of Artificial Sequence: Synthetic coding sequence
atgaacaacagtagttccgagacccgcggtcatcctcacagtgcgtcttctccatcagaacgggtgttccccatgccactacctcgcaaagcaccattaaacataccaggtactcccgtgttggaggactttccccagaacgacgacgaaaaggagcggctgcagaggcgccgctccagagtgttcgacctacagttctctaccgatagtccgcgacttttggcttccccgagctcaagatcgattgacatcagcgcgactatacccaagttcaccaatacccagataaccgagcactacagcacttgcatcaagctctctaccgagaataaaataactaccaagaacgccttcggactgcatctaattgactttatgagtgaaattctaaagcagaaggacaccgagcccaccaattttaaagtggcagcaggcacactggatgcatcaactaagatatacgcagttagagtcgacgctgtccacgctgatgtgtaccgtgttctaggcgggctaggaaaagacgccccgtccctggaagaggtggagggtcacgtcgctgacgggtccgctaccgagatgggaactaccaagaaggctgtgaagcctaagaaaaaacatcttcaccggaccattgagcagaatattaataatctgaacgtcagcgaagctgaccgcaagtgcgagattgatcctatgttccaaaagaccgccgcgtcttttgacgagtgctccacagccggcgtcttcctttctactttacactgccaggactatcgatcagagttactgttcccctccgacgtacagactctaagcacgggcgagcctctggagttgccagaactcggttgtgtggaaatgaccgacttaaaggccccccttcagcagtgtgccgaggaccggcaaatttgccccagcctagccggatttcagtttacccagtgggactctgaaacccacaacgaatccgtctcagccctcgtggacaagtttaagaagaatgaccaagttttcgatattaacgccgaagtggacgaaagtgactgcggtgacttccctgatgggtccctgggcgacgattttgatgccaacgatgagccagaccacaccgcggtgggggatcatgaggagtttcgatcttggaaagaaccctgccaggtgcaaagctgtcaagaggaaatgatctccctcggggacggtgatatcagaaccatgtgccccctgctcagtatgaaacccggcgaatacagttacttttctccgaggacaatgtctatgtgggctgggcctgatcactggcgctttcgcccaagaaggaagcaggacgcaccgagtcagtctgagaacaagaaaaagagtaccaaaaaggactttgaaatcgatttcgaagacgacatcgatttcgatgtctacttccggaagacgaaagctgcaacgatattgaccaagtcaacgttggagaatcagaactggagggccactacacttccaaccgattttaactataacgtggatacacttgttcagttgcatttgaaacccggtacaaggctgctgaaaatggcacaaggtcatcgcgtagagactgagcactacgaagagatagaagattacgattataacaatcccaatgacacgtctaatttctgtcctgggttacaggctgccgactccgacgacgaggatctagatgatctctttgtggggcccgtggggaactccgacctgtctccctatccctgtcatccccccaaaacagcgcagcagaatggggatacgcccgaggcacaagggctcgacatcacgacttatggggaatcaaatctagtggcagaacctcaaaaggtgaacaaaatcgaaatacattatgcaaaaacagccaagaagatggacatgaagaagctgaaacagagcatgtggagtttgttaaccgctttgagcgggaaagaggcagacgcagaagcaaatcatagagaggccggtaaggaagcagctctggccgaggttgccgatgaaaaaatgctcagtggcctgactaaagatctgcagcgctccctgccccctgtaatggcccagaacttaagtatccctctcgcctttgcatgcctactacatctggctaatgaaaaaaaccttaagcttgagggaactgaggatttgtctgacgtcttagtacggcagggggattag

SEQ ID NO: 17168 - DNA, 900 bp, Artificial Sequence
  Description of Artificial Sequence: Synthetic coding sequence
atggaaacgcagttccctgtgtcagaaggaaaagtcgacccataccggagctgcggtttctcgtacgaacaggacccaactcttcgggaccctgaggcagtggctaggagatggccctggatggtaagcgtgagggccaacggtacccacatttgcgccggcacaattattgcgagccagtgggtgctcacggtcgcacattgcctgatttggcgcgacgtcatttactcggtccgggtgggttctccctggatcgatcagatgacacagaccgcctcagatgtccccgttctgcaagttatcatgcattcccgctacagagctcagaggttttggagctgggtgggacaggcaaatgatatcggcctgctcaaactcaagcaggagcttaagtattcgaactatgtgagaccaatttgtctccccggcaccgactacgtgctcaaagatcacagcagatgcacagttactggatggggcctaagcaaggccgacggcatgtggccccaattccggactattcaagagaaagaagtgattattctgaacaacaaggagtgcgacaatttttatcataatttcaccaagatccccacacttgtgcagatcattaaatcccaaatgatgtgtgccgaggacacacatagggagaagttttgctatgaattaacaggtgagcctttagtgtgttcaatggagggaacttggtacttagtagggctcgtctcttggggagctggctgtcaaaagagcgaggctccaccaatttatcttcaggtgagctcctatcagcattggatttgggactgcctaaacgggcaggcactggccctgcctgcccccagccggaccctgcttcttgcgctgcctctaccacttagcttactcgccgctctatag

SEQ ID NO: 17169 - DNA, 1089 bp, Artificial Sequence
  Description of Artificial Sequence: Synthetic coding sequence
atgctggtgcctggatccacgcgaccctatagcaagaaacgccagaacagtaaatccgcgcagggcctggccggactacggaacctgggcaatacttgttttatgaatagcattctccaatgcctctccaatacaagagaactgcgagattattgcctccagcggctctatatgagggacctgcaccatggttcaaacgctcatacagccttggtcgaggaatttgccaagttaatccagactatctggacctctagcccaaatgatgtggtcagcccctccgagtttaaaacacagattcagagatacgcaccacgcttcgtaggttataaccaacaagacgcacaagaattcctgaggtttctcctcgacggcctccacaatgaagtgaaccgggtgaccctgagaccaaaatcaaacccggagaatttagaccaccttcccgatgatgaaaaaggtcgacagatgtggcgtaaatatcttgaacgcgaggactcccggatcggcgacctgtttgtcggacagctgaaatctagcctgacttgcacagattgtgggtactgcagtacagtgttcgatccattttgggacctatccctgccaatcgctaagcgtgggtatccggaggtgaccttgatggattgcatgaggctcttcactaaggaggacgtactggatggcgacgaaaagcccacatgttgtcggtgcagaggacgaaaaagatgtatcaaaaaattttccatccaacgctttccaaagattctggttttgcatctgaaacgattttccgaaagccgaataagaacctcaaagctaaccactttcgtgaatttcccactgcgggatctcgatctccgggagtttgccagtgagaatactaatcatgctgtatacaatctctatgccgtttccaatcacagcggcaccactatggggggccactatacggcctactgtcgcagtccagggacaggcgagtggcatacctttaacgacagctccgtgacaccaatgtcctcttcccaagtgcggacttcggacgcctacttactgttttatgaattggcctctcctcctagcaggatgtag

SEQ ID NO: 17170 - DNA, 1800 bp, Artificial Sequence
  Description of Artificial Sequence: Synthetic coding sequence
atggatcccggcgacgctgcaatcctggagtccagcctgagaatactgtatcgcttgtttgaaagtgtgcttccaccactgcccgccgcactgcagtctcgaatgaatgttattgaccatgtgcgcgatatggccgctgccgggcttcactccaatgttaggctcctgtcatccctgctgctgaccatgtctaacaacaacccagagctgttctcaccccctcagaaataccagctgttggtgtaccatgcagacagcctgtttcatgataaagaatacaggaatgctgttagcaaatataccatggctttacagcagaaaaaggcgttatccaagacatctaaggtgcggcctagtactggcaactccgcatctacaccccagtcacaatgcctccccagtgagatcgaagtaaagtacaaaatggccgagtgctacaccatgctgaaacaggataaggatgcaattgcaatcctggatggcattcccagtcggcagagaacccccaagatcaatatgatgctcgccaacctgtataagaaagccgggcaggagcgtccatccgtgaccagttacaaggaggtgctgcggcagtgtcccctagccctggacgcaatattagggctgctaagtctgagcgttaaaggggctgaagttgcatctatgaccatgaatgtgattcagaccgttcctaacctggactggctgtcagtttggataaaagcatacgcattcgttcacacaggtgataactctcgggcaatttcaacgatctgttcactagaaaagaagtccttactgcgagacaacgtggacctgctgggctccctggctgacctgtacttcagggcgggtgataataaaaatagcgtgctcaaattcgaacaggcccaaatgctcgatccatacctcattaagggaatggacgtctatggttacctcctagcacgcgaaggccggctggaagatgtcgagaacttgggttgtcgtctgttcaacataagcgaccaacatgcggagccgtgggtggtgtctggctgtcattctttctacagcaagcgatacagccgggctctttacctaggcgccaaggccattcagctgaatagtaattcagtgcaagccctcctgttgaagggggccgccctaagaaatatggggcgggtgcaggaggccataatccacttccgagaggcgatccgtctggccccttgccggcttgattgttacgaagggttgatagagtgctacctggcatcaaatagcatcagagaagctatggtcatggccaataacgtgtacaaaacactgggggccaacgcacaaaccctcacccttctggctactgtgtgtctcgaagaccctgtgactcaagagaaggcaaagacgcttcttgacaaggctctgacccagcgacccgactatataaaagccgtcgtgaagaaagccgagctcctgtcacgggaacagaagtacgaggacggtatcgcattgctgcgcaatgcacttgccaatcagtccgattgcgttctacatcgcattcttggtgacttcctggtggccgtgaacgaatatcaagaggcaatggaccaatactctattgcactgagcctggaccctaatgatcagaaaagtctggagggcatgcagaaaatggagaaagaggagtctcctacggatgctacccaggaagaggatgtggacgatatggagggaagtggagaagagggagacctcgaggggtcagattccgaagccgcacagtgggccgaccaagaacagtggttcggtatgcagtag

SEQ ID NO: 17171 - DNA, 507 bp, Artificial Sequence
  Description of Artificial Sequence: Synthetic coding sequence
atgcccgcgacgagaaagcctatgcgctacggacacaccgagggccatacagaagtgtgttttgacgacagtggcagcttcatcgtcacctgcggttccgacggcgatgtcaggatctgggaagatctggacgacgatgatccaaaatttattaatgtgggagaaaaagcgtacagctgcgcacttaaatccggcaaactggtgactgctgtgtcaaataatactatacaggtccacacatttcccgagggggtgccggatggtatcctgactaggttcaccacaaacgctaaccatgttgtatttaatggcgacgggacaaagatagcagcaggatcttccgattttctcgtaaaaattgtcgacgtaatggattcttctcagcagaagaccttccgggggcatgacgcccccgtgctgtctctgtccttcgaccccaaagacatatttctggcatcggcgagctgtgacgggtctgttcgcgtttggcagattagtgaccagtag

SEQ ID NO: 17172 - DNA, 141 bp, Artificial Sequence
  Description of Artificial Sequence: Synthetic coding sequence
atggtgaactcctgctgcggttccgtgtgctcagatcaagggtgcgggttggaaaactgctgccgcccttcttgttgtcaaacaacctgttgtagaactacgtgttgtaggcctctctgctgcgcaagctcctgttgttag

SEQ ID NO: 17173 - DNA, 669 bp, Artificial Sequence
  Description of Artificial Sequence: Synthetic coding sequence
atggcatccgtggttgagtataaaggcttgcgtgccggctaccattgcgggtattgcgatagcaaggagggcaaagcatcatgtggaatgtgggcccactccatgaccgtgcaggactaccaggatctgatcgatcgtgggtggaggagatcaggtaaatacgtatataagccagtcatgaatcaaacttgttgccctcagtacacaatcaggtgccggcccctccagttccagccttctaagagccacaagaaggtgcttaagaaaatgctgaaatttctagccaaaggcgaggtgcctaagggatcctgcgaggatgagcccatggacagcactatggatgatgcggtggctggtgattttgccctgataaacaagctggacatacagtgtgacttgaaaacactgtccgacgacattaaggagagtctggaatccgagggaaagaatagcaaaaaggaagagccccaggaactgctgcagtctcaggattttgtgggtgaaaaactgggctccggggagcccagtcacagtgtgaaggtgcacacagtgcctaaaccaggcaaaggcgccgatctctccaagccgccatgccgcaaggctaaggaaataaggaaggagcggaagcgcctgaaactgatgcaacaaaacccggctggcgagctgtag

SEQ ID NO: 17174 - DNA, 495 bp, Artificial Sequence
  Description of Artificial Sequence: Synthetic coding sequence
atgctcaaagccgtcattctgattggcggaccacaaaaaggaacacgattccggccattgtcattcgaagtacccaaacccctcttccctgtcgccggggtgcctatgatacagcatcacatcgaggcctgtgcccaggttccagggatgcaggaaatactgctgattggcttttaccagcccgacgaaccactgacacaattcctggaagccgctcagcaggaattcaacctgcccgtgcgctacctacaggagttcgctcccctgggcaccggtggcggcctgtatcatttccgcgatcagattctcgcggggtcgccagaggccttctttgtacttaacgctgatgtttgctcagattttccgttgtcggcaatgctggaggctcacagacggcagagacatccatttctattattgggtaccactgccaatcggacccagtcattgaattacggctgtatcgtcgaaaacccccagacccatgaggtttag

SEQ ID NO: 17175 - DNA, 339 bp, Artificial Sequence
  Description of Artificial Sequence: Synthetic coding sequence
atgttcgtgtctgattttcggaaagagttttacgaggtagtacaaagccagcgggtcctcctctttgttgctagcgatgtggacgccctttgcgcctgcaaaattctgcaagctttgttccagtgcgatcatgtccagtacacgctcgtgcctgtgtcaggctggcaggaactagagacggctttcctggagcataaggagcagtttcattattttattctcatcaactgcggagccaacgtcgaccttttagacatactacagccagatgaggacacaatattcttcgtttgtgacactcacagacccgtcaacgtggtcaacgtgtataatgactag

SEQ ID NO: 17176 - DNA, 942 bp, Artificial Sequence
  Description of Artificial Sequence: Synthetic coding sequence
accctggtggtctcaggtcgggatgatccaccaacacacagtcagcccgactcggatgacgaggctgaagagatccagtggagcgatgacgaaaatacagccactctaaccgctcctgagttcccggaattcgccacaaaggtgcaggaggcaattaactccctcggggggtcggtgttccccaaacttaactggtcagctccacgggacgcatactggatcgcaatgaactccagtctgaagtgtaagactttatcagatatctttctgctgtttaaatccagtgatttcatcactcgagattttacccagccctttatccattgtactgacgacagccccgatccttgcatcgaatacgagttagttctgagaaagtggtgcgagttgatccccggagctgagttcagatgcttcgtcaaggagaacaaattgattggtatatcccagcgcgattatacacagtactacgatcatatctccaagcaaaaggaagaaattcggcgctgcattcaggacttctttaaaaaacatattcagtataagtttctcgacgaggatttcgtctttgatatctatagagacagccgcgactctcccgcattccgctgcacaaattctgaagttaccgtgcagccctcaccttacctctcctatcgcctgcctaaggactttgtcgatctgtcaaccggggaggatgcgcataagttgattgataagtccgcgggcgggcgtctgatgagtgtcctggagctcgaaaaacggagacctcgtcccacagcgccaggagcagcccaccagccgcagttacctgctgatcccgatgccggcggtccatcttccgttgacatctcccactttctttactcctgcacattcacctggggaaagaagaggcgtgacttcgccacatgcaagaataacatcataaatcgtagttag

SEQ ID NO: 17177 - DNA, 1017 bp, Artificial Sequence
  Description of Artificial Sequence: Synthetic coding sequence
atggaactgtggggaagaatgttgtgggctctgctgtccggccctggccgacgcggctcgacaaggggttgggcattctcatcctggcagcctcagccgccactggctggcctcagctccgccattgagctagtctctcactggacgggtgttttcgaaaaaagaggcatcccagaggccagggaatcatccgaatacatagttgcccacgtgttgggggctaagacatttcagtcactgcgccctgccctatggactcaacccctgacttctcagcaactccaatgcataagagagctaagttctcgacgtctgcagagaatgcctgtccaatacatattgggcgagtgggacttccaggggctgtcactgcgcatggtgcctcccgtgttcattccacggcccgagacagaggaactagttgagtgggtgctggaggaggtggcacagcggagccacgcagtgggatcacccggttctccgttgatcctggaggtgggatgtgggagtggggccatatccctttccctgctttctcagctgcctcaatctcgcgtcatcgccgtcgataagcgcgaagcggccatcagcctcacccatgaaaatgcccagcggcttcgactgcaagacaggatttggatcatccatcttgacatgacaagcgaacgcagttggactcatctgccctgggggccaatggatctcattgtgtctaacccaccttatgtctttcatcaggacatggagcagttagctcccgagattagatcttacgaggacccagccgctctggatggaggggaagagggaatggacataatcacccatatcttggcattagctccaaggctgctaaaggatagtggatccatcttcttagaggttgacccgagacaccccgagctcgtgagtagctggttgcagtcgcgaccagacctctacctgaatttagttgcagtaagacgggatttctgtggacggccccgcttcctgcacatccggaggtcaggaccctag

SEQ ID NO: 17178 - DNA, 1119 bp, Artificial Sequence
  Description of Artificial Sequence: Synthetic coding sequence
atgaagcgcagaactgaccccgaatgtactgcccccatcaaaaaacagaaaaagcgcgtggcagagctggctctgagcctgtcgtctacctctgatgatgagcccccatctagcgtcagtcacggcgctaaagcctcaacgacctccctgtctggcagtgatagtgagacggagggcaaacaacacagcagtgactcattcgacgacgcctttaaggccgattctctggtggaaggcacctcaagtaggtattctatgtacaattccgtttcacagaagctgatggccaagatgggatttcgtgaaggcgagggcctgggcaaatatagccagggccggaaggacatcgtcgaagcatcaagccagaagggccggaggggactggggcttaccctaagggggtttgatcaggagttaaatgttgactggcgcgacgagcctgaaccctccgcctgtgagcaggtttcttggttccctgagtgtaccactgaaattcctgacacacaggaaatgtctgactggatggtggtcgggaaacgcaagatgataatcgaagatgagacagagttttgcggcgaagagctcctgcattccgtactccagtgcaaaaagccactggtcaaggaccgtgaagccgagctcctgtactttgccgatgtttgcgccgggccagggggcttctctgaatatgtgctgtggcggaaaaagtggcatgcaaaagggtttggaatgacacttaagggtccaaacgacttcaaactggaggatttttacagcgcctcatccgagctgtttgagccctattacggagagggggggattgacggagatggggatattaccaggccggagaacatcagcgcattccgcaatttcgtactcgacaatacagacaggaaaggcgttcactttcttatggctgatggtggcttctcggtggagggacaagagaacctgcaggagatattatccaagcagctcctgctatgccagttcttaatggccttgtcaatcgtaaggaccggaggccactttatctgcaaaaccttcgaccttttcacccccttcagcgttggcctggtttacctgttgtattgctgctttgaaagggtgtgctag

SEQ ID NO: 17179 - DNA, 408 bp, Artificial Sequence
  Description of Artificial Sequence: Synthetic coding sequence
tagcagctggcaagcatggtatggaataacccaagtcagcagcaatttatgcagttcggcgggagcagtggctcacaactgccccagatccagactgatgtggtgctccctagttgtaagaaaaaagcccctgccgaaactccagtgaaggagcggctcttcattgtctttaacccccaccctctgccccttgatgtcttggaggatatcttttgtaggttcgggaatctcatcgaagtgtacctcgtctcgggtaagaatgtcggctatgcaaaatacgctgacaggatcagcgctaatgacgcgatcgctacactccatggtaagatactgaatggcgtcagattaaaggtgatgctggcagactcccctcgggaagagagcaacaaaaggcagaggacatattag

SEQ ID NO: 17180 - DNA, 1764 bp, Artificial Sequence
  Description of Artificial Sequence: Synthetic coding sequence
atggcgtctgaggacatcgcgaagttggctgaaacacttgcaaaaacccaggtcgccggagggcagctgtccttcaaagggaagtcccttaaacttaataccgctgaggatgccaaggatgtgataaaggagatagaagatttcgactccttagaagccttgaggctcgaggggaatacggtaggagtggaggccgctagggtgatcgccaaggccctcgagaagaaaagcgagctgaaaagatgtcattggtctgatatgttcaccggcaggcttaggaccgaaatcccaccagccctcattagcctgggggagggcctgattacagccggggcccaattagtagagctcgacctgtctgacaacgcttttggtcccgatggtgtgcaaggattcgaggctctcctgaaatcctcagcctgtttcactctgcaggaactcaaactgaacaattgcggaatgggcatcggtgggggcaagatcttggccgctgcactgactgagtgccataggaaatcatccgctcagggcaagcccctagcattgaaggtgttcgtcgccggcaggaaccgactcgagaatgacggcgccacagcattagctgaggcctttagggttattggcacccttgaagaggttcacatgcctcagaatgggatcaatcatcccggcattaccgctctggcccaagcatttgccgttaatccacttctgagagtcatcaatctgaacgataatacatttaccgagaaaggcgccgtggcaatggctgagaccctcaagaccctgcgtcaggtggaggtcatcaacttcggggactgtttagtgcgatcaaaaggggcagtggctattgcggacgccatccgtggggggctgcccaaattaaaggaactaaacctctccttttgtgaaataaagagagacgccgcccttgctgtggctgaagcgatggctgataaagccgagctcgagaagctggaccttaatggcaatactctcggtgaggagggatgcgagcagctccaggaagtcttggaagggttcaatatggctaaagtgttggcaagcttgtcagacgacgaagacgaggaggaagaagaggagggcgaggaggaggaagaagaggccgaggaggaggaggaggaggacgaagaagaggaggaggaagaggaggaagaggaggaggaggagcctcagcagcgtgggcagggagagaagagcgccaccccaagcagaaaaatcctcgaccctaatactggcgaacccgccccagttctttcaagcccacctcctgctgacgtcagtactttcctcgcttttccttcccctgagaaactgctccgactcggtcctaaaagctctgtgctgatcgcgcagcaaactgacacctctgaccctgaaaaggtagtgtccgctttcctgaaggtgtcaagcgtcttcaaggacgaggcgaccgtgcgaatggccgtccaggatgccgtcgacgctttaatgcagaaggcctttaactcctcttcctttaattcaaatacattcctgacacgcttgttggtgcatatggggctgctgaaaagcgaggacaaggtcaaagctattgctaacctctacggcccactgatggcacttaaccacatggtgcaacaggactacttccccaaagccctagccccactgctgttggccttcgttactaagcctaacagcgcactggaatcgtgttcctttgctaggcactctctcctccaaacactgtacaaggtgtag

SEQ ID NO: 17181 - DNA, 1842 bp, Artificial Sequence
  Description of Artificial Sequence: Synthetic coding sequence
atggccactataccggactggaagctgcagttactcgctcggcgccggcaagaagaagcatctgttagaggcagggagaaggcagaaagagagaggttgtcccagatgcctgcttggaaacgcggcctgctcgaacgccgacgggccaagctcgggttatccccgggggaacccagtcccgtgctgggaactgtggaggctggacctcccgacccggacgagtctgccgtgctattggaggcgattgggccggtgcaccaaaaccgctttattcggcaggaaagacaacagcaacaacagcagcagcaacgctccgaggaactcctggcggagcggaaacctgggcctctggaggcacgagagcgaaggcccagccccggagaaatgcgagatcagtcacctaaaggaagggagagccgagaggaaaggctgtctccccgagagactcgggagagaagattagggattgggggcgctcaggagcttagtctgcggcctctagaggcacgagattggaggcagagccccggcgaagttggagatcggagtagccggctttcagaggcgtggaaatggaggctatctccaggtgaaactcctgaaagaagcctgcgcctggcagaaagcagggagcaatctcccaggcgcaaggaggtggagagtagactaagtcctggtgagtcggcctatcagaaacttgggctcaccgaggcacacaagtggagaccagacagtagggaatcccaggagcagtcccttgttcaactagaggccacagagtggagattgcgtagcggcgaagagaggcaggattattctgaggagtgcggcaggaaggaggagtggcctgtgccgggagtggcacccaaagagactgcggagctctccgaaacactaactcgtgaagcccagggcaactcgtccgctggtgtggaagccgccgaacagcgacccgtggaggacggggaaagggggatgaaaccgactgagggctggaagtggacactgaactccggaaaggctcgcgagtggacacccagagacattgaagctcagactcagaagcctgagcccccggaaagtgccgagaaattgttggagagtccaggagtggaagcgggcgagggcgaagctgagaaggaagaagcaggcgcccagggtaggcccttgcgtgccctgcaaaattgttgctctgtcccttctccactgccacccgaggacgccggaacaggaggccttcgtcagcaggaagaggaagctgtcgaactacaaccaccccccccagcccctctgtcgcccccaccgcctgcaccaactgccccccagcctcctggagacccattgatgtccagacttttctatggggtgaaagcaggtcccggggtcggagctccccggcggagcggccataccttcaccgtgaaccctagaaggagtgtgcctcccgctacccccgccaccccaaccagtccagctactgttgatgctgccgtgccaggcgctggcaaaaaacgataccctactgcagaagaaatcctagtccttggggggtacctgcggttgtccaggtcatgcctggccaaaggatctcctgagagacaccataagcaacttaagatcagcttttcggagaccgctctcgaaacaacataccagtacccttctgagtcatcagtgctggaagagttgggaccggaacccgaagtgccgagcgcgccgaacccgcccgctgctcagcccgatgatgaggaggatgaggaggagttgctgctattgcagccggaactgcagggcggtctgcggactaaagctctgatagttgatgaatcttgtaggcggtag

SEQ ID NO: 17182 - DNA, 477 bp, Artificial Sequence
  Description of Artificial Sequence: Synthetic coding sequence
atgacccactgctgcagtccctgttgtcaaccaacttgctgcagaaccacatgctgtcgcactacctgctggaaaccgaccaccgtcaccacctgctcttccaccccatgttgccaacccgcttgttgtgtgtcctcttgttgtcagccttgctgcagacccacatgctgccagaatacctgttgtaggacaacatgctgccaacccacttgtcccacctgttgcggttcctcatgctgcggacagacatcatgtggctctagctgcgggcaaagttccagttgcgcgccagtctactgccgacggacctgctattaccccacaacggtatgccttcctgggtgtcttaatcagtcatgcgggagcaactgctgccagccttgctgtaggcccgcttgctgtgaaactacctgctgccgaaccacttgtttccaacccacctgcgtgtctagctgctgtcagcctagttgttgctag

SEQ ID NO: 17183 - DNA, 1620 bp, Artificial Sequence
  Description of Artificial Sequence: Synthetic coding sequence
atggccacctccgcccccctacgttccttggaggaagaggtgacatgctcaatttgcctagattacctacgcgatcctgtaacaattgattgtggccacgtgttctgtaggtcctgcacaaccgatgtccggccaatatctgggagccgaccagtctgcccgttgtgcaaaaaacccttcaagaaggagaatatacgccccgtttggcagctggcaagtcttgtggagaacatcgagagactgaaggtcgataaagggcgtcagcctggagaggtcacaagagagcagcaggacgcaaaactatgtgagcggcacagagagaaactccattattactgcgaggacgacggcaagcttctgtgcgttatgtgtagagaatcacgtgagcatcggcctcatacggccgtcttaatggagaaggctgctcaaccacatcgagagaaaatcctcaatcacctgagcaccctccgaagggatcgcgataagatccaggggtttcaggccaagggcgaggccgacatcctagccgcactgaaaaagctgcaagaccagcgtcagtatatcgtggccgagttcgaacagggccatcaattcctaagggagagagaggaacatcttcttgagcaactcgccaaacttgagcaggaactgacagaggggcgggagaaattcaagagccgcggcgtgggcgagctcgcacgtctcgctcttgtaatatctgaactcgagggaaaggctcagcagccagctgcagagctgatgcaggacacacgggatttcctcaatcgttacccccgcaaaaaattctgggtgggtaaacccatagcccgcgttgtgaagaaaaagacaggagagttcagcgataaactactgtctctccagaggggattgagagaattccaaggaaaactcctgcgtgatttggagtacaaaaccgtgtcggtgactttggacccccagagcgcatcaggttacttgcaactctctgaggattggaagtgtgtgacatatacatcattatataagagcgcctaccttcaccctcaacaattcgattgcgaaccgggagttttgggatctaagggatttacgtggggcaaagtgtactgggaagtggaggtggagcgtgagggctggagtgaagacgaggaggagggcgatgaagaagaggagggcgaagaagaagaggaggaggaagaagccggctacggcgacgggtatgacgattgggagacggacgaagatgaagagagcctaggcgacgaggaggaggaggaggaggaagaggaagaagaggtcttggagtcctgtatggtcggtgttgcccgggacagtgtaaaacgaaagggagacctttcccttcgacccgaagatggcgtgtgggccctgcgattgtccagcagcggcatttgggcaaatacatcccccgaggccgagttgtttcctgctctgcgcccccggagagtgggtatcgccctggactacgaaggcgggactgttacattcacaaatgccgaaagtcaagagctgatttatacctttacggctacctttactaggcgattggtgcctttcctgtggctgaagtggcccgggactcggttgctgttgagaccctag

SEQ ID NO: 17184 - DNA, 2511 bp, Artificial Sequence
  Description of Artificial Sequence: Synthetic coding sequence
atggcagctgccctgggcccgcctgaagtaatagcccagctcgagaacgccgcgaaagttttaatgcagactttggcatgttccatcctgaccgccctgttgtccgaattctctagctcttcaaaaacctccaatattggactgtcaatggagttccatggaaattgcaaacgggtcttccaggaagaagatttgcggcagattttcatgctgaccgttgaagtgctgcaggagttcagccgaagggagaacttgaatgctcaaatgtcttccgtgttccaaagatacctggccctggcaaatcaggtgctaagctggaatttcctcccccctaaactcggcaggcattacattgcaatgttcgagagcagccagaatgtgctcttaaagccgactgaatcctggcgtgaaaccctgcttgattctagagttatggagctgtttttcactgtgcatagaaaaattcgggaggattctgatatggcccaggatagtttgcagtgcctcgcccagctcgctagtttacatggccctatctttccggacgaaggtagccaggtggactatctggctcactttatcgaaggccttctcaatacaattaacggaattgaaattgaggacagcgaggctgtgggtatctcttcgattatttcaaatctgattaccgtcttcccccgtaatgtattaacggccatcccttctgaactgttctctagttttgtgaactgtttaacccacctaacatgtagcttcggacgatcagcagccctcgaagaggttctggataaggacgacatggtgtacatggaggcttacgataagttattggaaagctggctgactctggtgcaagacgacaagcattttcataaagggttcttcacccagcatgccgtccaggtttttaactcctatattcagtgtcacctcgccgccccggacgggacgcgaaacctaaccgctaacggcgttgcttcgcgggaggaggaagagatttcggaattgcaagaagacgacagggaccagttcagcgatcagttagcctcagttggtatgttagggcgcatcgccgcagaacactgcattccccttctgactagcctcctcgaggagagggtaactagactacacgggcaactccaacggcatcaacagcagcttctggcatccccgggcagttccactgtagacaacaagatgctggatgacctttacgaggatatccactggctgatcctcgtcacaggttatctactggccgacgacacccagggtgagacacctctaattccccctgagatcatggagtatagcataaaacactcttctgaagtggatatcaatacaactttgcaaattttgggaagtcccggtgaaaaggcctcctctatccctggctacaacaggactgacagtgtgatcaggctcctgtcggcaatcttacgcgtgtcagaagttgagagccgcgccataagagcggatctgacccacctgctgtccccccagatggggaaggacatagtgtggttcctcaagcgctgggccaagacatatctcctcgtggatgaaaagctgtacgatcagataagcttgccgttctccactgccttcggcgctgataccgaggggtcccaatggattatcggctacctgctgcagaaagttatctcaaacctctcagtgtggagctctgagcaggacttggcaaacgacaccgttcagcttcttgtgacactggttgagagaagggagcgcgccaatcttgtcattcaatgtgagaattggtggaacttagctaagcagtttgcctccagaagtccacctctaaatttcctctcctcacccgtgcagagaacactaatgaaggctctggtcctgggcgggttcgcccacatggacaccgagaccaagcagcagtattggacggaagttcttcaaccactccaacagagatttctgagggtcattaatcaggaaaactttcaacagatgtgtcaacaggaggaagtgaaacaggagatcactgctacactggaagccctgtgtggtatcgctgaagccacccaaatcgataatgtggccatcttgtttaatttcctgatggactttctgaccaactgcatcggattaatggaagtatacaaaaacacccccgagactgtcaacctgatcatagaggtctttgttgaagtggcccacaaacaaatctgctatctgggcgaatctaaggcgatgaacctgtacgaggcttgtctgacactactccaagtctactctaaaaacaatttaggccgccaacgcatcgatgtgaccgcagaagaggagcagtaccaagacctgctgttgatcatggagctactgacaaatcttctgtcaaaggaattcatcgattttagtgataccgatgaggtgtttcgggggcacgaacccggacaggcggccaatcgttctgttagtgcagctgacgttgtactctatggagtgaaccttatcttgccactaatgtag

SEQ ID NO: 17185 - DNA, 1008 bp, Artificial Sequence
  Description of Artificial Sequence: Synthetic coding sequence
atggacttcttgttgggcaatccgtttagcagccccgtcgggcagcgcatagaaaaagctaccgacggcagcctccagtcagaggactgggccctcaacatggagatctgtgatatcataaacgaaactgaagaagggcccaaagacgctcttagggccgtcaaaaaacgaattgtgggtaacaagaacttccacgaggttttggaaacctgtgtgaaaaactgcggacataggttccatgtcctggtggcttcccaagacttcgtggaatccgttctggtgagaacaatactgcctaagaataatccacctaccattgtgcacgataaagtccttaacctcatacagtcctgggccgacgcttttagatcatcacccgatctcactggcgttgttacgatttatgaggatctaaggagaaagggcttagaattccccatgaccgacctcgatatgctatcgcctatccataccccacaaagaaccgtctttaactcggagacacagtctgggcaagactcagtgggcactgacagttctcagcaggaagacagcggtcagcatgccgcacctctgcccgctccacccatcctctctggtgatactcccatcgcccccactcctgagcagatcggcaagctacgctctgaactggagatggtgtctgggaacgtgcgtgtgatgtcagagatgctgactgaactcgtgcctacgcaggctgagcccgctgacttagagctattacaggagttaaaccgaacatgcagagcaatgcaacagcgcgtactagagctgattccacagatcgctaatgaacagctcacggaggagctgctaatcgtgaatgacaatttgaacaacgtgtttcttcggcatgaacgcttcgaacggttccgcactgggcagaccacgaaagcacccagtgaagccgagcccgccgccgatctgattgacatgggcccagatcctgccgctacgggaaatctgtcaagtcagcttgccggatag

SEQ ID NO: 17186 - DNA, 5193 bp, Artificial Sequence
  Description of Artificial Sequence: Synthetic coding sequence
atgggcaactctgactctcagtatactctgcagggatccaagaatcacagtaatactatcaccggggcaaagcagattccctgctctctgaaaataagggggattcatgcaaaagaagaaaaatcactccacggttggggacatggatctaatggcgcgggctacaaaagtcgttccctggctcgatcatgcctgtctcacttcaagtcgaaccagccctatgctagtcgactggggggacccacctgtaaagtgtctagaggagtagcttattccacacatagaacaaatgcaccagggaaagactttcagggcatctcagcggcgttttcaacagagaacggtttccactcggtcgggcacgagctcgctgataaccacatcacttcacgagactgcaatggccacctactcaactgttatggtagaaatgagtccatagcaagtaccccccccggtgaagacagaaagtccccccgagtcctgattaaaacgctgggtaagctggacgggtgcttaagggtggagtttcacaatggcgggaatccctccaaggtgcccgccgaggattgcagcgaacccgtccagctcctgaggtactcccctacactagcttctgagacgtctcccgtgccggaggctaggaggggctccagcgcggattcgctgcccagtcataggcctagtcccacggactcgagactcagatccagtaagggcagttctctgtcaagtgagagtagttggtatgacagtccctggggtaacgccggcgagctctcagaggccgaaggcagctttctcgcacctggcatgcctgacccaagcctccacgcctcattccctccgggtgacgcaaaaaagccgttcaatcagagttcttctttgagttccctgcgcgaactttacaaggatgccaacctcggctctctctcgcctagcggcattcgattatccgacgagtatatgggcacacacgcctcactctccaatcgcgttagcttcgcttcagacattgatgtgccttcaagagtcgcccatggcgatcctatccaatattctagtttcactctcccttgcaggaagccaaaggcctttgtagaagacacagccaagaaggactctttaaaagcaagaatgaggcggattagcgactggacaggcagtctgtccaggaagaagaggaaactccaggaacccagaagcaaagaaggcagtgattacttcgacagccgctctgacggcctgaatacagatgtgcaaggcagctcacaagcttctgccttcctgtggtctggtggaagtacgcagattctgtctcagagatcagaaagtacccatgccatcggatcagatccactgcggcagaacatatatgagaactttatgcgggaactcgaaatgtcccgtacaaacactgaaaatattgagacaagtacagagactgccgagtcctctagcgagagtctatccagcctggaacagctggacttactgtttgagaaagaacagggcgttgtccgcaaggccggatggttgttctttaagccactcgttaccgtgcagaaagagcgcaaattagaactggttgcgcggcgaaagtggaagcagtactgggtgaccttaaagggatgtactctgcttttttacgagacctacggtaaaaactctatggaccagtctagtgcaccacgatgcgccctttttgccgaagactccattgtgcagagtgtgcccgagcaccccaagaaagagaacgtgttttgtcttagtaactctttcggtgatgtgtacctctttcaagcaacgtctcagactgacttggaaaattgggttacggccgttcatagcgcctgtgcaagtttattcgcgaaaaaacatggaaaagaggatactctgcggttgctcaaaaatcaaactaagaacctgttgcagaagatagacatggatagtaagatgaaaaaaatggctgaactgcagctcagtgtggtgtcagatccaaagaatagaaaggcaatcgaaaaccaaatacagcagtgggaacaaaatctcgaaaagttccatatggaccttttccgcatgcgctgctatctcgcctcactgcagggcggcgaactcccaaaccccaaaagcctgctggcagcagcctcacggccgtcaaagttagcacttgggagactggggatcctctcagtcagcagtttccacgctctggtgtgttcgcgcgatgattcggcccttcggaaaaggacgttatcactcactcagagaggtcggaacaagaaaggaatcttctcatccctgaagggtctcgacactctggctcggaaggggaaagagaaacgaccatcaattacacaggtggacgaactgctgcacatatacggtagcacagtcgatggcgtcccccgagacaacgcttgggagattcaaacttatgtccatttccaggacaaccacggggtcactgtggggatcaagcccgagcatcgggtagaggacattctgaccctggcctgcaagatgagacagctggagccatctcactatggccttcagctccggaagctcgtcgacgacaacgttgagtactgcatccctgctccatatgagtacatgcagcaacaggtgtacgatgaaattgaggtgttcccactaaacgtgtacgatgtgcagctgactaagaccggatctgtgtgtgactttggattcgctgttaccgcacaggtggatgaaagacagcatctgtccaggatctttatctcagacgtgctgccagatggcttagcatatggcgaaggcttacgaaagggcaacgaaatcatgacccttaacggggaagctgtaagcgacctcgacttaaaacagatggaagctcttttttcagagaagagtgtgggactcaccttaattgcgcggccaccagacactaaggccaccctctgcaccagctggagtgattccgacctgttctcccgcgatcagaagtctttgctcccaccaccgaatcagtcacagctactggaagaattccttgacaacttcaagaagaataccgcgaacgattttagcaatgtgcccgacatcacaacaggtctcaagagaagccaaacggatggtacactagatcaggtgagccatagagagaaaatggagcagacatttaggagcgccgagcaaatcaccgcactgtgcagaagcttcaacgactcacaggccaacggcatggagggcccaagagagaatcaggatccccctccccggtcccttgctagacatctcagtgacgctgatagactgcgtaaagtaatccaagaattagtggacacagagaaaagctacgtgaaggacttgtcgtgtctgttcgagctataccttgaacctcttcaaaatgaaacttttctgacgcaggatgagatggaaagcctattcggatcactgccagaaatgctggaattccagaaagtcttcttagagacgctggaggacggcatctcagctagctctgacttcaacacactcgagacaccatcccagttccgaaagctccttttctctctcgggggctcttttctttattatgcagaccacttcaagctgtactccggattttgcgccaaccacatcaaagttcagaaggtgttggagagggcaaagaccgacaaggcgtttaaggcgtttctcgatgcacgtaatcctacgaagcagcatagcagtactctcgagagttatctgatcaagccagtgcaacgggtcctcaaatacccccttctcctgaaggaattagtctcactgacagaccaggagagcgaggaacactaccatctgactgaagccttgaaggccatggagaaggtggcatcccacattaacgaaatgcagaagatttacgaggactatggaaccgtgttcgatcagctggtagccgagcagtctggtaccgaaaaggagcaaccagagtggtcttctgaagtcatggatgtgttagacccccgtggtaaactgaccaaaggaactctggaggaaccgagaacactggtgacagagctctcaatgggcgagctgctgatgcatagtaccgtaagctggctcaaccctttcctctcgttaggaaaggccagaaaagacctggagcttacagttttcgtgtttaaacgggccgtcatcctggtgtacaaagagaactgcaagttgaagaagaaactgccctccaattcccggccagcccacaacagcacagatctggacccattcaaatttaggtggttgattccgatctccgcacttcaggtgagactgggtaacccggcgggaactgaaaacaattcaatctgggagctcatccataccaaatctgaaatcgagggccgtccagagaccatcttccaactgtgctgcagcgacagcgaaagtaagacaaatattgtgaaagtgattagatcaatccttagggaaaatttcaggcgacacataaaatgtgaactgcccctggagaaaacttgcaaagacagactggttcccctgaaaaatagagtccccgttagcgctaagcttgccagcagtcgctccctgaaagtgttaaagaatagcagctctaacgagtggaccggagagaccgggaaggggacgctcctggattccgacgaaggatctctctcctctggaacccagagctccggctgtcccacggctgaggggagacaggacagtaagagcacatcacctggtaaatacccccacccaggattagccgattttgcggataatcttattaaagagtccgacatcctgtctgacgaagacgatgaccacagacagacggtcaagcaggggtccccaactaaagacatcgagattcaattccagcgcttacgcatttcggaggaccctgatgtccaccctgaagctgaacaacagcccggcccagagtccggggaggggcagaagggaggggaacaacctaagttggttcggggtcacttctgtccaatcaagcgcaaggcaaattcaactaagagagatagaggcactctgctgaaagctcagatccgacaccaatcactcgactctcaatcagaaaacgcgactatagacctaaatagcgtgctggaacgggaattttccgtacagagcctcacgtctgtggtcagcgaagagtgtttctatgagaccgaaagtcacggcaaaagctag

SEQ ID NO: 17187 - DNA, 348 bp, Artificial Sequence
  Description of Artificial Sequence: Synthetic coding sequence
atggccccagctaagaagggtggagagaagaagaagggccgtagcgccattaacgaagtagtcaccagagaatataccatcaatatacataagcggatacacggagttgggtttaagaagagggccccgcgtgcactcaaagagatacgcaagttcgctatgaaggagatgggcactcccgatgtgcggatagacactagactcaataaagctgtttgggctaaaggtatccgaaacgttccctaccgcattagagtgcggttgtccagaaaacgaaatgaagatgaggactcacccaacaagctgtacactctcgttacctatgtccctgtgacaacatttaagtag

SEQ ID NO: 17188 - DNA, 747 bp, Artificial Sequence
  Description of Artificial Sequence: Synthetic coding sequence
atggcattagaggtcggcgatatggaggatggacaactgtccgactctgacagtgacatgaccgttgcaccctcagacaggccgttgcagctgcctaaagtgctcggtggcgactctgcaatgcgagctttccaaaatactgctacagcctgtgcccctgtctcccactacagggccgtcgagagtgtggattccagtgaggaatccttcagtgacagtgacgatgactcgtgcttgtggaagaggaaaagacagaaatgctttaatccacctcccaagccggaaccttttcagtttgggcagagttcccagaagccacctgtagctggcgggaagaagataaacaacatttggggggctgtgctgcagaagcttcgaaaagaaagccaggagcacacaaaagacctggataaggaattggatgagtacatgcatggaggcaagaagatgggcagtaaggaggaggagaacggccagggtcacctgaagaggaaacggcccgtgaaggatcggctgggcaaccgtccagaaatgaattacaaggggcgctacgaaatcacagctgaagactcccaagaaaaggtagcagatgaaattagcttcaggctgcaggaacctaagaaagacctgattgcacgagtggtccgcaacaagctccgtactttctccactctcaaaaccaagcgaaatatgaaaataaaaaagttactggggcgaggcgagcacaaatgctgggggaagaggtag

SEQ ID NO: 17189 - DNA, 78 bp, Artificial Sequence
  Description of Artificial Sequence: Synthetic coding sequence
atggccatggctccttcacccagtctagtgcaggtgtatacttcaccagccgctgtcgccgtgtgggaatggcagtag

SEQ ID NO: 17190 - DNA, 171 bp, Artificial Sequence
  Description of Artificial Sequence: Synthetic coding sequence
atgagctattatcagaggccgttttctcccagcgcttacagtctgcctgcaagcctgaattcttctatcgtcatgcagcacggaacttccctggacagtaccgatacatacccccaacacgcccagagcctggatgggactacctcttcctctatccccctgtacaggtag

SEQ ID NO: 17191 - DNA, 450 bp, Artificial Sequence
  Description of Artificial Sequence: Synthetic coding sequence
gtcagggaactggaagcggaactggacgccgaacagaagaagcacgccgaagctctgaagggcgtcaggaagcacgaacgccgcgtgaaggaactggcatatcaagccgaagaggataggaagaacctggctagaatgcaggacttggtcgacaaattgcaatctaaggtgaaaagttataaaaggcagtttgaggaagctgaacaacaagctaatactaatctagctaaatatcggaaggcccagcacgagctggatgatgccgaggaacgggcagatatggctgaaactcaagcgaataaactgcgcgcccggaccagggacgctctcgggcccaaggtgcgaagtggccggggtatcgctctatgtgcgggggggctgtggggactcacaggatctaccgctcactcagccattcccttctccagcgcgcaaggtgtgactgcatag

SEQ ID NO: 17192 - DNA, 468 bp, Artificial Sequence
  Description of Artificial Sequence: Synthetic coding sequence
tccaacgtgatggaagcgaacgctgccagacaagcaactccagctgaatggagccaggacgactcaaatgatatgtgggaggaccaggaagaggaagaggaagaagaggaggatggtttggctgggcagctcctctcagatatactcgcaactagcaaatacgaggaggactactacgaagacgatgaggaggatgatcccgatgcgttaaaagaccccctttaccaaattgatctgcaggcaaccctcatgaccatgcggggtgagttctacagaccttctgcaagtaaaaagggcagtctgagtacttttgccccttctggacccgcggcgaatcattttgcggccctaacagggctagagatgcatttccttctcaacctcaaatggcatctggatccctggcctctggcttccgccgtaactctgatgacaatccagactcggcttacaggggcggtgacgtag

SEQ ID NO: 17193 - DNA, 1620 bp, Artificial Sequence
  Description of Artificial Sequence: Synthetic coding sequence
atggcaacatcagctcccctccgctccttagaggaggaggtgacatgctccatttgtcttgactacttacgggaccctgtgacaattgattgcggacatgtattctgtcgtagttgtactactgatgttcgtcccatatccggcagtcgccccgtttgtcccctctgcaagaaacccttcaaaaaagagaatatccgtcccgtgtggcagctagcgagcctggtcgagaacatagagcggctgaaggtggacaagggcaggcagcctggtgaggtcaccagagagcagcaagatgcaaaactctgcgagcggcatagggaaaaactccactattattgcgaggacgacggtaaactgctctgcgtgatgtgcagagaatcaagagaacacaggccgcatacagcggtgctcatggagaaagcagcacagccacatagggaaaagattttaaatcatctgagtaccctcagacgggatcgggacaagatccaaggcttccaagcgaaaggagaggccgatattcttgcagcactgaagaagcttcaggatcaacggcaatacatagttgcagaatttgagcagggtcatcagtttcttcgggagcgcgaggaacatttgcttgagcagctggcgaagctcgagcaggagcttacagaggggagggagaagtttaagtcacgcggagtaggcgagctggctcggctggctctcgtgatttcggagctggaaggaaaggcccagcagcccgctgctgagctgatgcaggatactcgtgactttttgaatcgatatccgaggaagaagttttgggtggggaaacctattgcccgggtggttaagaagaagaccggtgagttctccgacaaactcctgtcactccaacgggggctgagagaattccagggtaagcttttaagagacctcgagtacaagacagtgtctgtgactctggatccacagtccgcgagcggctacctgcagctcagtgaagactggaagtgcgtgacttacacctcgctctataaaagtgcttacctgcatccacagcagtttgattgcgagcctggcgtgctgggaagcaaaggcttcacctgggggaaggtgtattgggaagtcgaggttgagcgggaaggatggtccgaagatgaggaagagggtgatgaagaggaagaaggagaagaggaagaggaggaggaggaagcaggatacggcgacggatatgacgactgggaaacagacgaggatgaagagagcctgggagatgaagaggaagaggaagaagaggaggaggaagaggtgctggagtcatgtatggttggggtagcccgagatagcgtaaagcgtaagggggatcttagcctgcggccagaagacggggtatgggccctcagactttcttcttcaggcatttgggctaacacaagtcccgaagccgagttgttccccgccctcagaccgcggagagtgggaatcgccttagactacgaagggggaacagtcacgttcactaatgcagagtctcaggaacttatttataccttcacggcaactttcactaggcgtttagtgcctttcctctggctgaagtggcccggaactcggcttcttctgagaccctag

SEQ ID NO: 17194 - DNA, 645 bp, Artificial Sequence
  Description of Artificial Sequence: Synthetic coding sequence
atgccttcaccctgggggtggttcgccgtaactgcgtgtggtgctcagcggaacaattttgaagagcctgtagctctgcaggaaatggacacttctaatggagtgctattgcctttctacgatcccgactctagtatcgtatacctgtgtggaaagggcgactcctccattcgttatttcgaaataaccgatgaacccccattcgtacattatcttaacacattctctagcaaagaacctcaacggggaatgggattcatgcccaaacgagggttggacgtctcaaagtgtgaaatcgcacgtttttacaagctgcatgagcgtaagtgtgaacccatcattatgaccgtgcctcggaaaagtgatctgttccaggacgccgagcctgtgctcatctcattaagagacgggtatgtccctcctaagcatagagagctccgggttacgaaacgcaatatactggacgtgcggcccccatcgggaccccgtcgatcacaatccgctagcgacgctccgctgtcacagcacacattagaaaccctgctagaggaaatcaaggcgcttagagaaagagtgcaggcacaggagcagagaattactgctctggaaaacatgctgtgtgagctggttgatggcactgattag

SEQ ID NO: 17195 - DNA, 690 bp, Artificial Sequence
  Description of Artificial Sequence: Synthetic coding sequence
atgctgcagctgcgcgattccgtcgactccgcgggaacatcacctactgcagtgctggccgccggagaggagcccggaagcatcgaacaagctgttgaagaaataagggttgtagttcgacctgtggaggacggggagatacagggcgtatggctgctaaccgaggtggaccattggaacaacgaaaaagagcggctggtcttagtcaccgagcagtcgttgctgatatgtaaatacgattttatttcactacagtgccaacaagtggtacgtattgccctgaacgcagtcgacactatctcctatggcgaatttcagttcccacctaagagcttgaacaagagagagggattcggcatcagaattcagtgggataaacagagtcgaccatccttcatcaataggtggaacccttggagtaccaatgttccatacgcaacatttacagaacaccccatggccggcgccgacgagaaaacagctagcctgtgccagctcgagtccttcaaggcgctgcttatccaggccgtcaagaaggctcagaaagagagcccactcccgggacaggctaatggagttctcatcttggaacggcctctgttaatcgaaacctacgtggggctgatgagctttatcaacaacgaggccaagcttggttactcgatgaccaggggtaagataggtttttag

SEQ ID NO: 17196 - DNA, 390 bp, Artificial Sequence
  Description of Artificial Sequence: Synthetic coding sequence
atgtgcgaagtctcacgcggctggaaaccatgcacagaaggtattctaaaagtgcgtccaacacggaagatctcttacgaagggaatattacccccaccgtggagctaaatgccctttgcatgaagctggggaaaaaacctatgtacaaacctgttgatccctattctaggatgcagtccacctacaattacaatatgaggggaggggcctacccgcctcgctacttttacccttttcccgtccctcccctgctgtaccaggtggagctgagcgtggggggacaacagtttaatggtaagggtaagacgcgacaggctgccaaacatgacgccgctgccaaagctctccgcatccttcaaaacgaacctttacctgagcgcctcgaatag

SEQ ID NO: 17197 - DNA, 3042 bp, Artificial Sequence
  Description of Artificial Sequence: Synthetic coding sequence
atggacctctttaggatgcggtgctaccttgcctccttacaggggggggagctcccaaacccgaaatcattgctggccgccgcctcccgccccagtaagctggcactgggcaggctgggcatacttagtgtgtctagttttcatgctcttgtttgctctcgggatgattcagcattacgtaagcgaacactgtccttgacacagcgaggtaggaataaaaagggcatcttttcttccttgaagggacttgatacgctggccaggaagggaaaagaaaagagaccaagtatcacccaggtggacgagctgctccacatttatggatcaacagttgacggggtgccgcgagataacgcatgggaaatccagacttacgttcacttccaggacaatcacggcgtgactgttggaatcaagcctgagcaccgcgtcgaggatatactaacactggcttgtaaaatgcgccagctcgagccttcacactacggcctccaattgcgtaagctggttgatgacaacgttgaatactgcatccccgccccgtacgagtatatgcagcagcaagtttatgatgagatcgaggtgtttcccttaaacgtgtacgacgtccagttaaccaagacaggatcagtgtgcgatttcggattcgccgtaactgcccaagtcgatgagcggcagcacctcagtagaatctttatctccgatgttttgccagatggtctggcttacggcgaaggtctgagaaaaggcaatgaaatcatgacacttaacggcgaggcagtatccgatctggacctgaagcagatggaggcactattctcagagaaaagcgtggggttaacgctgattgcccgaccccccgatactaaagcaacactctgcacatcctggtctgacagtgatctcttctccagagaccagaagagcctgctgcctccacctaatcagtcccagttgctggaagaatttttagataatttcaaaaagaatactgccaacgactttagtaacgtgccagacattaccacaggccttaagcggtctcagaccgacgggacgctggaccaggtatctcaccgcgagaagatggaacagacctttcgcagcgcagagcaaatcacagctctttgtagatctttcaatgattcgcaagccaacggcatggaaggcccccgcgagaaccaggaccctccaccaaggtctctagccagacacctgtcagatgccgaccggttacgcaaggttatacaagaactggtggacactgagaagagctatgttaaggatctgtcatgtctgtttgagttgtatcttgaaccgttgcagaatgagaccttcctcacacaggatgaaatggagagtcttttcggtagcctccctgaaatgctggagttccagaaagtctttctcgaaaccctcgaggacggaattagtgcttcgtccgatttcaacacactggaaactccgtcacagtttaggaaattgttgttttcacttggaggctcctttctttactatgcagaccattttaaattatacagtggcttctgcgccaatcatatcaaggtgcagaaagtgctggagcgagcaaagaccgacaaagccttcaaagcatttctcgatgccaggaacccgactaaacagcacagcagcacccttgagagctacctgatcaagccagtccagcgggtcctgaagtaccctctgttgctgaaagagctagttagtctgaccgaccaggagtctgaagagcactaccacctgaccgaagcgctgaaagcaatggagaaggtcgcctctcatattaacgagatgcaaaaaatttatgaggactatggaaccgtgtttgaccagctggtggcagagcagagtgggacagaaaaggaagtaactgaactgtctatgggagaactgctcatgcattccactgtaagttggcttaacccattccttagtctggggaaagcccgcaaggacctggagcttaccgtatttgtgtttaagagagccgtaattcttgtctacaaggaaaattgcaaacttaaaaagaaactcccatcaaactcccgacctgcccacaattctaccgacctggacccttttaagtttcgctggttgattcctatatccgctcttcaagtaagactggggaaccctgccggcacagagaataacagcatctgggaacttatccatacgaaaagcgagatcgaagggcggccagagaccatctttcaactgtgctgttcagattctgaaagcaaaacaaacatagtgaaagtgatcagatcaattttgagagaaaacttccgtcgccatataaagtgtgaacttcctcttgagaagacctgtaaggaccggctggtgcccttaaaaaacagagtcccagtttccgctaaactcgcaagctcccgctctctcaaagtactgaaaaactcgtcgtccaatgaatggactggagaaaccggcaaggggacccttctggacagtgacgagggcagcctcagctctggcacacaaagttccgggtgtccgaccgccgaaggccggcaggacagtaagtccacatctcctgggaagtacccacaccccgggctcgccgatttcgcggataacctgatcaaagagtccgatatcctttctgatgaggacgacgaccaccggcagacagttaaacagggctcacccaccaaagacatagagatccagttccagagactgcgcattagcgaagacccagatgtgcatcccgaagctgaacagcagccaggacctgaatccggcgagggccagaagggcggtgagcaaccgaaactggtgagggggcatttttgccccatcaagcgaaaggcaaattcaaccaagagggacaggggcacactgctcaaggcacagattaggcatcagagtcttgattcccagagcgaaaatgctacgattgatctcaacagcgttctcgagagagaattctcagtgcaaagccttacatctgtggtgtcagaggaatgcttttacgaaacagagtcacacggaaaatcttag

SEQ ID NO: 17198 - DNA, 1149 bp, Artificial Sequence
  Description of Artificial Sequence: Synthetic coding sequence
atggcggctaatctatcacggaatggccccgccctccaggaagcttacgtgcgggtagtgactgagaaatcccctacagactgggccctatttacgtacgaaggaaattcaaatgacataagagtggctggaactggtgagggtggcctagaggagatggtcgaggagctcaactcaggtaaagtgatgtatgcgttctgtcgggttaaagacccgaattccggtttgcctaagtttgtgctgattaactggacaggcgagggcgtcaatgacgtcagaaaaggcgcctgtgcttcccacgtgtccacgatggcatcttttttaaaggggagcgtgtaccagaagaccaatgctgttagcgagattaagcgggtaggcaaggacagtttctgggctaaagctgaaaaagaggaggagaaccgcagactggaggagaaaagaagagccgaagaggcccaacgccagctggagcaggagagacgggagcgggagctgagagaagccgctcggagggagcagcggtaccaagagcaagggggcgaagctagtcctcaatctcggacctgggagcagcagcaggaggtcgtgtctcggaatcggaatgagcaagagagtgctgtgcaccctcgtgagatttttaagcagaaagaacgggctatgtctacaacttctatttcgagccctcagccgggaaaactccggtcaccttttttgcagaaacagctgacacagccagagacccactttggtcgcgagccagcggctgccatatctcgccctcgcgccgacttaccagcagaagaacccgccccatccacgccgccttgtctggttcaggccgaagaagaggctgtatatgaagagccaccggagcaagagaccttctatgagcaaccacccttggtgcagcagcagggcgcagggtccgagcacatagaccatcatatccagggtcagggcttgtcggggcagggtctttgtgccagggcgctctacgactaccaggccgccgatgatacggagatttccttcgatcccgagaatctgatcacgggcattgaggttattgatgaggggtggtggcgcggatatggccctgatggacactttggcatgttccccgctaactacgtagagcttattgagtag

SEQ ID NO: 17199 - DNA, 660 bp, Artificial Sequence
  Description of Artificial Sequence: Synthetic coding sequence
atggtggtgttatctgtgcccgccgaggtgaccgtaattctgctggatatcgagggaactacaacgcccattgcatttgtaaaagacattcttttcccttatattgaagaaaatgtgaaggagtacctgcagacacactgggaggaggaagagtgccaacaggacgtatccctgctgcgtaagcaggctgaggaagatgctcacctcgacggcgctgtccccatccctgccgctagcggcaatggtgtcgacgaccttcagcagatgattcaggccgtggtcgacaatgtgtgctggcagatgagcctcgatcggaagaccacagctttgaagcagttgcagggacacatgtggagggcggccttcacggccggccgcatgaaggctgaatttttcgccgatgtcgttcccgccgttcgcaaatggcgagaagccgggatgaaagtgtatatatacagtagcgggagtgtagaggcccagaagctgctgttcgggcactcgactgaaggcgatatcctcgagctggtggacggccacttcgacactaaaattggacataaggtggaatctgagtcctacaaggattgtaggcagcactgggtcttgaaccagcagcacttcgtcagtgatagatgctattcacgcggacagtgctgctag

SEQ ID NO: 17200 - DNA, 1446 bp, Artificial Sequence
  Description of Artificial Sequence: Synthetic coding sequence
atggcaagcgctgctagcgtcaccagcctagcagacgaggtgaactgccctatctgtcagggaaccctgcgggagccagtgactattgactgtgggcataacttttgtagggcttgccttacgcgctattgcgaaatccctggcccagatctggaagaaagcccgacgtgccctctctgtaaggaaccattccgtcccgggagtttcaggccaaactggcagcttgctaatgtcgtcgagaatattgaacggcttcagctcgtgagcactctgggactgggtgaggaggacgtgtgccaagaacacggtgagaaaatatactttttctgtgaggatgacgagatgcagttatgcgtggtatgtagggaggcgggtgaacacgccactcataccatgcgatttctggaagacgctgctgcaccataccgagagcaaattcataaatgcttgaagtgcctccgcaaggaacgtgaagaaattcaggagatacagtccagggagaataagaggatgcaagtgctgctgacccaggtttctacaaaaaggcaacaagttattagcgaattcgcccatcttagaaaatttctggaagaacagcagtcgatcctgctcgcccaactggagtcccaagacggcgatatcctgcgccagagagacgaattcgacctgctggtcgctggggagatctgccggttttctgccctcatcgaagaactggaagaaaagaatgagaggcctgctcgagagctcctgaccgatatccggtcaactctgatccgatgcgaaactaggaaatgccggaagcctgttgctgtctctcccgagctaggccagcgaatccgcgatttccctcaacaggcactgcctctgcagcgggagatgaagatgtttctggaaaagttatgttttgaattggattacgagccagctcacataagtctagaccctcaaacttcacaccctaagctgctgttaagtgaggatcatcagagagcccagttcagctataagtggcagaattcccctgacaacccgcagcgtttcgatcgtgcaacctgcgtgctcgcacatacgggcataactggtgggcgtcatacttgggtggtgtcaatcgatctggcccatgggggcagctgtacggtgggggtggtgagcgaagatgttcaaagaaagggtgaactacggcttcgccccgaggagggagtgtgggcagtcagactggcctgggggttcgttagtgctctaggctcattccccacccgcttgacactgaaagaacagccaagacaggtcagggtgtccctggactacgaggtgggatgggtgaccttcaccaatgctgtgaccagggagcccatatataccttcaccgcatcattcactcggaaggtaatccctttctttggtctgtgggggagaggtagtagcttctccctcagtagctag

SEQ ID NO: 17201 - DNA, 1644 bp, Artificial Sequence
  Description of Artificial Sequence: Synthetic coding sequence
atggccggaactaagaataagacgcgggcacaggctaagacagagaagaaggcagccattcaagcaaaggctggcgccgagagagaagccaccggtgtggtgagacccgtcgccaaaacgagggcaaaagccaaggctaagactggctctaaaaccgatgcggtggccgagatgaaggcagtgtcaaaaaacaaagttgtagccgagacaaaagaaggcgccctgtccgagcctaagactcttggcaaggccatgggcgacttcactcctaaagccggcaatgaaagtacctcgtctacatgtaaaaacgaggctggaaccgatgcctggttttgggctggtgaggaggcaactatcaactcctggttctggaacggcgaagaggcgggcaactctttcagcaccaagaacgataaacccgagattggcgcgcaggtctgtgcagaagagttggagccagccgccggcgccgattgtaaacctcgctccggcgccgaggaggaggaagaagagaatgtgattggaaattggttttgggagggcgatgatacgtcgttcgatccaaacccaaaacctgtctcacgtatcgtgaaacctcagcctgtttacgagattaacgagaaaaaccggcctaaagattggagtgaagtgaccatctggcctaatgctccagccgttactccggctgtgcttggctttcggtcccaggcaccatcagaagcctccccgccctcttacatcgtgctggcctccgctgaggaaaacgcttgcagtttgccggtggccactgcatgcagacctagcaggaatacccgttcctgtagtcagccaatccccgagtgtcgcttcgactctgatccctgcattcagacgattgatgaaatcagacggcagatccggattcgggaggtgaatggaatcaagcctttcgcctgtccttgcaaaatggagtgctacatggacagtgaagaattcgagaaattagtgagtttgttaaagagcactactgatcctctgattcacaagatcgctagaatcgccatgggggtgcataatgttcaccccttcgcacaggagtttataaacgaggtcggggtggtcaccctgattgagagtttgctgtcctttccctctcctgagatgcgaaagaaaacagttatcacactgaacccacctagcggggatgaacgtcagcgtaaaatagagctgcacgttaagcacatgtgcaaagagactatgtccttcccccttaactctcctgggcagcagagtggactgaaaattctaggccagctgacgactgacttcgtgcatcactacatcgttgccaactatttcagtgaactgtttcacctcctgagctctggcaactgcaagaccaggaacttagtgctgaagctgctgttgaatatgtccgaaaaccctaccgctgctcgtgatatgatcaacatgaaagctttggcggctcttaagctgatatttaaccaaaaggaagcaaaggcaaatctggtaagcggagtcgctattttcatcaatattaaagaacatatccgcaaaggctcaattgtggtggtggatcacctctcatataacacacttatggccatattccgagaggtcaaggaaataatagaaacaatgtag

SEQ ID NO: 17202 - DNA, 1887 bp, Artificial Sequence
  Description of Artificial Sequence: Synthetic coding sequence
atgagcgacaaatcagacctgaaagctgagttagaaagaaaaaaacagcggctggctcagataagggaggagaagaagcgaaaggaggaagagagaaaaaaaaaggaagctgacatgcagcagaagaaggagcctgtccaggatgacagcgacctggatcggaaaaggagggaaaccgaggctctgctccagagcattggcatctcccccgagccacctttggtccctacacctatgtctccaagttccaaaagcgtgagcacaccgagtgaggccggctctcaggacagcggtgatcttggccctctgacacgcacccttcagtgggacacagacccatcggttcttcagctgcagagtgactcggagctaggcagacgcctccataagttgggcgtgagtaaagtgacccaggtggacttcctgcctagagaagtcgtgtcctactctaaggaaacacagacgccacttgcaactcatcagagtgaagaagacgaggaagatgaggaaatggtggaaagcaaggtcggacaagattccgagctggagaatcaagacaaaaaacaggaagttaaagaagctcctcccagagaactgacagaggaggagaagcagcagattctacactctgaggaattcctgattttctttgacaggaccattcgcgtgatcgaacgcgccttagctgaagactcggacattttctttgattacagtggccgagaactggaagagaaggatggtgatgtgcaggctggagcgaatctgagcttcaatcggcagttctatgatgagcactggagtaaacacagagtggtgacctgcatggattggagcctgcagtaccctgaactaatggtcgccagctataacaacaatgaggacgccccccatgagcccgatggcgtggcactcgtttggaacatgaagtttaagaagacgacccctgagtacgtctttcactgccaatctagtgtgatgtctgtgtgttttgctcggtttcatcccaatctcgtggtgggggggacctacagcggccagatcgtcctgtgggacaataggagtcacagaaggaccccagtgcagaggacaccactgagcgccgccgcccatacccaccccgtctactgtgtgaacgtggtgggaactcagaatgcccacaatctgattaccgtgtccaccgacggaaagatgtgtagctggagtctggatatgctgagtacaccccaggagtccatggagctggtgtacaataagagcaaacccgtggccgtaacgggcatggcctttcccaccggagacgtaaacaatttcgtcgtcggctccgaggaggggactgtatatacggcttgtaggcatgggtcaaaagctggaatcggagaagtcttcgagggtcaccagggccccgtgacaggcatcaattgccacatggcagtggggcctatagatttctcccatctgttcgttactagttccttcgactggacagtaaagttgtggacaaccaaacacaataagcctctgtacagcttcgaggataatgccgattacgtctatgacgtgatgtggagccccgtgcaccccgccctcttcgcatgtgtcgacggtatgggcaggctggacctctggaacctgaacaacgacaccgaagtgccaaccgccagcgtggcaattgagggcgcttcagcattaaaccgagtccgctgggcgcaggcgggcaaggaagtggcagtaggagatagtgagggacgtatctgggtatacgatgttggagagttggctgtccctcataacgacgagtggacccggttcgccagaaccttagtggagatccgtgcgaatagagcagatagcgaggaggaaggcactgtggagctatccgcttag

SEQ ID NO: 17203 - DNA, 474 bp, Artificial Sequence
  Description of Artificial Sequence: Synthetic coding sequence
atgaggagtgggtttagatgcgatgaaccagccgaggccgtggccccagaaagacagacagtttccggagccgtcgccttggcttcttttacatctccccacactcaccccgtcgatgacggggggcgtcactatagttgggggagtcctaagaggatccttggccttggtcccggggacgctgctaaagaggccggtttggtgagaccccttcaggggcagagtgagaagattctgctacgcacacgcaatagacagccaatggaaccaccaatggagccgagcggaggcgagcaagaacccggtgccgtgcgattcctggatctcccatgggaggatgtgctgctgccccatgtgctgaatagggtgccactaaggcaactcttgcggctgcagagagtctcacgcgctttccggtccctggtgcagctccacctggccgggctgcggaggttcgacgcagcgcaggtgtag

SEQ ID NO: 17204 - DNA, 483 bp, Artificial Sequence
  Description of Artificial Sequence: Synthetic coding sequence
atggaagccgagagaccacaggaggaagaagacggggagcaaggccccccccaagacgaagaggggtggccaccccctaactctacaacccgaccttggcgctctgctcctccaagccctccacctccgggtactcgccacactgcgttgggtcctagatccgctagccttctgtccctgcagacggagctcttacttgacttggtcgccgaagcccagtctcgaagactggaggaacagagggcaaccttttacacacctcaaaatccttcctctctggccccagcccctctcaggcccctcgaagatagggaacagctttattcaaccatcctttctcaccagtgtcagagaatggaggcccagaggagcgagcctcccctccctccggggggacaggagttgttagaacttctgcttagagttcaaggtgggggcaggatggaggagcagcgatcaaggccacccactcatacgtgttag

SEQ ID NO: 17205 - DNA, 402 bp, Artificial Sequence
  Description of Artificial Sequence: Synthetic coding sequence
atggctgccctgcgtccattggtcaagccaaaaattgtcaagaaaaggaccaaaaagttcataaggcaccaatccgatcgttatgtgaagataaaacgaaattggcggaaaccgaggggaattgacaatcgagttcgccggcggtttaaggggcaaatcctgatgcctaacatcggctatggctccaacaaaaagactaaacacatgctaccaagcggctttcggaagtttctggtccataacgtgaaagaactcgaggtactgctcatgtgcaataagtcttattgcgccgaaatcgcccataatgtgtcttcaaaaaacagaaaggcaatcgtcgagcgtgctgctcaactggcaattcgcgtcaccaacccaaatgcaagactgaggagcgaagaatag

SEQ ID NO: 17206 - DNA, 639 bp, Artificial Sequence
  Description of Artificial Sequence: Synthetic coding sequence
atggacttgtttggagacttgccagaacccgagcggagtcctagaccagccgccggcaaagaagcacaaaaaggtccacttctgttcgacgacctacctcccgccagcagcacagattccggatccgggggccccctcttgtttgatgacctccctccggcgagttcgggagacagtggatctttagctaccagtatctcccagatggtaaagacggagggtaagggggctaaaagaaaaacctcggaagaggagaaaaacggttccgaggagctggtcgaaaaaaaagtgtcaagcagcgtcatcttcgggctgaaaggttacgtggccgagcgtaaaggcgaacgtgaagaaatgcaggatgctcatgtgatcctcaatgacattacagaggaatgtagacctccttcgtccctgatcactcgggtgagttactttgccgtcttcgacggccacggtggcatcagagcctctaaatttgcagcacagaacttgcaccagaacctgattcgcaaattccctaaaggagatgtgatctctgtggagaagaccgtgaaaagatgtctgctggatacatttaagcatacagatgaggaatttttgaaacaggccagctctcaaaagcctgcatggaagtag

SEQ ID NO: 17207 - DNA, 1131 bp, Artificial Sequence
  Description of Artificial Sequence: Synthetic coding sequence
atgcccttacaggtcagcgactactcatggcaacaaaccaagaccgcggtgttcctctcactccctctcaaaggggtgtgtgtacgggataccgacgtattttgtacagagaactacctcaaggtgaactttcctcctttcctgttcgaggcgttcctttacgccccaatcgatgacgagtccagcaaagctaagatcgggaatgacactattgtgtttacactgtacaagaaggaggctgcaatgtgggaaacacttagcgtgaccggtgtggacaaggagatgatgcagaggattagggagaaatccattctgcaagctcaggaacgagcaaaggaagcaaccgaggctaaggctgctgccaagcgtgaggaccagaaatatgcactgtctgttatgatgaagatcgaggaggaggagcgcaagaagattgaagatatgaaggaaaatgagaggattaaggcaacgaaggcattggaagcatggaaggagtaccagagaaaggctgaggaacagaagaagattcagagggaggagaaactctgtcagaaagagaagcagattaaggaagagcgcaagaagattaaatataaatccctgaccaggaacctcgcctcgcggaatctcgctcccaaaggaaggaactcagagaatatcttcactgaaaaacttaaagaggactccattcccgctccaagaagcgtgggcagcataaaaattaatttcaccccacgtgtgtttcccacggccctgcgggagtctcaggtagccgaggaagaagagtggctccataagcaagccgaagcccgccgcgccatgaacacagatattgcagaactttgcgacttgaaagaggaggaaaaaaaccctgaatggttaaaagataagggaaacaagctgtttgcaaccgaaaattaccttgcggctatcaatgcatataaccttgctatcagactgaataataagatgccgcttctgtacttgaatagggccgcgtgccacttgaagttaaagaatctgcacaaagcaatcgaggatagctccaaggcgtacagaattatgaagagacatctgaggctaatacacccaaccaagctgtataagctaatgttgaggcggtttggaatgtag

SEQ ID NO: 17208 - DNA, 1485 bp, Artificial Sequence
  Description of Artificial Sequence: Synthetic coding sequence
atggccgctgccgccgagtgcgacgtggtgatggcggcaactgaaccagagctgctcgacgatcaagaggcgaaacgggaagccgagacttttaaggagcaggggaacgcgtattatgctaaaaaagattataacgaggcctataactattacacaaaggccattgatatgtgcccaaagaacgctagttactacggcaaccgggccgcgaccctcatgatgctaggccggttcagggaggcacttggagacgcccagcaatccgtgagactggacgactctttcgttcggggacacctaagagaaggtaagtgtcatttgtcactgggcaacgcgatggctgcgtgtcggtctttccaaagagcactcgaacttgaccataaaaacgctcaggcacagcaagaatttaaaaacgccaacgctgtgatggaatatgaaaaaatagcagagacagactttgagaagcgggattttaggaaggttgttttctgcatggatcgtgctttggagttcgcgcctgcatgtcaccgctttaagatcttgaaggccgagtgccttgccatgcttggtaggtacccagaggcgcagtcagtggctagcgacatcctacggatggacagcacaaacgcagatgcactctacgttcggggcttatgtctgtattacgaggattgtattgaaaaggccgtccagttctttgtgcaggcactgcgtatggctcctgaccatgagaaggcctgcattgcctgtcggaatgccaaggctctgaaggcaaagaaggaggatgggaataaggccttcaaggaggggaactataagttggcctacgaactgtacacagaagcattaggtattgaccccaataacataaagaccaatgccaaactctattgcaacaggggaacagtgaattctaagttgaggaagttagatgacgctatcgaggactgtactaacgccgtcaaactggacgacacttacattaaagcttacctaaggcgcgcccaatgttacatggataccgagcagtatgaagaggcggtgagggactacgaaaaggtgtaccagacagagaaaacaaaagagcataagcagctgctgaagaacgcccaactggagttaaaaaaatccaaaaggaaggactattataagatcttgggggtggataagaacgcaagtgaggacgagattaaaaaggcctataggaagagagccttaatgcaccatcctgatagacactccggcgccagcgccgaggtccagaaggaagaggaaaagaagttcaaggaggtcggggaagcctttaccattctgtcggatcccaaaaaaaagacaagatacgattctggtcaagacctagacgaggaaggaatgaatatgggcgactttgatcccaacaacatcttcaaggcttttttcggaggtcctggcggatttagtttcgaggcttccgggcctggcaacttcttcttccagtttggatag

SEQ ID NO: 17209 - DNA, 1329 bp, Artificial Sequence
  Description of Artificial Sequence: Synthetic coding sequence
aacgaagtgtacaatctcacccaggaattctttcggcacgacaagcccgtaaatgcggagagtcaaaatagcgttggcgtgttcactagagaagaggtccgcaatcgcatcagaaacgatcctgatgacccagaggcgactaaacgtttgaagctcgccatgatccagcagtacctgaaagtagaaagctgtgaatcgtcatcacacagtatggatgaggtgtctctgtccgcattcggggagtggacagaaatacccggggcccaccatatcatcccatctgggttcatgagggtcgtggagctgctggccgagggcatccccgcccatgtgattcagctgggtaaaccagttcgatgcatccactgggaccaggcttcggcccggccaagggggcctgaaattgaaccgcgaggagaaggtgaccacaatcacgatacaggtgagggagggcagggaggtgaagaaccccggggcggaagatgggacgaggatgaacaatggtcggtcgttgtcgagtgtgaggactgtgagttaatcccagctgatcacgttatagtgactgtgtccctgggcgtgctgaaaagacaatacacatccttttttcgccctggcttgcctactgagaaggtcgcagctatccatcggctggggatcgggacaacagataagatcttcctcgagttcgaagagcctttctgggggccagagtgcaacagcctgcagttcgtctgggaggatgaggctgaatcccatacgctcacataccccccagaactgtggtaccgtaagatctgcggttttgacgtgttataccctcccgagcgatatgggcatgtgctgtccgggtggatatgtggcgaggaggccctcgttatggagaaatgcgacgatgaagccgtagcagagatctgcactgagatgctgagacaattcacaggtaatccaaatatccccaagccacggcggatacttcggtcagcatggggttccaacccttattttaggggatcctatagctatactcaggtgggctcttctggagctgacgttgaaaagctggccaaaccattgccctataccgaatcttctaagaccgcccacgggagttctacaaaacagcagcccggacacctcttttcgtcaaagtgccctgagcagcctcttgacgcaaatcgaggagccgtcaagccaatgcaagttctgttctccggggaagccactcacagaaagtattactctaccacacacggcgcgctgctttccgggcagcgagaggccgcaagactcatcgaaatgtaccgagacttgtttcaacagggcacttag

SEQ ID NO: 17210 - DNA, 180 bp, Artificial Sequence
  Description of Artificial Sequence: Synthetic coding sequence
atgagttactaccagcgaccgttctcgccttccgcctattccctgccagcatccttaaactccagcatcgtgatgcagcatggaacctcattggatagcactgatacgtacccccagcacgcgcaaagcttggatggaaccacgtccagctccatcccactctaccgctcaagtgagtag

SEQ ID NO: 17211 - DNA, 837 bp, Artificial Sequence
  Description of Artificial Sequence: Synthetic coding sequence
atgaagtgcgaacattgcaccaggaaggagtgtagtaagaagacaaaaaccgacgatcaggagaacgtgagcgccgacgccccatctcctgcgcaagagaacggcgaaaagggcgaattccataagctagccgacgctaagatcttcctttcggactgcctggcgtgcgactcatgcatgacagccgaagaaggagtgcagttaagtcaacagaatgctaaagacttcttccgagtgctgaacctcaacaagaaatgtgataccagcaaacacaaagtgctggttgtgtccgtttgccctcagtctctgccttactttgcggccaaatttaatttgtcggtcacagacgcaagcagacgcctgtgtgggtttctcaaaagtttggggtgggtccgctacgccgagcgggtgttaggtcgacccatcactgcccacctgtgtaccgccaagtcgccgcagcaggtaatgggctccctcgtcaaagattacttcgccagacaacagaatctgagcccggaaaaaattttccacgttattgtggctccctgctatgacaaaaaactcgaggcactgcaggaaagcctgccacccgctcttcatgggtcccggggagccgactgtgtactaacttccggaacgggatcactttgggagtgtacccctgtgattacggctacacaggaagcggccgccagggagtctctcgagccaggtcggcagcggcttcaacgggataagatcgcccccctagattctagcttgggaggcggcggcgaaatcgcccaaatcatggagcagggggatctgtccgtccgcgatgcagcggtcgacacctag

SEQ ID NO: 17212 - DNA, 471 bp, Artificial Sequence
  Description of Artificial Sequence: Synthetic coding sequence
taagggaaagcacagcgcaagattagtgcaatccacatattggacgtgctggtgttgaacgggactgacgttcgcgagcagcacttcaatcagcgcatccagcttgccgagaaattcgtgaaggcagtgagcaaaccatctcgaccagacatgaatccaattagggtgaaggaggtgtacaggctcgaagaaatggagaagattttcgtcaggctcgaaatgaaaattatcaaaggctccagcggcacaccaaaactgagctacacaggccgcgacgacaggcacttcgttcctatgggtctgtatatcgtgcggaccgtcaacgaaccttggactatggggttctctaaatcttttaagaagaagtttttttacaacaagaagaccaaagacagcacattcgatctacctgcagactcaattgctccattccacctgccctctcttgcatgcctgagcaagatggattag

SEQ ID NO: 17213 - DNA, 1200 bp, Artificial Sequence
  Description of Artificial Sequence: Synthetic coding sequence
atggcaaccggggacctgaagaggagtctgcgcaatctggagcaggtgctcagattactgaactaccctgaggaggtcgattgcgtggggctgataaagggtgaccccgctgccagtctcccgattatctcgtactcttttacctcttacagtccatacgtgaccgagctcattatggagagcaatgtggagttaattgccaagaacgacctgaggttcattgatgccgtgtacaagctgttacgggatcagtttaattataagcccatcttaaccaaaaagcagttcatacagtgtggcttcgcagaatggaaaattcaaattgtgtgtgatattctgaactgcgtgatgaagaaacacaaggagctctccagcctgcagaaaattccctctcagcagagaaagaaaattagttcaggcaaatccgaaccccccctggggaatgagaaaatcagcgcagaggccgtgggagttgatatttccggacgttttatgaccagcggaaaaaagaaagctgttgtgatccgtcatttgtacaacgaagataacgtggacatctccgaggacaccctcagtccgattacggatgtgaacgaggctgtagacgtttcagatctgaacgctaccgagattaagatgcccgaggtcaaggtgcctgagatcaaagccgagcagcaggacgtgaacgtgaatccagagatcaccgcactccagactatgctggctgagtgccaagagaacctgaagaagttgacatctattgagaaaagattggattgtctggagcaaaaaatgaaaggaaaggtcatggtggatgagaatacctggaccaacttgctctccagggtaactcttttggagactgaaatgctgctcagcaaaaagaatgatgagttcattgaatttaacgaggtcagcgaagactatgcgtcttgtagcgacatggatttgctgaatcctcacaggaagtccgaggtcgaacgcccggccagtattcccctttctagcggatactcaaccgcaagcagcgactccacaccccgggcttccacagtcaattattgtggcctgaacgaaataagcgaaaatttccctgcttggtctgccactagctcttgtagctcgctcagttggctcctgaggggccacacaagctaccttagcagtcagtcgtttgcgtggcctctttcctgcgtctag

SEQ ID NO: 17214 - DNA, 819 bp, Artificial Sequence
  Description of Artificial Sequence: Synthetic coding sequence
atggcaagtctgctccaggatcaactgaccaccgatcaagatctacttctgatgcaggagggtatgccaatgcgaaaggtgaggtcaaaaagctggaagaaactgagatacttccgccttcagaatgacggaatgaccgtttggcatgccagacaggctcgtggaagtgctaagccttctttctccatatccgacgtggagaccatcaggaatggacatgactctgagctactacgctctcttgctgaagagctccccttggagcagggctttaccattgtgtttcacggaagacgctccaacttggacctgatggcgaattcggtggaagaggcccagatctggatgaggggtctgcagctcttagtagacctggtcactagcatggaccaccaggaaagattggaccgctggctgtcggactggtttcagagaggtgacaagaatcaggacgggaagatgtcattccaggaggtgcaaaggctgttacatctcatgaatgtggaaatggatcaggaatacgcctttagtctctttcaagctgccgatacttcccaaagcggtaccctggagggcgaagaattcgtccagttttacaaagctcttaccaaaagggccgaagtccaggagctgtttgaatctttttctgccgatggccagaagttgacactgttagagtttcttgatttcctgcaggaggagcaaaaggagagggactgcacttcagaactggctctggaactgatcgacagatatgaaccctcggatagcggggcctcagaagaggatcctggggagggggaggaggtgaacacttag

SEQ ID NO: 17215 - DNA, 360 bp, Artificial Sequence
  Description of Artificial Sequence: Synthetic coding sequence
atggacaagaatataggcgagcaactgaataaagcctacgaggcgttcagacaggcttgtatggatcgtgacagcgctgtgaaagagctgcagcagaaaactgaaaactatgagcagagaataagggagcagcaagaacaactctctctgcagcagaccattattgataagctgaagtcccagctcctcctcgtgaacagtactcaggacaacaattacggttgcgtgcctctgcttgaggattcagagactcgcaaaaacaacttgacactggatcagccacaagataaagtgatctccggcatcgctagggaaaagttgccaaaagttgacatcgcaagtgccgaatcctctatttag

SEQ ID NO: 17216 - DNA, 1881 bp, Artificial Sequence
  Description of Artificial Sequence: Synthetic coding sequence
atgtgcagcacccttaaaaagtgcggaacatacaggacagaagttgccgaatgtcatgaccacggctcaacatttcagggaagaaagaaaggcgggagctcctttcgcgacaacttcgacaaaaggagctgccattacgagcatggaggctatgagcgtccgccctcccattgccaggaaaacgacggctcagtcgagatgagagatgtgcacaaagaccagcagttgcggcatactccatacagcatcagatgcgagcggaggatgaaatggcattctgaggatgaaattcggattacaacgtggcgaaaccgcaagccgcccgaaagaaaaatgagccagaatactcaagacggctatacaaggaactggtttaaagttaccatcccttacggtatcaaatacgacaaagcttggctgatgaattcaatacagtctcattgcagcgacagattcacgcctgtggattttcattacgtcagaaaccgggcatgcttttttgtgcaagacgcgagtgcagccagcgccctcaaagacgtttcatataaaatttatgatgacgagaatcagaaaatttgtatcttcgtcaatcacagcacagccccttactcagtgaagaataagctaaaaccaggacagatggaaatgttgaagttgactatgaacaagcggtacaacgtcagccaacaagctctggatttgcaaaacctgcgatttgatccagatctcatgggtagagatattgacatcatcttgaatcgacggaactgcatggccgccacactgaagatcatagagaggaatttccccgagttgctgtcacttaacttatgtaacaacaagctgtaccaattagatggtctctccgatatcaccgagaaggccccgaaggttaagaccctgaatctgagcaaaaacaaattggaatctgcttgggaattaggcaaagtgaaggggctgaagctggaggaactgtggcttgagggcaatcccctatgtagcaccttctccgaccaaagtgcttacgtctcagcaattcgtgactgcttcccgaagctcctcaggctcgacgggcgggaactttctgcacccgttatcgtggacatcgactcatctgaaacgatgaaaccatgcaaagagaattttacaggttcagagactctgaagcacctcgttctgcagttcttacagcaatattacagcatctacgatagtggagatcgccagggcttgctcggcgcctaccatgacgaagcttgcttttccctggccatcccatttgaccctaaagattcagctccttctagcctctgtaagtattttgaggacagccgcaacatgaagaccctgaaagatccatatttaaagggggagttactcagaaggacaaagcgagatatcgttgatagcctgtcagctttgcctaaaacacaacacgatctatctagcatcctggttgatgtttggtgtcagacagaacgtatgctttgtttttctgtaaatggggtgtttaaggaagtcgaaggccaaagccagggtagtgtgcttgcattcacaagaacctttattgccacccctgggtcttcctcgtctctgtgcatagtgaatgatgaattgtttgtgagggacgccagcccacaggaaacgcagtccgcgttcagtataccggtctctacactgtcgtcctctagcgagccttcacttagtcaggaacagcaagaaatggtgcaggcatttagtgctcagagcggaatgaagctggaatggagtcaaaagtgtctgcaggacaacgaatggaattacacccgtgcaggtcaggcctttacgatgctccaaacggagggcaaaataccagcggaggccttcaagcagattagttag

SEQ ID NO: 17217 - DNA, 189 bp, Artificial Sequence
  Description of Artificial Sequence: Synthetic coding sequence
atggcaatggctccgtccccgtcacttgtgcaggtgtatacatctcccgccgctgtggctgtgtgggagtggcaggacggcctgggtacttggcacccttatagtgcaactgtttgttcttttatcgagcagcagtttgttcagcagaaaggccagaggtttgggcttgggtctctggcacacagctag

SEQ ID NO: 17218 - DNA, 228 bp, Artificial Sequence
  Description of Artificial Sequence: Synthetic coding sequence
atgcgcttgtccctcccactcctgttactcctactgggggcatgggcgattccaggcgggctgggggacagggcgccactcaccgccacagcccctcagctggacgatgaggagatgtactccgcccatatgccggctcacctgcggtgtgacgcatgtagggcagtggcctaccagagactctgttcataccctccccacctgccattaacagagcaacagtcatag

SEQ ID NO: 17219 - DNA, 2619 bp, Artificial Sequence
  Description of Artificial Sequence: Synthetic coding sequence
atgggggacagcgatgacgagtatgatcgtaggcgaagggacaagtttcggcgcgagagatcagactatgatcgctcacgagagcgggatgaacgcaggcgaggcgacgattggaatgaccgcgagtgggacagaggccgcgagaggagatcacggggagaataccgcgattacgatcgtaatagaagggagaggttctccccgccccggcacgaactgagtcccccgcaaaaacgaatgcgcagggattgggacgagcacagcagcgacccatatcacagtggatatgaaatgccatatgccggggggggcggcggaccaacttacggaccaccccaaccctggggccacccggacgtgcacattatgcagcatcatgtccttccaatccaagccagattgggctctattgctgagatcgatctgggcgtccctccacccgtgatgaaaacgtttaaggagtttctcctgtcactggacgatagtgtcgatgaaaccgaggctgtgaaaagatacaatgactacaaattggacttcaggcgacaacaaatgcaggacttcttcctcgctcacaaagacgaggagtggttcaggtctaagtatcatccggatgaagttgggaaaagacgccaggaagccagaggcgccttgcagaacagattacgcgtctttctgtcgttgatggaaactgggtggtttgacaatctcctgcttgatatagacaaagccgatgcaattgtgaagatgctggatgctgctgtgataaaaatggaagggggtaccgagaacgaccttcggatactggagcaggaggaggaagaggagcaggccggcaaaccgggcgagcccagtaaaaaagaagaggggagggccggagcaggattgggggatggcgaaagaaaaactaacgacaaagatgagaaaaaggaagacggtaaacaggccgaaaatgattcatcgaacgacgacaaaaccaaaaagtccgagggcgacggcgataaggaagaaaagaaggaggattccgaaaaagaagcaaaaaagtccagtaagaagcggaatcgaaagcatagcggagacgactctttcgacgagggaagcgtctccgaatctgagagtgaatccgaatcggggcaggccgaagaagagaaggaggaggctgaagaggccctcaaagagaaggagaagcccaaggaagaagagtgggagaaaccgaaggatgccgctgggctggaatgcaagccgcgccctctgcataagacctgctcactgttcatgagaaatattgccccaaacatttctcgggccgagatcattagcctctgtaagcgctatcccggttttatgcgtgtcgccctcagcgagccacaacctgagaggcgatttttccgtagaggctgggtgacttttgaccgttccgtgaacattaaggaaatctgctggaatctacagaatattcgacttagggagtgcgagctttctccaggggtcaacagggatcttacccgtcgggtgagaaacattaatggtataacacagcacaaacagattgtcaggaatgacatcaagttggcagctaagctgatccacaccctcgacgacagaacccagttgtgggcctctgagccgggaactcctccactgccaacttcattacccagccagaatccgatcttgaagaatatcacggattacctgattgaggaggtttccgcagaggaagaggagctcctgggaagcagtgggggcgctccccccgaggaacccccaaaggagggcaatcctgcagagatcaacgtggagcgggacgaaaagcttatcaaagtgctggacaagttgttactgtacctgcgcattgtacactctttggattattacaacacatgtgagtatcctaatgaagacgaaatgccaaataggtgtggcataattcatgtgcgcggacctatgcccccaaatcgaatatcacacggcgaggtgcttgagtggcagaagacattcgaagagaaactgactccgctcctcagcgtgagagaaagcctgtctgaggaagaggcccagaagatgggaaggaaagaccccgaacaggaggtggaaaagtttgttacatcaaatacgcaagaactcggaaaggacaaatggttatgtcctctgagtggaaagaaatttaaaggccctgagtttgtgagaaaacacatcttcaataaacatgccgagaaaatcgaggaggtgaaaaaagaagtggcctttttcaacaatttcttgacagacgctaagaggcccgccttgccagaaattaaacccgcccagcctccaggccctgcacagtccttaaccccaggccttccatacccccatcagacaccccaggggcttatgccctacggtcagcctaggccccctattctcggctacggcgctggggcagtgcgtccggctgttcccaccggcggtccaccttatccccacgccccgtacggcgcaggaaggggaaattatgacgccttccggggccaggggggatatcccggcaagccacgaaatcggatggtcaggggcgatcctagagctatcgtcgaatatcgcgatctggacgctcctgacgatgtcgattttttctag

SEQ ID NO: 17220 - DNA, 483 bp, Artificial Sequence
  Description of Artificial Sequence: Synthetic coding sequence
tagcccgaggacgtgcaggctttggttagtgggaagcttgccttgaggtatgcagggcgccagactgaagctctaaaatgtgtggctcaggcctccaagaaccgatcattggccgacttcgagaaggcacttactgattatcgcgcggaactgcgtgacgatcctatcataagcacccacctggccaaactgtatgataacttgctcgagcagaatctcatccgcgtaattgaaccatttagcagggtccaaattgagcacatttcatcactcattaaactttctaaggccgatgttgaacgtaagctgtcacagatgatcctcgacaaaaaattccatgggattctcgaccaaggagaaggggtgctaatcatcttcgatgaacctccggtagataagacttatgaggctgcgctggagacaatccaaaacatgagcaaggtcgtcgattctctgtacaataaagcaaagaagttgacctag

SEQ ID NO: 17221 - DNA, 3906 bp, Artificial Sequence
  Description of Artificial Sequence: Synthetic coding sequence
atgtggcggagaaagcatccacgtacttctggcggcacaagaggagtcttgtccgggaatcgcggggttgagtatggatctgggcgcggccacctcggaacttttgagggcagatggagaaaactccccaaaatgcctgaggccgtagggactgatccctccacttctcggaagatggctgagctggaggaggtgactttagacggaaaacctctgcaagcattacgggtgaccgacttaaaggcagcattggagcagcgaggcttggcaaaaagcgggcagaaatctgctctggtcaaacgactgaaaggtgctctgatgctggaaaacctacagaagcacagcaccccacacgctgcttttcagccaaattctcagatcggcgaggagatgtcccagaatagctttatcaaacagtatctggagaagcaacaggagctcttgcgccaaagactcgaacgggaagccagagaagccgccgaactggagggcaaaagctcctctatctccgaggaaaaaggcgattctgacgatgagaaaccccgaaaaggcgagaggcgctcgagccgtgtcaggcaagcacgcgcggccaagctctccgagggaagtcaacccgccgaggaggaggaggaccaggaaaccccctcccggaacctacgcgtgagggctgacaggaacctgaagacagaagaagaggaggaggaagaggaggaagaggaagaggatgatgaggaagaagagggcgatgatgagggccagaagtctagagaggcacctatactcaaggagtttaaagaggagggcgaggagatcccacgggtaaaacctgaggaaatgatggacgagcgacctaaaacaaggtcccaggagcaagaggtgctagaaagaggaggtagatttacccgctcacaagaagaagcccggaaaagccaccttgcaagacagcagcaagagaaagaaatgaaaacaacctctcccctcgaggaagaagagcgtgagattaaatcctcccaggggctgaaggagaaatcaaagtctccaagtcctccaagactgacagaggatcgaaaaaaggcttccctcgtagcgcttcccgaacagacggcatctgaggaggaaactcccccccctctgctgacgaaggaggcctccagtcccccaccccatccacagctgcacagcgaggaagagattgagcctatggaggggcctgctccggccgtgcttatccagcttagcccacctaacaccgacgccgatacccgagaactgctggtaagccagcatacagtgcaactcgtgggaggccttagccccctgagcagtccttctgacacgaaggcagagtcccccgccgagaaagtgcccgaggaatccgtgctccccttagtgcagaagtccaccctggccgattactcagcccagaaagatctagaaccagaatctgaccgtagcgcacaaccactgccactcaagatcgaagaactggcccttgccaaaggtatcacagaggagtgtttaaaacagccttcccttgaacagaaagaagggcgccgcgcctctcacacgcttcttcccagtcatagacttaaacaatcagcggactcatcttcatctcggtcaagcagctcctcttccagctcctctagatcccgttcccggtctcccgactcttccggtagccggtcacacagccctttacgtagcaaacagagagacgtcgcacaggcacggacacatgccaaccctagaggccggcccaagatgggatcacggtccacctcagagagccggagccggtccaggagtcgtagccgctctgccagctctaattcacgaaagtcactttcacccggagtgagtagggactcgagcaccagttataccgagaccaaagacccctcctccgggcaggaggtggctacgccccccgttcctcagcttcaggtttgcgagcctaaagaacggacatccacatcctcctcttccgtgcaggcccgcagactgtctcagccagaaagcgcagaaaagcacgtgactcagcgtctgcagcctgaacggggatctccaaaaaaatgtgaagccgaagaagcggaacctccggccgcaacccaaccacagacatccgagactcaaacctcccacttgccagaaagtgagcgtatacatcatacagtggaagagaaagaggaagtaactatggataccagtgagaaccgcccagagaacgatgttcctgagcccccaatgcctatcgctgaccaagtcagcaacgatgaccgcccagagggctcagtggaggacgaagagaagaaggaatcttctctgccaaaatcattcaaacgcaaaatatccgttgtgagcgcaactaagggcgtgccggccgggaatagtgacaccgaaggtggccagccagggaggaagcggcgctggggggctagtacagctacaacccagaagaaaccaagcatttcaatcaccaccgaatccctgaaaagtctgatccctgatattaaaccactggcaggccaggaggctgtcgttgacctccacgccgatgactctaggatcagcgaagatgaaaccgagcgtaatggagatgatggaacacacgacaagggcctgaagatttgtcggacagttactcaagttgtgcccgccgaagggcaggagaacggacagcgggaagaagaggaagaagagaaggaaccagaggccgagccacccgttcctccgcaggtctccgtggaggtagccctgcctcctcccgccgagcatgaggtgaaaaaggtgacattaggcgacactttgacgcgccgttccatttctcagcagaagtcgggcgtgagcatcacaatcgacgaccctgtccgaactgctcaagtgcctagtccacctcgggggaaaatttccaacatcgtgcatatttccaatttagttagacccttcacgctgggccagcttaaggagctgttgggacgcaccggaaccctggttgaagaggctttttggattgacaagattaagagccattgctttgtcacgtattcaactgtcgaagaagccgtcgctacgcggacagcgctgcacggcgtgaagtggccacagagtaatccaaaatttctgtgtgccgattatgcagaacaggatgagctggactatcatcgcggcttgctggtggataggccgtccgaaacaaagacagaagaacaaggcattcctaggccgctgcatcccccccctcctccaccagttcagcctcctcagcatcctcgcgcggagcagcgggagcaggaaagagctgtgagggaacagtgggcagaacgggaaagggagatggaaagaagggagagaacgcgatccgagagggaatgggacagagataaagttagagagggacccaggagccggtctagatcaagggatcggcgccgaaaggagagagcaaaaagtaaggaaaaaaaatccgagaagaaagagaaggcccaggaggagcctcctgctaagctgctcgacgaccttttccgtaaaaccaaggcagctccttgtatctattggcttccgctgaccgatagccagattgtgcagaaggaggccgagagagccgagagggccaaagagcgtgagaaacgccggaaggagcaggaagaagaagagcagaaagaaagagaaaaagaggctgagagggaacgcaaccgccagctggagcgggaaaaacgacgggagcactcccgtgagcgagacagagaaagagagcgggagcgtgaacgagatcggggggacagagacagagatcgcgaacgcgaccgggagcgaggacgtgaacgcgaccgacgagatacgaagagacactcaagatcacggagtcgatcaactcccgtgagggatcggggtggccggagatag

SEQ ID NO: 17222 - DNA, 231 bp, Artificial Sequence
  Description of Artificial Sequence: Synthetic coding sequence
atgctcctcgaaaacctgacagataacgaatccgagaataccaatctgaagaagaaggtcttcgaaaaggaagcccacatccaggagctcagctgcctgttccagagcgaaaagtctctggaaaccaaaatcgcaaagtggaacttgcagagcagaatgaataagaatgaggcaatagttatgaaggaggctagcagacagaaaacagtggcgttgaagaaggcctcttag

SEQ ID NO: 17223 - DNA, 1749 bp, Artificial Sequence
  Description of Artificial Sequence: Synthetic coding sequence
atggaggtgcgcgcgtcccttcagaaggtgtcagggtcatccgactcagttgctactatgaactctgaagaattcgttctggtgcctcaatacgcagacgataacagcacaaaacacgaagaaaaaccacagctgaaaatcgtgtccaatggagacgaacaactggaaaaggctatggaggagatactccgagacagcgaaaagcgccctagctctctcctcgtcgactgccaaagctcatcagaaatatctgatcactctttcggagacatccccgcttctcagactaacaagccctcacttcagcttatcctggaccccagtaacacagagatcagcactcccaggccttcaagtccagggggcctgcccgaagaggacagtgtgttgtttaataagttgacttacctgggatgcatgaaagtgagttccccacgcaacgaagtggaggccttgagggcaatggccaccatgaagtcctcctcgcaatacccatttccagttacattatacgtacctaatgtgccagaaggctccgtcaggatcatagatcagtcgtctaatgtagaaatcgcaagtttccccatctacaaggtgcttttctgcgcacgcggccacgacggcactactgagagtaactgtttcgcttttactgagtcgtcccatggtagcgaagagtttcaaatccatgtgttctcctgcgaaatcaaagaggctgtgtcaaggatcctatactcgttctgtacagcctttaagagatcaagtcgtcaggtctcagacgtgaaagactccgtgattccaactcctgactctgacgtcttcacattttccgtgagcttggaggtgaaggaagatgatggcaagggcaatttccgactgctcgtaattcctatacctttcgagtatttctcacccgtccctaaggaccgggacaaattctatttcaaactcaaacagggtatagagaaaaaagtggttatcaccgtgcagcagctgagtaacaaagaactggcaatcgaaagatgttttggcatgctcctgagccctgggcgcaatgtgaagaatagcgacatgcacctcctcgacatggaaagcatggggaagtcctatgacggcagagcttacgttatcaccggtatgtggaaccccaacgcaccggtttttctggcactcaacgaagagacacccaaggacaaacaggtttacatgactgtggccgtggatatggtcgtcaccgaagtggtggaaccagtgagatttttgcttgaaactgtggtgcgggtataccccgctaatgaaaggttctggtattttagccgaaagaccttcactgaaacattttttatgcggctgaaacagagcgagggtaagggccataccaacgccggcgatgcaatctatgaggtcgtgtctctgcagagagaaagtgacaaagaagagcctgtaacaccgacttccggcggcgggcctatgagcccccaagacgatgaagctgaggaggaatccgacaatgaactgtcttctgggacgggagacgtctccaaagactgtccagaaaagatcctctactcctggggcgagctccttgggaagtggcatagcaacctaggcgctagacctaaaggtcttagcacactggtgaagtccggtgtacccgaggcactccgcgcagaagtctggcaactgctggcgggttgtcatgataatcaggctatgctggacaggtaccggatcctcataactaaatag

SEQ ID NO: 17224 - DNA, 138 bp, Artificial Sequence
  Description of Artificial Sequence: Synthetic coding sequence
atggatgctgattctgacgtggcactcgacatcctgatcacgaacgtggtgtgcgtgttccggaccaggtgccacctgaacttgagaaagatcgcactggagggagcgaacgtgatttacaagcgggatgtgggttag

SEQ ID NO: 17225 - DNA, 762 bp, Artificial Sequence
  Description of Artificial Sequence: Synthetic coding sequence
atggaagacgcgccccagcggctcaggtggcaggctcatcttgaattcacacataatcacgacgtgggagatcttacatgggacaaaatcgccgtgagcttacctagaagtgagaagcttcgctctttggtcttggccggcatccctcacgggatgcgaccacagctctggatgagactgagcggggctctgcagaaaaaacgaaattccgaactgtcctaccgtgaaatcgtgaagaactcttctaatgatgaaactatagctgccaaacagatcgaaaaggatttgcttcggaccatgccttcaaacgcttgcttcgcaagcatggggagcatcggggttccgaggctgcggagagtactgagagccctggcctggctttacccagaaatcgggtactgccaggggactggcatggtcgcagcctgcctcttgctctttcttgaagaagaggacgccttctggatgatgtccgcgattatcgaggatctattaccggccagttacttctccacaacgctgttaggggtgcaaaccgatcaaagggttcttcgccacctcatagtccagtaccttccaaggctggacaaactgctccaggagcacgacatagagctatccctaattaccctgcactggtttctcacggcctttgcctctgtggttgatattaaattacttctgcggatttgggacttgtttttctacgaaggtagcagagtgcttttccagctgacactgggaatgttacacctgaaatag

SEQ ID NO: 17226 - DNA, 336 bp, Artificial Sequence
  Description of Artificial Sequence: Synthetic coding sequence
tgaccgctggtgaaagtgcagatctttggagtacggttggacacagctaggcaggagaccaactacgtggagaataacggcttcaacccatattggggccagactctatgttttagggtcctggtgcccgagctagccatgctgagattcgtggttatggactatgattggaagtctagaaatgattttatcggtcagtatacactcccatggacttgcatgcagcagggatacaggcacatacatctcttaagtaaggatggcatctctttacgtcccgcttctatcttcgtgtatatctgtattcaggagggtctggagggagatgaatcctag

SEQ ID NO: 17227 - DNA, 552 bp, Artificial Sequence
  Description of Artificial Sequence: Synthetic coding sequence
atgatgcagatctgtgacacatacaaccaaaaacacagtctttttaatgctatgaatagatttatcggggcggtgaacaacatggaccagacggtgatggtgccgagtctgttgagagatgtgcccttggccgacccaggacttgataacgatgtgggagtggaagtcggaggttccggtggatgcctagaggagagaacgcctccggtgccagacagcggcagcgcgaacggcagtttcttcgcgccatccagagatatgtatagccactatgtccttctgaagtcaatacgaaatgacatcgaatggggcgtactgcatcaacccccaccccctgccggatccgaggaaggatcggcttggaaaagtaaggacatattggtggacctgggccacctggagggggccgatgccggtgaggaggacttggagcaacaattccactaccacctgaggggtctgcacaccgtcctgtctaagctgaccaggaaggctaatatcctcactaatcggtacaagcaggagatcggctttggcaattggggacactag

SEQ ID NO: 17228 - DNA, 1215 bp, Artificial Sequence
  Description of Artificial Sequence: Synthetic coding sequence
atgatgttgtccaccgaaggacgggaaggattcgtggtgaaagtacgggggctgccctggagctgtagtgctgacgaggtgatgaggttcttttccgattgcaagatccagaacggtacatctggaatccggttcatttacacccgtgagggaaggccctcaggagaagcgttcgttgagcttgagtccgaggaggaggtgaaactcgcacttaaaaaggaccgcgagacaatggggcaccgctacgtcgaggtgttcaagtccaactcggtagagatggactggatgactctccctgtggacttccagggccggtctaccggcgaggctttcgtacagttcgcgtcccaggagatagccgagaaagcccttaagaaacacaaggagcggattggacatcggtacatcgaaattttcaagagttccagggccgaggttagaacccactacgacccacctaggaagcttatggccatgcagaggccaggcccttatgacagacccggggccggaagaggctataattctatcgggcgcggagccggctttgaaaggatgcgccggggtgcttatgggggtggctatgggggatacgatgattatggaggatataatgacggatatgggtttgggtctgaccgctttgggagagacctgaactactgtttcagcggaatgagcgatcatcgctatggggatggtggctcctcattccagtccacgaccggtcattgcgtccacatgagggggctgccctatagggccactgaaaacgacatctataacttcttcagccccctgaatcccatgcgtgtgcatatagaaataggcccggacggcagagtgacaggcgaagctgatgtggaattcgctacacacgaggacgcagtcgctgctatggccaaagacaaggccaacatgcagcacaggtacgtggagcttttcctgaattccacagccggcacaagtgggggagcctatgaccacagttacgtggaactgtttttgaactccactgcaggtgcttcaggtggggcttacggctcccaaatgatgggaggcatgggcctctcaaaccagtcatcttacgggggccccgccagccagcaattaagtgggggttatggcggtggatacggaggccagtcctctatgagtggttacgatcaggttttacaggaaaattcctccgactatcagagtaacttagcgtag

SEQ ID NO: 17229 - DNA, 1545 bp, Artificial Sequence
  Description of Artificial Sequence: Synthetic coding sequence
atgtccattagttccgacgaggtcaacttcttggtttatcggtacttgcaggaaagtggtttctcccatagtgccttcactttcggaatcgagtcccacatttcccagtcgaacataaacggcgcgctcgtgcccccagcagcacttatcagcatcatccagaaaggcctgcagtatgttgaggccgaggtgagcatcaatgaagacgggaccctctttgacgggcgacccatcgaaagcctctctctaatcgacgccgtcatgcccgatgtggtgcaaacccgccagcaggcctacagagataagctggcacagcagcaggcggccgccgccgcagcagccgccgccgctgcgagtcagcagggctccgccaaaaatggcgaaaatacagccaatggagaagagaacggtgcacatacaatagcaaacaatcacaccgacatgatggaagtcgatggagacgtggaaatccctcccaataaggcagtggttctgagggggcacgagtctgaggtgttcatttgcgcatggaaccctgtctctgatctgcttgcctccggttccggcgactctaccgcccgaatatggaacctctctgagaactctacatctggcagcactcagctggttctccggcattgcattcgggagggtggccaggatgtgcctagtaataaagatgtgacatctcttgattggaacagcgagggcaccctgctcgcaactggcagttacgacggtttcgctcggatctggactaaagatggaaatctagcctcaaccctgggccagcataagggccccatttttgcgctgaagtggaacaaaaaagggaatttcatcttgtccgcgggagtggacaagacaaccatcatctgggacgcacacacaggcgaagcaaagcaacaattccccttccattctgcccctgctctggacgttgattggcagagtaataacacattcgcctcatgctccacggatatgtgtattcatgtctgtaaattaggacaggatcgtccaattaagacttttcagggacatactaacgaggtgaatgccatcaagtgggatccaaccggcaatttgttagcaagctgcagcgatgatatgactctcaagatctggagcatgaagcaagacaattgcgtccacgacctgcaagcacataataaagaaatttacacaatcaaatggtcacctactggcccagggactaataatcccaacgccaacctgatgctcgcttccgctagttttgactcaaccgtgcgcctctgggacgttgacaggggtatttgtatccataccttgaccaagcaccaagagcccgtgtatagtgttgcttttagcccggacggccggtatctagcctcaggtagttttgacaaatgtgttcacatctggaatacacagacaggcgccctggttcactcctaccggggcaccggcggtatattcgaagtgtgctggaatgctgcgggcgataaggttggcgcttctgcctccgatggctcagtatgcgtgctggacctgcggaagtag

SEQ ID NO: 17230 - DNA, 2928 bp, Artificial Sequence
  Description of Artificial Sequence: Synthetic coding sequence
atgaaatttgttagtgaggaccttcatcgttgcgccttgctcaccgctgacagttttggagatcccttcttcccgcggacaacacagatactattggagtatcagctgggacgctgggtgcctcgcctccgggagccacgtgacctgtacggagtatcaagcagtggccctttgtctccaaccaggtggccgtaccattgcgaggtgatcgatgagaaggtgcaacatatcgattggacccctagctgtccggaaccagtgtacattcccacaggcctcgagacagaacctctgtatcccgacagcaaggaagccacagttgtgtacttggctgaagacgcatataaagagccctgttttgtctactctagggtgggaggaaatcgcacccccctcaaacagccagtcgactacagagataacacattaatgtttgaggctaggtttgaatcagggaacctccagaaagtcgttaaagtagccgagtacgagtaccagctgaccgttcgaccagatttattcactaacaagcatacccagtggtattatttccaagtcacaaacatgcgtgccggtattgtctatcgctttacaatagtaaatttcaccaaaccggccagtctctatagccgtgggatgcggcccctgttttatagcgaaaaagaggctaaggcccatcacattgggtggcagaggattggtgaccagattaaatactacagaaacaacccgggacaggacggacgtcattacttctctctgacttggacgttccagtttccgcataataaggacacatgttatttcgctcattgttacccatacacgtatacgaacctgcaggaatatctgtcagggatcaacaatgatcccgtccgcagcaagttctgcaagattagggtgctatgccataccctggcacgaaatatggtgtacattctgactatcaccacccccttgaaaaattccgactcccggaagaggaaggccgtcatcctgaccgcaagagtgcatcccggcgaaaccaacagttcttggatcatgaagggcttcctggattatatcctgggtaactcctcggacgcccagctgttacgtgacacatttgttttcaaggtcgttccgatgttaaacccagatggtgtgattgtcggaaattaccgctgctcacttgcagggcgtgatctgaatcgaaactatacgagcctgctcaaggagagcttcccttctgtatggtacaccagaaatatggtgcatcgcctcatggaaaaacgtgaggtcatcctgtattgcgacctccacggacattcaaggaaggagaatatcttcatgtatggctgtgatgggtctgataggtcaaaaaccttgtatctgcagcagcgcatcttccctctcatgctgagtaaaaactgccctgataagtttagcttctcagcctgcaaatttaatgttcagaaatccaaagaaggaacaggcagggtggtaatgtggaaaatgggaatccggaactcatttactatggaggcgacattttgcggcagcacactgggaaataagcgcggcacacacttcagcacaaaagatctggaaagtatggggtaccacttctgtgactccctacttgactattgtgaccccgaccggacaaagtactacaggtgtctgaaggaattggaggagatggaacgacacataacattagaaaaggtgttcgaagatagtgacacacctgttatcgatatcacgctagatgtcgaaagctcgagtagggggagcgatagtagtgagagtattgactccctgacctacttgctcaaactaacttcccaaaaaaagcacctaaaaacaaaaaaggagcgcaatagcacaatcgcttctcaccaaaacgcacgaggccaggaagtttacgatcgtggacacctattgcagcggcatacccaaagtaattcagacgtaaaagatacccggcctaatgagcccgatgactacatggtggactactttaggcggcaattgcccaaccaagggctggcacactgcaaattgcgcctgcctggtagccgtcactcccctgcatctgcctcgcgcgtcgccggtactaccggtaccagacaccatacttggctcattttcgtgtttcttgtggaaatgggtaagaagattccactgaagggcactgatctatacggcaattgcttcaaggtgacctcactgcagtcacccatgggcaagcagacctctacctggacggagaagacacgtatcccgaccgaggacttacaccacaatcttaagtcaaagattaaggagtgtatctcctttcagtccaaaaagaccggcatcaattggaccgacgatgagaagcgctcctacaaagacaagggaatcgtgcagacacaggaaatcttacagtacctgctcccgatcgtgcactcaacaaagaatatgcaaaccacacaaatcaaacagctttttaatcctcggaccaactttcagattcaacatcagctgaatcccgcaacttgccggaatattaaaaagtactcaactagttggacagctccgcggaaccaccccttcgtcatccagggtgatgtcatggcgaattcatctgagtgggtgcagagcaaaccacaccggagtctcgaatctctttcaccactcaaaggacctaagaaaaacaaacactcccagatctgggcaattaaaaacgaagacatcaaaccgctgtctagtaaatgggaaacagcttccagctcttttggcatggacgccaacgtattgaagtataaatccctgcaggcagaagaaacaaaccagcaatcctccaagcacacggcactgcatctcaccaaaaataaggacgaacaggcgaacaaaaacgacgggcagccaacactgtatctgaagtttcagcgagagtcttag

SEQ ID NO: 17231 - DNA, 1626 bp, Artificial Sequence
  Description of Artificial Sequence: Synthetic coding sequence
atgagctcgtccggctatcctccaaaccagggcgcattctctaccgagcagtcaagataccctccacacagcgtgcagtatacattccccaatacgcggcaccagcaggagttcgctgtgcccgattaccgttcctcccatttggaggtctcgcaggcatcgcaacttctacagcagcagcagcagcagcaattgcggcgcaggcccagtctgctgtctgaatttcatcccgggtctgatcggcctcaggagaggcgcaccagctacgagccctttcaccctggaccttcccctgtcgatcatgatagtctggaatccaagcgacctcgtttggagcaggtgtccgactcccattttcagcgcgtgagtgctgcggtccttcccctcgtccacccactgcctgagggactccgtgcaagtgccgacgcaaagaaggaccccgccttcggcggcaagcatgaagcgccctcatcgccaatttcgggccaaccctgtggcgacgatcaaaacgccagcccgtccaagctgagcaaggaggagctgatccaaagcatggacagagtggaccgcgaaatagccaaagtcgaacagcagattctgaaactgaagaagaaacagcagcagttggaggaggaagcggcaaagccaccagaacctgagaagccggtttcacccccgcccgtggagcagaagcaccggagcatcgtgcagatcatttacgacgagaatagaaaaaaagccgaggaagcccacaaaattttcgaaggactggggcctaaggttgaactgcctttatacaaccagccaagtgatacaaaagtgtaccacgagaacattaagactggcgtccctgcccggagaatgatgaaaaaccaggtgatgagaaagaaactcatcctgttcttcaagcgtcgcaaccacgcgagaaagcagcgggaacagaagatctgccagagatatgatcagctcatggaggcctgggaaaagaaagtagaccgaatcgagaataatccacggagaaaggcgaaggaatctaaaacaagggagtattatgaaaagcagttccctgaaattcgtaagcagcgggagcagcaggagcggtttcagagggtaggccagagaggggctggcctgtccgcaaccatcgctcggagcgaacatgaaattagtgaaattatcgacggactgagtgaacaagaaaataacgagaaacagatgcggcagttaagcgttattccacctatgatgtttgatgcggagcaacggagggtcaaattcattaatatgaacggcctcatggaagacccaatgaaggtctacaaagaccgacagttcatgaatgtgtggactgatcacgaaaaagagatctttaaggataaattcatccagcacccgaaaaattttgggctgatcgccagttatcttgagagaaagtcagtaccggactgtgtgctgtactattatttgaccaagaagaatgagaactacaaggctcttgtgcggagaaattatggtaaaaggaggggtaggaatcaacagattgcccggcctagccaggaagagaaagtcgaggagaaggaagaagataaagctgaaaagacggaaaagaaggaggaggagaaatag

SEQ ID NO: 17232 - DNA, 840 bp, Artificial Sequence
  Description of Artificial Sequence: Synthetic coding sequence
atgaaatttccctttctccctattctagtgatgaagtttattgagaaggcccagaatatgtctaagtacgtcctgatcgacacacccggacagatagaggtgtttacgtggagcgctagtggaacaattataacagaagccttagcttctagtttcccaacagttgtgatatatgtgatggacacatcccgatctacaaatcccgtgacctttatgtccaatatgctgtacgcttgctccattctgtataaaacgaagctgcctttcattgtcgtcatgaacaagaccgacatcatcgatcactcctttgccgtggaatggatgcaggactttgaagcatttcaggatgcgctgaatcaggagacgacatatgtcagtaacttaactcgctctatgagcttggttctcgacgaattctattctagtctgcgggtggtcggcgtgagtgccgtcttaggaacaggactcgacgagcttttcgtgcaggtgacgtctgccgctgaggagtacgaaagggagtaccggccggagtacgagagactgaaaaaatcgctcgccaacgccgaatctcaacagcagcgggagcagcttgaaagactaaggaaggacatgggctcagttgccctggacgcagggacagcaaaagactcgttgtcccccgtgctgcacccatctgacctcattctgacaagaggcacccttgatgaagaggacgaggaggcggattctgatactgacgacatagatcatcgggttaccgaggaaagccatgaggagcctgccttccagaattttatgcaggagtccatggctcagtattggaaacgaaacaacaagtag

SEQ ID NO: 17233 - DNA, 1230 bp, Artificial Sequence
  Description of Artificial Sequence: Synthetic coding sequence
atgaaggatacccaggacattcaggaggcatcaaaagcaatgcagaataaggtgcatgagcaggaagacaaaaacgagaaacaaaagcagcgggaggacaagcttggcgtttacagtctcgtgcatttcagccccaagatgctcgggagtgtggccactaccctgccactctcctccagtaattcaagtggcatgccgttaggttactacctctcatcgcctcagattagcagggtgaccatatctacaacgggtcagctcacttccaaagccaccgttggatcttgctcacgcgtggaaaacagtctggatgccagcccttttagcgttccaaaaaagcaggatgagtccccgatgatcggcgatggtgaggattatttcctgagccttttcggagacagcaaaaagctgaccgcgcacagcaattatacacagaagaccctgaaatactttagcatgatacttgaggaggtagggcagtttacaagcagctcactgggcgacgtggaaattgccgaagtcaacgtgaaagggctattcgtaaagctgattaactcttcgctggacaaagaaatggctattggagaccatatactgcagcagaatgtgaatggccagaccatatccctctaccgctttctgcccaacatcgtgatgcaagccaacagtaccgtcaccgtttgggccgccgcatcagaagctaaacaccagcctccttccgattttctgtggaaggagcaagacaaatttagagcctctccggattgcataacaattctgtgcaagcccaacgggcaagccatcgcttggtacacgccaatacactggaagcaggcctgggaaaagctggacgcagatgtggagttcaaccggtgttcagtggttagccctactttccgaaagcgcgttttccaatggacggcaagtactgctaccattacaaaagaaaaacaggatcaacccaagaaggatatctctaattatcaggtcgagcaggctcaagtacttttgaagcgcgaaaaggaaatcccccctaccgtattccctaatagaagcccctggtgtcaaaatccttatgtctccgcacatccgtattgccctttaatagagccacacaatacttcaacggcgggaggccggttggaccggcagcctcggactcggtcgaccagaccaaatcgagcttcaggttctaagaaaaaaaaaacaagcgagagccaaaagcagtag

SEQ ID NO: 17234 - DNA, 2442 bp, Artificial Sequence
  Description of Artificial Sequence: Synthetic coding sequence
atgtcggagcagggcgacctcaaccaggccattgcagaggagggcgggacagagcaggagactgcaacccccgaaaacggcatcgtaaaaagtgagtccctggatgaggaggagaagttggagctgcagcggcgcctggaggcccagaatcaagagcgccggaagtccaagtcgggcgctggcaagggcaaactgacccggtccttagctgtttgtgaggaatcatcggctaggcccgggggggaatctcttcaggaccaagaaagcatccacctgcagttgagctccttctcctctctgcaggaagaggataaaagtagaaaggatgacagcgaacgcgaaaaagaaaaagataaaaacaaggataagacaagtgagaagcccaagatccgtatgttgtcaaaagattgtagccaagaatacacagactccacgggtatcgacttgcatgaattcttgatcaatacccttaagaacaactctagagatcggatgattctcctgaagatggaacaggagatcatagacttcatcgccgacaataacaatcactacaaaaagtttccccagatgtctagttaccagcgcatgttggtgcacagagtggctgcctacttcggtctagaccataatgtggaccaaacaggcaagtcagtgattataaacaagacttctagcactcgcatcccagagcagcgcttctgcgagcatctcaaagacgaaaagggagaggagtctcaaaaaaggttcatacttaagagggacaattcttctatagataaagaggacaatcagtcggtatgctcacaagagagccttttcgttgagaacagccggcttttggaggatagcaatatttgcaatgagacttacaagaagcgccagctgttccgaggcaatagagacggttcaggtcgaacgtccggctcccgtcagtcatcctctgagaacgaacttaagtggagcgatcatcagcgcgcatggtcttccaccgacagcgacagttccaatcgcaatctcaagcctgccatgaccaaaaccgccagttttggaggcatcacagttcttacacggggagactcgacatccagcactagatcgacaggcaagctgagtaaagcaggctcagaatcatcatcatctgccggatcaagcggctcgctgagccgcacccatccaccactccagtctacaccgctggtgtccggcgtcgccgctggctcccctggatgcgtgccgtacccagagaacggcattggcggacaagtcgccccgtctagtacttcctatatcctgctgccattggaggccgccacaggcattccaccaggcagtatcttgctaaatcctcacaccggacagccatttgttaatcccgacggcacgccagctatttataacccccccacatcacagcagccccttagatccgctatggttggccagagccagcagcagccgccccaacaacaacccagccctcaaccgcaacagcaagtacagccgccccagccgcagatggccggccctctcgtcacccaaagcgtgcagggactgcaggcttcatcccagagcgttcagtaccccgccgtctcattcccaccacagcacctgctacccgtttcacccacgcaacatttccccatgagagatgacgtcgcaacccagtttggccagatgacactttctagacagagctctggagagactccagaacccccttccggtcctgtgtacccatcatcattaatgccccagccagcacagcagccctcgtatgtaatcgcctctaccggccagcaacttccgacaggcgggttcagcggaagtggtcctcccatcagccaacaggtcctgcagccccctccctcaccgcaaggcttcgtgcagcaaccacctccagctcaaatgcctgtttactattacccatccggccagtatcccacttctaccactcaacagtatcgtccaatggcacccgtacaatataatgcgcagcgatcacagcagatgccacaagccgcacagcaggctggatatcaaccggtcctgagtggacagcagggatttcaggggcttattggcgtgcagcagcccccccagtcccagaatgtcataaacaaccagcaaggtactccggtccagtccgtaatggtcagttatccaaccatgagctcataccaggtgcctatgacacagggtagccaagggttgccacagcaaagctaccagcaacctatcatgttacccaaccaagctgggcaggggagcctacccgccacaggcatgccagtgtactgtaatgtcacgccaccaaccccgcaaaataacttgaggctcattggccctcactgcccctcatcaacagtgcctgtcatgtcagcgtcatgcagaacaaactgtgcatcaatgtcaaatgcaggttggcaggtaaaattctag

SEQ ID NO: 17235 - DNA, 1773 bp, Artificial Sequence
  Description of Artificial Sequence: Synthetic coding sequence
atgcccagccctcagttgcttgtactattcggctcacagaccgggacagcccaggacgtgtccgagcggctaggccgggaagcaagacgcaggagactgggttgcagagtccaggcattagactcttatcctgttgtgaaccttattaatgagccactcgtgatctttgtgtgtgcgaccacgggtcaaggcgaccctccagataacatgaaaaatttctggcgtttcatttttagaaagaacctgcctagtaccgcactgtgccagatggacttcgcagtgctcgggctgggagattcatcttacgcaaaatttaacttcgtggctaaaaaactgcatcgacgtctgctgcagctcggcggctccgcactactgcccgtgtgcctgggtgatgaccagcatgagcttggtcctgacgctgctgtagacccttggctaagagacctttgggaccgggtgctcggactgtatccgccaccccctggtcttactgaaatcccacccggtgttccactgccatctaaattcacactcctgttcttacaggaggccccgagtactggttccgagggccagcgcgttgctcaccctgggtcacaggaacccccaagtgaatcaaagccttttctcgctcctatgatcagcaaccagcgcgttaccggcccttcgcacttccaggatgtccgactgatcgaattcgatatcctcgggtccggcatctcttttgctgccggtgatgtggtcttaatccagccctctaacagcgctgctcacgtacagaggttctgccaggtgctaggcctggaccctgaccagctgtttatgctgcagccacgggagcctgacgtgtcctcccccacccgtctgccccagccttgttccatgcgccatctggtgtctcactacctggacattgcttcagtgccaaggagaagcttcttcgaacttctcgcttgcctgtctctgcatgaacttgaaagggagaaactactggaatttagcagcgcccagggccaggaggaattatttgaatattgtaaccggccacgaaggactattttagaggtgttgtgcgatttcccccataccgcggctgcaatcccgcccgattatctgttagacctgatccccgtaatcagacctagagctttctccatcgcgtcttcattgctgattttagtggctgttgtgcagtttcagaccaggctgaaggaacctagaagaggactctgctccagctggctcgccagcctagacccgggccaggggccagtgcgggtacctctgtgggtgcggcctgggtcactggcgtttcccgagacaccagacacgccggtcatcatggtgggcccaggcacaggagttgcccccttcagggctgctatccaggaacgcgtggcccagggccagaccggcaactttctgttcttcggctgccgctggcgggatcaggatttttattgggaggctgagtggcaagagttggagaagagagactgcttaactctcatacccgccttttccagggagcaggagcagaaagtgtacgtccagcaccgtcttagggagctcggttcattagtttgggagctgttggacagacagggtgcatacttctacctagccggcaacgcaaagtcaatgcccgccgacgtgtcggaggccctgatgtctattttccaagaggagggcgggctctgctcccccgatgctgccgcttacttggcacggttacagcagacccggaggttccagaccgaaacctgggcatag

SEQ ID NO: 17236 - DNA, 2436 bp, Artificial Sequence
  Description of Artificial Sequence: Synthetic coding sequence
atgcccctgtccagtcccaatgcagctgccacggcaagcgacatggacaaaaatagtggtagtaactcatcctcagcatcctcaggctcatcaaagggccagcaaccacctcgctccgcctctgctggcccagccggagagagcaagccgaagtcggacggaaagaatagttccggcagtaagagatataaccgaaaacgggagctgtcatacccaaagaatgagagtttcaataatcagtcccgccggtcatcctcgcaaaagtccaaaacctttaacaagatgcccccccagcggggtgggggatcatctaagttgttttcctctagcttcaatggtggacgcagggacgaggtggcagaagcacagcgcgccgagttcagccctgcacagttctcaggccccaagaagatcaacctcaaccacttgcttaatttcacctttgagccccgcggccagacaggccacttcgaggggtctggccacggaagctggggtaaacgtaataagtggggtcataaaccatttaataaggagctttttttacaggctaactgccagttcgtggtgtctgaggatcaagactacacggcccattttgcggaccccgatactcttgtgaactgggacttcgtggagcaggtgaggatatgttcccacgaagtgcctagctgcccaatctgtctgtatcctccaaccgccgcgaagatcacgaggtgtggtcatattttttgctgggcctgtatcctgcactatctaagtctgagcgaaaagacatggagcaaatgccctatttgttatagcagcgtccacaaaaaggatcttaagtccgttgtggccacagaatctcaccagtatgtagtgggagacacaattactatgcagctcatgaagcgggagaagggcgtgctggttgcactaccaaaatctaaatggatgaatgtcgatcaccccatccatctgggggacgaacaacatagccagtactccaagttgcttctggcctctaaggagcaggtgctgcatcgtgttgtcttagaagagaaagttgcacttgagcaacagctggccgaagagaagcacactcctgaatcttgttttatagaggcagcaatccaggaactaaaaacaagggaggaggccctgtccgggctcgctggttcccggcgggaggtgacgggggtggttgccgccctagaacagcttgtcttgatggcccccctcgcaaaggagtccgtgttccaacccaggaagggcgtcctggagtacctgtcggcattcgacgaggaaactaccgaagtgtgcagcctggataccccgtcacgcccccttgccctgcccctggtggaggaggaagaagcagtctctgagccagaacccgagggcctccctgaagcatgtgacgacctggagttagccgacgataatctgaaagaaggcacgatctgcaccgagagctcacagcaggagccaattactaaatctggtttcacccgcctctcgtcctccccttgctactatttctaccaggcagaggacggccagcatatgttcctgcaccccgtaaatgttaggtgtctggtgagagaatacggatcattagagcggtcacctgagaagatttcagccacagttgtagaaatcgccggatactctatgagcgaggacgtgcggcaaaggcacagatacctgagccatcttcccctcacatgcgagttctcaatctgcgaattggctctgcagcctcccgtggtcagcaaggagacgttagaaatgttcagcgacgacatcgagaagcgaaagaggcagcgacagaaaaaagccagagaggaacggaggagagaaagaagaatagagatagaagaaaataagaagcagggtaagtatcctgaagttcacatcccgctggagaacctccagcagtttcctgcttttaattcttacacttgctcatctgatagcgcacttggacccacctctacagaaggtcatggggcgctgagcattagccccctttcgaggagtccaggaagtcatgctgatttcctcctcacaccgttgtcccccaccgcgagccaaggatcgccatccttttgtgtgggcagcctggaggaggactctccgttcccctcgttcgcccagatgttaagagtgggcaaggcgaaagcagacgtgtggccgaagaccgctccaaagaaagacgaaaattccctggttccgcctgctccagtagattccgatggggagagcgataactctgatcgcgtgccagtgcccagcttccagaacagcttcagccaggcaattgaggccgccttcatgaagctggatacgcctgctacctccgaccccttgagcgaagaaaaggggggcaaaaaacggaaaaaacagaagcagaagcttctcttcagcactagcgtggtacatacaaaatag

SEQ ID NO: 17237 - DNA, 189 bp, Artificial Sequence
  Description of Artificial Sequence: Synthetic coding sequence
atgcccgagataagggtaactccattgggtgcttgccctgtgttgtcctggaacctggtgttgccccctgggcgaggaagtcgggcaccaagctctacggataccagaacgggtttccacgtgctgccccacggcgtatccgcttcaagtgaaggcgcacccagacccggagtggatacagtgctgtag

SEQ ID NO: 17238 - DNA, 948 bp, Artificial Sequence
  Description of Artificial Sequence: Synthetic coding sequence
atgtccgggctcgttctgggccagcgggatgagcctgccgggcacagactgagtcaagaagaaatcttgggtagcactcgccttgtgtcccaaggattggaggccttgaggtcggagcatcaggccgtgctccagtctctgtcccaaacaatcgagtgtctgcaacagggagggcacgaggaaggacttgtgcacgaaaaagccaggcagctgcggcgctctatggagaatatcgaactgggcctcagcgaggcccaagtcatgctcgctttggctagccatctgtccacagtcgaatcagaaaaacaaaaattaagagctcaggttagaagactttgccaggagaatcaatggctgagagatgagctggcggggacacagcaacgcctacagcggagtgaacaggccgtggcccagctggaggaagaaaagaaacatctagagttccttggtcagctgagacagtacgacgaggatggccacacctccgaagagaaggagggcgatgctaccaaagacagtctggatgacctgtttcccaatgaggaagaagaggacccctctaacggtcttagccggggtcaaggcgccaccgccgcacagcaaggcggctacgagatacccgcacgactccgtacactccacaacctggttattcaatatgcagcccaaggcaggtacgaagttgccgttcctctgtgtaagcaagccttagaggatctggagcgcacatccggaaggggccaccctgatgtcgccacaatgcttaatatcctcgccctggtgtatagagaccagaataaatacaaggaggctgcccatctgttgaacgacgcattgtccatacgggagagtactctgggtcccgatcacccagcagtgtctattccctgtcccccccacccgacacccagaactccacaccactgctgttttgggttgagttag

SEQ ID NO: 17239 - DNA, 2055 bp, Artificial Sequence
  Description of Artificial Sequence: Synthetic coding sequence
atggagaatttacagactaatttttccctggtacagggaagtactaaaaagctaaacggcatgggcgacgacggcagtcctccagccaaaaagatgattactgatatacatgcgaatggaaaaacaatcaataaggttcccacggttaagaaagaacacctggacgactatggggaggccccagtcgagaccgatggagaacacgtcaagcgaacctgtaccagcgtgccagaaacactccatctgaatccttctttgaagcatactttagcccagtttcacctatccagtcagtcctccctggggggacctgccgccttttcagctaggcacagtcaggagagcatgagcccaactgtattcctcccactgccctccccacaggtccttccgggtcctcttctgattccaagcgactcctctacagagctgacgcagacagtcctggagggagagtcaatctcctgcttccaggtgggcggagagaagaggctatgcctgccacaggtgctgaattcagtgctgcgggaatttacgctgcaacagataaatactgtctgcgacgaactctacatttactgcagcaggtgtacctctgaccagttgcatattctcaaggtattgggcattcttccgttcaatgccccctcttgcgggctaattaccctaacagatgcccaacggctgtgcaacgctttactgcggccccgtactttccctcaaaatggctctgtgctgccagccaagtcaagcctcgctcagcttaaggaaacgggatctgcgttcgaagttgaacacgagtgtttaggtaaatgtcagggactcttcgctccccagttttacgtacagcctgacgccccatgcatccagtgtctggagtgctgtgggatgttcgctccacagacctttgtgatgcactctcataggtcaccggacaaacggacttgtcactggggcttcgagtctgccaaatggcactgctatctccatgtgaatcagaagtacttgggcacgcctgaagagaagaaacttaagatcatcctggaagaaatgaaggagaaattctctatgcgatctggcaagcggaaccaatccaagacagatgctcctagcggcatggagttgcaatcctggtatccagtgataaaacaggaaggcgaccacgtgagccagacgcatagtttcctgcatccttcgtactacctttatatgtgtgacaaagttgtcgccccaaacgtctccctcactagtgctgtttctcaaagtaaagagcttacaaaaacggaggcttccaagagcattagtcggcaaagcgagaaagcccacagcagcggaaaactacaaaaaaccgtgtcctacccagatgtgagcctggaggagcaggaaaagatggatcttaagacatccagggaactctgcagccgactggatgcttcaattagcaacaacagcacctcgaagagaaagagtgagtctgccacatgcaatttggtccgagatataaacaaagtgggcatcggattggtggctgcggccagttccccacttctcgtgaaggacgtaatctgtgaggacgacaagggaaaaattatggaggaggtcatgcggacatacttaaaacagcaggaaaagcttaacctgattttacagaaaaaacagcagctgcaaatggaagtgaagatgttgagctcttcgaagagcatgaaagaactcaccgaggaacagcagaacctacagaaggagctcgaaagtctgcagaacgaacatgcacagcggatggaggagttctacgtcgaacagaaagacctggagaagaagctagaacagataatgaagcagaaatgcacctgtgattctaacctcgaaaaggacaaagaggccgaatacgccggacagttggcagagctcaggcagagactggatcacgctgaggccgaccgccaagaattacaggacgaactgagacaggagagagaggccaggcagaagttagagatgatgatcaaggagctgaaactacagattctgaagtcttctaagacagccaaagagtag

SEQ ID NO: 17240 - DNA, 4050 bp, Artificial Sequence
  Description of Artificial Sequence: Synthetic coding sequence
atggaggagaatgagtcccagaagtgtgaaccttgcctgccatattctgccgaccgccgtcagatgcaggagcagggcaaaggaaatctccacgtcactagccccgaggatgcagagtgtagacgtacgaaggaacgcctgagtaatggcaattcgcgggggtccgtctccaaatcatcccgcaacattccgcggagacacaccttgggcggtccccgatcctctaaagagattctaggtatgcaaacctcagagatggaccgcaagcgcgaggcatttttggaacatctcaaacaaaagtacccacatcacgccagcgcgatcatgggtcaccaggaacggctcagggatcagactcgatcacctaaactttcccattcaccacagccgccaagcctgggtgatcctgtggaacatctttccgaaacttccgcagattcgctcgaggccatgagtgagggcgatgcacccacgccattctcacgcgggagccgtactcgcgcaagtctgcccgtggtgcgatccacaaatcagaccaaggaacggtcattaggggttctttacttgcagtacggcgatgagacaaagcagctgcgcatgcctaacgagataaccagcgctgacacaatcagagcattattcgtaagcgccttcccacagcaattgaccatgaaaatgctcgaaagtccatctgtggccatctacattaaggacgaatcgcgtaacgtatactacgagttaaacgacgtgcgaaacattcaggaccgcagcctcctcaaagtgtacaacaaggacccggcccacgcctttaaccacaccccaaaaaccatgaacggtgacatgagaatgcaacgggagctggtctatgcaagaggggatggccccggagcaccaaggcccggcagcacggctcacccgccccacgccattcccaattctccaccaagcactcccgtgccccattccatgcccccttccccatcccgaatcccatatggggggacccggtcaatggtcgttcctggaaatgctaccatacctcgcgaccgaataagctcgctcccggtgagcaggcctatctcgccatccccttcagcgatattagagcggcgcgatgttaaaccggacgaggacatgtccgggaagaacatcgcgatgtacaggaatgaggggttttacgccgacccttacttgtatcacgaaggccggatgtccattgcctctagtcacggaggacaccccctcgacgtccccgatcacataattgcttaccatcgcaccgccatacgtagcgcttctgcttattgcaaccctagcatgcaggcggaaatgcacatggagcagtctctctaccggcagaaatctcgcaagtacccagatagtcatctaccaacgctgggaagcaagacgcctcctgccagtcctcacagggtctctgatctcaggatgattgacatgcatgcgcattacaatgctcatggcccaccgcacacgatgcagcccgacagagcctcgccaagtaggcaggcctttaaaaaggaaccaggtactctagtttacatcgagaagccgagatccgctgcaggactgagcagcctggtagacctcgggcccccgcttatggaaaaacaggtgtttgcctacagcacagccactatccctaaggatcgcgagacatccgagaaaatgatgaagaccacagcaaacagaaatcatacagattcagcaggcacccctcacgtgagcggcggaaagatgctcagcgccttagagtctacggtccctcccagtcagccccctcctgtgggcacttcggccatccacatgtctcttctggagatgcgccgatcagttgccgagctgagattgcagttgcagcagatgcggcagctccaactacagaaccaggaattgttaagagccatgatgaagaaggccgaattagagatctctggtaaagtgatggaaactatgaaaaggctcgaggacccagtgcaaagacagagagtactcgtggagcaggaaagacaaaagtacttgcacgaggaggaaaagatcgttaaaaagttatgtgagctggaggacttcgtggaggatctaaagaaagactcgacggctgccagccgcctggtgacgttgaaagacgtcgaggacggggccttcctcctgcgtcaggtcggagaagccgtggccactctcaaaggagaattcccaacgctgcagaacaagatgcgggcgatactgcgtatagaagtcgaggcagtccgcttcctgaaagaagaaccacataaactggactcactgctgaagcgagttcgaagcatgacggatgtgttaacaatgctacgccgtcatgttactgacgggttactcaagggcacagacgcggcacaggccgcccagtacatggctatggaaaaggccacggccgctgaagtgctcaagtctcaggaggaagccgcccacacaagcggacagccgttccattccacgggggcccccggggacgccaaaagcgaagttgtcccactgtcaggcatgatggtcagacatgcgcaaagtagtcccgtcgttattcagcccagtcagcatagcgtcgccctgcttaatcctgcccagaatctgcctcacgtggcctcctcccctgccgtaccacaagaggcaacaagtaccttgcagatgagccaagctccacagtcccctcaaatcccaatgaacggaagcgccatgcagagtctgtttatcgaggagatccatagtgtctccgctaaaaatcgggcagtttctatagagaaagcagagaagaagtgggaggaaaaaaggcagaatcttgaccattacaacgggaaagaatttgaaaagctgctggaggaagcacaggctaacatcatgaagagcattccaaatctcgagatgccacctgccactgggcccttgccccgaggggacgcccccgttgacaaagttgaacttagtgaggattcccccaatagcgaacaggatctggaaaagcttggagggaaatcccctccccccccgcccccccccccacggagatcttacctgcccgggagcggattaaccactactcgctccggcgacgtggtgtacacgggtaggaaggaaaacattactgctaaggcaagtagtgaggacgccggaccatccccacagactcgcgctactaagtatcccgcggaagagccagcaagcgcctggacaccttcaccccctccggtgaccacctcctcatctaaggacgaagaggaggaggaagaggagggcgacaagatcatggcagaactccaggcgttccaaaaatgcagctttatggacgtgaattccaattcccatgccgaaccttcgcgtgcagattcacacgtgaaggatacccgaagcggtgccaccgtgccacccaaggagaagaagggtagctccggcgcgcctcagacatcccggatgcccgttcctatgtcagccaagaatagacctggtactcttgataaacctggaaagcagtccaaactacaggacccacgtcagtaccgtcaggccaacggaagcgcgaagaagagcggcggagacttcaaacctacctccccctcactgcctgcaagcaagattccagctctgagtccttcctcagggaaaagctcaagccttccttcctctagcggggatagtagcaacctgcccaatcctcccgccacaaaacccagcatcgcatccaatcctctgtcaccccagactggtccccctgcccactcggcaagtctcatcccaagcgtttctaacgggtccctcaaatttcagagtctgacacatacaggaaaagggcatcacctgtctttctccccccaatcccagaacggcagggcccccccgccccttagtttcagtagtagccctccaagcccggcatcttcagtatccctcaatcagggagccaagggcaccagaacgatacacacgccctccctgacctcttacaaggcacagaatggctcgtccagtaaagccaccccctccacagccaaagaaacctcctag

SEQ ID NO: 17241 - DNA, 177 bp, Artificial Sequence
  Description of Artificial Sequence: Synthetic coding sequence
tgaataatccacaaactggcaatgcagctgcgtcacataggggacaacattgaccacagaatggtgagagaagatcttcagcaggacggacgagacgccttggaccactttgtgttttttttcttcaggagggtccaggtcctgctccattttttctggaacaaccatcttctgtag

SEQ ID NO: 17242 - DNA, 429 bp, Artificial Sequence
  Description of Artificial Sequence: Synthetic coding sequence
atgccggaagaccaagtggggaagctggaagcaaccgagaacactatctccgccatggcagccgctgctgccgagcagcaacagttttacttactgttgggaaatcttttgtcacccgataacgtggtgagaaagcaggctgaagagacgtacgagaacatccctggacagtccaagattacatttctcctccaggccatacggaacaccactgcagccgaggaggcccgccagatggctgcagtcctgctgcgaagactactgagtagcgctttcgacgaggtgtatccggctctgccaagcgacgttcagacggcaataaagagcgagttattgatgatcatacagatggagacccagagcagcatgaggaaaaaggtgtgcgatatagccgcggaactggctcggaacctcattggcgtctattag

SEQ ID NO: 17243 - DNA, 93 bp, Artificial Sequence
  Description of Artificial Sequence: Synthetic coding sequence
atgggaagccggaaaaaagagatagctttgcaggtgaatatatcgactcaggagctttgggaggagatgctgagttccaaaggcctaacctag

SEQ ID NO: 17244 - DNA, 645 bp, Artificial Sequence
  Description of Artificial Sequence: Synthetic coding sequence
atggccggggagaactttgccactccctttcacgggcacgtcggccgcggtgcattttctgacgtgtacgaacccgccgaggatacatttctactacttaacgctctggaggctgcggccgccgagttagccggagtggagatctgcttggaggtgggatcgggctctggagtcgtctccgccttcttggcaagcatgatcgggccgcaggctctttatatgtgtactgatatcaaccccgaagccgctgcgtgtaccttagaaacagctagatgtaataaggtccatatccagccagtcatcacggacctcgtgaaagggcttctgccccgactgactgagaaagtagacctgctggtgttcaaccctccttacgttgtgacccctccacaagaagtaggctcgcacgggatcgaagccgcctgggctggcggcaaaaatggtagggaagtcatggatcgattctttccgctcgtgcccgatcttctgtctcccaaggggctattttatctagtgactatcaaggaaaataatcccgaggaaattctgaagattatgaagacaaagggactgcagggaacgactgcgctctcccgccaggcaggccaggaaaccctatccgtgttgaagtttacaaaatcttag

SEQ ID NO: 17245 - DNA, 1158 bp, Artificial Sequence
  Description of Artificial Sequence: Synthetic coding sequence
atgggccgatggtgccagaccgtagcccgcgggcagagacctcgaacatcagcaccctcccgagcaggcgctttactgctgttattgctgttgttaaggtccgccggctgctggggcgccggagaagcgccaggtgccttatccactgctgacccagcagaccaatcggtccaatgtgtacctaaagcaacttgcccatccagtagacctcgtctcttatggcaaacccccaccacacaaaccctcccgagcaccaccatggagacgcaatttccagtgagtgagggcaaagtggatccctatcgcagctgcggatttagttacgaacaggatcccacactgagggatcctgaggctgtagcccggcggtggccttggatggtcagcgtgcgtgccaatggaactcacatctgcgcaggtaccatcatcgcctcccagtgggtcctgaccgtggctcactgtctgatttggcgtgatgtcatctatagtgtgagagtgggctctccttggattgaccaaatgacacagactgcgtcagacgtcccagtactccaggtcatcatgcactcccggtacagagctcagcggttttggtcatgggtagggcaggctaacgacataggactgctaaagttgaaacaggaactgaaatatagcaactacgtgcgacctatctgcctgccagggacggactacgtgctgaaggaccattccagatgcactgtgacaggttggggactttcaaaggcagacggaatgtggccacaatttagaactatccaagagaaggaagtgattatattgaataataaggaatgcgacaacttctaccacaacttcacaaagatccctacacttgtgcagatcattaagagccagatgatgtgtgccgaggacacccaccgggagaagttctgttacgagctcactggggagccactggtttgctcaatggagggtacatggtacctcgtggggctggtgagctggggcgctggttgccaaaaatcagaagctccccccatttacctgcaggtctcaagctaccagcattggatctgggactgcttaaacggacaggcccttgcccttcccgcgccctcgagaaccctactgctggccctcccactgccactctcactcctggccgctctatag

SEQ ID NO: 17246 - DNA, 255 bp, Artificial Sequence
  Description of Artificial Sequence: Synthetic coding sequence
atgagtggtctcgtgctgggccagagagacgagccagccgggcacaggctgagtcaagaggaaatcctcggaagtacacgccttgtctcccaggggttggaggccttgagaagtgagcaccaggccgtgctccagtccttgtcacagaccatcgaatgcctccagcaggggggacatgaggaagggctcgtgcatgaaaaagcacggcagctgcgcagatccatggagaatatcgagcttggcctgtctgagtag

SEQ ID NO: 17247 - DNA, 483 bp, Artificial Sequence
  Description of Artificial Sequence: Synthetic coding sequence
atgtccgtgaacagcgaaaagtcttcaagtagtgagcgacctgagccgcaacagaaggccccactggtgcctcctcctcccccccctccaccgccccctcctcctcccttacctgaccccaccccccctgaacctgaagaggaaattttaggctcagatgacgaggagcaggaggatcctgcggactactgtaagggcgggtatcacccggtaaagattggagacctgtttaatggcagataccatgtgattcggaagctgggctggggtcacttcagtacagtatggctctgttgggacatgcagggcaagaggttcgtggccatgaaagtggtaaaaagcgctcagcactacactgaaaccgctctggacgagatcaagctcctaaagtgcgtgcgcgaaagcgatccctccgacccgaacaaggacatggtggtgcaattaatagatgactttaaaatctccggtatgaatggaatatag

SEQ ID NO: 17248 - DNA, 66 bp, Artificial Sequence
  Description of Artificial Sequence: Synthetic coding sequence
atgaaccccgcgtccgcaccccctcctctacctccgccaggccagcaagtgattcacgtgacatag

SEQ ID NO: 17249 - DNA, 1212 bp, Artificial Sequence
  Description of Artificial Sequence: Synthetic coding sequence
atgagcggttctgacggcggcctggaggaggagcccgaactgtccatcacactaaccttaagaatgctgatgcacggaaaagaggtcggctctatcattgggaagaaaggagagactgtcaaaaggatccgcgagcagagctcagcccgtattactatctcagaagggagctgcccagagcggatcaccaccataacgggaagcacagctgccgtatttcacgccgtctcaatgatcgcattcaagttagatgaggacctttgtgcagcaccggcaaacggaggcaacgtgagcagacccccagttacactgcgcttggtgattcccgcgagccagtgtggaagcctgattggcaaggccggaaccaagattaaggagatacgcgaaacgaccggcgcccaggttcaagttgccggtgaccttctcccaaattccacggagcgcgctgtgactgtctccggagtgcctgacgcaatcatcctttgtgttcggcaaatctgtgccgttatcttagagtccccccccaaaggagcaacaatcccctaccatccctctctgagtctgggtaccgtcttgctctccgcaaaccaaggcttctctgtccagggacagtatggcgccgtgacgcccgccgaggttacaaagttgcaacagctgagtagccacgccgtcccgttcgccacacccagtgttgtcccaggcctggacccaggcacacagacatcctctcaggagtttctggtcccaaacgatctaattggatgcgtgatagggcggcagggatcaaagatcagtgagatccgccagatgagtggtgcacatattaagatagggaatcaagcagagggcgcaggggaacgtcacgtcacaatcacaggctctcccgtgagtattgcactggcacagtacctgattacagcatgcctggagacagccaagagtacctctgggggcactccttcaagtgctccagctgatctgccagctcccttcagcccgcccctgacagcgcttcctacagccccccctggattgctgggcacgccttacgcaatttcactgtctaatttcatcggcttgaaacctatgccctttctggccctgcccccagcttcccccgggcccccgcctgggttggccgcttacactgccaaaatggccgccgctaatggatccaagaaagcagaacgccagaaattctcaccttactag

SEQ ID NO: 17250 - DNA, 5106 bp, Artificial Sequence
  Description of Artificial Sequence: Synthetic coding sequence
atggggaacagcgacagccagtacaccctgcagggctccaagaaccattcgaacaccataacaggcgctaaacaaataccatgctccctgaagatccgcggtattcacgccaaagaggaaaaatcccttcacggctggggccacggatccaacggggcaggctacaaatcccgaagcctcgctcgctcctgtctgtcccacttcaagagtaaccagccctatgcttctaggttaggtgggccgacttgcaaagtcagcagaggggtggcttatagtacacataggacgaacgccccgggaaaggacttccaaggcatcagcgcagccttttctaccgaaaacggcttccacagtgtgggtcatgagctagcggataaccacattacctcccgggactgtaatggtcacctacttaattgttacgggcggaatgagagtatcgcttccacgcctccaggtgaagatagaaagagcccgcgggtgctgatcaagaccctcggcaagttggatgggtgtctacgggtggagtttcacaatggtgggaacccctcaaaggttccagccgaggactgctcggaacccgtccagctactgagatattcccctacactcgcttcagagacgtcccctgtgcctgaggctaggcgtggctcctctgcagactccctaccgagtcaccgaccttctccaaccgactcccgccttaggagcagtaagggttcttcgttaagttctgagtccagttggtacgattcaccttggggcaatgccggcgagctgagcgaggccgaagggtcttttttggccccaggcatgccagaccccagcctccatgccagcttcccgcctggtgatgcaaaaaagcccttcaaccagtctagctctctaagttcactgcgtgagctatacaaagacgctaatctggggagtctgagcccctcaggcatccgattgagcgacgagtacatggggacacatgcctctttaagtaaccgggtctcttttgcatcagatatcgacgttccctctagggttgcccacggggaccctatacagtatagtagctttacgctgccatgccggaagcctaaggcattcgtggaagatactgctaagaaggattctctcaaggctaggatgaggcggatcagcgactggaccgggtcactatcacgcaaaaagcgtaagctgcaagaaccccggtccaaagaggggtcagactatttcgactcccgcagcgatgggctgaacaccgacgtccaagggagcagccaggctagtgctttcctgtggtctggaggctctactcagatccttagtcagaggtcggagtctactcacgccattggaagtgatcccttgagacagaacatatacgagaattttatgagggagctggagatgtctaggacaaacacagagaatattgaaacatccaccgaaacggctgagagctcttcagaatctctgagtagtctcgagcagttagaccttctgtttgagaaggaacagggagtcgttagaaaggctgggtggctattctttaagccgcttgtgaccgtgcagaaagaacgaaagctagaactggttgcgcggcggaaatggaagcagtattgggtgacattgaagggctgtacattgctcttttacgagacgtacggcaagaattctatggaccagtccagcgctccacggtgcgcactctttgccgaagattccattgtacaatctgtcccagagcaccctaagaaagagaatgtgttttgtctcagtaattcatttggcgacgtgtatctcttccaggcaaccagtcaaacagacctcgaaaattgggtaaccgctgtccatagcgcctgtgcatccctgtttgcgaagaagcacgggaaagaagatactctacgattactcaagaaccagaccaaaaacctcctgcaaaaaatagacatggactcaaagatgaagaaaatggcggaactgcagctgtccgtggtcagtgacccaaagaatcgtaaggccatagaaaatcagatacaacagtgggagcagaacctcgagaagttccatatggatttatttcggatgcggtgttatttagcctcattgcagggaggggaacttcctaaccccaagtcccttctcgccgcagcctccaggccttccaagttggcacttgggcggttgggcattctcagcgtcagttcatttcacgcgttggtgtgcagcagggatgatagcgcactccgtaagcgcactctgtccttaactcagagggggcgaaataagaaaggcatcttcagcagtctcaaaggattggacacccttgctcgcaaaggtaaagaaaaaaggccaagcataacacaggtagacgagctgttacatatatacggaagtaccgtggatggtgtacctcgcgacaatgcttgggagatacaaacctacgtgcatttccaggataaccatggcgtgaccgtcgggattaaacctgagcaccgggtagaggatatactgactctggcttgtaagatgcgccagctcgagccatcacactacggtctgcagttaaggaaactagtggacgataatgtagaatactgcataccggcaccttatgagtatatgcagcagcaggtgtatgacgagatcgaagtgttcccactcaacgtctatgacgttcagttgaccaagacagggtccgtttgtgattttggtttcgctgtcacagctcaggttgacgaacgtcagcacctgtcgcgcatattcatttccgacgtcctacctgacggtcttgcatacggggaggggctccggaaaggcaatgaaatcatgacactaaacggcgaagcggtgtcagaccttgacctaaaacagatggaggctcttttttcagaaaaaagcgttggcctgacgttgatcgctagaccacctgacacgaaggccactctgtgtacaagctggtcagacagcgacctgtttagtagggatcagaagtctctcttacctccaccaaaccagagccagctccttgaagagttcctagataactttaagaaaaataccgccaacgatttctctaacgttcctgatataactaccggactgaagagatcacagaccgacggcactttagatcaagtgagccaccgagagaagatggaacaaaccttccggtcagcggaacaaatcaccgctctgtgccgctccttcaacgactcacaagcaaacgggatggagggcccacgcgaaaatcaggatccaccccctcggtcactggcccgacatctgtctgatgctgaccggctgcgtaaagtcatccaagaactcgtggatactgaaaaatcttacgtgaaagacctgtcatgcctcttcgaactgtacctcgagcctctgcagaacgagacattcctgacccaggatgagatggagagtctttttggatctctgcctgaaatgcttgagtttcaaaaagtgtttctggagaccctggaagatggcattagcgcctccagcgattttaacacgctggaaactccaagtcagttcagaaaattgctgttcagcttaggtggtagcttcttatactacgctgaccacttcaaactttattccggcttttgcgccaatcatattaaagtgcaaaaagtgctcgagagggccaagacggataaagcttttaaagcattcctggacgctcggaatccgaccaaacagcactctagcacgctggagagctatctaattaagccggtgcagcgcgtattgaaatatcctctgctgctcaaagaactagtgtcccttactgatcaggagtccgaagaacattatcacctgaccgaggccctgaaagctatggagaaggttgcatctcatataaatgaaatgcagaagatttatgaggactatggaacagtgttcgaccagttagtggcagagcagtctggcaccgagaaggaagtgacagaactctcaatgggagagctcctgatgcactcgaccgtcagctggcttaatccattcctgtctcttggcaaggcgcgaaaagacctcgagttaactgtgttcgtgttcaagcgtgccgtcattctggtgtacaaggagaattgtaagctcaaaaaaaagctcccttccaattcaagacccgcccataattctacagacctcgatccatttaaattccgatggttgattccgatctctgccttacaggtcaggctcggaaatcccgccggaactgaaaacaactccatatgggaactgatccacacgaagagcgaaatcgaaggccgcccggagaccattttccaactgtgctgttctgattcggaaagcaaaacaaacatagttaaagtgattagatcgattttgcgggagaacttcaggcgacatattaaatgcgagctgcccctcgaaaagacctgcaaagatcggctggtaccactgaagaaccgcgtgccggtatccgcaaagctcgccagcagtcggtctcttaaagttttgaagaacagttcttctaatgagtggacaggcgagacaggcaagggaacgttgttggattcagatgaggggagcctcagctcagggacccagtctagtggttgtcccaccgctgaaggccggcaggatagcaagagtacatccccgggcaagtatcctcacccaggattggctgactttgccgataaccttatcaaggagagtgatatactgtctgacgaagacgatgaccatcgacagaccgtaaagcaggggtctccaaccaaggacattgaaatccagtttcagaggcttaggattagcgaagaccctgatgtccaccccgaggccgagcagcagccaggccccgaatccggcgaaggtcagaagggtggcgagcagccaaaactcgttaggggacacttctgtcctatcaagcgcaaggccaacagtactaaaagagacaggggaactttactgaaggcacagattagacaccagtctctcgacagtcaaagcgaaaacgctacaatcgacttgaattccgtgctggagagagagttttctgtccaatcccttacatccgtagtgtcagaggagtgtttttatgaaacagagagccacggaaaatcgtag

SEQ ID NO: 17251 - DNA, 408 bp, Artificial Sequence
  Description of Artificial Sequence: Synthetic coding sequence
atgggtaagagttgcaaggtcgtggtctgtggccaggcttcagtcgggaaaaccagtattctggaacagttactgtacgggaaccacgtggtcggcagtgagatgatagagactcaagaggatatttacgtcggatccattgagaccgacagaggggtcagggagcaggtgacaattgttgtccttggaaataagtgtgaccttcaggagcaacgccgggttgatccagacgtggcccagcactgggccaagtccgagaaggtcaagctgtgggaggtgagcgtggctgaccgtcggtccttgctggagccctttgtgtatctggcctcaaagatgactcagccacaatctaaatctgcattccccctgtctaggaagaataaaggttccggcagcttggacgggtag

SEQ ID NO: 17252 - DNA, 3693 bp, Artificial Sequence
  Description of Artificial Sequence: Synthetic coding sequence
atgcctcgaaaggggacgcagccctctactgcccgcaggagggaagaaggccctcctcctccttctccagatggggccagctctgatgctgaaccagaacctcccagcggccggaccgaaagtcccgccactgcggcggagactgccagcgaagagcttgataatcgaagcctggaggagattttgaactcaataccacccccacctccaccagcaatgactaacgaagctggggccccccgtcttatgattacacacatcgtcaaccagaactttaagagctatgcaggggagaaaattctgggccctttccacaagcgattcagctgtattattgggcccaatggctctggcaagagcaacgtgatcgactctatgctctttgtatttggctaccgcgcccagaagatcaggtccaagaaactgtccgtcctgattcataattccgacgagcataaggacatccagtcatgcaccgtggaggtacacttccagaaaattattgacaaggagggggatgactacgaggtgattccaaattctaatttctacgtttcaagaacagcctgcagagataacacatccgtctaccacatctccggaaagaagaagaccttcaaagacgtcggcaatctcctgaggagtcacggtatcgatcttgaccacaataggttcctgatcctgcagggcgaggtggagcaaattgccatgatgaagccgaaaggccagactgagcatgacgaaggcatgctggaatacctggaggacattattggatgtggaagattgaacgaaccaatcaaggtactatgcagacgagtagagatcctgaacgagcaccgaggcgagaaactgaaccgggtcaagatggtagagaaagaaaaagatgccctggagggagagaaaaacatcgcaatcgagtttcttacattggagaatgaaatcttcaggaagaagaaccacgtgtgccagtactacatctacgaactgcagaagagaattgctgagatggagacacagaaagagaaaattcatgaggatacaaaggaaattaacgaaaagagcaacatactgtccaatgagatgaaagccaagaacaaagatgtcaaggacacagaaaaaaagctgaacaagatcacgaaatttatcgaagagaataaagagaagttcacacagctcgatctggaggatgttcaagtccgggagaaacttaaacacgccacgtcaaaagctaaaaagttagaaaagcagctacagaaggacaaagagaaggtggaggagttcaaaagcatacccgccaaatccaataacattatcaatgaaacaaccactcggaacaatgctcttgagaaggaaaaagagaaggaagaaaaaaagctgaaggaggtaatggatagtctaaaacaggagacacagggcttacagaaagagaaagagagtcgggaaaaagaactcatgggttttagcaaaagtgttaatgaagcccggtcaaagatggacgtggcccagtcggagcttgatatttacctgagccggcacaacaccgctgtgtcccaactaaccaaagctaaggaggccctgatcgctgcaagcgagaccctgaaagagcgcaaggcagcaattagagacatcgaggggaagctgccacagactgagcaggagctgaaagaaaaagagaaggagctgcagaaacttacccaagaagagaccaactttaagtcattggtccacgacctatttcaaaaagtggaggaggcaaaaagcagtctcgccatgaataggagtcgcggaaaggtgttggatgcaatcatccaggagaaaaagagcggacgcatccctgggatttatggccgtctaggagacctcggtgctattgacgagaagtatgatgtggccatctctagctgctgccacgccctggactatatcgtggttgactctatcgatattgcccaggagtgtgtaaatttcctgaaacggcaaaacattggggtcgctacgttcatcgggctggacaaaatggcggtctgggctaaaaaaatgaccgagattcaaactcctgagaataccccaaggttgtttgacctcgtcaaggtgaaagacgagaagatccggcaagcattttatttcgccctgagggacacgctggtggcagataatttggatcaggctacacgggtggcttatcagaaggaccgacggtggcgagtcgtgaccctgcagggacagatcatcgaacagagtggcacgatgacgggcggcggatcaaaagtgatgaaggggcggatgggctcatcactcgtgatcgagatcagcgaagaagaggtaaataagatggagtctcaactgcagaatgactctaagaaagcaatgcaaatccaggagcagaaggttcagctcgaagaaagggtcgttaaacttcgccactccgagcgagaaatgagaaatacactcgaaaaattcaccgcctccatccagagactcattgaacaggaagaatacttaaatgtacaagtaaaggagctggaggctaatgtgctcgccactgcaccagacaagaaaaaacaaaagctgctggaggagaacgtgagtgccttcaaaactgagtacgacgcagtcgcagaaaaggccggcaaagtagaggccgaagtgaagaggttacacaataccattgtggagattaataaccacaaactgaaagcccaacaggataaattggacaaaataaacaagcaactggacgagtgcgccagtgcaatcacgaaggcccaggtggccattaagaccgcagaccgcaatctgcagaaggcccaggatagtgtgctgcgaactgagaaggaaatcaaagacaccgagaaggaagtggacgacctgacggcagaactgaagagcctggaagataaggcagccgaagtggtcaagaatactaatgctgcggagataagtaagatttccctgcaccctatcgaggacaatcctattgaggaaatctcggtactgtccccagaggatctggaagcaattaagaacccggatagcatcaccaatcagatcgcgctcctcgaagcacgctgccacgaaatgaagcccaatttgggcgcaatcgctgaatacaagaagaaggaagaactttacttacagcgcgtggccgagctggacaagatcacgtatgagcgtgattctttcaggcaggcctatgaagaccttcgaaaacaacgactgaatgaatttatggccggattctacataatcacaaacaagcttaaagagaactaccaaatgctgaccctagggggggatgcggaacttgagcttgttgatagcctggacccatttagtgaggggattatgttctcggttcgccctcccaaaaaaagttggaaaaagatattcaatctgtccggcggggagaaaacactatcaagtctcgctctggttttcgcgctgcaccactacaaacctacacccctctattttatggacgagatcgatgctgctctggatttcaaaaatgtctcgatcgttgcattctacatttatgagcagaccaaaaacgcccagttcatcattatctcacttcgcaacaacatgttcgaaatttctgatagattgattgggatttacaaaacctataatattactaagagtgtggccgtgaatcccaaagaaatcgccagcaagggactatgctag

SEQ ID NO: 17253 - DNA, 267 bp, Artificial Sequence
  Description of Artificial Sequence: Synthetic coding sequence
atgcctgaagatcaggtcggcaagctggaggctacagagaataccatatccgctatggctgcagcggcggctgagcagcagcagttctacctcctgttgggaaatctactgtcccccgataatgttgtacgtaaacaggcagaagaaacttatgaaaatatccctggacagtcgaagattacattcctgctgcaggccatccgcaacacgacggcggctgaagaggctcgccaaatggcagcagttctgttgaggcgactattatag

SEQ ID NO: 17254 - DNA, 3627 bp, Artificial Sequence
  Description of Artificial Sequence: Synthetic coding sequence
atggacagcttgcctgacgaattcttcgtccgtcaccccgccgtggaagatcagaggaaggaggagacagaaaacaaactcgagaagagctccgggcaattgaataaacaggagaacgacatccctacggacctggtccctgtgaatctcttactggaggtaaaaaagctcctgaacgccatcaacacccttcccaaaggggtggtccctcatatcaaaaaattccttcaggaagactttagcttccaaaccatgcaacgggaggtagccgcgaatagtcagaatggggaagaaattgtccctgcattgacgctgaggttcttgattactcagctggaggcagctctgcgaaatattcaggcaggaaactataccgctcaccagatcaacatcggttactatttgacactgctgtttctctatggcgtagccctaaccgaaaggggaaagaaagaggactataccgaagctgagaacaaatttctggtgatgaagatgatgattcaggagaacgaaatttgcgaaaattttatgagtcttgtttacttcggcaggggactactgcgctgcgctcagaaacgttacaacgggggtctattggagtttcacaagtcattgcaggagataggcgataaaaacgatcattggtttgatatcgatcccacagaagacgaggatctgccaacaacattcaaggacctgctgaacaactttatcaaaacaaccgagagtaacattatgaaacagaccatatgcagttatctggactgtgagcggtcttgcgaggccgacatcctcaaaaatacttcttataaggggttttttcagttgatgtgttctaagagctgctgcgtctactttcacaagatttgctggaagaaattcaaaaatctgaagtatccaggagaaaacgatcaaagcttttctgggaaaaaatgcttgaaagaaggatgcacgggcgatatggttcggatgttacagtgtgatgtgcccgggatcgtgaagatattattcgaagtggtgagaaaggacgagtacataacgatcgaaaatcttggcgcttcctatcggaagctgatttcactaaaaattactgatactgatatccgacccaagataagcctcaagttcaacacaaaagatgaaatgccaatatttaagctcgattacaactatttctaccatctactccacattatcatcattagtgggactgatattgtgcggcaaattttcgatgaggccatgccgccacctctcctgaagaaggaacttctgatccataaaaacgttctggagagctattataaccacctgtggacaaatcatcctcttggcgggagttggcacctactgtatccgccaaataaagagctgccacaaagtaagcaattcgacctttgccttttgctggccttgataaaacatctgaatgtgttccctgcacctaagaagggctggaatatggagccaccaagcagtgacataagcaagagtgctgacattctgaggctgtgcaagtaccgagacattctgctctccgagatcttaatgaacggtttgacagagtcacagttcaacagcatctggaaaaaggtgtccgatattctccttcgactcggaatgatgcaggaagacatcgataaggtaaaagagaatccgatcgaaaacattagcctcgactatcatcagctgtccgtttatctcgggatccccgtaccagagattatacagcgcatgctgagttgttaccaacaaggcattgctcttcagagtatcacaggcagccagcgaatcgaaattgaggaactgcagaatgaagaggaggagctgtcgccacctctgatggaatacaacatcaatgtcaaaagtcaccccgaaattcagttcgcagagatcaataaagacgggaccagtatcccaagtgaatcatccacggagtccctaaaggacttgcaggaggtaaagagcaagcagcggaagaagaagaaaacaaagaacaaaaaaaataaggactcaaaggaggaccaagtcccctacgtggttgagaaggaagagcaactgcgaaaagagcaggcaaacccccacagcgtctctaggctaataaaggatgatgcgagcgatgtacaggaagactcggcaatggaggacaaattttattccttagatgagctgcacatcctcgatatgatcgaacagggctctgccggaaaagtgactaccgattacggtgagaccgagaaagagagactcgcacggcagagacagttgtacaagctgcattaccaatgcgaagactttaagaggcagctccggacagtgacttttagatggcaggagaaccagatgcaaattaaaaagaaagataagatcatagcctctcttaatcagcaagtcgcttttggtatcaataaagtgagtaagctccagcggcagattcacgccaaggataacgaaatcaaaaatctgaaggagcagctatccatgaaaaggtcccaatgggagatggaaaaacacaatctggaatccacaatgaagacttacgtcagcaaacttaacgcggaaacatcccgtgccctgaccgctgaagtttactttctccagtgtagaagggacttcggccttctgcacctcgaacagaccgagaaagaatgtttgaaccagcttgccagagtaacccatatggctgcttcgaaccttgaaagcctgcagttgaaggccgccgtggattcctggaatgcaattgtcgcagacgtgcgcaataagatcgcatttctaaggacacaatacaacgagcaaattaacaaggtcaaacagggatttgcactcagtacactccctcccgttcagctgcctcctccgccgccatctccagaaatcctgatgcagcagtttcttgggcgcccactggttaaagaaagtttttttcggccgatcctgacagtgccgcagatgccagccgtatgcccgggtgtggtcagcgccaccggccagccacgggcccctctcatgaccggaattgcttgggcactgccagccccagtgggcgatgcggtgcccccgagcgcaggactccgtagtgacccaagcattatgaattgggaaagaattacggaccggctgaaaacagccttccctcagcagacacgcaaagagctcactgatttccttagaaagctcaaggatgcatacggaaagtcgctgtcggaactaaccttcgacgagattgtctgtaaaatcagtcagttcatcgacccaaagaagtcccagtcccagggaaagtcagtgtctaacgtcaattgcgtttcaccaagccactccccaagtcagccagatgctgcccagccccccaaaccggcatggcgcccgctgaccagccagggcccggccacgtgggagggcgcaagcaaccccgatgaagaagaagaggaagaagagccctgcgtcatttgccatgaaaatctgagtcccgaaaatctgagtgtattgccttgtgcacataaattccatgcccagtgtatccgcccttggctcatgcagcagggcacgtgccccacatgccgcttgcacgtacttctccctgaagaattcccggggcatccctctaggcagctgcctaagatctag

SEQ ID NO: 17255 - DNA, 1743 bp, Artificial Sequence
  Description of Artificial Sequence: Synthetic coding sequence
atggtgctcgtcgggacacaggatgcgatctctgccgccaatcctcgcgtaattgatgactccagagcccggaagctctcaacggatctgaagcgctgtacctattacgagacctgcgcgacttatggacttaacgtcgagcgtgtttttcaagacgtcgcccaaaaggtcgtggcgctgcgcaaaaaacaacaactggcaatcggcccctgtaaatcactgcctaactctccctcccattctgccgtctctgcagcctccattcccgcagtgcacattaatcaggcaacaaacggggggggttctgcattcagcgattattcctccagcgtgccatccactccttctatcagtcagcgcgaactccgcattgagacgatcgccgcttctagtactcctacccctatccggaaacagtctaagagacggagtaacatcttcaccagcagaaaaggcgccgacttggacagagagaaaaaagccgcagaatgtaaggtggatagcataggctctgggcgggctattcctataaagcagggtatcctcctgaagcggagtggcaagtctctgaataaggagtggaaaaaaaaatacgttacattatgtgacaacggactgcttacctaccatccgagcctgcacgattacatgcaaaacatccacggaaaagagattgacctgctgcgtactaccgtgaaagtcccggggaaacgtctgccccgagcgactcctgccactgcccccgggactagtcctcgggcaaacggattgtcagtcgagaggagcaatacccagctgggcggtggcaccgaggcggaagagagtttcgagtttgtagtagtgtccttaaccggccaaacatggcatttcgaagcctcaaccgccgaggaaagggagctatgggtccaaagcgtgcaagcccagattctggcctctctccagggatgcagaagcgccaaagacaaaacaaggcttggcaaccagaacgccgccctggcggtccaggccgtgagaaccgtgcgcggcaactccttttgcatcgattgcgacgctcccaacccagactgggcgagcctcaatctgggagctttaatgtgcatcgagtgctcgggtatacatagacacctgggcgcacatctttcccgtgtacggtccctagatctggacgattggccccccgagcttctggcggtcatgaccgccatgggaaacgccctggccaacagcgtgtgggagggtgctctgggtggctacagcaagcccggtcccgatgcctgtagggaagagaaggaacgctggatccgggctaagtatgagcaaaagctgtttttggcccccctgccttctagcgatgtcccgttggggcaacagctcttgcgggccgtggtggaagatgaccttaggttactggtcatgttgctagcacacgggtcaaaggaggaggtcaatgagacttatggcgacggagatggccgcacggcactgcacctgagctcagcgatggctaatgtagtatttacacagctgctgatttggtacggagtagatgtgcgttctagagatgcgcggggtctgacaccactagcctacgccagacgcgcaggatctcaggagtgtgctgatattttgattcagcacggctgcccgggcgaaggatgtggcctcgcccccacgcctaacagggaaccagccaacggaaccaatccatccgcagaattacatcgtagcccaagcctgctgtag

SEQ ID NO: 17256 - DNA, 312 bp, Artificial Sequence
  Description of Artificial Sequence: Synthetic coding sequence
atggcagaactgattcagaagaagctacagggcgaggtggaaaagtaccaacaactgcagaaggacttgagcaaatcaatgtccggtcgccagaagctggaggcccagctgaccgagaacaacattgtgaaggaggagcttgcacttttagacgggagcaacgtcgtttttaaactgttaggccctgtgttagtgaagcaggaattgggagaagcgagggccactgtggggaagcgcttggattacattactgcggaaatctttcttcggactataccagatcctggcgacgttcctgactcctttttctag

SEQ ID NO: 17257 - DNA, 453 bp, Artificial Sequence
  Description of Artificial Sequence: Synthetic coding sequence
atgacgtcacggaagaaggtcttgctcaaggtgatcattctgggagatagcggtgtcgggaaaacatctttgatgaaccagtatgtgaacaagaaattttctaatcagtacaaggccaccatcggtgccgacttcttaacaaaagaggtgatggtggatgaccggcttgtgacaatgcagatctgggataccgcgggacaggaaaggttccaaagcctgggcgtggccttctatagaggtgcggactgttgcgttttggtgttcgatgtgaccgctcccaatacatttaagacgctggactcatggagggacgaatttctgatacaggccagccccagggatccggagaattttccatttgtagttttaggaaataagatagacttagaaaacagacaagtcgcaacaaagcgtgctcaggcatggtgttattcaaagaataatattccctag

SEQ ID NO: 17258 - DNA, 540 bp, Artificial Sequence
  Description of Artificial Sequence: Synthetic coding sequence
atgaccgatctcgtggccgtgtgggatgtagctctgtctgacggcgtgcacaaaatcgaattcgaacatggaaccacatctgggaagagagttgtttatgtggacggcaaagaggaaatacgtaaggagtggatgttcaaactggtggggaaagagactttctacgtcggcgcagcaaaaacaaaagccacgataaacattgatgccatttcaggttttgcctatgaatacactctggagatcaacggaaagtcattaaagaaatatatggaggacaggagtaagactacaaatacttgggtgctccatatggatggagagaacttcagaatcgtacttgagaaagatgcgatggatgtgtggtgtaacgggaagaagctagaaaccgccggcgagtttgttgacgatggcaccgaaacacacttctcaatcggcaaccatgattgttatattaaagccgtaagctccggtaagaggaaagagggaatcattcacaccttgatcgttgataacagagagattccagagatcgccagctag

SEQ ID NO: 17259 - DNA, 171 bp, Artificial Sequence
  Description of Artificial Sequence: Synthetic coding sequence
atggatagttccatacatctgtcatccttgatctcccggcacgatgacgaagctactagaacatcaacttctgagggcttggaggagggcgaagtggaaggagagacactccttattgtggagtcagaggaccaagccagcgtcgacctcagccatgatcagagcgggtag

SEQ ID NO: 17260 - DNA, 153 bp, Artificial Sequence
  Description of Artificial Sequence: Synthetic coding sequence
atgtgcagtacaagtgggtgcgacctcgaagaaatcccattggatgatgatgacttgaatactattgaatttaagatcctcgcctattatacacgacaccatgtatttaagtctacacctgctctgtttagtcctaagctgctgaggacctag

SEQ ID NO: 17261 - DNA, 1203 bp, Artificial Sequence
  Description of Artificial Sequence: Synthetic coding sequence
atgaaccccgcatcggctccaccccctctgcccccaccaggacagcaggtcatccatgtgactcaggatttggataccgatttggaggccctattcaatagtgtgatgaatcctaaaccttcttcttggcggaagaagattctccccgaatcattctttaaggagccagattccggctcccacagcaggcaaagctctactgattcatctggcgggcacccagggcctcggctcgccggtggagctcagcacgtgcggtctcactcgtcccccgcatccctccagctcggaacaggagctggtgccgccggaagcccagcacagcagcatgcacatctgagacaacagtcctacgacgttaccgatgagctcccccttccacccgggtgggaaatgactttcactgccacaggacagcgatattttctaaaccacattgagaagatcaccacttggcaggaccctcgaaaggccatgaaccaaccactgaaccacatgaatttacatcctgccgtcagcagcacccccgtaccccagcgatccatggcagtgtcccagccaaatctggtgatgaaccaccagcaccaacaacaaatggctccctcgactctgtcccagcagaaccatccaacccagaacccccccgccggcttgatgtcaatgccaaatgcacttaccacgcagcagcagcaacagcagaagctccggctgcaacggatccagatggaacgggagcggatccgtatgcgccaggaagaacttatgagacaggaagccgccctttgcagacagctccccatggaggccgagacgctcgccccggtacaggcggccgttaatccccccactatgacgcccgacatgcgaagtatcactaataactcttccgatcctttcctcaacgggggaccataccactcccgcgagcaatcaaccgattccggactcggcctgggctgttattctgtgcccacgacaccagaggattttctttccaatgtggacgagatggacaccggagagaacgcaggccagactcccatgaacattaaccctcagcagacccgctttcctgactttcttgactgcttgcctgggacaaatgtagatttagggaccctggaatccgaggacctgatccctttattcaacgacgttgaatctgcccttaacaagagtgaaccctttttgacatggctctag

SEQ ID NO: 17262 - DNA, 513 bp, Artificial Sequence
  Description of Artificial Sequence: Synthetic coding sequence
atgccccggaaagggactcagccaagcaccgcccggcggcgcgaggaagggccccccccaccaagtcctgacggtgcatcatctgatgcggagcccgagcctccaagcgggcggacagagagtccagccactgcggcggagactgcttcagaagagctggacaacagaagtctggaggagattctgaatagcatccctccacctcccccaccagcaatgacaaacgaggccggcgcacccaggctcatgatcacacacatcgttaaccaaaacttcaagtcctacgcaggggagaagatcttgggacctttccacaagaggttttcctgtatcataggtcccaatgggtcgggcaaatcaaacgtcatagactccatgcttttcgtgttcggctaccgagcacaaaaaattcggtcaaagaaacttagcgtcttgatccataatagcgacgagcacaaagatatccagtcctgcaccgttgaagtgcacttccagaaaataattgacaagtag

SEQ ID NO: 17263 - DNA, 504 bp, Artificial Sequence
  Description of Artificial Sequence: Synthetic coding sequence
atggagaaagctgttaacgatggaagccactccgaggagctcttttgccatttgaagacaatctcggagaaagaggacctacccagatgtactagcgaatctcacctgagttgtttaaagcaggatatcctcaacgaaaagacagagctggaggccactctcaaggaggccgagctcgtcacccactcagtcgagcttctcttacctctgtttaaggatactatcgaaaaaatcaacttcgagaacgcgaacctatcagctctcaaccttaagataagcgaacagaaggagattctcattaaagagctggataccttcaaatcagtgaaacttgctctggagcaccttctgcgtaaacgggactacaaacaaacaggagacaatttgagttctatgctgctcgaaaatcttaccgacaacgagagtgaaaacacaaatttgaagaaaaaggtgtttgagaaagaggcgcatatccaggagctaagctgcttattccagtcctag

SEQ ID NO: 17264 - DNA, 2376 bp, Artificial Sequence
  Description of Artificial Sequence: Synthetic coding sequence
atgtcaaaccagcaggagaagtacgaagcccaaaatattgtgaactccaccgaggagtcagatgacgccttcgataccgtcaccatcccagtacctagtgaggagccccaggaaagcgatcagactgaggagcacgagtcaggcattgagcagtttagcgagtcccacgccatccatgtggaggagcagagcgatcagagcttcagctcactcgagcccgacaacgagcagctgatggaagaagtgatttcccccagacaagtcagctatactccccagcaccacgaaaaacagtacgcaatgcagcgccctaatgatgactctctggccttcctggataaaatcaaatcggtgaaagaaagcttgcaagaatctgtggaggactctctggccaccgtcaaggttgtgctgataccggtgggacaggaaattgttattcccttcaaggttgacacaatactcaagtacctaaaagatcacttttcacatctgctgggaatccctcattcggtcctccagattaggtactccggcaaaatcctgaagaataacgagaccctggtacagcacggcgtgaagcctcaggagattgtgcaagtggagattttctctaccaacccagatttatacccggtcagacgaattgacggcctgactgatgtctcacagataattactgtgaccgtgcagactggcctcgaccaataccagcaggtgcccgtagagatcgtcaagtccgattttcacaagccctttctgggagggttccggcacaaagtgaccggtgtggaatatcacaatgctggtacacagaccgtcccaaaacggatacctgagcgtctgagtatcttctgcagagacactcagactgtctttcaaaagaaaaacctccagcagaccactaacacaaccagcactcagatgacaaacatcggagtgtacgtgtccaacatgacagacaagctggtgactccaggtaaatacttcagcgcagcagaataccacgctcagcgcctgaaggccgttatagtgatccagacctactatcgccaatggcatgccaagattttcgtggagaatcttcgcaggcagaagtctctgagactggagtgggaaacgcagcaggaactgcgcaagatccgagaaaaagaagaatggatcaagttagactaccatcgccgacacaaccccaaaactaacgaagacttcgagttcctgtacaacgccctggagttttggcggcaagaagaactcactcggatcaatcaatcctttaccggagccgaaagaaaggccgctttatgcgagttactggaaaaggagacgcaaattatcgcctcaattgggaggcataggtatatcgcctatatggcaaatcaggaggctgcgattcaagccttcttagataaatgcagcgcccctaagatctggaggacgcccaatggcaaaacgatcgagatggatactcaattcaccattcgcgcccgcgaacttcagaatatttataagtgtataatgttaaaaaatatctcacaggacgaaaggttggacgtattgcttacccttaagcataccgtaaaagagcacgagtgcaagcttacccaggagatcctggaactcatcgatagggaggtggatctcatgatgcggggagtgaaacaccataacctggaaggactacgcaagaggatcgccaccttgttcttccactacattaagactcccctctttaatccagaggtcgcaaaatatttaaaggtgccccaggatcctcttaagttctacaaaaagatttatttttgccacagctgccagctctacttgccatcgaccgaattttccgtgtccagcacctcacgtcgcatctatcgctgcaggaactgtatcaacctgcagaatgaagcccaaaagcgggagagtttcctgaaatataagtgtctgctgcagcagctgtactacactgaagccgactacgaggacgattcaaagatcgcttttttaatgcaacttcaggacatccagtatctcaccgaaaatatttgggcctcacagtcagtcctgtctgcctgcgataatctgagcgatctggtgatggtgcgatggaataagtctttagagtggtctccttggaattgcattctcctgacgaaggacgaagctgccgctcatcttaagttgacatcaatcgaggaaggttacgaacgatctttcattcacaaaatcaaacacaagcatatcctcgccaagaactattttagtcaggtcccagttctggcctctttcatcctggatgatggggagatcgatgaaatcagatggaagtaccattctgacacaacaccaaaaattatagaatcccaacgccctcctcactag

SEQ ID NO: 17265 - DNA, 687 bp, Artificial Sequence
  Description of Artificial Sequence: Synthetic coding sequence
atgactgaccagacttactgcgatagattggtgcaagatacaccatttcttacaggacatggcaggttatctgagcagcaggtggacaggattatcttacagttgaaccgttactacccccaaattctgacaaataaagaggctgaaaaattccggaatccaaaggccagcctgagggtgaggctctgcgatcttttgagccacctgcagaggtctggggagagggactgccaggagttctacagagccctgtatatacacgcgcagccacttcactcccgtcttccctcacgccacgccctgaggaaattccacattactaaccatgcatgcctggtgctcgctcggggggggcacccatcactgcccttgatggcctggatgagttccatgacaactcaggtgtgttgctcgcccgggcttgccagtccactggcctctgcccctcctcaacgaccgccatccggacccgagggtcgagtttggcaggcccaggccgtgcagatgctggtgagcgtatcacatttcctcccactgcccccgtcgctcagtcacggatctttccacactgcctggggaatcctgtacgtgcactcctgtccctccttttcgaatctgattcccaggggctcactgcatgtgtgcgtggacagcaacttggtgcccacagccgcctggagaagctag

SEQ ID NO: 17266 - DNA, 948 bp, Artificial Sequence
  Description of Artificial Sequence: Synthetic coding sequence
atgcccggactttcctgtcgtttctatcagcacaagttccccgaggtagaggatgtggtgatggtgaatgtgcggtctattgcagaaatgggggcttatgtctctctgcttgagtacaacaacatcgaagggatgatcctgctgtccgagctgtcccgtcggagaattagaagcatcaataagttaatcagaatcggcagaaatgagtgtgtggtggtaattcgagtagataaagagaaaggttatatagatctatccaaacgccgcgtaagcccggaggaagctattaaatgtgaggataagttcacaaagagcaaaaccgtgtatagcatcctcaggcatgttgcggaggtgctggagtacacgaaggacgaacagctcgaaagcttattccagaggactgcctgggtgttcgatgataaatataagagaccgggctatggcgcttatgacgccttcaaacacgcagtatcagatccatccatcttagattctctcgatctgaacgaggatgagcgtgaggtactgattaacaatataaaccgacggctaaccccacaggcggtgaagattcgagcagatattgaggtcgcctgttatgggtacgagggtatcgacgccgtgaaggaggcgctgcgcgccggtcttaattgctcaacagagaatatgccaattaaaatcaatcttatagcccctccaagatatgttatgacaacgacgacacttgagagaaccgagggattgtctgtgctatcgcaggctatggccgtcatcaaggaaaaaattgaagagaaacgtggtgtgttcaatgttcagatggagccaaaagtggtcacggacaccgacgaaacagaattggcacggcaaatggaaaggctggagagagaaaacgccgaggtcgatggagacgacgatgcagaagaaatggaagccaaggctgaggattag

SEQ ID NO: 17267 - DNA, 1203 bp, Artificial Sequence
  Description of Artificial Sequence: Synthetic coding sequence
atgaaccccgcttcagcacccccgcctttgcctcctccgggtcagcaggttattcacgtgacccaggacctggatacagatctcgaagcccttttcaatagtgtgatgaaccctaagccgtcctcctggcgaaagaaaatcctccctgaatcatttttcaaggaacctgattccggcagtcactcccggcagagctccacagacagttcgggaggccatcctggaccgagactcgctggtggagcgcagcacgtcagatcacactcatccccagcctcactgcagctgggcacaggtgccggggcagccggctccccagcacagcagcatgcccacttaaggcagcagagttatgacgttacagacgagctgccactaccccctggctgggaaatgaccttcaccgccaccggacagcgatattttctcaaccacatcgagaagataaccacctggcaggacccccgtaaggctatgaatcagccacttaatcatatgaacctccacccggccgtgtcctcaactccagtccctcaaagaagcatggccgtatctcagccgaacctagtgatgaatcaccagcatcaacaacagatggcacccagtactctctctcaacagaatcatcctacacagaatcctcccgctggattaatgagtatgcccaacgcattgacgactcagcagcaacagcagcagaagctgcgcctacagaggatacagatggaaagggaacgcatacgaatgcggcaggaagagctgatgcgacaagaagcagccctgtgtcgtcaacttcctatggaggctgagacactggcaccggttcaggctgctgtgaaccccccgacaatgactccagatatgcgctccattactaataattcttcagatccattccttaatggcggaccttatcactcaagagagcaatccaccgactcaggccttggtttagggtgttactccgtgcctactactcctgaggactttttgagtaacgttgatgagatggacaccggtgaaaacgccggtcagaccccgatgaacatcaatccccaacagacgcggtttcccgactttcttgactgcctgcctggtacaaatgtcgatcttggaaccctggaatcggaagacctcattccattatttaacgacgtcgaatcagctctgaataaaagcgagcccttcctcacctggctctag

SEQ ID NO: 17268 - DNA, 381 bp, Artificial Sequence
  Description of Artificial Sequence: Synthetic coding sequence
atggtgctgattctgggcagaaggctgaaccgagaggacctgggagtgcgggactcgccagcaaccaagagaaaagttttcgagatggatcccaaatccctgacaggtcacgaatttttcgacttttcctccgggtcttctcacgccgagaacatacttcagatcttcaacgaatttcgggactcgcggctcttcactgacgtcataatctgtgtcgaaggcaaggagttcccctgccaccgggcggtactctccgcatgcagttcctatttcagagccatgttttgtaatgaccaccgcgaatcccgggagatgctcgtagagatcaacgggatcctggcagaggcaatggagtgcttcctgcagtacgtgtacacatag

SEQ ID NO: 17269 - DNA, 312 bp, Artificial Sequence
  Description of Artificial Sequence: Synthetic coding sequence
atggcagagttaattcagaagaagctgcaaggcgaagtggagaaatatcagcagctgcagaaggacctgagtaagtctatgagcggccgtcaaaagctggaagctcagcttactgagaacaacatagtaaaagaggagcttgcacttctcgacggctccaacgtcgtgttcaagctactaggacctgtgctggttaagcaagagctcggagaggcccgagcaacagttggaaagcggttggattacatcacagctgaaatcttcctgcgcactatcccagacccaggggacgttcccgacagcttcttctag

SEQ ID NO: 17270 - DNA, 237 bp, Artificial Sequence
  Description of Artificial Sequence: Synthetic coding sequence
atggtacttatcctggggagacggctgaacagggaggacctgggcgtgcgggactcccccgcaacaaagcggaaagtgtttgagatggatccgaagtcactcacaggacatgaatttttcgacttcagctcaggctcaagccacgcagaaaatattttacagattttcaacgaatttcgggactcgagattgtttactgacgtgatcatatgcgtagaaggaaaggagtttccgtag

SEQ ID NO: 17271 - DNA, 1320 bp, Artificial Sequence
  Description of Artificial Sequence: Synthetic coding sequence
atggcggccaatttgtcgcgcaatggccccgccctccaagaggcctatgtaagagtagtgactgaaaagagccccacggactgggccctgtttacatacgaaggaaactcaaacgacattcgcgtagccggcaccggcgaaggtggcctggaagaaatggtggaggagttgaatagcgggaaagtcatgtacgccttctgtagggtgaaggaccctaatagtggcctcccaaagtttgtcttaataaattggaccggggagggagtaaacgacgtgcgaaagggtgcttgtgcatctcacgtaagcacaatggcctctttcttgaagggagcacatgtgaccatcaatgcccgtgccgaggaggacgtagagcccgagtgtatcatggagaaagtggccaaggccagcggcgctaactactcattccacaaagagagcggtagatttcaggacgtgggaccacaggcccccgtggggagcgtgtaccagaaaacaaatgccgtgtccgagatcaaaagagtcggtaaggacagtttctgggccaaagctgaaaaggaagaggagaatagacgtctggaagagaagcggcgcgctgaggaggcccagaggcaactcgaacaggagaggagagaaagagagctgcgcgaggcggcccgcagggaacagcgttatcaagagcagggcggggaagccagcccacaatcacgaacgtgggaacagcaacaggaagtggtttcacgcaatcgtaatgaacaaggatccacctgcgcctccctgcaagagtcagctgttcatccaagagagatcttcaagcagaaggaaagggccatgtccacaaccagtatttcatccccccaacccggcaaactgaggtccccctttctgcaaaagcaattgactcagcccgagactcattttggccgcgagccagccgcggctatcagtaggcctcgtgccgacctgccagcagaggaacctgctccttccacccccccctgcctggtgcaggctgaagaggaagcagtgtacgaagagccgcctgagcaggagaccttctacgagcagccacccctcgtccagcaacagggcgctggttccgagcacatcgaccatcacatacaggggcagggtttgtcggggcagggtttgtgcgctcgggccctttacgattaccaggcagcagacgacactgaaattagttttgatcctgaaaaccttatcacaggcattgaagttatcgacgagggatggtggcgtggttacgggccagacggccacttcggcatgtttccagccaattacgtggaactgattgaatag

SEQ ID NO: 17272 - DNA, 219 bp, Artificial Sequence
  Description of Artificial Sequence: Synthetic coding sequence
atgagctaccagcaacagcagtgtaaacagccttgccagcctccaccagtgtgcccagcccccaagtgtccagaaccctgtcccccgcccaaatgccccgagccatgccccccttctaagtgccctcagtcttgccctccccagcaatgtcagcagaagtgccccccggtcacccctagcccaccgtgccagcccaagtgcccgccaaaatccaagtag

SEQ ID NO: 17273 - DNA, 342 bp, Artificial Sequence
  Description of Artificial Sequence: Synthetic coding sequence
atgtctgcaatccaaaacctgcactcatttgaccctttcgctgatgcctctaagggggatgacctcttgcctgccggaaccgaggactacatacacatcaggatccagcagcgtaacggccgcaaaaccttaacgaccgttcaggggatagccgacgactacgataaaaagaagttggttaaggcgttcaaaaaaaaattcgcgtgtaatgggaccgttatagagcaccctgagtatggagaggtgattcaattgcagggtgaccaacgaaagaatatctgtcaattcctggttgagatcgggctggccaaggatgaccagctgaaggtacacggattctag

SEQ ID NO: 17274 - DNA, 927 bp, Artificial Sequence
  Description of Artificial Sequence: Synthetic coding sequence
atggccagttctaatacggtgcttatgcggcttgtggcctctgcatacagcattgctcaaaaggctggcatgatcgtccgccgcgtaattgccgagggcgacctgggtatcgttgagaagacatgtgccacagatctccaaaccaaagctgatcggctggcccaaatgtctatttgttccagcctggcccgaaaatttcccaagctgacaataattggggaagaagaccttccgagcgaagaggtggaccaggagctgatagaggattcacaatgggaggagattctcaagcaaccctgtccttcgcagtacagtgctatcaaagaggaggacctggtcgtctgggttgaccccttagacggcactaaggaatacacagagggcctgttagataacgtgacagttctgatcggcatcgcctatgaaggcaaagcgatcgctggagtgatcaaccagccctattacaattacgaggccggacctgacgcagtgttgggtcgaactatatggggcgtgctggggttaggggcctttggctttcagctgaaggaagtacctgcaggcaaacatattatcacaaccacaaggtctcatagcaacaaacttgtaaccgactgtgtggcagcaatgaacccagatgccgtccttagggtcggcggagcaggaaataaaataatccaactaattgaaggaaaggcctccgcctatgtgtttgcctctcctggctgcaaaaaatgggacacatgcgccccagaggtcatcctgcacgcagtggggggaaaactgaccgacattcatggcaatgttctccaataccataaggatgtcaaacacatgaacagtgcaggcgtcctcgccactctacgcaactatgactattatgcctctcgtgtgcctgagtcaattaaaaacgcattagttccttag

SEQ ID NO: 17275 - DNA, 1809 bp, Artificial Sequence
  Description of Artificial Sequence: Synthetic coding sequence
atgattgagaaaatgcaagggagcaggatggacgaacagaggtgctcgtttccaccaccactaaagaccgaagaagactatatcccctatccaagtgtacatgaagtcctggggcgggaggggccattccccctaattctgctgccacagttcggcgggtactggatcgagggcaccaaccatgagattacctcaatccctgagaccgaacccctccaatccccaaccaccaaagtgaaactcgaatgtaaccctaccgctcggatctatagaaagcactttctgggaaaagagcactttaattactactcactggatgcagcactgggccatcttgtgttctcgcttaagtatgatgtcataggtgaccaggagcacttgagactgttactccgtaccaaatgcaggacctaccatgacgtaatccctatcagttgcctaacagagttcccaaacgttgtccagatggcaaaattggtgtgcgaagacgtgaatgtagacaggttctatcctgtcctataccctaaagcctcaagattaattgtcacatttgatgaacacgtaatctcgaataatttcaaatttggagtcatttaccagaagctcggccagacttctgaggaagagctgttctcaacaaatgaagagtcgccagccttcgtggagtttctcgagtttttaggacagaaggtcaagctgcaggatttcaaggggttcagaggtggactggacgtgactcacggccagacgggaacagagtccgtttactgcaattttagaaataaggagatcatgttccacgtgagcaccaagcttccttacactgaaggtgacgcccagcagttacaacggaaaagacacattggcaacgatatagtggccgtagtctttcaggacgagaatactcccttcgtgcctgacatgatcgcatcaaacttcctgcatgcttacgtcgtggttcaggccgaaggaggcggacctgacggacccctgtacaaggtatcagtcactgcccgtgacgacgtcccttttttcggccctccgctgcccgaccccgcagtatttcgcaagggaccggaatttcaggagtttctgctcacaaagctgattaacgcagagtacgcttgttataaggcagagaaattcgcaaaattagaagaaagaaccagggctgcacttctcgaaaccctctacgaagaactccacatccattcccagtcaatgatgggcttgggcggcgacgaagacaagatggagaatgggagcggcggtggagggttctttgaatccttcaagagggtgattaggtcccgcagtcagagcatggacgccatggggctgagcaataaaaagcccaatacggtgagtacctctcattccggcagctttgcacctaataaccccgatctagccaaagccgccggaatttcgctgatagtgcccggcaaaagtcctactagaaagaagtccgggccttttgggagccgcagatcctcagcgatcggtatcgaaaatatccaggaagtccaggagaaacgcgaaagcccgccagcggggcagaagactcctgattctggccatgtcagtcaggagcccaaatccgaaaactcttcgacacagagctcgcctgagatgcctacaaccaaaaaccgagcagaaacagcagctcagcgagcagaggctctgaaggatttctctagaagcagtagctctgcttcctcatttgcttctgttgtggaggaaactgaaggagtggacggggaagatacgggcctgcatgtagctggcggacagtgccaacatcactag

SEQ ID NO: 17276 - DNA, 177 bp, Artificial Sequence
  Description of Artificial Sequence: Synthetic coding sequence
atgggtagggtgtgggacctccccggtgtgctgaaggtggaaggcttccgcgctaccatggctcagaggttagttagagtcctccagatttgcgccggccatgtccctggggtatctgccctgaacctgcttagtcttctgcgaagcagcgaggggccatctctcgaggacctttag

SEQ ID NO: 17277 - DNA, 2199 bp, Artificial Sequence
  Description of Artificial Sequence: Synthetic coding sequence
atgctgccatgtgccgcaggggctagaggccggggggctatggtggtgttacgggcaggaaagaaaacgttcctgccacccctttgtagggcatttgcttgtaggggatgccagctggctccagagcgcggagctgagagacgagataccgctccttctggcgtctcaaggttctgtcctcctaggaaatcctgccacgactggataggtccacctgataagtactctaatctgcggccagtccatttttatatccccgaaaatgaaagtccactggagcaaaagctgcggaagttgcgccaggagacccaggaatggaatcagcagttttgggctaaccaaaacctaactttctccaaagaaaaagaggaattcatccattctagattaaaaacaaagggcttaggcctccggacagagtctggtcagaaggccacactgaacgcagaggagatggccgatttctacaaggagtttttaagcaaaaatttccagaaacatatgtactacaaccggatgtacgataacatgagcacaatggtctacatcaaggaagacaagcttgagaagctgacccaggacgagatcattagtaagactaagcaggttattcaaggactagaggcactgaaaaatgaacataacagtatcctccaatcgttgcttgagacactcaagtgtctaaaaaaggatgacgagtctaatctggtggaggagaaatcaaacatgatcaggaagtctctggaaatgctggaactgggcttgtccgaggcacaggttatgatggccctgagtaaccatctgaacgctgtcgagtcggaaaaacagaaattacgcgcacaggtgagacggctctgtcaagaaaatcagtggctgcgcgacgagctggccaatacgcagcagaaactgcagaaaagcgagcagtctgtggcccagttggaggaagagaagaagcacctggaattcatgaaccagcttaaaaagtacgacgatgacattagcccatctgaagataaagataccgatagcaccaaggaacccctagacgacttgtttcctaatgacgaggacgacccgggacaaggcatccaacagcagcactcgtcagctgccgcagctgcccagcagggcggatatgaaattcctgcacgcctgcggactcttcacaacctcgtcattcagtacgctagccaaggtcgatatgaagtcgccgtgcctctgtgcaaacaagcacttgaagacctggaaaaaacatccggccacgatcaccctgatgtagcaactatgttaaacattctcgccttagtgtacagagaccagaacaaatataaagacgcagctaatctcttgaacgatgccctcgccatccgggagaaaacactgggaaaggatcaccccgctgttgccgcgaccctgaataatctcgctgtgctctacggcaagcgtggaaaatacaaagaagcagagcccctgtgcaagcgggcacttgagataagagagaaagtgttggggaaggaccacccggacgtggctaagcagctcaataatttggccctactctgccagaaccaggggaaatatgaagaagtggagtactattatcagcgggcgctagagatctaccagaccaaactcggtcccgatgaccctaatgtcgcaaagacaaagaataacctggccagctgctacttaaaacagggaaagtttaaacaagccgagaccctgtataaagagattctgacaagagctcatgagagggagtttggcagcgtagacgacgagaacaagcccatttggatgcacgctgaggaaagggaggaatgtaaaggcaagcagaaagacggtactagttttggagaatacgggggctggtacaaagcctgtaaagtggattcccccacggtcaccacaacgctgaaaaacttgggggcgttgtatcgacggcaaggcaagtttgaggctgcagagaccttagaggaggccgccatgagatcccggaagcagggacttgacaacgtccataagcaacgggtggccgaggtccttaatgatccagagaatatggaaaaacgccgtagcagagagagcttgaatgtggacgtagtcaaatacgagtccggccccgacgggggtgaagaggtttccatgtctgtggaatggaatggcatgaggaagatgaaattaggacttgtgaattag

SEQ ID NO: 17278 - DNA, 249 bp, Artificial Sequence
  Description of Artificial Sequence: Synthetic coding sequence
atgagcggcctggttctgggtcaacgagatgagcctgccggacatcggctgtcacaggaggaaatcctgggcagcactcggctggtcagtcaggggctcgaagctctgcggagtgaacaccaggcagtgttacaaagcctgtcacagacaattgaatgtttgcaacaaggtggccatgaagagggcctcgtacatgagaaggccaggcagcttcggaggtctatggagaatattgagctgggactatag

SEQ ID NO: 17279 - DNA, 222 bp, Artificial Sequence
  Description of Artificial Sequence: Synthetic coding sequence
atggttctcattctaggaagaagattaaaccgagaagacttgggggtacgtgatagcccagccaccaagagaaaagtattcgagatggatcccaagtctctcacggggcatgagtttttcgatttctctagcggcagcagccacgccgaaaacattctccagatcttcaacgagtttcgtgacagtaggctgtttaccgatgtgattatttgtgtggaatag

SEQ ID NO: 17280 - DNA, 1191 bp, Artificial Sequence
  Description of Artificial Sequence: Synthetic coding sequence
atgaatttccaagcgggggggggtcaatctcctcagcagcagcaaagtctggctgcccccggcgggggaggagccgcagcacaacagctggtgtgtggcggccagtttggcggggctggaccaggagccgggggggggggaggccccagccagcaactggctggtgggcctccgcagcagttcgccctgagcaattctgccgctattcgcgccgaaattcagcggttcgaatctgtacaccctaacatttatgctatttacgatctaatcgaaaggatagaagacctcgctcttcaaaaccagatccgcgagcatgttatcagcatcgaggacagcttcgtgaacagtcaggagtggactctcagccgctccgtgccagaactcaaagtcggcattgtaggaaatctgtccagcggaaagtcggccttagtccaccggtacctaactggaacctatgtccaggaggagtccccagagggcgggcgtttcaaaaaagaaatcgtcgttgacggccaaagctatctgctgctgattcgggacgaaggaggccctccggagttacagtttgcagcctgggtcgatgcagtggtcttcgtcttttcccttgaggatgaaatatcatttcagaccgtgtacaactacttcttgcggctatgcagctttcggaatgctagcgaagttcccatggttctggtggggacacaggatgcaatcagtgcagctaatccccgagttatcgacgactctagagcacgaaagctcagtaccgatctcaagcgatgcacttattatgaaacgtgcgccacctatgggttgaatgtcgagagagtttttcaggatgtggcccagaaggtcgtggcactgagaaaaaaacagcagctggccattgggccatgcaagagcctgccaaactcccccagtcacagcgctgtcagcgccgccagtattcccgccgtccacatcaaccaagccacaaacggcggaggctccgcctttagcgactatagttcctccgtcccatctacccccagtatatcacaacgggagctgcggattgaaaccattgccgcgtcctccaccccaacacccatacggaagcagtcaaagagaaggtctaatatattcactatctgtgccaccgtcagcaactttagcagtacaaagcgaccattccagctccttcctaactag

SEQ ID NO: 17281 - DNA, 1110 bp, Artificial Sequence
  Description of Artificial Sequence: Synthetic coding sequence
atggattcatgtctcatggtttggcacatgaagccccagtcaagggcctaccgttttactggacacaaggatgcggtcacttgcgttaactttagcccctccgggcacctcctggcttccggatccagggataagaccgtccgcatctgggtccctaacgttaagggagaatccactgtgtttcgcgcacataccgctaccgtccggagtgttcatttttgctcggacggccagtccttcgtgaccgcttccgatgacaagactgtgaaagtatgggccactcataggcagaaattcctgttttcactgtctcaacatatcaactgggtaaggtgtgccaagttctcccccgacggccggctcatcgtgtctgcttctgatgataagacagtaaagctgtgggacaagtcttctagagagtgtgtgcactcctattgcgagcacggaggcttcgtcacctatgtggacttccaccctagtgggacatgcattgcagccgccggaatggataacacggtgaaggtctgggacgtaagaacacatcggttgctccagcattaccagctccatagtgccgcagttaatggcctcagcttccacccttctggcaactacttgattaccgccagctccgactccacgctgaagattctggacctcatggaaggcagactcctatacacactccacggacatcagggaccagccacaactgtcgcattctccaggaccggcgagtacttcgcctctggaggatcagacgagcaggtgatggtctggaagtccaacttcgatatcgtggaccacggtgaagtgacaaaagttccaaggccacccgccactctggccagcagcatgggaaacctgccagaggtggacttcccggttccgcctggccgaggtcgctctgtggagagcgtgcaatcccagcctcaggagcctgttagcgtgccccagactttgacctccacactggagcatatcgttggacagctggatgttttgacccaaactgttagtatcctggagcagcggctgaccttaacagaggacaaactaaaacagtgtcttgagaatcagcaactaattatgcaacgggccaccccatag

SEQ ID NO: 17282 - DNA, 312 bp, Artificial Sequence
  Description of Artificial Sequence: Synthetic coding sequence
atggctgagttaatccagaagaaactgcaaggcgaggtagagaagtaccaacagttgcagaaagacttgtcgaagtcaatgagtgggcggcaaaaactcgaggcccagcttacagaaaataacatcgtcaaggaagagttggcattgctggatggatcaaatgtagtctttaaactgctcggaccagttctagttaagcaggagctgggagaggcccgggcaaccgtgggaaaaaggctcgattacattaccgctgaaatcttcctgcgaactatcccagacccgggcgacgtcccagactcttttttctag

SEQ ID NO: 17283 - DNA, 270 bp, Artificial Sequence
  Description of Artificial Sequence: Synthetic coding sequence
atgagtgagcagggggacctgaatcaggcaatcgccgaagaggggggcaccgagcaggagaccgctacacctgaaaacggaatagtaaagtctgaaagcctcgacgaggaagagaagctcgagttgcagaggaggctcgaggctcagaatcaggagcgccgtaagtctaagagtggggccggcaagggcaagctaacaagatccctggccgtgtgcgaggaaagctctgcacggcctggcggtgaatccctgcaggaccaaactctatag

SEQ ID NO: 17284 - DNA, 1140 bp, Artificial Sequence
  Description of Artificial Sequence: Synthetic coding sequence
atgtggcacttggattttgggctgcatacaggcaaaactttccagcctctcccctttatcatagtggtgtatccaggcgccggcagacgttggggccttgtactgtcactggcttcacaccggcggaggacggaggcgggtggtggaaccgggcccacaagtgacactggatggggatgtatgctgcgctgtggacaaatgatttttgcccaggctctagtgtgccgtcatctgggaagagattggcgctggacccagcgaaagaggcagcccgacagctacttttcagttctcaatgccttcatagaccggaaagattcctactacagtatccatcagatcgcacagatgggtgttggcgagggaaagagtatagggcagtggtatggacctaacacagtcgcccaagtgctgaaaaaattggcggtgtttgacacatggtcctcattggctgttcacatcgctatggacaatactgtggtgatggaagagattaggcgtctatgccggacgagcgtgccatgtgctggggccacagccttccccgccgattccgatcgacattgtaatggattccctgccggcgccgaagtaactaaccgaccctcaccttggaggcccctagttcttttgattccactgcgtttggggctaaccgacataaatgaagcctacgtagagacactaaagcattgctttatgatgccccaatctttgggagtcatcggcggaaagccgaacagcgctcactatttcatcggctatgtgggggaagagcttatatatctagacccccacacgacccagcccgcagtggaaccgactgacggatgtttcattcccgatgaatctttccactgtcagcaccctccttgccggatgtccatcgccgagctggacccgtctattgctgtcggatttttctgcaaaaccgaggatgacttcaacgattggtgccagcaggtcaagaagctgagcctactaggtggcgccttacctatgttcgagttagtggagctgcagcccagccaccttgcttgcccagacgtcttaaatctctcccttgactcaagcgacgtggaaaggctagagcgctttttcgactcagaagacgaggacttcgaaatcttgtcactgtag

SEQ ID NO: 17285 - DNA, 1683 bp, Artificial Sequence
  Description of Artificial Sequence: Synthetic coding sequence
atgagcgagcacagccggaactccgaccaagaagagctcttggacgaagagattaatgaggatgaaatacttgctaatctgtcagctgaagaactcaaagaacttcagtctgaaatggaggtgatggcccccgatccctctctccccgttggcatgattcagaaggatcagacggataaaccgcccacaggaaacttcaatcacaaaagcctggtggattacatgtattgggaaaaggccagccgcagaatgttggaagaagaaagggttccagtaaccttcgtaaaatcagaggagaagacccaggaagagcatgaggagatagagaagaggaacaagaatatggcccaatacctgaaggagaaactgaataatgaaatcgtcgctaacaagcgggagagcaaagggtcaagcaacatccaggagaccgatgaagaagatgaggaagaggaggatgatgacgatgacgacgagggcgaggacgacggagaggaatcagaggagactaatcgcgaggaggagggcaaggcaaaggagcagattaggaactgcgaaaacaactgccagcaagtgacagacaaggcctttaaggagcagcgagacagacctgaggctcaagagcaatctgagaaaaagattagtaaactggaccctaagaagctggcgctggatacatccttcttaaaagttagcactaggccgagtgggaaccagaccgaccttgatggtagcctgaggagagtgcgaaaaaacgatcccgacatgaaagagctgaacttgaacaatatcgaaaacattccgaaggagatgttgcttgatttcgttaatgccatgaaaaaaaacaaacacatcaagaccttctccctcgcgaatgtgggggccgacgaaaatgtggcttttgcactggccaacatgctcagagagaataggtctatcactactcttaacattgagtctaatttcattaccgggaaggggatcgtggctatcatgcggtgtctgcagtttaacgaaaccttaaccgaactccgattccacaaccaacggcatatgttgggtcaccacgccgaaatggaaattgcacgcttgttgaaagccaacaatacactgctaaagatgggctaccacttcgaactacctggaccgcggatggttgtgacaaatttactcactaggaaccaggacaaacagaggcagaagcggcaagaggagcagaaacagcaacagctcaaagagcagaaaaagctcatagcaatgctggagaatggcctgggtttgcctccaggtatgtgggaactcctgggcggaccaaagcctgatagtcggatgcaagaattttttcagccccctccccctaggcctccgaacccacagaacgtaccttttagccaacgttctgaaatgatgaagaagccttcccaggctcctaaatatcgcaccgaccccgatagctttagagtagtcaaattaaagaggatacagcgaaaatctaggatgcctgaagcgcgtgaacccccagaaaagaccaatctgaaagacgtaatcaaaaccttgaagccggtgccacgaaaccggcccccccctctggtcgaaataactcctagagaccagctcctaaacgatatcaggcattcgagcgtggcctatctgaaacccgtgcagctcccaaaagagctcgcgtag

SEQ ID NO: 17286 - DNA, 330 bp, Artificial Sequence
  Description of Artificial Sequence: Synthetic coding sequence
atgaatcccgctagtgctcctcctccattgccacctcccgggcagcaggtcattcacgtgacccaggacctggatacggacttagaggcattattcaactccgtcatgaaccctaaaccgtcttcctggcgtaaaaagattctccctgagagctttttcaaagagcctgactcaggttcccactcaaggcagtcttctactgacagcagcggaggccaccccggcccacgtctcgctggaggggctcagcacgtgaggtcacatagttcccctgcatccctgcaactgggaacgggtgccggggccgccggtagcccagcccaacaatag

SEQ ID NO: 17287 - DNA, 609 bp, Artificial Sequence
  Description of Artificial Sequence: Synthetic coding sequence
atggggagccgcaaaaaggagatcgccttgcaggtgaacatctctacacaggagctgtgggaagaaatgctatcaagtaaaggcctcacagtagttgacgtatatcagggctggtgcggcccatgtaaacctgttgtcagcctctttcagaaaatgcgcatagaagtgggcctggacctactacattttgcacttgccgaagcagatcggctggacgtcctggaaaagtatcgggggaagtgcgagcccaccttcctgttttacgcaggcggggagctcgttgctgtggttaggggcgctaacgccccacttctccaaaaaaccattctcgatcagcttgaggccgagaaaaaagttttagctgaaggccgggaacggaaggttataaaggacgaagctctttcggacgaggatgaatgcgtcagccacggcaagaataatggagaggatgaagatatggtgagctcggaacgtacttgtactctggccatcatcaagccagatgcagttgcgcatggcaaaactgatgaaatcatcatgaagattcaagaagctggcttcgagatcctgaccaacgaagaacggacaatgaccgaagctgaggtttag

SEQ ID NO: 17288 - DNA, 195 bp, Artificial Sequence
  Description of Artificial Sequence: Synthetic coding sequence
atggccccgcaaaaagatagaaagccaaagaggtcaacatggcggtttaacctcgacttgactcatcccgtggaggacggtattttcgactccggcaactttggaacattcccttccgaatacttaggattctctagtctggtgctgcatttcttctgctttaagattggcgcaatctcaacgggggaaggctag

SEQ ID NO: 17289 - DNA, 372 bp, Artificial Sequence
  Description of Artificial Sequence: Synthetic coding sequence
atggagaacctgcagacaaacttcagcctggtgcagggctccactaagaaactcaatggcatgggagatgacgggagccctcctgcgaagaaaatgattactgacatccacgccaatggtaagacaatcaacaaagtgcccacagttaagaaggagcacctggatgactacggtgaagctcctgtcgagacagatggcgaacatgtgaaaaggacctgcacctcagtgcccgagactcttcatctcaatccaagcttgaagcataccttggctcagtttcatttgtccagtcagagcagtctgggcggccctgctgctttcagcgctcgccacagtcaggaaagtatgtcaccaacagtgtttttaccctag

SEQ ID NO: 17290 - DNA, 201 bp, Artificial Sequence
  Description of Artificial Sequence: Synthetic coding sequence
atgaaccctagtatgaagcagaaacaggaggaaataaaagagaacatcaaaaattcctccgtgcctcgccgcactttaaagatgattcagccatcggcgtcaggatccctcgtgggtcgggaaaacgagttgtcagctgggctttctaagaggaagcatcgtaatgatcacctcacctccacgaccagttccccagggtag

SEQ ID NO: 17291 - DNA, 1614 bp, Artificial Sequence
  Description of Artificial Sequence: Synthetic coding sequence
atggtgttgattcttggacgcagattaaatagggaggacttgggggtgagggattcacccgccactaagcgcaaagtcttcgagatggatccgaaaagtctgacaggccatgaatttttcgactttagttcaggatcttcacatgcagaaaatatcctgcagatattcaacgagtttcgcgattctcgcctcttcaccgacgtcattatttgcgtcgaggggaaggaattcccctgtcaccgagcagtattatcagcttgcagcagctacttccgggcaatgttctgcaacgaccaccgcgagtcccgggaaatgttggtcgaaatcaatgggatactggcagaagcaatggagtgctttttgcagtatgtgtatacgggcaaggtgaagatcaccactgaaaacgtgcagtacttgtttgagactagtagcttgttccagattagtgtattgcgtgatgcttgtgctaagttccttgaagagcaattggacccctgtaactgtctggggattcagcgctttgcagatacacatagcctaaaaacgctgttcacgaaatgtaagaactttgccctgcagacttttgaagacgtgagccagcacgaggaattcctcgaactcgataaagatgagttgatagactacatttgctccgacgagcttgtgatcggtaaagaggaaatggtctttgaggcagttatgaggtgggtctaccgggctgtcgacctccgccgtcccctgctacacgaactcctgacacatgtaagactgcctctgcttcatcctaactattttgtgcagaccgtcgaggtcgaccagctgatccagaatagcccagaatgctatcagctcctacatgaagccagaagataccatatcctgggaaatgagatgatgagtccccggaccaggcctagacggagtactggctacagtgaagtgatcgtggtcgtcggcggctgtgagcgggtgggtggattcaatttgccatacactgagtgttatgatccagtaactggggagtggaaaagccttgcaaagctgcccgagtttacaaaaagcgagtacgctgtctgcgcactgagaaacgatattctcgtctcaggaggccggattaactccagggacgtgtggatctataattcccagctaaacatctggatacgtgtcgcgagcttgaataagggccggtggcggcacaaaatggctgtgttgctcggtaaggtctacgtggtcgggggctacgacggacagaaccgactcagcagcgtggagtgttacgattctttcagcaacaggtggacagaagtggcacctctgaaggaggccgtctcatcccctgccgtgacctcctgcgtgggaaaactttttgtaattggagggggaccggacgacaatacctgttccgacaaagtgcaatcttatgaccctgaaaccaattcctggctcctccgggccgctattcccatcgcaaagcggtgcatcaccgctgtcagtttgaataatctaatctacgtggccggaggacttactaaagccatctactgctatgaccccgtcgaagactactggatgcacgtgcagaatactttctctcgacaggtgataacttag

SEQ ID NO: 17292 - DNA, 1611 bp, Artificial Sequence
  Description of Artificial Sequence: Synthetic coding sequence
atgaggctggaagaactgaagcggctgcagaatcccttggagcaagtcaacgacgggaagtactcgtttgaaaacatccagcgcgcatggagggaatatctccaaaggcaggaacctctggggaagaggtccccaagccccccaagtgtctcttctgaaaaattgagctctagcgtctcaatgaatactttcagtgattcttccacccccgactatagggaagacggcatggatcttggatcagatgccggctccagcagctctagcagtcgggccagctcacagtccaactcaaccaaggtgaccccttgcagcgagtgcaagagctcctcatcgcccggtggttccctggatctcgtgagcgcactggaagactatgaggagccttttcccgtgtaccagaagaaggtcatagatgagtgggcccccgaagaagatggcgaggaggaggaagaggaagacgagagggatcagcgaggataccgtgacgaccggtccccggctagagagcccggtgacgtctcggcccgcacgaggtccggcgggggggggggaagaagcgctacaaccgcaatgcccccaccagttccgaacggcaacctgcaccagcatgatccccaggacctgcggcataacggcaacgtggtagtggccggccgccccagttgtagccgcggacctaggagggctatacagaagccacagcccgcaggcggtcgacggagcggccggggtccggccgctggaggactttgtctccagccccctgacggtgggacctgtgtgcctgaggagcctcccgtgccacccatggattgggaagccctcgagaagcacctggcaggactccagttccgggagcaagaggtgaggaaccagggacaggcaagaactaattccacctcagcacagaaaaatgaacgcgaaagcataaggcagaaactggcccttggctcattcttcgatgatggacctgggatttatacttcatgcagcaagtccggaaagccttcgttgtcttctaggctgcagagcgggatgaatctgcagatttgttttgtcaacgattcaggttccgacaaagactcagacgcagacgactccaagaccgaaacgtccctggacacaccactgagtcctatgagtaagcagtcttcttcctattccgaccgggacacaactgaggaggagtccgagtctctggatgacatggacttcctcaccagacagaaaaagctgcaggcagaagctaagatggctttggccatggcaaagccaatggccaaaatgcaggttgaggtggagaagcagaatcggaagaagagccccgtggccgaccttttgccgcacatgccccacataagcgagtgccttatgaagcggtcccttaaacccaccgacctgagagatatgactattggacagctacaggtcattgtgaatgatcttcatagccaaatcgaatctttaaatgaagagcttgtacagctgctgctgatcagagatgagctccacactgagcaagatgctatgcttgtagatattgaggacctgacaagacacgcagaatcgcaacaaaagcatatggccgagaagatgcccgcaaaatag

SEQ ID NO: 17293 - DNA, 630 bp, Artificial Sequence
  Description of Artificial Sequence: Synthetic coding sequence
atgagtgagaacgcggctcccgggctgatctccgagctgaaactagctgttccatggggtcatatcgccgcaaaggcttgggggtcactgcagggccccccagtcttatgtctccatggttggctcgacaacgctagctcctttgacaggctgatcccattactgccacaggatttctactacgtcgccatggactttggcggacacggcttatctagccattacagccccggtgttccatactatctgcagacttttgtgagcgagataagacgtgtagtggccgccttaaagtggaatcggtttagcatcctcgggcatagctttgggggggtggttggcggtatgtttttctgcacatttcctgagatggtggacaaactcatacttctggacacacccctgttcctgcttgagtcagatgagatggagaacctccttacatacaaacgaagagctattgagcacgtcctgcaggtggaagccagtcaggaacccagccacgtcttttctttaaagcagctgctccagaggctcctgaagagtaacagtcacctttcagaggaatgcggcgaactcctgctgcaacgtgggaccacaaaggtcgctaccggacgtgagcagcactag

SEQ ID NO: 17294 - DNA, 201 bp, Artificial Sequence
  Description of Artificial Sequence: Synthetic coding sequence
atgccagaagatcaggtgggaaagctggaggccaccgaaaatacgatcagcgccatggcggcagcggctgctgagcaacagcagttttacctgctcctcgggaacctgctgtccccagataacgtggtgcgtaagcaggccgaggaaacttacgagaatattcctggccagtcaaaaatcaccttcctgctgcaagcatag

SEQ ID NO: 17295 - DNA, 2061 bp, Artificial Sequence
  Description of Artificial Sequence: Synthetic coding sequence
atggctatttctcagcaccagttctatcttgaccgcaaacagagtaaggcgaagatccctagtgcaagatccctcgatgaaatagccatggacctgactgagactggcacccagagagcgagtaagttggtgaccttagagactaaatcgcagttcataatggctagtaacggcagccttatctcttcgggatctcaagattcagaagttagtgaagagcaaaagagggaaaagattctcgaacttaagaagaaagagaagctgctccaggagaagctccttaaaaaagtggaggagctcaaaaaaatttgtctgcgggaggccgagctcactgggaagatgccaaaggagtaccctctaaacatcggcgagaaacccccgcaggtgcgtcgaagagtgggaactgcctttaaactcgatgataacttgctgccatcagaggaggatcctgcactgcaggagctggagagcaatttcctgattcaacaaaagctagtggaggcagcgaagaagttagctaatgagcccgacctgtgcaagaccgtcaagaaaaaacgcaagcaggattatacagatgcaatgaaaaaactccaggaaatcgagaatgccatcaacgagtatcgaatcaggtgtggcaagaaaccttcccagaaagctactgtactgccagaagacatcatcccatcagaatcctcatcacttagcgacacaaccacatatgatgacccaagcgatgctttcactttccccggtcagagatcgtcctccgtgccacacagccctagaattctgccacctaaatcattagggattgagaggattcattttaggaaatccagcattaacgaacagttcgtggacacccggcagagtagagagatgcttagcacacacagcagcccctacaaaacactggagcggcgtccacaagggggccgttctatgcccactacccctgtactcacacggaatgcatactcatcctcacatttggaacctgaatcatctagccagcattgccgacaaagatccgggtccctggagtcccagtcccatttattgtctgagatggatagcgataaacctttcttttccctctccaagagccaacgctcgtcttccactgagatattggacgacggtagttcttacacttctcagtcatccacagaatattattgtgtgacaccagttaccgggccatattacacaacccagacactggacacaaggactagagggagacggcggagcaagaagcagaatgtgtctacttccaactctggaagcatgcccaacttggcccagaaagacagtctcaggaacggtgtctactccaagagccaagaaccaccctcaagcagttattatatcgccggctatactccttacgcagagtgcgacttttattattctggcggctatgtctatgaaaatgacacagaggggcagtattcggtaaatccctcgtaccggagtagtgcgcactacggatatgaacgccagagggattactcgcggagctttcatgaagacgaagtcgatagagtccctcacaatccctacgcaaccctgcgtctaccccgcaaggctgccgctaaatctgagcatattaccaagaatattcataaagccctagtcgccgagcacctgagaggatggtaccagcgagcatccggccaaaaggatcaaggccacagcccccagacctcattcgatagtgatcgtggcagtcaaagatgcttgggctttgcagggcttcaagtgccatgctccccttccagcagagctagcagttacagcagcgtatcaagcaccaatgcctctgggaactggcggacccaactcactatcggcttgtctgattatgaaacacctgcacacagctcctacacttcctgctacggcaatgtgtataacccgttaccctcccccagccggcaatacaccgaaattagccaactcgatggtaccgatggcaaccagctggaggacaacctggaaagctcagagcaaagactattctggcacgaggatagcaaacctggaactctcgtgtag

SEQ ID NO: 17296 - DNA, 219 bp, Artificial Sequence
  Description of Artificial Sequence: Synthetic coding sequence
atgatggaggaaatctctattatggtggcatacgatgcacacgtcttttcccagctgcacgatgaagatttcctgacaagtctggttgcaattagcaagcccaggagcatggtgcctacaaagaagcttaagaaatacgagaaggagtaccagactatgcgagaatctcaactgcagcaagaggatccaatggaccggtacaaattcgtatacctatag

SEQ ID NO: 17297 - DNA, 1965 bp, Artificial Sequence
  Description of Artificial Sequence: Synthetic coding sequence
atggactcactgcccgatgaattctttgtacggcatcccgccgtcgaagaccagaggaaggaggagaccgagaacaagctggagaaaagcagcggccagttgaacaagcaagaaaatgacatcccgaccgatctggtgccagtgaacctcctccttgaggtgaagaagttactgaatgcaataaataccctaccaaagggcgtggtaccacacatcaagaagttcctgcaggaggatttcagcttccagactatgcaacgggaggtcgccgccaacagccagaacggtgaagagatcgtgccagccctgactctacgattccttatcacacagcttgaggcagctctccgtaatatccaggcgggcaactacacagcccaccaaattaacattgggtactatcttacattgctctttctatatggagtagcacttactgagcgtggcaagaaggaggactatacagaggccgagaataagtttctggttatgaaaatgatgattcaggagaacgagatttgcgagaactttatgtctttggtgtatttcggccgcggtctgctcagatgcgcacagaaacgctataacgggggattgctggagttccacaaatctttgcaggaaatcggagacaagaatgatcactggtttgacattgatcccactgaagatgaagatctccccaccacgttcaaggatctactgaataattttataaagaccaccgagtccaacatcatgaagcagacaatttgctcctacctggattgtgagcgttcttgtgaagcggatattctcaagaacacctcctataagggattcttccagctgatgtgctcaaagtcctgctgcgtttactttcacaaaatttgttggaagaaatttaagaacctcaaatatccgggagaaaacgaccagtcttttagcggcaaaaagtgcttaaaagaggggtgtaccggggacatggtgcgcatgcttcaatgcgacgtgcccggaattgtaaagattctcttcgaagtggtccggaaggacgagtatatcacaatcgagaacctgggcgcttcttacaggaagctcatttcgctcaaaatcaccgataccgacatccgacctaagatctctttgaagtttaatacaaaagatgagatgccaatcttcaaattggattataattatttttaccatctgctccacattatcattattagcggaactgacatcgtgcgccagattttcgatgaggcaatgcctccgcccttactgaaaaaggagctgttgatccacaaaaacgtcttggagtcctattataaccacttgtggacaaatcaccctctgggagggtcctggcatctcctgtatccgccaaataaggagctgccacagtccaaacagttcgacctgtgcctgttgctagccttgattaagcacctgaacgttttcccagcccctaagaaaggttggaacatggagccaccctcttccgacataagcaagtccgccgacatcctacgtctgtgcaagtaccgagatatccttctgagtgaaattcttatgaacgggctcactgagtcccagtttaactcaatttggaaaaaagtgtcagacatcctgctgaggttgggaatgatgcaggaggacattgataaagtgaaagaaaaccctattgagaatatatctctagattatcaccagctgtcagtatatctggggattccagtgccagagattatccagcggatgctgtcctgttaccagcaggggatcgcgctgcagtccattactgggtcacagcggatcgaaatcgaagaactccagaacgaagaggaggagttgtcaccccctctcatggagtataacattaatgtgaaatcccatccagaaatacagtttgccgagattaacaaagatggcacatctataccatctgaatcatcaactgagagcttgaaggaccttcaggagtag

SEQ ID NO: 17298 - DNA, 570 bp, Artificial Sequence
  Description of Artificial Sequence: Synthetic coding sequence
atgaatcccgccagcgcaccaccacccctccctccacctggccaacaggtgatacacgtgacccaggacttggacacagatctggaggcactgttcaatagtgtgatgaaccccaagccaagctcgtggcgcaaaaagatcctgccagaaagtttttttaaggaacccgattctggatctcactcaaggcagtccagcacagactcttcggggggacatcctggaccacgcctggcaggcggggcccagcatgtgcgcagtcatagttcccccgcaagcctgcagctcggtacaggtgccggcgccgctggctcccccgcacagcagcacgctcacctgcgtcagcagagctacgatgtcaccgacgaactgcccttgccaccagggtgggagatgacctttacagcgactggacagcggtacttcctcaaccatattgagaaaataacaacatggcaggatcctcggaaggccatgaaccagcctttgaaccacatgaacctccaccccgcggtgtcatcgacaccagtcccacaaaggtccatggccgtttctcagcctaacttatag

SEQ ID NO: 17299 - DNA, 849 bp, Artificial Sequence
  Description of Artificial Sequence: Synthetic coding sequence
atgggacctctcccccggaccgtggagctgttctacgacgtgctgagtccctacagctggctcggcttcgaaattctctgccgctaccagaatatatggaacatcaaccttcagctaaggcccagtctcattaccggcatcatgaaggacagcggaaataaaccccctggactactccctagaaagggtttgtatatggcaaacgacctaaaattgcttagacaccatttacagatacccattcacttccctaaggatttcctgtcggtgatgctagagaaggggtccttgtcagctatgaggttcctgaccgccgttaatctcgaacatcctgagatgctcgaaaaagcctccagagaattgtggatgcgagtttggtcgcgtgtgagcgtgggcctctgggagtcttcaggtaggaccctagatgattttctgacatttcccagacacgttttcagagtgatgattctgcccccacccgggggatcgaccgtgctgcctgtgacccccctttccccacaccggcttcctgctgtgttcagtagctcacaaaacgaggatatcaccgagccacagagcatattagccgctgctgagaaagccgggatgtcagccgagcaggcgcagggactgctggagaagattgctacccccaaggttaaaaaccagctcaaggaaacaaccgaggccgcttgccggtacggagctttcggactgccaattacagtggctcacgttgacggtcagacccatatgcttttcggctccgatcgtatggagttgctggctcatcttttgggggagaaatggatgggtcccattccgcccgcagttaatgctaggctgtag

SEQ ID NO: 17300 - DNA, 1221 bp, Artificial Sequence
  Description of Artificial Sequence: Synthetic coding sequence
atggatcagttggagaacgccaaaatggagcatacaaatgccagttttgacacattcttctgtgagaccagggcaggaaaacacgtccctagggcactctttgtcgacctggagcccacggttatcgatggcattcgaacagggcagcatcggtcactgttccacccagaacaacttttgagcggcaaggaggatgctgccaacaattatgcccgcggcaggtactcagtcggctcagaagtgatcgatcttgtactggagagaactaggaaactcgctgaacagtgtggggggcttcagggctttcttattttccggtcttttggaggggggactgggagtggattcaccagccttttgatggaaaggctcactggcgagtatagtcgcaaaaccaaactggaatttagcgtctacccggcgcccagaattagtacggcagtcgtcgagccgtacaacagcgtccttactactcacagtacaacagagcacacagattgcacatttatggtggataatgaagccgtgtacgacatctgtcacagaaagctgggggtggaatgcccaagccacgctagtatcaatcgcctggtggtccaagtggtctcatctattacagcctctttgagattcgaaggaccgctcaacgtagacctaattgagttccagacaaacctggttccttacccgcgaatacatttccctatgacagcctttgctccaattgtctccgccgacaaggcttatcacgaacagttctccgtgtccgacattaccaccgcctgtttcgagagttccaatcagcttgtgaaatgtgaccctagactcggtaagtacatggcatgttgcctgctgtacaggggggacgtcgtccccaaggaagttaatgccgcaatcgccgcgaccaaaagccggcattcagtacagttcgttgactggtgcccgaccggtttcaaggtcggtattaataacagaccacctactgtgatgcctggaggagatctggccaaagtgcaccgaagcatctgtatgttgtcgaataccactgctatagtcgaagcctgggctcgtctcgatcataagtttgatctgatgtatgccaaacgagcgttcttgcactggtatctgcgcgagggaatggaagaggctgaatttctggaggcaagagaagatctcgccgctctcgagcgagactacgaggaggttgcccagagcttctag

SEQ ID NO: 17301 - DNA, 1860 bp, Artificial Sequence
  Description of Artificial Sequence: Synthetic coding sequence
atgtccggcttggtgctaggtcagcgtgatgaaccggctggccaccggctgtcacaagaagaaatactgggcagtactcgccttgtctctcaggggctcgaagccctccgaagtgagcaccaagccgtcctgcagagcttatcccaaaccatcgagtgtctccagcaagggggacacgaagagggccttgtgcatgaaaaggcccgccagctcagacgctcaatggagaacatcgaactcggactatcagaggcacaggttatgctggccttggccagccacctgtcaaccgtcgagtcagagaagcagaaactgagagcccaggtgcgacggctttgccaagaaaaccagtggctgcgagacgagctggccggtactcagcagagacttcagcgtagcgagcaagccgtcgcgcagctcgaggaagagaagaagcatttggagttcctcggtcagctgaggcaatatgacgaggacggacacacttctgaggagaaggagggcgatgctactaaggactccctggacgatctgttccctaacgaggaagaggaagatccttcaaatggcttgtcacgcggtcagggggctactgctgcccagcagggcggatatgagatccctgcccggctaagaaccttacataacctagtgattcagtacgcagcccaagggagatatgaggtcgctgtcccattatgcaagcaggccctggaagatttggaacgaacttctgggcgggggcatcccgatgtggcgacaatgttgaatatcttggccttggtgtacagggaccagaacaaatataaggaggctgctcacttactcaacgacgctctgtcaatacgcgagtcgaccctgggcccagaccacccagctgtggccgctacccttaataaccttgcagtgctgtacggcaagagggggaaatataaagaggccgaacccctgtgccaaagagccctggagattagagagaaagtactgggcaccaaccaccccgatgtggccaagcagcttaacaatctcgcactgctgtgtcaaaatcaggggaaatacgaggccgtggagaggtattatcagcgcgcactggcaatctatgaaggacagttgggacccgacaatccaaacgtagctcgtacaaaaaataatctggcctcgtgctatctcaagcaagggaagtatgctgaagctgagaccctatacaaagaaatcctgacacgggcccatgtgcaagagttcggctctgtggatgacgatcacaagccgatctggatgcacgccgaagagcgtgaggagatgtcaaaaagtcgtcaccacgaaggtgggactccctacgccgagtatggcggttggtacaaggcctgcaaagtctcgtcccctacggtcaatacaactctgcgcaacctcggggccctctatcggcgccaggggaaattggaggccgcagagacactggaagagtgcgcccttcggagcaggagacaaggaacggaccccatctctcagacaaaggtggcggaactgctgggggagtcggacggccggagaacctctcaggagggacccggcgactcagttaaattcgaaggtggagaggacgcctctgtggcggtggaatggagcggcgacggaagcggcacactccagcgctccggatctctgggaaagatccgggatgtccttaggcggtcctcggaattgttagtcaggaaactccagggcacagaacctcgtcctagcagctctaatatgaagcgcgctgcctctctgaattacttaaaccagcctagtgccgcccctctgcaggtctctagggggttgagcgcgtccacaatggatctcagttcatcatcctag

SEQ ID NO: 17302 - DNA, 294 bp, Artificial Sequence
  Description of Artificial Sequence: Synthetic coding sequence
atggggaaaagttgcaaagtggtcgtctgtggtcaagctagtgttggaaaaacctctattttggagcagcttctgtacggtaaccatgtcgtgggctccgagatgatcgaaacgcaggaggacatatacgttggaagcatcgaaacggacagaggggtaagggaacaaatagccgagtcactgttctctgtttggtcttgcagtagacggcggcttacgaatccaaggacaaggaggaggtcccctagctggtccttggctaccagcgtcacctatagaagcagtggtgtatag

SEQ ID NO: 17303 - DNA, 387 bp, Artificial Sequence
  Description of Artificial Sequence: Synthetic coding sequence
atgactgacctggtggctgtatgggatgtggctttgagcgacggggtccataaaatagagttcgagcacggaaccacatccggtaaaagggtggtctacgtagatgggaaggaagaaatcagaaaggagtggatgttcaagctcgtcggcaaagaaacattttatgttggtgccgctaaaaccaaggctacaataaacattgatgctatctcaggctttgcctatgagtataccctggaaatcaatgggaaaagcctcaaaaagtacatggaagataggagcaagacaacaaacacctgggtgctccacatggatggagaaaactttcgcatcgtgctagaaaaggacgcgatggatgtgtggtgtaacggaaagaagctggagtag

SEQ ID NO: 17304 - DNA, 879 bp, Artificial Sequence
  Description of Artificial Sequence: Synthetic coding sequence
atgaccgtgtctaaattcatggcgatccaaaaggccctccagcctgactggtttcagtgtctttccgatggagaagtttcttgcaaagaggctaccagtatcaagcgagtcaggaagagcgtggatcgctctctgttatttctcgacaattgcctcagactccaggaagaatctgaggtgctgcagaagagcgtaattatcggtgtcatcgaaggaggcgacgtcatggaagagcggctaagaagcgcacgggagacggcaaaaagaccggtgggggggtttctgctcgacgggttccagggcaatccaaccactttagaggccagattgcggctgctcagctccgttacagcggaattgcccgaagataaaccgaggctcatatctggcgtgtctcggccagacgaggtgttggaatgtattgaacggggggtggacctatttgaaagcttctttccataccaagtcactgagagggggtgcgccctaacgttttcttttgactaccagcctaaccctgaagagactctcctgcagcagaatggcacccaagaagaaatcaagtgcatggaccagatcaagaagatagaaaccactgggtgcaaccaagaaattacttcctttgagataaatcttaaggagaagaaataccaggaagacttcaatccgctggtaagggggtgcagctgctattgctgcaagaaccacacacgggcttacatccatcatctgctggtgacaaatgagcttctggctggggtcctactgatgatgcacaacttcgagcactacttcgggttcttccattacatcagagaggccctcaagagcgataaactggcgcagctcaaggagctgatccaccgccaggcttcctag

SEQ ID NO: 17305 - DNA, 600 bp, Artificial Sequence
  Description of Artificial Sequence: Synthetic coding sequence
atgcggtttaggttttgcggagacctcgattgcccagattgggtgttagccgagatctcaacgctagctaaaatgtcctcagtgaagctgaggctgctctgttctcaggtgctgaaagaactgctaggccaggggatagactacgaaaagatcctgaagcttaccgcagatgcaaagtttgaaagcggggatgtgaaggccactgtcgccgtcctcagcttcatcctctcatccgcagccaaacacagcgtcgacggcgagtccctgagctctgaactgcagcagctgggtctgcctaaagagcacgcagcatccttgtgcagatgttatgaagagaaacaaagcccactccagaagcacctgcgggtgtgctcacttcggatgaatcgactcgctggcgtcggatggagggtcgactatactcttagctcttctctgctgcagagtgtggaagagcctatggtacaccttcgtctagaagtggccgctgcacctggtacgccagcacaacccgtggcaatgtcactgagtgctgacaaattccaggttttacttgctgagctgaaacaggcacagacactgatgagcagcctcgggtag

SEQ ID NO: 17306 - DNA, 354 bp, Artificial Sequence
  Description of Artificial Sequence: Synthetic coding sequence
atgcccgaggatcaggtgggaaagttagaagctaccgaaaataccatcagtgcaatggctgcggccgccgccgagcaacagcagttttacctgctcctcggaaacctcctttctcctgacaacgtggttcgtaagcaggccgaggagacctacgaaaatattcccgggcagtcaaagattacctttctgttgcaagccatcaggaacactaccgccgcggaagaggcgcgacagatggccgccgtcctgctgagacgcctgctgtcatccgcatttgacgaggtgtatcctgccctcccgtccgacgtgcagactgcaattaagagcgagctcctgatgatcattcagatgtag

SEQ ID NO: 17307 - DNA, 888 bp, Artificial Sequence
  Description of Artificial Sequence: Synthetic coding sequence
tgaacgaagctggctacggggtccaaagacaccaccgtgatcatctggcaggtggatcctgacacccacctgttgaagctgctgaaaactttggaaggccatgcatatggcgtgtcctacattgcctggtccccagatgacaactaccttgtagcctgtgggccggacgattgcagcgagttgtggctctggaacgtccaaacgggggaactacggacaaagatgtcccagtctcatgaagattctctgacatcagtagcgtggaatcctgatggtaaaaggttcgttaccggtggccagagggggcaattctaccagtgcgatctggacgggaatctgctcgattcatgggaaggggtccgcgtccagtgtctctggtgtctgtcagatggaaagaccgtcctagcatctgacacacatcaacggatcagggggtacaacttcgaagacctgacggacagaaacatagtgcaggaagaccacccaatcatgtccttcacaataagtaaaaatggtcggctggcacttctcaacgtcgccactcaaggcgtgcacctctgggatctgcaggatcgggtgctcgttagaaaataccagggtgtcacacaaggcttttacacaattcattcttgttttggcggacacaatgaggactttattgcatccgggagcgaagaccacaaggtttatatctggcataagagaagcgaattgccaatcgccgagcttaccggccatacgaggacagtgaactgcgtgtcctggaacccacagattccctcaatgatggcctccgcgtcagacgacggaacagtgcgcatctggggcccagcaccctttattgatcaccaaaatatagaagaggaatgcagctccatggattcttag

SEQ ID NO: 17308 - DNA, 1053 bp, Artificial Sequence
  Description of Artificial Sequence: Synthetic coding sequence
atggcgcgttggatccccaccaaaagacagaaatacggggttgccatctacaactataatgctagccaagacgtcgagctttccctccagatcggggataccgtgcatatcttggagatgtatgagggatggtatagaggatatacactgcagaacaagtctaagaagggaatctttcctgaaacatacatccatctgaaggaagctactgtggaggacctcggccagcacgagacagtgatccccggggagctccctctggtacaggaactgactagcacactgcgtgagtgggctgtgatctggagaaagctgtatgtgaacaataagctgaccttgtttcgtcagctgcagcagatgacttatagcctcatcgagtggaggtctcagatccttagtggaacattgcccaaggacgaactggcagagctgaagaagaaggttacagccaaaatagatcacggcaacaggatgctggggctagatctcgttgtccgagacgacaatgggaatatactagatcccgatgaaacgagcactattgccctgtttaaggcccatgaagtggcttcgaaacgcatagaagagaagattcaagaggagaaatctatactgcagaatctggatctccgggggcagtctattttttcaactatccacacctatggcctgtatgtgaacttcaagaacttcgtttgtaatataggagaggacgctgagcttttcatggccctgtacgatcccgatcaatctacattcatctccgagaactacctgataaggtggggatccaatggcatgcccaaggagattgagaagctgaataatctccaggctgtgtttacggacctcagcagtatggacctcattaggccccgcgtcagtttagtctgccagatcgtgcgtgtcggccacatggagctgaaggaggggaagaaacacacatgcggcctgcgcaggccctttggcgttgccgtaatggatatcactgacatcatccacggtaaggtggacgacgaggagaagcagcatttcatccccttccagcagtag

SEQ ID NO: 17309 - DNA, 360 bp, Artificial Sequence
  Description of Artificial Sequence: Synthetic coding sequence
atgccggaggatcaggtgggtaagctggaagccaccgagaacaccatctcagcgatggcagcagctgcggctgagcagcagcagttctatctgcttctcggcaatctactcagtcccgacaatgtggtgagaaaacaggctgaggagacatacgaaaatatcccaggacagtccaagattacgttccttctacaggcaattagaaatacgacagctgctgaggaggcaagacagatggccgccgtccttctgaggcgtctcctcagctccgcttttgatgaagtgtatccagcgctgccatccgatgtgcaaacagccattaaatctgagctgcttatgattatacagatggaaacatag

SEQ ID NO: 17310 - DNA, 279 bp, Artificial Sequence
  Description of Artificial Sequence: Synthetic coding sequence
atgtccgggctcgtgcttggtcagagagatgaacccgcaggccatcgcctgagtcaagaagagatactcgggtccactcgcttggtgtcccagggcctggaagccctccgctctgagcaccaggccgtactccagagtctgtctcagactatagaatgtctacagcagggtggacatgaggagggtctggtgcacgagaaggcccgccagctgagacggagcatggagaacatcgagttagggctctccgaggcccaggtgatgctggcgcttgcctag

SEQ ID NO: 17311 - DNA, 405 bp, Artificial Sequence
  Description of Artificial Sequence: Synthetic coding sequence
atggtgctgatcctgggtagaagactgaacagagaggatctgggggtgcgagatagcccggctacaaaacgaaaggtgttcgaaatggatcctaagtccctgacgggtcatgagttcttcgatttctccagtggctcctcgcacgccgagaatatcctgcagatttttaacgagttccgggattccagattgtttactgatgtaatcatctgtgtggagggtaaggaatttccttgtcaccgcgccgtgctatcggcatgcagtagttatttccgtgctatgttttgcaatgatcaccgggaaagccgtgagatgcttgttgagatcaacggaatcctcgcagaagccatggaatgttttctgcagtatgtttatacaggaaaggtcaaaataacgactgagtag

SEQ ID NO: 17312 - DNA, 312 bp, Artificial Sequence
  Description of Artificial Sequence: Synthetic coding sequence
atggcagagctgatccagaagaaactgcagggtgaagttgagaaatatcagcagctgcagaaggacctgagtaagagcatgagcggacgacaaaagctggaagctcagcttacagagaataacattgttaaggaagaactcgcgttgctcgacggttccaacgtggtgtttaagttactcggccccgtcttggttaagcaagagttgggagaagcccgcgcaactgttggcaagcggctcgactacattacagctgagattttcttaagaaccatcccagatcctggagatgtccccgatagtttcttctag

SEQ ID NO: 17313 - DNA, 1923 bp, Artificial Sequence
  Description of Artificial Sequence: Synthetic coding sequence
atggggaggagatccggcctgctgggactgaggccaggaccggaacccgtggctctggagagagttataaacaaggtccatctgaaggcaaaccacgtggtgaagcgagacgtggatgaacacctcagaattaagacagtttatgacaagagtgtagaggaactgctgcccgaaaaaaaaaatttggtcaagaacaagcttttccctcaagcaatctcatacttggaaaagaccttccaggtcagaagacccgctggaaccattctgctgagtcgtcagtgcgccactaaccaatatctgcgcaaggagaacgacccccaccgttactgtaccggcgagtgcgccgctcatacaaagtgcgggcccgtgatcgtgcctgaagagcatctgcagcaatgtcgggtctacagggggggtaagtggcctcatggcgccgttggtgtaccggaccaggagggtatctccgacgccgatttcgtactatacgtgggagctctggcaaccgaacgatgttctcacgaaaacatcatctcctacgcggcttattgccagcaggaggcaaacatggatcggcctatcgccggctacgccaacttgtgccctaatatgatctccacccaaccacaagaattcgtagggatgctctctaccgtgaaacacgaggtgattcatgctctgggattttctgccggtctgttcgctttttaccatgataaagatggaaatccgctcacatctagattcgccgatggtctgcccccattcaattacagcttaggcctctaccagtggagcgataaggtcgtgcggaaagtggaacgcttgtgggacgtgagagataacaagatcgttaggcacaccgtgtatctgctggtcacaccaagagtcgtcgaagaggcgcgcaagcattttgactgccctgtcctggagggtatggaattggaaaaccaaggcggggtgggcaccgaactgaatcactgggaaaagcgactgttggaaaacgaggcaatgaccggatcccacacccaaaatcgcgtgctctccaggattactctggctctcatggaagataccgggtggtataaggccaactattccatggctgaaaagctggattggggccggggcatgggatgcgactttgtgaggaaaagttgtaaattctggatcgaccagcagaggcaaaagcgccagatgctatccccttactgcgacacactgcgatcaaacccactgcaactgacctgtcggcaagaccagcgggccgtggctgtctgtaacctacaaaaatttcctaaaccactgccgcaggaatatcagtattttgatgagctgtctggcattcctgcggaggacctcccttattatggaggcagcgttgagattgctgattactgcccattctcccaggagttctcatggcatctgtcaggcgaataccagcgctcatccgactgcagaattctggaaaaccagccagaaatctttaaaaactacggtgctgagaaatatggacctcactctgtgtgcttaatacagaagtccgcttttgtgatggagaagtgtgagagaaaactctcataccctgattggggctccggatgttatcaggtatcgtgctcaccgcaaggcctcaaggtctgggtgcaggacacgagttatctgtgctccagggctggacaggttctgccagtgagcatccagatgaacgggtggattcatgatggcaacctgctctgtccgtcctgctgggacttttgtgaattatgtcctccggagacggatcctcctgcgacaaacctgactcgggccctccctttagacctgtgttcctgttctagttccctggtggtgactttatggctgcttcttggaaacttattccccctgctggccggtttcttactctgcatatggcattag

SEQ ID NO: 17314 - DNA, 783 bp, Artificial Sequence
  Description of Artificial Sequence: Synthetic coding sequence
atgaaccttgactctgatggtatggacgacataatatcacaggaatccagcctcgatatggaaggtaactacaagaaagcccaaaaaaatgaaagggagtctatacgccagaaacttgcccttggatccttttttgatgatggccctggaatctacacatcgtgctctaagtcagggaagccgagcctgtcctcacgactacaatccggaatgaacctgcagatatgtttcgtgaatgactctggcagcgacaaggactcagacgctgacgactcaaagaccgaaacaagtctggacacccctctgtctcctatgtccaagcagtccagcagctatagtgaccgagataccaccgaggaggaaagcgagtctctcgacgacatggattttctaacacggcagaagaaactccaggccgaagccaaaatggccctggcaatggcgaaacctatggccaagatgcaggtggaggtggagaaacagaatagaaagaagtcccccgtggcagacctgttgccccacatgccccacatttccgagtgcctgatgaaacggagcttaaaacctactgatctgcgagacatgaccattggccagctgcaggtaatcgtgaacgacctccattcacagatcgaatccctgaacgaagaactggtgcagctgttgcttatcagggatgagctccatacagaacaggacgcaatgctcgtggatattgaagatctgacaaggcacgcagagtcccagcagaagcatatggccgaaaagatgcctgctaagtag

SEQ ID NO: 17315 - DNA, 633 bp, Artificial Sequence
  Description of Artificial Sequence: Synthetic coding sequence
atggccgcatctgtcgaacagagagagggcaccattcaggtgcagggccaggccctgtttttcagggaagctctgcctgggagcggtcaggcccggttcagcgtcctcctcttacacggcatccgtttcagctcagaaacttggcagaacttgggcactctacatagactggcccaggcaggctatcgggctgtggctatcgatttacctggcctggggcactccaaggaagccgccgctcccgcgccaataggtgaattagcacctgggtctttcctcgcagccgtggtggacgccctcgaactcgggcctccagtggttatttctcctagcttatcaggcatgtattctctgccattcttgactgccccgggttctcagttgcccgggtttgtgcccgtggcgccaatttgcaccgataagataaatgccgccaactatgcctccgttaaaacccccgcccttattgtttatggcgaccaggatccaatgggccagaccagtttcgaacatctgaaacaactccccaatcaccgggtactgataatgaaaggagcaggccacccgtgctacctggataagcccgaggagtggcatacaggactgctggatttcttgcaggggcttcagtag

SEQ ID NO: 17316 - DNA, 381 bp, Artificial Sequence
  Description of Artificial Sequence: Synthetic coding sequence
atgaaccagagatcgcacctgggaacgacttatctcgacactgctaaaggggcggttgagacatttatgaagctccgggcccgtgaccccgcctccagaggagaccggtatatgcttgtgacattcgaggaacccccttacgctatcaaggctggatggaaggaaaatcacgcgactttcatgaatgaactaaaaaatctgcaggccgagggactaacaactctggggcagagcctcagaacagccttcgacctgctaaacctgaatcggttggtgaccgggatagacaattatggccaggggagaaacccgttctttctagagcccgcaataattatcacaattaccgatggatcaaagctcactactacatcagggtag

SEQ ID NO: 17317 - DNA, 1188 bp, Artificial Sequence
  Description of Artificial Sequence: Synthetic coding sequence
atggccaatgaccctttggagggcttccacgaggtgaacctcgcctctcctactagtcccgatcttctcggcgtctatgaaagcggcactcaggagcaaactacctccccaagcgtgatttataggccccacccctccgcccttagctccgtgccaatccaggccaacgccctggacgtatccgaactccccacccagcccgtgtactctagcccgcgacgtcttaactgcgctgagatatccagtatctcttttcatgtgacagaccccgcaccatgttccacttctggagtcaccgctggcttgacaaaattgaccactcgcaaggataactataatgctgaaagggagttcttgcaaggagctaccattaccgaggcctgtgatggcagcgacgacattttcggactcagcactgatagcctcagcagactgagatctccttcggtgcttgaggtgcgggaaaaagggtacgaacgcctcaaggaggaactggccaaggcgcagcgagagctgaagctgaaggacgaagagtgcgagcgcctgagtaaggtcagagatcagctgggccaagagcttgaagagttgacagcttccttgttcgaggaggctcacaaaatggtccgagaggctaacattaagcaggctaccgccgagaaacagctgaaggaggctcagggaaaaatcgacgtgctgcaagctgaggtagccgccctcaagacactggtgctgtcaagttctccaacctcacccactcaggaaccactccccggtggcaagacccccttcaagaaggggcatactcgaaataaaagcacatcttcagcaatgagtggatcacatcaggacttatcggtgatccagcccattgtcaaagactgtaaggaagcggatctgtcactctacaatgaatttagattgtggaaagacgagccgacaatggataggacctgcccgttcttggataagatatatcaggaggacatctttccctgcctgaccttctcaaaaagtgagctggcatctgccgtcctggaggcggtggagaataatacgctgtccatcgagcctgttggtctgcaacctatccggttcgtcaaggcaagcgcagtggagtgcggggggcccaagtctttactctacgtgaccttccttcacacatttgatacattctccagagactcttag

SEQ ID NO: 17318 - DNA, 786 bp, Artificial Sequence
  Description of Artificial Sequence: Synthetic coding sequence
atgggcagcagaaaaaaggagatcgcactgcaggttaatataagtacacaagaactctgggaggagatgctgtcttctaagggactgacagtcgtcgatgtttatcagggctggtgcgggccttgcaaaccagtcgtgagcctcttccagaagatgagaatcgaggtgggccttgatctcctccatttcgccctaataaaggatgaggctctctcagatgaggatgagtgcgtttctcacggaaagaacaatggagaggacgaagatatggtgagctccgagcggacatgtactctagcaataattaaacccgatgcggttgcccatgggaagaccgatgagatcatcatgaaaatccaagaggcgggtttcgaaattctaaccaatgaggaaaggactatgaccgaagcagaggtaagactgttttaccagcacaaggctggagaagaagctttcgaaaagctggttcaccatatgtgcagcgggccatctcatctgttgatattgacccggaccgaggggtttgaggatgtggttactacatggcgcactgtcatggggccccgcgatccaaacgtagccaggcgcgaacagccagagtcccttcgggcccaatacggtactgagatgcccttcaacgctgtccacgggagcagggaccgggaagatgccgatagagaacttgccctgctatttccctctctcaagttctccgacaaagacaccgaagccccacagggagagagctctactcagccccgcttgaagatcaccgacctcgactag

SEQ ID NO: 17319 - DNA, 1284 bp, Artificial Sequence
  Description of Artificial Sequence: Synthetic coding sequence
atggtatgttggcaggatctggaggagagccttaggatgaaactgagccttacgaaggtagttaatggatgtcgtttgggaaaaatcaaaaacctcgggaagactggcgatcacaccatggacattcctggatgtctgctgtacacgaaaacagggtctgccccccatttgacacatcataccctacacaatatccacggtgtccctgccatggctcagttgactctgtcttccttggccgaacaccatgaagtgctgacggaatacaaggaaggggtcgggaaattcatcgggatgccagagtcattgttgtactgttccttgcacgatccagtgtctccttgccctgccggatacgttaccaataaatcagtgagcgtgtggtcagtggctggacgggtggagatgacagtatcgaaattcatggccatacagaaggccctgcagcctgattggtttcaatgtcttagcgacggcgaagtttcttgtaaggaagctacctcaattaagcgcgttagaaaatctgtggaccgctccctgctgtttcttgataactgcctgcgactacaagaggagagcgaagttctgcagaagtcagtcatcatcggggtgattgaaggcggcgatgtaatggaagagcggctgcgcagcgctcgggaaacagccaaacgccccgtgggtggattcctgttggacggcttccagggaaatcctactacccttgaagctaggctgagactcctgtccagcgtgactgctgagttgcccgaagataagcctaggcttatcagcggggtctctagacccgatgaagtactggaatgcatcgaacgcggagtggatctgttcgagtccttctttccatatcaggtgactgagcgcggctgcgctcttactttctcttttgattaccagcctaatcctgaggagacactcctccagcagaatggcactcaggaagagattaagtgcatggaccagattaaaaaaatagaaaccacgggctgcaaccaggagattacttcatttgagatcaacctcaaggagaagaagtaccaggaagacttcaatcctctagtgaggggatgtagttgctactgctgcaagaaccacacaagggcctacattcatcatctgctggtaacaaatgaactgctcgctggcgtgctgctaatgatgcacaactttgaacactacttcggcttctttcactatatcagggaggccttgaagtccgataagctggcccagctcaaagaactgatccacaggcaggcgagctag

SEQ ID NO: 17320 - DNA, 393 bp, Artificial Sequence
  Description of Artificial Sequence: Synthetic coding sequence
atgaaccagagatcgcacctgggaactacatacctcgacactgcaaaaggtgccgttgagacgttcatgaaactacgcgcccgcgaccccgcctcaaggggcgacaggtacatgctggtcactttcgaggagcccccctacgccatcaaggctgggtggaaagaaaatcatgctacttttatgaatgagttaaaaaacctgcaggccgaaggtctgactaccctgggccagagcctcaggaccgcgtttgaccttcttaatcttaatcgcctcgtcactggcatcgataactatggacagggaaggaaccccttttttctggaacctgccatcatcattactattacggatggctcaaagttgaccacgaccagtggtgttcaggacgagtag

SEQ ID NO: 17321 - DNA, 417 bp, Artificial Sequence
  Description of Artificial Sequence: Synthetic coding sequence
atgaacccagcatccgcaccgccacccctgcctcctcctggccaacaagtgatccacgtcacccaggatctggatactgacctcgaagccctattcaacagtgttatgaatcctaagccctcctcctggaggaagaagatcctgcctgagtcgttcttcaaagaaccagatagcggcagtcacagtcgtcagtcctcaactgatagctctgggggacaccctgggccacgcctggccggtggggctcagcacgtacgatcccactccagccccgcgagtttacagttaggcacgggcgccggtgctgccggtagccccgcccagcagcacgcgcacctgaggcagcagtcatacgatgtcaccgacgagttgccactgcccccgggttgggaaatgacttttactgcgactgggtag

SEQ ID NO: 17322 - DNA, 1692 bp, Artificial Sequence
  Description of Artificial Sequence: Synthetic coding sequence
atgcggctggaggagcttaagagacttcagaaccccttggagcaggtcaatgatggcaaatattcatttgagaaccaccaattggctatggatgccgaaaacaatattgagaagtaccccctgaaccttcaacctctggagagcaaggtgaagatcatacagagggcctggagggagtatctccaaagacaggagcctctgggcaagagatctccctccccgccttccgtgtcttcagagaaactgagtagctccgttagcatgaataccttctctgactcatccacaccagactatcgcgaagatggtatggacctgggatccgacgctggctcaagttctagcagctctcgggcttcctctcagtcgaattctacgaaagtgaccccttgctctgaatgcaagtctagctctagcccgggggggagtctggatttggtctctgcgctagaggactatgaggagccatttcctgtgtatcagaagaaagtgattgatgagtgggccccggaagaggacggagaggaggaggaggaggaggatgaacgggaccagcgcggatatagggatgaccgctcgcccgcgagagagcccggcgacgttagcgcacgcactcggtccggagggggaggcggccgcagcgctaccacagctatgccacctcctgtgccaaacggcaatctgcatcagcacgatccacaggatctgcgacacaacggcaacgtggtagttgccgggcgaccatcatgttccagagggccccgcagagccattcaaaagccccagcctgctggaggtagacgctctggcaggggccccgcagccggaggcctctgtctgcaacccccagacggaggcacctgcgtgccagaggaaccaccagttcccccgatggattgggaagccctcgaaaaacacctagcgggtttacagttcagagaacaggaagtgcgcaatcagggacaagcaagaactaactctacctcggcccagaagaacgagcgggagtccatcaggcagaaactggcccttggttcattcttcgatgacggaccagggatatacacaagttgttccaaaagcggtaagccatctcttagctcccgtcttcagtccgggatgaatttacagatatgcttcgttaacgacagcgggagtgacaaggattctgatgccgacgacagcaagaccgaaacctcactagatactcctctgtcccctatgtcaaaacaatcatccagctacagcgatagagacacgaccgaagaagagtctgagtccctggacgacatggacttcctgactcggcagaagaagctgcaggctgaggctaagatggcactcgctatggctaaaccaatggcgaagatgcaggtcgaggtggaaaagcagaataggaaaaagtcccccgttgccgacctcctgccacacatgccacacatctcggagtgtttgatgaaaaggtcacttaagcccactgatttaagagatatgactatcggccagctccaggtaatagtaaatgatttgcattcccagatcgagtcgctgaacgaggagcttgtgcaactgcttttgatacgcgatgagctccacactgaacaggatgctatgttagtggatatcgaagaccttaccaggcacgccgaatcacaacagaagcatatggctgaaaaaatgcctgctaagtag

SEQ ID NO: 17323 - DNA, 228 bp, Artificial Sequence
  Description of Artificial Sequence: Synthetic coding sequence
atgccagaggaccaggtaggaaagctggaagcaacagagaacacaattagtgctatggctgccgccgctgcagagcagcagcagttctaccttcttttggggaacctgctgtctccagataacgtggtgcgaaagcaggccgaagagacatacgaaaacatccctggacagtcaaagattacctttctattgcaagccatccgaaacaccaccgccgccgaagagtag

SEQ ID NO: 17324 - DNA, 2712 bp, Artificial Sequence
  Description of Artificial Sequence: Synthetic coding sequence
atgcccgagcagttcagcgtggctgagttcctagcagtgactgccgaagatctgagtagccctgccggggctgccgcattcgcagctaagatgccgaggtatcggggtgcagctctggcccgtgaagagatcctggaaggggaccaggccattcttcagagaataaagaaagccgtccgggccatccactcgtctggcttagggcatgtggaaaacgaggagcagtaccgcgaggccgtggagtcactaggtaattctcacttatcccagaattcacacgagctcagcacaggatttctgaacctggcagtctttaccagagaggtcgccgccctgttcaaaaatttaattcagaaccttaataacatagtatcctttcccctggactcccttatgaagggccagttaagagatggaaggcaggactcaaaaaagcagctggagaaggcctggaaggactatgaggctaaaatggcaaagctggaaaaagagcgggatcgtgccagagtaacaggagggatcccaggggaagtggctcaggatatgcagcgcgagaggagaatcttccaactccacatgtgcgaatatttattaaaagcaggggagagccagatgaaacagggacccgattttcttcagtctctgatcaaattttttcacgcccagcataactttttccaagatggatggaaagcggcccaatccttgtttccctttatagagaagttagctgcaagcgtgcatgctctgcatcaggcccaggaagacgagctccagaagctcacacagctgcgggattctctgcgcggcacgttgcaactcgaaagccgagaggagcatctgtccaggaaaaattcaggctgcggctattccatccaccaacaccagggcaataagcagttcggaaccgagaaggtgggctttttgtataagaaatccgatggaatcaggcgggtttggcagaagcggaagtgcggtgtcaaatacggctgtcttactatcagtcatagtactatcaacaggccacccgtgaaactcactcttctgacgtgtcaggtgcgacccaaccccgaggagaagaagtgtttcgacctagttacccacaaccgcacataccactttcaggctgaggacgagcacgagtgtgaagcgtgggtttctgtgctacagaactccaaggacgaagccttgagtagcgcgttcttaggcgaaccctccgccgggccaggttcctggggatccgctgggcatgatggagagccacacgatcttacaaagctgcttatcgccgaggtgaagagtagaccggggaattcccagtgttgtgattgtggggccgcggatccgacttggttatcaactaatcttggcgtgctgacatgtattcaatgcagcggtgtccatagagaactgggcgtccggtttagcaggatgcagtctctaacactcgatctgcttgggccatccgaactgctactcgcgctgaacatgggtaatacttcctttaatgaggtcatggaggcccagctgcccagccatggggggcccaagccatccgctgagagtgatatgggtaccaggagggattacataatggccaagtatgtggagcacagattcgccaggcggtgcactcctgaacctcagcggctgtggacggccatttgtaatcgagacctgttatccgtgctggaggcttttgccaacggccaggactttgggcagccccttcccgggcccgacgcgcaggctcccgaagagttggtcctccatctggctgtgaaagttgcaaaccaggcaagcttgccattagtggacttcattatccagaatggcggacacctggacgccaaggcggccgacggcaacaccgcgctgcactacgctgctctgtacaaccagcctgattgcttaaaactcctgctgaaaggtagagccctagtgggcaccgtgaatgaagctggtgagaccgccctcgatatcgcgcgtaagaaacaccacaaagaatgtgaggaactgctggagcaagctcaggccggcaccttcgcatttccactacacgttgactactcatgggtgattagcactgagcccggctccgactcagaagaggatgaggaggaaaaacggtgtcttctcaaactgccagcccaggcacattgggccagcggtcggctggatatttcaaataagacatatgagaccgtggcctcactgggggcagccactccccagggggaatccgaagattgcccaccaccactgccagtgaagaattccagtcgcacactcgtgcaggggtgcgctcgtcatgcgtctggtgataggagcgaggttagttcactcagtagcgaggcgcctgagaccccagagagccttggttcccccgcttcctcaagctcgctcatgtcacctctagagcccggggacccaagccaggccccacctaacagcgaggagggcctgagagagccccctggcacgagccgacccagcttgaccagcgggacaacacccagtgaaatgtacctgccagttaggttctccagtgagtccaccaggtcatacaggcggggggcacgttccccggaggacggaccttctgccagacagcccctcccgaggagaaacgtcccagtgggcatcacagagggcgacgggagcagaaccggatctttaccagcttcttctgtccagttactccaggactag

SEQ ID NO: 17325 - DNA, 522 bp, Artificial Sequence
  Description of Artificial Sequence: Synthetic coding sequence
atgccaagaaaggggacacaacccagcaccgccaggagacgcgaagagggcccaccacctccctccccagacggagccagctccgatgctgagcctgaaccacccagcgggagaacagagtcaccggccactgcagctgagacggcctcagaagagttggacaataggtccctggaagaaatcctgaattccattccacctccacctcctcccgctatgactaacgaggccggagcaccaagactgatgatcacccacatcgtgaatcagaactttaaaagttacgcaggagagaagatcctgggccctttccacaagaggttttcatgcattattgggcctaacggctccggaaagagtaacgttatagattccatgttgtttgtgtttggttacagggcacagaagattagatccaagaaactctctgtgctgattcataatagtgacgagcacaaagacatccagtcatgcaccgtcgaggtgcactttcagaaaatcatcgataaagaaggcgattag

SEQ ID NO: 17326 - DNA, 2262 bp, Artificial Sequence
  Description of Artificial Sequence: Synthetic coding sequence
atgtactcccctataatctatcaggctctctgtgagcacgtgcaaacacagatgagcctcatgaatgatttaacctctaagaacattcctaatggcatcccagctgtaccttgccatgcacccagtcactcagaatcccaggccacaccacatagctcctatggcttgtgtacttcaactcccgtctggtctttgcagcgtcctccttgccctccaaaagtccattcggaggtgcaaactgacggaaactcccagttcgcaagccaggggaagacagtgagtgccacttgtacggatgtgctaaggaattcatttaacaccagtccgggagttccttgctctctgcccaaaacagatatttctgccatcccaacattgcagcaattgggcctagtcaacggcattttgccccagcagggcatccacaaggagaccgacctactgaaatgtatccagacatacttaagcctgttcagaagtcatgggaaggagacccatcttgacagccaaacacaccgcagtcccacccagtcccagcctgccttcctggccacaaacgaggagaaatgtgcacgggagcagatccgtgaggctaccagtgaacgaaaggatctcaatatccacgtcagggataccaagacagtcaaagatgtccagaaggctaagaatgtcaataagacggcagagaaagtgaggatcatcaaatatctgttgggagaactaaaggcacttgtggcggaacaggaagattccgagatccagaggctgatcactgagatggaagcctgcattagtgtactccccaccgtgtccgggaacaccgatatacaagtagaaattgccctggcaatgcaacctctccgcagcgagaacgcacagttgaggcggcagctccgcatcctcaatcaacagcttagggagcagcaaaaaacacaaaaaccaagcggcgctgtggactgcaacctcgagctgttttcgctccaatccttgaacatgtctctgcagaaccaactagaggagagtttaaaatcgcaggagctgctgcagagcaaaaacgaggaattattaaaggtcattgaaaatcagaaggacgaaaacaaaaagttctccagcatttttaaggataaggatcaaaccattttagaaaacaaacagcaatatgatatcgagatcaccagaatcaagatagagcttgaagaggccctcgtgaacgtgaaaagcagccagttcaagctggaaacggccgagaaagagaaccagattctgggcatcacgctgcggcagagagacgctgaagtgacaagactgagggagctgactaggacactgcagacctctatggctaagctgctcagcgatctgtccgtggattctgcacgttgcaagccgggtaataatctcactaagtccctgctgaacatccacgacaaacaactccagcatgatccagccccagcacatacttctatcatgagttacctgaacaagcttgagacaaattattcctttacccatagcgagccgctttctacaatcaaaaatgaggagacaattgagcctgacaagacctatgagaacgtcttgtcgtctcggggccctcaaaattccaacactagaggcatggaggaagcttccgcaccgggtattatatcagccctctctaagcaggacagtgacgagggctccgaaaccatggccctgatagaggatgaacataatctggacaacacgatctatatcccgttcgccaggtccacccccgaaaagaagagtccactctcgaagagactaagtccacaacctcagattcgcgctgccacaacacagctggtttctaactccgggcttgctgtgtcaggcaaggagaacaagttgtgcacgcctgtgatctgtagcagctccacaaaagaggcagaagacgcgcccgagaagctgtcaagagccagcgacatgaaagacacccagctgctcaagaaaatcaaggaggccatcggaaaaatccctgcagcaaccaaagagccagaagagcaaacagcatgtcatggtccatccggctgcctctccaacagcctgcaagtgaaggggaatacggtgtgtgatggctcagtcttcacttctgacctgatgtccgactggtcaatttccagcttctctacattcacaagccgggatgagcaggattttcggaatggccttgctgctcttgacgccaacatcgctcgtctgcaaaagtcccttagaacaggcctgctagaaaagtag

SEQ ID NO: 17327 - DNA, 219 bp, Artificial Sequence
  Description of Artificial Sequence: Synthetic coding sequence
atgatggaagaaatctccataatggtggcatatgatgcccacgttttctctcagctccatgacgaggactttctgacaagtctcgtggcaatttccaaacccaggtcaatggtcccaacaaaaaagcttaaaaagtacgagaaggagtatcagaccatgagagaatcccaactacagcaagaagacccaatggaccgatataaatttgtttatttgtag

SEQ ID NO: 17328 - DNA, 588 bp, Artificial Sequence
  Description of Artificial Sequence: Synthetic coding sequence
atgtggcacatgaccaggaattggccactcgtgggtaaaacatctctgatcacccggtttatgtacgattcttttgacaacacctaccaggcgacgatcggaatcgatttcctaagcaagacaatgtatcttgaagacaggaccgtgagactgcagttgtgggatactgctggccaagaacggtttagatctctgataccatcttacatccgagactccaccgtagcagtcgtggtttacgacattactaacttgaacagcttccaacagactagcaagtggatcgacgacgtgcgaacggagcggggctcggacgttatcatcatgctggttggcaataaaactgatctggcagataaacgccagattacaattgaggaaggagagcagagggcaaaagagctttctgtaatgtttatcgagacctctgcgaaaaccggctataatgttaaacagttgttccggagggtggcttccgccctccctggaatggagaatgtgcaggaaaagagcaaggaaggaatgattgatattaagttggacaagccgcaggaaccccctgcttcagagggaggctgctcctgttag

SEQ ID NO: 17329 - DNA, 1047 bp, Artificial Sequence
  Description of Artificial Sequence: Synthetic coding sequence
atgagcttgcctcgctttcaaagagtgaattttgggccctacgataattacatcccagtaagcgaactgtccaagaagagttggaaccagcagcactttgccctcctgtttcctaagcctcaacgacctggtacaaaaagacggtcaaagcctagtcaaattagagataacaccgtcagtattattgacgaagagcagttgcgcggggacaggcggcagcctctctggatgtacaggagtctgatgcgcattagcgaaagaccttccgtttatctggccgcaagacgccaacccctaaaacctacgcgaactgtcgaggtcgactcaaaggctgccgagatcgggaagaaaggagaagataaaaccacacagaaggacacgacagattctgagtcggaattgaaacaggggaagaaagactcaaaaaagggaaaggatatcgagaaaggaaaagaggaaaaactggatgccaagaaagattcaaagaaaggaaaaaaagacgctgagaagggcaaggactccgccacagagagcgaagacgaaaagggcggagctaagaaagacaacaagaaggacaaaaaggactcaaacaaaggcaaagattctgcgacagagtccgagggcgaaaagggagggacagagaaagactctaaaaaaggaaaaaaagactccaaaaaagggaaggatagtgcgatagaactgcaggcggttaaggctgacgagaagaaggacgaagacggaaagaaagatgcaaataaaggggacgaatctaaagacgccaagaaggacgccaaggaaataaagaaaggaaagaaagacaagaaaaaaccctcatccaccgacagtgactcaaaagacgatgtcaagaaagagagcaagaaggatgctaccaaagacgctaagaaagtcgcgaagaaggatactgaaaaagagagtgctgatagcaagaaggacgcgaaaaagaatgccaaaaaggacgccaaaaaagatgccaagaaaaacgccaaaaaggacgaaaaaaaagacgccaaaaagaagggcaaatag

SEQ ID NO: 17330 - DNA, 2862 bp, Artificial Sequence
  Description of Artificial Sequence: Synthetic coding sequence
atgaaaaggggcattcgacgcgacccttttaggaaacgcaagctaggagggagggctaagaaggtgcgagagcccactgcggtcaacagcttttatcgggaagcttctcttcccagcgtgtgggccagcctccgccgcagggagatggttcgctcgggagccagaccaggccaggtgctgtcttctggacggcacaccggaccagcgaaactgaccaatggaaagaaagcaacatacttgagaaagatcccacgattcaacgcagactcagggtatagtatccatagcgactcagagtcacaggccgaaaccgtgcacggccttgacggttgtgcatcactactgcgggatatcctgagaaatgaagacagtggtagtgagaccgcctatctcgagaatagaagtaatagcagacccctagagtccaaaagatacggatcaaaaaaaaagcggcatgaaaaacatactatacccctcgtggtccagaaggagacatcaagtagcgataacaaaaagcagatcccaaacgaagccagcgcacggtccgaaagggatacatcagatctggagcagaattggagtctgcaagaccactaccgtatgtacagcccaattatttaccaagccctctgcgaacacgtgcaaactcagatgagcctgatgaacgacttgacgtccaaaaacattccgaatggcatcccggccgttccttgtcacgcacccagccactccgaatcacaagctaccccccatagcagttatggactctgcacttctacccctgtctggtcactccaacgtcctccctgtccacccaaggtgcatagcgaggtacagaccgatggaaacagccagtttgcctcgcaggggaaaacggttagcgcaacctgcaccgacgtcctgcgcaattccttcaacaccagtccaggagtgccctgttctctcccaaagaccgacatctctgccattccaaccttgcagcagttgggactggtgaatggaattctcccccagcaaggtatacacaaagagactgacttactcaagtgcatccagacctatctgtctctgtttcgctctcatgggaaagaaacccatctcgacagtcagacccatagaagcccaacacaatctcaacccgcttttctcgccactaacgaggaaaaatgcgccagagagcagatccgcgaggctacaagtgaacgaaaagacttgaacattcacgtaagagacacaaagaccgttaaggacgtgcagaaagcgaagaatgtgaataaaacagcagagaaagtgagaattattaagtacctcctcggggagttgaaggcacttgtggctgaacaggaagatagcgaaatccagagactcatcaccgaaatggaggcttgcatcagtgtactccccaccgtcagcggtaatacagacatccaagttgagattgccttggctatgcaaccattgcgtagcgagaacgcccagctgcgaagacagctgcggatcttgaatcagcaactcagagagcagcagaagactcagaagcctagtggcgctgttgactgtaacctggagttgttttcgcttcagagtttgaatatgagtctgcagaatcaactcgaggaatcactgaagtcacaagaactgcttcagagcaaaaacgaggagttgctgaaggttatcgaaaatcagaaagacgagaataagaagttctccagtatcttcaaagataaagatcagaccattttggagaacaagcagcaatacgatattgaaattacccggatcaagatcgagttagaggaggctctggtcaatgtaaaatctagccaatttaagctagaaactgcagagaaagaaaaccagattctcggcataacactcagacagcgggatgctgaggtgacacggctccgggagctaacccgaactctgcaaacctccatggccaagcttctcagcgatttaagtgtcgatagcgctaggtgcaagccaggcaacaacctgactaaatctctgctgaacatccacgataaacagctgcagcatgatccagcccctgcccacacatcgataatgtcatatttaaacaagttggaaaccaattactcctttacacacagtgaacccttgagcacaataaaaaacgaagagaccattgagcctgataagacctacgaaaatgtgcttagtagtcggggaccccagaattccaacaccagagggatggaggaggcttctgctcctgggattattagcgcactttcaaagcaagattcggacgagggatccgagacaatggctttgatcgaggatgagcacaaccttgacaataccatctacattccctttgcccgatccacaccagaaaaaaagtctccgctcagcaagcgactttctcctcagccccagatccgtgccgctaccactcaactcgtgagtaacagtggtctggctgtttccggcaaagaaaacaagctgtgcaccccagtcatctgcagttcttcaactaaagaagcagaggatgccccggagaaactatccagagcgagcgacatgaaggacacccagctgctcaaaaagattaaggaagctattggaaagatcccggcagccacaaaagagccggaggaacagaccgcgtgccacggccctagtggctgtctgtctaacagtcttcaggtaaaagggaatactgtctgcgacgggagcgtttttacttccgacttaatgagtgactggagcatttcgtctttcagtacatttacctcccgcgatgagcaggatttccgcaacggacttgccgctctggatgccaatattgcgagacttcagaaatctctgcgcaccggtttgctggagaagtag

SEQ ID NO: 17331 - DNA, 1683 bp, Artificial Sequence
  Description of Artificial Sequence: Synthetic coding sequence
atgtccgaacatagccggaattccgaccaggaagaactgcttgacgaagagatcaacgaagacgaaatcctggcaaatctatccgcggaggagctgaaggagcttcagtctgaaatggaagttatggctccggacccatccctcccggtgggcatgattcagaaagaccaaacagacaagcctccaacaggaaacttcaatcacaaatcactagtggactatatgtattgggagaaggcctctcgcaggatgttggaggaggagcgggttcctgtgacctttgtgaagagcgaggaaaaaacccaagaggagcacgaggaaatcgagaaaagaaataaaaatatggcccagtaccttaaagagaaattaaataatgaaatcgtggccaacaagcgagagtctaagggcagctccaatatccaggagactgacgaggaagatgaggaggaggaggacgatgatgacgatgatgagggagaggacgacggtgaggagagcgaggagactaaccgagaagaagaagggaaggccaaggagcagattcgcaactgtgaaaataactgtcaacaagttacagacaaagcattcaaggaacaacgggacagaccggaagcacaagagcagtcggagaaaaaaatcagcaaattggaccccaagaagcttgccctagacacatctttccttaaggtgtccacccgaccttctggcaaccagacagacttggacggctcattgagaagagtgcgaaagaacgacccggacatgaaagagctaaacctgaacaatattgagaacattccgaaggaaatgctcttagactttgtaaatgccatgaagaaaaacaaacatataaaaacattttctctggccaacgtgggggcagatgaaaacgtagcctttgctcttgccaacatgctacgggagaaccggtcaatcacaacgttgaacatagagtcaaatttcattacagggaaaggaatcgtagctataatgcgctgcttgcagttcaacgaaacgttgacagaactcagatttcataaccaaagacatatgctgggtcaccatgcagagatggaaatcgcacgcttgctgaaagcgaacaataccctgctcaagatggggtaccatttcgagctgccaggaccccggatggttgtgactaacttgctcactcgaaaccaggataaacagaggcagaaaaggcaggaggagcagaagcagcagcagctgaaggaacagaagaaactgatcgcgatgctcgagaacgggcttggcctaccacctggtatgtgggaactgctgggtgggcccaagccagactctaggatgcaagagttttttcagccaccaccacctaggcctcccaatccacagaatgtgcccttctctcaaagatcagaaatgatgaaaaagccctcccaggctccgaagtatagaaccgatcccgacagcttccgagtcgtgaagttaaagaggattcagcgcaaaagccgaatgcccgaggccagagagccccctgaaaagactaacctgaaggatgtcatcaaaacacttaagccagtgcccaggaaccggccccctcccttagtcgagatcactccacgggaccaactgcttaatgatatccggcactctagtgtagcctacctgaagccagtacagctaccaaaagagctcgcctag

SEQ ID NO: 17332 - DNA, 153 bp, Artificial Sequence
  Description of Artificial Sequence: Synthetic coding sequence
atgccagaggatcaggtcggcaaacttgaggccacagagaacacgatctccgccatggcagccgccgccgctgagcagcagcagttctatctccttttaggtaacttgctttccccagacaacgtcgtgcggaaacaagccgaggttacctag

SEQ ID NO: 17333 - DNA, 288 bp, Artificial Sequence
  Description of Artificial Sequence: Synthetic coding sequence
atggccataggcaaacggctggccacattgccaactaaagaacagaagacacagaggctgatttcagagctcagtctgctcaatcacaaactcccggcccgtgtttggctgcccaccgctgggtttgatcatcatgtagtccgcgtgccgcacacacaggccgttgtgctcaactcgaaggacaaggccccctatcttatatacgtcgaggtgttagaatgtgagaacttcgacactacatccgtgccagccaggattccggagaacagaatacgttcaaccagatag

SEQ ID NO: 17334 - DNA, 1260 bp, Artificial Sequence
  Description of Artificial Sequence: Synthetic coding sequence
atggctggctctggatgcgcttggggggcagagccgcccagattcctcgaagcatttggaaggctttggcaggtgcagtccaggctcggcagcgggtcttcggctagcgtgtatcgcgtgcgttgctgtggaaaccctggctctcctccaggcgctcttaaacagtttctgccccctggtaccaccggagccgcagcatccgcagctgagtacggcttcaggaaagaaagagcagctttggaacagcttcagggccaccgcaatatagtcacactctacggcgtgtttactattcacttctccccaaatgtgccaagccggtgtctgctccttgaactcctggatgtctccgtgtcggagctccttttgtactcgagccatcaaggttgtagtatgtggatgatccagcactgcgcacgcgacgtcctggaggctctcgccttcttacaccatgagggctacgttcacgccgatctcaaaccccgtaacatactttggagcgccgaaaacgagtgcttcaagctgatcgatttcgggctgtcttttaaggagggaaaccaagacgtcaagtacattcagactgacggctaccgcgcccctgaggccgagctgcaaaactgcttggcgcaggccggtctccagagtgacactgagtgcacaagcgctgtcgatctctggtcattgggcattatcctgctcgagatgttttccgggatgaaattgaaacacacagtcaggtctcaggaatggaaggcaaatagctcagctatcatcgaccacatcttcgccagcaaggctgttgtcaatgccgctatccctgcctaccacttgagagacttaatcaaatcaatgctccatgatgacccatctcgtcgaatccctgctgaaatggccctgtgcagcccatttttttcaatcccctttgcgccgcacatcgaggacctcgtcatgctgcccaccccagtactgcggctgttgaatgtcttggacgacgactatttagaaaatgaagaagaatatgaggacgtggtcgaagatgtcaaggaggagtgccagaagtatggacccgtcgtgtctctactggtgccgaaggaaaacccggggcgcggccaggtgttcgtggagtacgccaacgccggggattctaaggccgcacagaagctcctgacaggaagaatgttcgacggtaagtttgtagttgccaccttttatcctctgagcgcctacaaacgcggctatctgtatcagacactgctgtag

SEQ ID NO: 17335 - DNA, 1272 bp, Artificial Sequence
  Description of Artificial Sequence: Synthetic coding sequence
atgccccgcaaaggtacacagccatccacagcccgccgccgggaggagggtccaccaccaccttcaccggacggggcctcatccgacgcagagccggagcctcctagcggccgcacagaaagtccggccacagccgcggagaccgcatctgaagaactggataaccgcagtttggaggagatcctgaacagtatcccccccccccctcctcccgccatgaccaacgaagcaggagcgcctcggctgatgattactcatatcgttaaccaaaacttcaaaagctacgccggcgaaaagattctcggaccattccataaacgattcagttgcataattggtccaaatggttctgggaagtctaacgtgatagattcaatgttattcgtgttcggctacagagctcagaaaattagatctaagaagctttccgtacttattcacaatagcgacgagcacaaggatatacagtcttgcaccgtagaggtccacttccagaaaatcatagataaggagggggacgattatgaggttattcccaacagtaatttctatgtttctaggaccgcttgccgggacaacactagcgtgtatcacattagcggaaaaaagaagacattcaaggatgtgggtaatctacttcggtctcacggtattgacttggaccataaccggttcctaattctgcagggcgaggtggagcagatcgcaatgatgaagcccaaagggcagacagagcatgacgaaggcatgctggagtatctggaagatatcattggatgcggtcggctcaacgagcccatcaaagtgttatgtcggcgggttgaaatactgaatgagcataggggcgagaaactgaatagagtgaaaatggttgaaaaggagaaggatgccctcgagggcgaaaagaacatcgccattgaattcttgactctggaaaatgagattttcagaaaaaagaatcacgtgtgtcagtactacatctacgagctgcaaaagagaatcgcagagatggagacgcaaaaagaaaagattcacgaagatacaaaagagattaatgagaaatccaatatcctgagcaacgaaatgaaagcgaagaataaagatgttaaagacaccgaaaagaaactgaacaagattacaaagttcatcgaagaaaacaaggaaaagttcacccaactagacctggaagacgttcaagttcgtgagaagcttaaacacgcaacctccaaggcaaagaaattggaaaagcagctgcagaaggataaggagtag

SEQ ID NO: 17336 - DNA, 1113 bp, Artificial Sequence
  Description of Artificial Sequence: Synthetic coding sequence
atggaagagggagtgccatgtcctgccccagctgcaaagctcactcccccagtgaagaagtcacaggatatgcacgatgagagatctaagctggtgaatgaatacgcatgccgagttctcgagctgctcggtatgggtcatagattgtttgtaccacgcctgctggccactagtaaggaggatcttctccaggccgattttgagggagccctgaagtttttccgcgtccagttgccaaagcggtaccgcgccgaagagaacgcacggcgccttatggagcaagcatgcaacattaaggtgccaactaagaagcttaaaaaatatgagaaggaataccaaaccatgagggaatcacagctgcagcaggaggatcctatggatcggtataagagggagaatcgcaggctccaagaagcttccatgagactggaacaggaaaacgatgacttggcacatgagctagtgaccagcaagatcgccctgcgcaatgatttggatcaggccgaggacaaggccgacgtgctgaataaggaacttttgctgacaaagcagagactggtggaaactgaagaggagaaacgaaagcaggaggaggagacagctcagttaaaggaggtgttcaggaaacaactcgagaaagcagagtacgagataaaaaaaactacagctattattgcggagtacaagcagatttgcagccaactttcaacacggctcgaaaaacagcaggcagcttcaaaggaggaactggaagtggtgaagggcaaaatgatggcgtgcaaacactgttccgatatcttcagcaaagaaggagcactaaaattggcagccaccggcagagaggaccagggcattgagacggacgacgagaaggatagcctgaagaagcagcttagagaaatggaactggagttggctcagactaaattgcagctggttgaggcaaaatgcaagatccaggagctcgagcatcagagaggtgctctgatgaacgaaatccaggctgccaaaaattcttggttctcaaaaaccctgaacagtattaagaccgctacaggcactcaacccctccagccagcgcccgttacacagccgcccaaggaatctacctag

SEQ ID NO: 17337 - DNA, 2262 bp, Artificial Sequence
  Description of Artificial Sequence: Synthetic coding sequence
atgtactcccccataatttaccaggcattgtgcgaacacgtacagacacagatgtccttgatgaatgacctgacttccaaaaatatcccaaacgggatacctgctgtgccgtgtcatgccccctcacactcggagtcgcaagcaactccccacagcagctacggactgtgcacttccacacctgtgtggagtctacagcggcctccttgtccaccgaaggttcattccgaggtgcagaccgacggaaactcccagtttgccagtcaagggaagacagtaagcgctacgtgtacagacgtgctgagaaattcatttaacacttccccaggggtgccttgttcactgcctaagactgacatctctgccatacctaccctgcagcagctcggcctcgtgaacggaatcctaccacagcaaggcatccacaaggagacggatcttttgaagtgtattcagacctacctgagccttttcaggtcccacgggaaggaaacccacttggactcacagacacaccgctctcccacacagagtcagcctgcgtttctggctactaacgaggagaagtgtgccagagaacagatccgtgaggctacatcggagagaaaggatctgaatatccacgttcgcgacacaaaaactgtaaaggacgttcagaaggcaaaaaatgttaataaaaccgccgaaaaagtcaggatcatcaagtatttgcttggggaactgaaagctctggtcgcggagcaggaggactcagagatccagcggctaattacagagatggaggcatgtattagcgtgctaccaacagtgtccggcaacactgatatacaggtcgaaatcgctcttgcaatgcaaccactgcgtagcgaaaatgcgcagctgagaagacagcttcgtatccttaaccagcagttgagagaacagcagaagacccaaaagccttctggagcagtggactgcaacctggagctgttttccctacagagcctgaacatgtctctgcagaatcagttagaggaaagcttgaaaagccaggaattgcttcaatctaagaacgaagaactgctgaaggtgatcgagaaccagaaggacgaaaataagaaattctccagcatctttaaggataaagaccaaactatcctcgagaacaaacagcagtacgacatcgagatcacccggatcaagatagagctcgaagaagcactggtcaacgttaaaagcagccagttcaaactagagaccgccgaaaaagagaaccaaatcctggggatcacactcagacaacgggatgctgaggtgacgcggctaagagagctaacccgaaccctgcagacatcaatggccaaactcctgagcgatctttcagtcgatagcgcgagatgtaagcccgggaacaatctcaccaagagccttctgaacatccacgataaacagttgcagcatgatcctgcccctgcacatacatctattatgtcctatctgaataaactagagacaaattacagctttacacattcagagcccctctctacgataaagaatgaggagactatcgagcctgataagacctatgagaatgtcctttcaagcagaggtccacagaattccaacactagaggcatggaggaggctagcgctccgggaataatttcagccttaagcaaacaggatagcgatgagggctctgaaactatggctctgatcgaggatgagcataatctggataacactatatacatcccattcgctaggagcaccccggagaagaaatcaccactatcgaagaggctttccccacagcctcagattcgtgctgccaccacacagctggtctccaactctggtctggccgtgagcgggaaggagaacaagctgtgcaccccagtcatctgttcaagctctacaaaggaggcagaggacgcacccgaaaaactaagccgggcgagtgatatgaaagacacccagctgcttaaaaagatcaaggaagctatagggaaaatcccagctgctacaaaagaacccgaggagcagactgcttgtcatgggccaagcggatgcctgtcaaactctctccaggtgaaaggcaacaccgtttgtgatggatccgtcttcaccagtgatttaatgagcgactggtcaatttcctctttcagcacttttacttcaagagatgaacaggattttaggaatggattagccgccttggatgccaacattgcccgactgcagaagtctctcagaactggccttctcgaaaagtag

SEQ ID NO: 17338 - DNA, 2067 bp, Artificial Sequence
  Description of Artificial Sequence: Synthetic coding sequence
atgagcgtcaatagtgagaagagttcctcttcggagaggcctgaacctcagcagaaagccccacttgtgccccctccgccaccaccacctccaccacctccaccgccgctccctgaccccacaccaccggagcctgaggaggagatactcggcagcgatgatgaggaacaggaggaccctgcagactactgtaagggtgggtatcacccagtcaaaattggagacctgttcaatgggcgctaccacgtgatccgaaagctcgggtggggtcatttcagtactgtctggctgtgttgggacatgcaaggcaagaggtttgttgcaatgaaggtggtcaagagcgctcaacactatacagagacagccctcgacgaaatcaaattactgaaatgtgtcagagaatccgatcccagtgaccccaataaggatatggtcgtgcagttaattgacgacttcaagataagtggcatgaatggcatccacgtttgcatggtgtttgaggtgctgggacaccacctgctgaaatggataatcaaatcaaattatcaggggttgccagtcaggtgtgtcaaaagcataatcagacaggtgttacagggccttgattacctgcacagtaagtgcaagataatccatacggatataaaacccgaaaatatcctgatgtgcgttgacgatgcgtatgtacgacgcatggcggccgaggccactgagtggcagaaggcgggagcgcctccccctagtggcagcgcagtaagtactgccccccagcagaagcctatcggcaaaatatctaaaaacaaaaaaaagaaactgaaaaaaaagcagaaacgccaggccgaactactcgaaaaacgattgcaggagatcgaggagctggagagagaggctgaacggaagatcatcgaagagaacataacaagcgccgctccgagcaacgaccaggacggagaatattgtcccgaagtcaagctgaagaccaccggcttagaagaggccgcagaagctgagaccgccaaagataacggagaggctgaagatcaagaggagaaggaggatgcagaaaaggagaacatagaaaaggatgaagacgatgtagaccaggagcttgccaacattgatccaacgtggatcgaaagcccgaaaacgaatgggcacatcgagaacgggcccttcagccttgaacaacagttggatgacgaagatgacgacgaagaggattgcccgaaccccgaggagtacaacctagacgagcccaacgcggagtcggattacacttatagctccagctacgagcaatttaatggtgaattacccaacgggcggcacaagatcccagaatcacaatttcccgaattttctacatctctcttcagcggttcgctagagccagtagcttgcggatcggtgctgtctgaagggtctccgttgactgagcaggaggagtcaagcccttcccatgaccgatctagaactgtgtccgcctccagcacaggagacttaccaaaagcgaagacacgcgctgccgatctgctggtgaatccactggatcctcgcaacgccgataaaatccgcgttaagatcgccgatcttggaaatgcatgttgggttcacaaacattttacagaagatattcagacccggcaatacagaagcatcgaggtgctcattggcgcaggctatagcacgcccgctgatatatggtcaactgcttgtatggctttcgaactggccaccggtgactacctcttcgagcctcacagcggggaggactacagtagagatgaggaccatattgcacacattatcgagctactgggaagcatcccccggcattttgccctttctggcaagtacagtagagaattcttcaaccgccggggcgagttgaggcatatcaccaagctgaaaccatggagccttttcgatgtgctggttgagaaatacggctggccacatgaggatgctgctcagtttactgacttccttattccgatgctcgagatggtgccagaaaagagggcttccgcaggcgagtgtttacgacacccttggctaaactcctag

SEQ ID NO: 17339 - DNA, 543 bp, Artificial Sequence
  Description of Artificial Sequence: Synthetic coding sequence
atgccgcgtaagggtactcagccctctactgcccgaagaagagaagaaggaccaccccctccctccccagacggcgcttctagcgatgccgagcccgaacctccatcaggacgtacagagtcaccagcaactgctgccgagacagcatccgaggaacttgataaccgcagccttgaggagatcctcaactccattcctccacctcccccaccggctatgaccaacgaagcaggagctccccgacttatgatcacccatattgtaaatcagaactttaagtcctacgcaggtgagaagattcttgggccctttcataaacgttttagctgcatcattggacccaacgggtcagggaagtccaatgtgatcgatagcatgctgttcgtttttggctacagggcccagaaaataagatctaagaagttgtctgtccttattcacaacagcgacgaacacaaggatatccagtcatgcacggtggaggtccatttccagaagatcattgacaaggagggtgacgactacgaggtgattcctaattag

SEQ ID NO: 17340 - DNA, 4689 bp, Artificial Sequence
  Description of Artificial Sequence: Synthetic coding sequence
atgcccggagaagcagcacgtgcagagttgctcctgccggaggccgacaggcccggccctcgcacagacctgagctgtgacgcggccgccgcgacaacgattctgggaggcgataggcgcgagccatgcgctctgacacccggaccctcacaccttgctctcacattcctgccatcgaagcccggggcgcggccacagcctgagggagcatcatgggacgccgggcccgggggtgctcccagcgcctgggccgatccaggagaaggagggccatctcctatgttgctacctgaaggtctaagctctcaggctctgtcgaccgaggcgcctttacccgccacactggagccccgcattgttatgggagaagagacttgtcaagcgctgctgagtccacgggccgccaggaccgcactgcgagaccaggaaggcggacacgcctccccagatccacccccagagctttgctcgcagggagatctatcggtacccagcccaccgcctgacccagattctttcttcacacctccctctacccctacgaagaccacatacgctttgctgcctgcatgcggcccccatggagacgcgcgggacagtgaagccgagcttcgtgacgagcttctggacagccccccggctagtccatcgggttcgtatatcaccgctgacggcgactcctgggcttcttcaccatcttgttccctgtcactgctggctcccgccgagggcctggacttccccagcggctggggactgagtccacagggctccatggtggatgagagggaattgcatccagcgggtacccctgagcccccctctagcgagagttcactcagtgctgatagcagctcctcctggggacaggaaggccatttctttgacttagacttccttgccaacgaccccatgattccggccgcgttactgccttttcagggtagtctcattttccaagttgaggcagtggaggtgacccctctctcccccgaggaggaggaggaagaggcagttgctgaccccgaccctggcggcgatctcgccggagagggggaggaagactcaactagtgcctcatttctccagtccttaagtgatttgtcaataacagagggaatggatgaggcttttgctttccgcgatgacacgagtgctgcttccagtgattccgattctgcttcctatgccgaggccgacgatgaacgcctttactccggagagccccatgcccaagccactcttctgcaggatagtgtgcagaagaccgaggaagaatctggcgggggtgcaaaaggacttcaagctcaggatggaacagtcagttgggctgtggaagcagccccccaaacctcagataggggagcgtatctgtctcagcggcaggaattgatttcagaagtcacagaagaggggctcgcgctgggccaagagagcactgccactgtgacacctcacaccctgcaggttgcccccggattgcaagtggaagtggccacgcgggtgacacctcaagccggagaagaggagactgattcaaccgccggtcaggagagcgccgctatggcgatgccacaaccatcacaggaaggcatctctgagatcctaggccaagaatcagtgactgccgagaagcttcccacaccacaggaggaaacctcattaacgctctgccctgattctcctcaaaaccttaaggaggaagggggactggacctgcccagcggaagaaagccggtagccgcggccaccatagtgccccgacaagctaaggaggatttgacactgcctcaggacagcgctatgacacctcccttaccccttcaggacacagatctatcgtctgcacctaaacccgtcgccgccgcgaccatcgtctcacagcaagccgaggagggactcactttaccgcaggattctgtgatgacaccaccactcccactgcaggacacagagctgtcttcagctcccaaaccagtagccgccgctaccctggtgtcccagcaagccgaagagggccttaccctacctcaggactccgcaatgacacctcccctgcctctgcaagacacagatctgagctccgcccctaagccagtggccgccgcaaccctggtgagtcagcaggctgaagagggcctgacattaccccaggattcagcaatgacaccaccactgcctctgcaagacaccgatctgtcctctgcccctaagcctgtggctgctgcaaccctagtctcccagcaggcagaagaaggccttactctaccccaggattccgcgatgactccacccctgcccctccaagacaccgacttatccagcgcccctaagccggtggctgcggcgaccatcgtgtctcagcaggccgaagaaggtctcacactgccccaagactccgccatgactccccccttgccacttcaagacactgacctgtcctccgctccgaagccagtagcggccgccaccattgtatctcagcaggctgaagaaggccttacattgcctcaagactcagcaatgaccccacctctccctctacaggatactgacctttcgtccgccccaaaaccagttgccgctgccactccagtctctcagcaggctgaggagggcctgaccctcccccaggactccgctatgacaccacccttgccgctccaagataccgacttgtcttccgcaccaaaaccagtggccgccgccacccctgtgagtcagcaggccgaggaaggcttgacactccctcaggacagtgccatgacagctccgttgccactgcaggacacaggacccacgtccggaccagaacccctggcggtggcaacaccgcagaccctccaagcagaagctggctgtgcgcccgggacagaacccgtggctacgatggcacagcaggaggtaggcgaagcgctgggcccacggccagctccggaggaaaagaacgccgctctgcccactgttccggaaccagccgcactggatcaggttcagcaggacgaccctcaacccgcggctgaagctgggacgccatgggcagcccaggaagacgccgactctacattggggatggaggccctctccctgcctgaaccagctagcggagccggcgaagaaattgccgaagctctgtcaagaccagggcgggaggcatgcttggaggccagagcccacacgggtgatggtgccaagccagattccccgcagaaagagaccctggaggtggaaaaccagcaagagggtgggctcaagccgctcgcacaggagcatgggccaaggtccgctctggggggagcaagggaggtgcctgacgctcccccagcggcctgtcccgaggtcagccaggctcgcttattatctcctgccagagaagagagaggattgtccggaaagtccactccagaacctacgttgccctccgcggtcgcaaccgaggcatccctggattcctgccccgagtcaagcgtgggagcggtctcctctctggacagagggtgtcctgatgcccctgctcctacctcagcccccacttcgcagcaacccgaacctgtgttgggactgggaagcgtcgagcagcctcatgaagttcccagtgtgctaggaaccccactccttcaaccccccgaaaacctggcaaaggggcagcccagcacacccgtggatagacctttaggccccgaccctagcgcaccgggcactctggccggagcagccctgccacctctggaaccaccagccccttgtttgtgccaggatcctcaggaggacagtgttgaggatgaagagccaccaggctcactggggctcccaccgccccaggccggggtgcaaccagcagccgcagctgtgtccggcacaactcaacccctcggaacagggcctagagtatcgctaagcccccactctcctctactgagtcctaaggtcgcaagcatggacgccaaggatctcgccctgcaaattctgcctccatgccaggtcccaccaccttctggtcctcagtctccagctgggccacaaggcctgagtgcgcctgaacaacaagaggacgaagacagtctggaagaggatagccccagggcactcggaagcggacagcacagcgacagccacggcgagtcatcagccgagttggacgaacaggacatcctggccccccagacagtgcagtgtcctgcgcaggcgccagccggcggcagtgaagaaacgatcgccaaagctaagcagtctcggtcggaaaaaaaggcgaggaaagccatgtctaagcttggcctgaggcagatacagggcgttactcggattaccattcaaaaaagtaagaacattctgttcgtaattgccaagcccgacgtgtttaaatcgccagcaagcgacacctatgtggtttttggcgaggcgaagatagaggatctcagtcaacaggtccacaaggcagcagccgagaagtttaaggtccccagtgaaccttccgccttagtacctgagtctgctccaagacccagggtgcgactagaatgcaaggaggaagaggaggaagaagaggaagaagtcgacgaggccggactcgaactgagggatatcgagctggttatggcacaagcgaatgttagccgggctaaggctgtaagagcactccgcgacaaccatagtgatatcgtcaatgccattatggaactgacaatgtag

SEQ ID NO: 17341 - DNA, 3294 bp, Artificial Sequence
  Description of Artificial Sequence: Synthetic coding sequence
atggcagccgctgctgctgagcagcagcagttctatctgttactcggtaatttgctttccccagacaatgtcgtcagaaaacaggccgaagaaacatacgaaaacatccctgggcaaagcaagattacttttctgctacaggctatcagaaacaccacagccgccgaagaggcaagacaaatggctgccgtgcttctgcggcggctccttagcagcgcctttgacgaagtctatccggcgctcccatctgatgtgcaaactgctatcaaatctgagttactgatgatcattcagatggaaacacagagctcaatgaggaagaaggtgtgcgacatcgcagccgagcttgctcgtaatctgattgatgaagacggaaataatcaatggcctgaaggtctcaaatttctcttcgattctgtgagcagtcagaacgtgggactgagagaagctgcgctccacattttttggaatttccccggtattttcggcaaccagcagcaacattatctcgatgtgatcaagcgtatgctggtacagtgcatgcaagaccaggaacacccttctattagaactctatcagcaagggctaccgcggctttcatcttggcaaacgagcacaatgtggctctgtttaagcactttgctgacctgttaccgggcttcctgcaggcggtcaatgatagttgctaccagaacgatgactcggttctgaagagcttagtggagatcgccgatacagtccccaaatatcttcgaccacacttggaagctactctgcagttgagtctgaaactatgtggcgatactagtctgaacaacatgcaaagacagttggccctggaagtgatcgtgacattatcagagactgccgcagccatgctccgcaaacataccaacatagtcgcacagaccattccgcagatgcttgccatgatggtagacttggaagaggacgaggattgggccaatgccgacgaacttgaggacgacgattttgattctaatgccgtggcaggggagtccgcactggatcggatggcctgtgggctcgggggcaaattggtacttccaatgatcaaagagcatattatgcagatgttacagaatcccgattggaaatataggcatgcagggctgatggcacttagcgctattggtgaaggttgtcaccaacaaatggaagggattctcaatgagattgtgaacttcgtgctgctgttccttcaagacccccacccccgagtacgttacgccgcttgtaatgcagtgggtcagatggccacagactttgccccaggcttccagaagaagttccacgagaaagtgattgctgccctgcttcagaccatggaagaccagggtaaccagcgagtgcaggcgcatgcggctgccgcgctgattaactttactgaagactgtccaaagagcctgctgatcccataccttgataacctcgttaagcatctgcatagtataatggtgttgaaactgcaagagctcatccagaagggcactaagttggtgctcgagcaggttgtcaccagtattgcgtcagtggccgataccgcagaggagaaatttgtgccgtactacgatcttttcatgccatctctgaagcacattgtggagaatgctgtgcagaaagaactcagactcctgcggggcaagacaattgagtgcatctctctgataggattggcagtgggaaaagagaaatttatgcaggatgcctccgacgtgatgcagctactgctgaaaacgcaaaccgatttcaatgatatggaagatgacgacccccaaatctcctatatgatttccgcttgggccagaatgtgtaagattcttggaaaggaattccaacaatacttgcctgtggtgatgggcccactcatgaagacagccagtattaagccagaagttgcgttactggatactcaggacatggagaatatgtccgatgacgatggttgggagttcgtgaatctaggcgatcaacagagtttcggtatcaagactgctggcttagaggaaaagtccaccgcgtgtcagatgctcgtgtgttacgccaaagaattgaaagaaggattcgtggagtatactgaacaagtggtcaagctgatggtgccactcctaaagttctatttccacgatggcgtgagagtggcggcggctgagagcatgccactgctcctcgaatgtgccagggttcgtggcccagaatatctcacgcagatgtggcacttcatgtgcgatgcgctgatcaaggccatcggtactgagcctgatagcgatgtgctttccgaaattatgcatagctttgctaagtgcattgaggtgatgggtgatggctgtctgaataatgagcatttcgaggagctagggggcatattaaaggcaaaactggaagagcattttaaaaatcaagaacttcggcaggtgaaaagacaggacgaagattacgatgagcaggtcgaggaaagcctccaagacgaggatgacaatgatgtgtacattctgacaaaagtgtccgatattctccactctatcttctcttcttacaaggagaaggtgctaccctggttcgagcagctgttgcctttgatcgtgaacctcatatgcccgcataggccctggccggataggcaatggggactatgtattttcgacgacgttatcgaacattgcagcccagctagttttaaatacgccgagtatttcctgcgacctatgcttcaatacgtgtgcgataattcacctgaggttcgccaggccgctgcttacggactcggggtgatggcccagtacggaggagataattacagaccgttctgcacagaggcgttaccactgctcgttcgagtcatacagagcgcggattcgaagacgaaggaaaacgtaaatgcgacagaaaattgtatcagcgctgtcggcaagatcatgaagtttaaacccgattgcgttaacgttgaagaagtcctgccccattggctgagctggctgccactccacgaggataaagaggaggctgtgcagacatttaactacctttgcgatctgatcgagagtaatcaccctattgtgttggggcctaacaataccaacctgccaaagatcttctcgattatcgctgaaggtgagatgcatgaagccattaagcatgaggacccctgtgcaaaacggctggccaacgttgttagacaagtgcagacctctggcggtttgtggactgagtgtatcgcccaacttagccctgagcagcaggccgctatccaagaactcctgaactctgcctag

SEQ ID NO: 17342 - DNA, 1011 bp, Artificial Sequence
  Description of Artificial Sequence: Synthetic coding sequence
atgaaggctactgctatgaccagcgcctggctcgcccaggggggtgcacacgtcaccattaacgccagggcggaagaggacgtcgagcctgagtgtatcatggagaaggtggctaaagctagtggtgccaactatagcttccataaggaatctggccgtttccaggacgttggaccacaggccccagttgggtctgtgtatcagaaaactaatgccgtcagtgaaatcaaacgagtgggtaaagactcattttgggccaaggcagaaaaagaggaggaaaaccggcgcctggaggaaaagcgccgagcagaggaggcacaaagacagctggagcaagaacggcgcgaacgcgaactcagagaggcggcaagacgggagcagaggtatcaggaacagggcggcgaagcttctccccagtcaagaacctgggagcaacagcaggaagttgtgagccggaacagaaacgaacaagagtccgcggttcaccctagagagatcttcaagcaaaaggagcgcgccatgtccactacctcaatttccagcccacagccaggaaagctgcgctcgccttttttacaaaaacaactcacccaaccagagacacactttgggagggagccggcggctgctatttcacggccaagagcagacctgccagctgaggaaccagccccttctacacccccctgtcttgtgcaagcggaagaggaagctgtttatgaagagccacccgagcaggagaccttttacgaacagccaccgctggtgcagcagcagggggcgggatccgaacacatcgaccatcacatacaggggcaaggactgtcaggccagggattatgcgcacgagccctgtacgactaccaggctgcagacgatacagaaatatcctttgaccccgagaacctcatcactggcatcgaagtgatagacgagggttggtggcgggggtacggcccggatggacattttgggatgttccctgctaattacgtcgagctgattgagtag

SEQ ID NO: 17343 - DNA, 78 bp, Artificial Sequence
  Description of Artificial Sequence: Synthetic coding sequence
atgtggatgcacgttgcaaaggttcaccccaaagggggggagatggtgggagctatacgtaatgccgcctttctgtag

SEQ ID NO: 17344 - DNA, 312 bp, Artificial Sequence
  Description of Artificial Sequence: Synthetic coding sequence
atggccgagctgatacagaagaagttacaaggagaggtggagaagtatcaacagctgcagaaagatctatcaaaatccatgtcaggccgccagaagttggaggcccagctaacagaaaataacattgtcaaggaggaactagccctcttagacggaagcaacgtcgtgtttaaacttctcgggccagttcttgtgaaacaggagctgggtgaagcccgagctactgtgggcaagagactagattacattacagcagaaatttttttgcgtacgatcccagatccaggagacgtgccagattcatttttctag

SEQ ID NO: 17345 - DNA, 4101 bp, Artificial Sequence
  Description of Artificial Sequence: Synthetic coding sequence
atggccgataccgatctgttcatggagtgcgaagaagaggagctggaaccgtggcagaagatcagtgatgtaatagaggattctgtggtcgaagactacaacagcgtggacaagaccacaactgccgggaacccactggtgcagcagggtggccaaccccttattctgacgcagaatcctgcacctggcctcggtaccatggttacccagccggttctaaggccagttcaggtgatgcagaacgccaaccacgttacttccagtccagtcgcctcgcagcccattttcattactacccagggatttccagttagaaacgttagaccagtgcagaatgccatgaaccaagtgggaattgtgctgaatgtgcagcagggtcagaccgtcagacctattacgctggtgcccgcaccaggtacacaatttgtaaaacctacagtgggtgtacctcaagtgttctcgcagatgacccctgtacgacctgggagtactatgcctgtccggcctaccacaaacacttttaccactgttattcccgccacgctcacaatcaggagtactgtaccccagtcccagtcacagcaaacgaaatccaccccttcaacatccaccacacctacagcgacacagcccaccagtttaggacaattggctgtgcagtccccaggccagagtaatcagaccacaaaccccaagcttgcaccaagtttcccctctccaccagcagttagcatagcgagcttcgtaactgtaaagcgccccggggtgactggagagaacagtaacgaggttgcgaagttggttaatacacttaatacgattccaagcctcggccagtcacctggcccagtcgtagtttccaataattcgtccgcacacggatcccagcgaacaagcggtcccgagagtagcatgaaagttaccagctcaattcctgtgtttgacttgcaggacggcggccgcaagatctgccctaggtgcaatgcccagttcagagtcaccgaagccctccgcggacacatgtgctactgctgtcctgagatggtcgaataccagaaaaagggcaagagcttagattctgagccaagtgtcccttccgcagccaagcctcctagccccgagaagactgcccccgtcgccagtaccccaagtagcacccctatacccgctctttcccctcctactaaggtgcctgagcctaacgagaacgtgggggatgcagttcaaaccaaactgatcatgctggttgatgacttctattatgggcgagatggggggaaggtggctcagctgacaaacttcccaaaggtcgccacgtctttccgctgtccacactgtactaagaggcttaaaaacaatatacggttcatgaaccacatgaagcaccatgtggagcttgaccaacagaacggggaagtggacggtcacacaatatgccagcattgttacaggcagttcagtacgccttttcagttacagtgccacttagagaacgtgcactccccctacgaatccaccaccaaatgtaaaatctgtgagtgggcctttgaatctgagcccttgttcctccaacacatgaaggacacacacaagcccggtgagatgccgtacgtgtgccagccctactttcctagttatgtgacccaggtgtgtcagtacaggtctagcctttattcagaagtcgatgttcactttagaatgattcacgaagatacccgacaccttctgtgcccctactgcttgaaagttttcaagaacgggaatgcctttcagcaacattacatgcgccatcagaagcggaacgtgtaccattgcaataagtgcagactgcagtttctatttgctaaggataagatcgagcataagctgcaacaccataagacctttcgcaaacccaaacagttggaagggctaaagccaggaactaaggtgaccataagagcctcaagaggccaacctaggacggtcccggttagtagtaatgatactccaccctcagcactgcaggaagcggccccactcacaagttcgatggatccactgcccgtcttcctctatcctcccgtgcagagatccattcaaaagcgggccgtacgcaagatgagcgttatgggtagacaaacctgccttgaatgttctttcgagatccctgactttccaaaccactttccaacttatgtacactgtagcctgtgcaggtattctacgtgttgtagtagggcttacgctaaccatatgataaataaccatgtgccccgtaagtcccccaaatacctggctttgttcaagaactcagtaagtggaatcaaactggcttgtacgtcctgtacatttgtgacgtccgtaggggacgctatggccaaacatctggtgttcaatccatcccatcggtcatcctctatactccctcgaggactcacctggatcgctcattctaggcacggtcaaaccagagatagggtgcacgacaggaatgtgaaaaatatgtaccccccccccagttttcctacgaacaaagcagccaccgtgaaaagcgcaggcgctactcccgcggaacctgaagagctcctgacgccactcgccccagcactgccaagcccagctagtacagcaacgcccccacctacacctactcacccacaggcactcgcccttcccccactcgcaaccgaaggggccgaatgtttgaacgtggacgaccaagacgagggatcccccgtgacgcaagagcctgagctggcatctgggggtggcggctctggtggggtcgggaagaaagaacaactttccgtcaaaaagctgcgggttgtgctcttcgctctgtgttgcaacaccgaacaggcagcagagcacttcagaaatccccagagacggattagacggtggttaagaaggtttcaggcctcccaaggggaaaacttggagggaaagtacctgagcttcgaagctgaggagaaattagccgaatgggtgctcacacagagagagcagcagctgccagtgaacgaagagacactcttccagaaggcaactaaaatcggtcgtagcctggagggaggattcaaaatctcttatgagtgggctgtacggtttatgttgaggcatcacttgacacctcacgccagaagagctgtcgctcatacactgccaaaagacgtcgccgaaaatgcgggactcttcatcgactttgtccagaggcagatccacaatcaggaccttccgctatccatgatagtcgcaattgatgagatcagcttgttcctggacacagaagttctctcctcagacgatcgaaaggaaaatgccctgcagaccgttggcactggagagccttggtgtgatgtggtgctcgcgatcttggctgacggcactgtccttcccacgttagtcttttatcgcggccagatggaccaaccggcgaacatgcctgatagcatcctcctggaggccaaggaaagcggatatagcgacgatgaaatcatggaactgtggtcgacccgagtctggcagaagcacaccgcttgtcagcgctctaagggcatgttggtcatggattgtcatagaacccacctgagcgaagaggtactggccatgctgtccgcatcatctacactgccagctgtggtcccagccggctgctcatccaagattcagcccctggatgtgtgtatcaagcggacagtcaaaaacttcttgcataaaaaatggaaagaacaagcgcgggaaatggcagataccgcatgtgatagtgacgtactcttacagctcgtactcgtgtggcttggcgaggtgctcggtgtaatcggtgactgccctgagttggtgcagcggtcctttctggtcgcctcggttctaccggggccggacggcaatatcaactcacctacaaggaatgccgacatgcaggaggagctcatcgcttccctggaagagcagctgaaattatcaggtgaacactccgagagttccacaccgagacccaggagcagccctgaggagaccattgaacccgaaagcctccatcagttgttcgagggtgaatccgaaaccgagtccttctatggcttcgaagaagctgacctggatctgatggaaatttag

SEQ ID NO: 17346 - DNA, 564 bp, Artificial Sequence
  Description of Artificial Sequence: Synthetic coding sequence
atggatatctccaagggtctcccagggatgcagggcggtctccacatttggatttcggagaatagaaagatggtgcctgtgcccgagggcgcctacggaaatttttttgaagagcactgctacgtaatactgcacgtgcctcagagcccgaaagccacccagggagcctctagtgaccttcattactgggtaggcaaacaggcaggcgctgaggcgcaaggagctgctgaagccttccagcaacgcctgcaagatgaactgggcggccagacagtcctccaccgggaagcccagggtcacgaatccgactgcttctgctcttattttagaccaggcatcatttaccgcaagggcggacttgcttccgacctgaaacatgttgagacaaatctgtttaacattcaaagacttctccacatcaaagggaggaagcacgttagcgctacagaggtagagttatcttggaattcttttaacaagggcgacattttcctgctagacctgggcaagatgatgattcagtggaatggacccaagacttccatttctgagaaggcacgatag

SEQ ID NO: 17347 - DNA, 1329 bp, Artificial Sequence
  Description of Artificial Sequence: Synthetic coding sequence
atgcctctggagaatctggaggaggaagggttgcccaagaacccggaccttcggattgcccagttgaggttcctgctgtctctgccagagcaccggggagacgctgctgtccgcgacgaattgatggctgcggtccgggacaacaacttctggaatcggatacggcaggaacagacagaagactgtccaccgagctccccgtctcgaggctggcactgccaggactggccatcgagaaagcctccgaccagtatccggttatgttttgctaagcccataatcaagaggcacagaatgccttcttatatggccccgtactacgaggcactctgtaagagcctggactggcagatcgacgtcgatctgctcaataaaatgaagaaagccaacgaggatgagctgaagcgcctcgacgaagaactggaggacgcggagaagaatctgggggaaagcgaaatccgcgacgccatgatggccaaggctgaatatttgtgcagaataggtgacaaagagggcgcattaacagccttcaggaagacctacgataaaaccgtggcactgggccataggctggatatagtgttttatctgttacggattgggcttttttacatggacaacgatctgattacccgcaacacagagaaggccaagtcattaatcgaagagggtggtgactgggataggcgaaataggctcaaggtttatcagggcctctattgtgtggcaatccgcgacttcaagcaggcagccgaactattccttgacactgtttctacattcacgagttacgaactgatggactataaaaccttcgtgacctacactgtgtacgtttccatgatcgccctcgaacgcccggacctcagggaaaaagtgattaagggggcagaaatacttgaagtactccacagtcttcccgcagtgcggcagtaccttttttctctttacgaatgtcgatattcagtcttcttccagtcactggcagtagtcgagcaggagatgaaaaaggactggctgtttgctccacattacaggtactatgtcagagagatgcggatccacgcatacagccagctgctcgaatcttaccgctccctgacactgggctacatggccgaggcattcggagtgggcgtggagttcatcgaccaagagctgtcccggtttatcgcagctgggcgtttacattgcaagatcgacaaggtaaacgagatagtggaaacaaatcgacctgatagcaaaaattggcagtaccaggagaccattaaaaagggcgatctcctcctgaatcgagtgcaaaaactgagtcgagtgatcaatatgtag

SEQ ID NO: 17348 - DNA, 333 bp, Artificial Sequence
  Description of Artificial Sequence: Synthetic coding sequence
atgctgtgctggggtaacgcttcctttggtcagttaggactcggagggatcgatgaggaaatagtgcttgaacctaggaagagcgacttctttataaataagcgggtacgtgacgtaggctgcggtctgcgtcatacagtctttgtacttgatgatggaactgtatacacatgcggttgcaacgatttaggacaactggggcacgagaagagtcgtaagaaacccgagttccgctcatgctttcccggtcgttcagcaatggctccttctcgtctgaccgctacgagtgcaagtcaggtgcaagcgatactccttcctcagccgccagagtag

SEQ ID NO: 17349 - DNA, 930 bp, Artificial Sequence
  Description of Artificial Sequence: Synthetic coding sequence
atggtctgttggcagtccgtctcagtgtggagtgttgcaggtagggtcgagatgaccgtaagcaaattcatggccattcagaaggccctacaaccagactggtttcagtgcttaagcgatggggaggtcagctgtaaggaagcaacatcaataaagcgggtcaggaaaagtgttgacaggtccctcctttttctggataattgcctgcggctccaggaggagtcagaggttctgcagaagtccgtgattattggcgtaatcgagggaggggatgtaatggaagagcggctacggtccgccagggagaccgctaagagacctgttgggggtttcttgttggatggctttcaggggaatccaaccaccctagaagctagactcaggcttttatcatcggttactgccgagctccccgaggacaaaccacggctgatttccggcgtcagcagacccgacgaggttctggagtgcattgaacgcggagtggacctcttcgagtctttcttcccctaccaggttactgaaaggggctgcgcgctgacgttcagctttgattaccagccgaatcctgaagaaactctcctccagcagaacggtacccaggaagaaattaagtgcatggaccagatcaaaaagatagagacaaccggctgcaatcaggaaatcacgtctttcgagataaacctgaaagaaaaaaaataccaggaagactttaacccattagttaggggttgtagttgttactgttgtaagaatcatacccgggcctacatacaccacctccttgtaaccaatgagctgttagcaggagtgctgttaatgatgcacaatttcgagcactactttggcttcttccattacatccgagaggcactcaagagcgacaaattggcacagcttaaagaacttatccaccgccaggccagctag

SEQ ID NO: 17350 - DNA, 384 bp, Artificial Sequence
  Description of Artificial Sequence: Synthetic coding sequence
atggtgctaattttaggccgacgcttgaatcgagaagacttaggtgtaagagactccccagccacaaaaagaaaggtttttgagatggatcccaagtctttaacaggacacgagtttttcgacttcagctcgggaagctcccacgctgaaaacatcctgcagatctttaacgagttcagggattcaagactcttcacagatgtaataatttgtgtggaagggaaagagtttccttgccacagggctgtgctgtctgcctgctcctcctacttccgagctatgttctgcaacgaccatcgggaaagtagagagatgcttgtcgagattaatgggattcttgccgaggctatggagtgtttcctccagtacgtctacacaggatag

SEQ ID NO: 17351 - DNA, 1581 bp, Artificial Sequence
  Description of Artificial Sequence: Synthetic coding sequence
atggaagaaattcctgcgcaagaagcagcaggttcacctagggtacagtttcagagtctagagacgcagtccgagtgtctgtcccctgagccccagttcgtgcaggacaccgatatggaacagggcttgaccggcggcttcccaataagcaaaccggacggcatctcccaactcgagcaggatcttcaggtgtttgacctggagacaaaaacaagagaagtgctgagggacgactgttccgacggcgagacccgcgaggaaaacaaactcttgatccctaagcagaaaatctccgaggaagttcacagttataaggtccgggtcggccggctaaaacacgacattacccaagtccctgagactcgggaggtgtacaaatcagaggatagactggaacggctgcaggagatcctccgaaaatttctgtatcttgagagggagttccgccagatcaccatctccaaagagacctttacttcagagaagaataacgaatgtcacgaaccagagaaatcattctctctggacagcacaatcgatgccgaccaaagggttctcaggattcagaacaccgacgacaatgacaaatatgatatgtctttcaatcaaaatagcgcatccggcaaacatgagcacttaaatctgactgaagactttcagtcttccgaatgcaaggaatcactgatggatttgagccatttgaacaagtgggaaagcattcctaacaccgagaaaagctataaatgtgatgtctgtggtaagattttccaccagtcctcggcacttacgcgacaccagcggatccacacacgagagaaaccatataaatgtaaggaatgtgaaaagagtttttcccaaagttccagtctttcccggcataagagaatccatacaagagagaagccttacaaatgcgaagcctccgataagagctgtgaggcgtctgataagtcttgctccccatcaagtggtatcatccagcacaaaaaaatccacacacgtgcgaaatcttacaagtgcagttcctgtgagagagtgttcagccgatccgtgcacctgacgcagcatcagaagatacataaagaaatgccttgcaagtgtacagtgtgtgggtctgatttttgccacacttcttatctcctggagcatcaaagagtgcaccatgaggaaaaggcatatgagtatgatgaatatgggctggcctatattaagcagcagggtattcactttagggaaaaaccctatacttgttccgaatgcggaaaagacttccgcctcaatagtcatctgatccaacaccaaagaatccatactggtgaaaaggcacacgagtgcaatgaatgcggaaaggctttctcacagacctcctgcttaatccagcaccataagatgcacagaaaggagaaatcttatgagtgcaacgaatacgaaggcagcttttcccactcctcagacttgatccttcagcaggaagtacttactagacaaaaggcgtttgactgcgatgtgtgggagaagaatagcagccagagggctcatctagtgcagcatcagtccattcataccaaggaaaattcttag

SEQ ID NO: 17352 - DNA, 195 bp, Artificial Sequence
  Description of Artificial Sequence: Synthetic coding sequence
atgccagaagatcaggtaggaaagctggaagcaactgaaaacacaatctctgcaatggccgccgccgccgcagagcagcaacagttctacctcctcctaggaaatcttctgtcacccgataacgtggtgcggaagcaggcagaagaaacctatgaaaacattcccggccagagtaagatcactttcctcctgtag

SEQ ID NO: 17353 - DNA, 741 bp, Artificial Sequence
  Description of Artificial Sequence: Synthetic coding sequence
atggctgagcaggaacagcgcaagatccctcttgtgccagaaaatcttcttaagaaacgcaaagcctaccaggcgctgaaggccacgcaagctaagcaagccctcttggcgaaaaaggagcagaaaaagggcaaggggctccggtttaagcgcctggagtcctttctgcacgactcttggcgtcagaagcgtgacaaggtgagacttagacgcctggaggtcaaaccccacgctttggagctgccagataaacacagtttagctttcgtggtgaggatcgaaaggattgacggcgtctctttgttggtgcagcgcacaatcgcaaggctacggttaaaaaagatttttagtggtgtgttcgtgaaagtcacacctcagaatcttaagatgttgaggatagtggagccgtacgtgacctggggtttcccaaacttgaaatcggtgcgtgagctcatcctaaaaaggggccaggcgaaggttaagaacaagaccataccgctgaccgacaacacagtgatcgaagaacacctaggcaagttcggcgtcatctgcctagaggacttgattcacgagatcgcattcccaggcaagcactttcaggagatctcatggtttctgtgcccctttcacctgagcgtcgctcggcacgctacaaagaaccgggtgggttttctgaaggaaatgggaacccccggatatcggggtgagcggataaaccagttgattaggcagctgaattag

SEQ ID NO: 17354 - DNA, 1296 bp, Artificial Sequence
  Description of Artificial Sequence: Synthetic coding sequence
atggctgccaacctcagtagaaacggcccagctctgcaggaagcatacgttcgagtggtcacagaaaaatcacccactgattgggctctgtttacctacgagggtaattccaacgacatccgggtagcgggtaccggcgagggtggcttggaggaaatggtagaggagctgaacagcgggaaggtcatgtacgcgttctgtcgggtcaaagatcctaacagcggcctacccaagtttgtgttgattaattggacaggagagggggtcaacgatgtcagaaaaggtgcctgcgcctcacatgtctccactatggcgtcctttttgaaaggggcacacgtcaccataaacgctcgggctgaagaagacgtggagccggagtgcatcatggagaaggtcgctaaagcttctggcgcaaactactcattccacaaagaatctggcagatttcaggacgtgggacctcaagcccccgtggggagcgtataccagaagacaaatgccgtcagcgaaattaagcgggtggggaaagacagcttctgggccaaggccgaaaaggaagaggagaaccggcggcttgaggagaaaaggagagcggaggaagcccagcgccagttggagcaggagaggcgagagagagaattacgggaggctgccagaagggagcaaaggtatcaagagcagggcggtgaggcttctccccagagtagaacgtgggagcagcaacaggaagtcgtgtctagaaatcgtaacgaacaagagtctgccgtgcatcccagagagatctttaagcagaaggaaagagctatgtccactacgagcatatccagcccacaaccaggtaaactgcggtcccccttcctccagaaacagttaactcagccggagacacactttggaagggagccagctgccgctatcagccggcctagagccgacctgcccgcagaggagcctgcaccgagcactcctccgtgcctcgtgcaggctgaggaggaggccgtgtacgaagaacctcctgagcaggagactttttatgaacagccaccattggtacagcagcagggtgcagggagcgagcatatagaccatcacatccagggccagggcctgtctggtcaggggctttgcgcaagggccctgtacgactaccaggcggcagatgataccgagatttctttcgatcctgaaaacttgatcaccggcattgaagtgatcgatgaaggctggtggcggggatatggcccagatgggcatttcggaatgtttccagccaattacgtcgagttgattgaatag

SEQ ID NO: 17355 - DNA, 1854 bp, Artificial Sequence
  Description of Artificial Sequence: Synthetic coding sequence
atgattgagaaaatgcagggctcaagaatggatgagcagagatgttcttttccgccacccctgaaaacagaggaggactacattccttatccttccgttcacgaggtgctgggccgcgaggggccttttcctctaatattactgccccaatttggcggttactggatcgaaggaaccaaccatgaaataaccagcatccccgaaacagaacccctccagtcgcccaccaccaaagttaaactcgagtgcaacccaacggcacgcatataccggaagcatttcctcggcaaggaacacttcaattattactcattggacgccgcgctgggacacctggtctttagtttgaagtacgacgtcatcggtgaccaagagcaccttagattactgctcaggaccaagtgtcgaacatatcacgatgtcattcctatttcttgtttgacagagttccctaatgtggtgcagatggccaagctggtgtgcgaagatgtcaatgttgaccgcttctaccccgttctgtaccctaaggcatcacgtctgattgttacgtttgacgaacatgttatatccaataacttcaaattcggagtgatataccagaagcttggacagacttctgaggaggagttattctcaacgaatgaggagagccccgctttcgttgagtttctggaattcctggggcagaaggtaaaactccaagactttaagggcttccgggggggcctagacgtgacccacggccagacaggtacagagtccgtgtattgtaattttaggaataaggagattatgttccacgtgtcaactaaactgccttacactgagggcgatgcccagcagctgcaacggaagaggcatatcgggaacgatatagtagctgtggtgtttcaagatgagaataccccatttgttccagacatgatagcttccaacttcctccacgcatatgtcgtagttcaagcagagggcggggggcccgatggaccgctgtataaggttagcgtgacggcacgcgatgacgtcccattctttgggccccccctgcctgatcccgcggtgtttcggaaaggtcctgagtttcaggaattcctgcttaccaaactgatcaacgcggagtatgcgtgctataaagctgagaagttcgcaaaactggaggaaaggacccgcgccgccctgctggaaacgttgtatgaggaactccacattcactcacaatccatgatgggcctggggggagatgaagataagatggagaacgggagcggtggagggggttttttcgaaagctttaagcgtgttatccgcagccggagccagtcaatggacgcaatgggtttgtccaataagaagccaaatacagtcagcacgtctcactccggatcattcgcacctaacaaccccgacttagccaaggctgcgggaattagcctgctgatccccggaaagagtgcaagccgctttggaagaagaggcagcgcaatcgggattggcaccgttgaggaagtcgtggtccggggcgccgccggctcgggcgggtgcctgcacgctctgttttctgcgaggtcccaggacggcgggcatatcggagacgttgcccccctgccccccggacaggcaccaggtagagccggctggtcaggcggctctagtgatggtactcagcatctcctgtggggcctggtccctgtgcctgaacccgttcctctcacgcggggtttttggccctgcctgggaccttgggatcctggacctgtgccagctaggataagatatccaaaggccctacacccggctgcaaggcctccgataagcccagtgtgcatggagaggcatccctcacctttgccttag

SEQ ID NO: 17356 - DNA, 1224 bp, Artificial Sequence
  Description of Artificial Sequence: Synthetic coding sequence
atgggaaacacttcgttcaacgaagtgatggaggcccagctgccgtcacacggaggtccgaaaccatctgccgaaagcgatatgggtacgagacgcgactacattatggctaaatatgtcgagcaccgattcgcgaggagatgcacccctgagccccagcgcttatggaccgcgatctgtaatagggatttactttccgtcctggaagcatttgcaaatggccaggatttcggccagcccctgccaggccccgacgcacaggcaccagaggaactggtcctgcaccttgccgtcaaagtggcaaatcaggctagcctgcctctggtagacttcattatccagaacggagggcatctcgatgccaaagccgcggacggtaataccgcattgcactatgccgccctgtacaatcaacctgattgcctgaagctgttgctgaagggccgagccttagtggggacggtaaacgaggctggagagaccgctctcgacatcgcacgcaagaagcatcacaaagagtgtgaggaactgctggagcaggcccaggcaggcacttttgcatttcccctccacgtggattattcatgggtgatcagcacggaacccggatccgattcggaggaggacgaggaagaaaaacggtgtctgcttaaactcccagcgcaagcccattgggcctcgggtcgccttgacatctctaacaagacttatgagacagtcgcatcactcggagcagccacgcctcagggggaatccgaggactgccctccgccgctgcctgttaagaacagcagccggaccctggttcagggctgcgccaggcatgcctcaggagatcgctcagaggtatctagcttgtctagcgaggctcccgaaacccccgagtccctcggtagcccggcgagcagtagcagcctgatgtctccattagagcccggcgatccctcccaggcaccacccaactccgaagaaggattacgggagcccccagggacgtccagaccaagccttaccagcggaactacaccgagtgaaatgtatcttcctgttagattcagttccgagagcactcgttcgtatcgccggggcgccagaagtcccgaggatggcccttcagctagacaacccctgccccggagaaatgtgcctgtaggcatcaccgagggagatgggtcccgcaccgggagcctgccagcctcatctgtgcaactcttacaggactag

SEQ ID NO: 17357 - DNA, 813 bp, Artificial Sequence
  Description of Artificial Sequence: Synthetic coding sequence
atggccatggaaatgcgtctgccagtggctcggaagccgctctcagagaggttgggcagagacacaaagaagcaccttgtggttccaggggataccatcaccacagatacagggttcatgcgggggcacggaacttacatgggcgaggaaaagctcatagcttccgtggcggggagtgttgagcgagtcaacaaactgatctgtgttaaagccctcaagacaaggtacataggcgaagtaggggacatcgtggtgggaaggataacagaagtccagcagaagcggtggaaggtggaaactaattcaagattagattctgtgttactgctgtctagcatgaatctccctggaggagaactccgacgccggtccgctgaggatgagttggccatgcgtgggtttctacaggaaggggacctgatttccctggggcagggagtgttggtgcaggtgtcacccagtttagtgaaacgtcaaaaaacacattttcacgacctcccttgcggagcctccgtgattttaggtaataacggcttcatatggatctatccgacacctgagcataaggaagaagaagctggcggcttcatcgcaaacctggagcccgtgtccctcgcagaccgcgaagtcattagtcgtctgaggaattgtataatctctctagtgacacagcggatgatgctgtacgatacaagtatactttattgctatgaggcgagcctgccacaccagattaaagatatcttaaaacccgagataatggaagaaattgtaatggaaacacgccagcgcttgctggagcaggagggatag

SEQ ID NO: 17358 - DNA, 297 bp, Artificial Sequence
  Description of Artificial Sequence: Synthetic coding sequence
atgcctgaagatcaagtgggtaagttggaagctactgagaacacaatctcagccatggccgcggcagccgctgagcaacagcagttctatctgctgctggggaacctgctatcaccagacaatgtggtgcgcaaacaggctgaagagacgtatgaaaatattccagggcagtcgaagattaccttcctgttgcaggccatccgcaatacaacagcggcagaggaagcgcgacagatggccgccgtgcttcttcgaaggctcctgtcatctgcgtttgatgaggtttaccctgcctag

SEQ ID NO: 17359 - DNA, 306 bp, Artificial Sequence
  Description of Artificial Sequence: Synthetic coding sequence
atggacgaggtggagcaagatcagcacgaggccaggctgaaagagctgtttgacagcttcgacactactgggaccggcagtcttggacaagaagaactgacagacctgtgtcacatgctgagcttggaggaggtggctccagtcctgcagcagacactcctccaggataatctgctgggccgagtccattttgaccagttcaaggaagctctgattttgatcttatcccgtacactgagcaatgaagaacacttccaggagcctgattgtagtctggaggctcaacccaaatacgtgcgcggctag

SEQ ID NO: 17360 - DNA, 1065 bp, Artificial Sequence
  Description of Artificial Sequence: Synthetic coding sequence
atggcccacagccccgtggcagtgcaggtgcccggtatgcagaacaatatcgcagacccagaggagttgtttaccaaattagaaagaattgggaagggtagcttcggcgaagttttcaaaggcatcgacaaccgaactcagcaggtagtggccatcaaaataatagatttggaagaggcagaggacgagatcgaagatattcagcaggagatcacagtcttgagtcagtgtgacagctcgtatgtcacaaaatactatggatcttatcttaaggggagtaagttatggatcatcatggaatatctggggggaggaagcgccctggaccttttacgagctggaccattcgatgaatttcaaatagctaccatgctgaaggagatattgaagggcctggattacctgcacagcgaaaagaagatccaccgagacattaaagcggccaacgtgctgctctcggaacagggagacgtcaagttagcggacttcggagtcgcggggcagctgaccgatactcagataaagcgcaatacgttcgtcgggacaccattctggatggcgcctgaagttatacaacagagcgcctatgactcaaaaaggccgactgcaaaggagcttctgaagcacaagttcattgttaaaaactcgaagaaaacttcatatctgaccgagctgatagataggttcaaaagatggaaagccgaaggacattccgacgacgaatccgattctgagggctcggactctgagtctacttctcgcgagaataacactcatcctgaatggtcgtttaccacggtacgcaagaagcccgaccccaaaaaggtgcagaacggagcagaacaggatttagttcagactctgtcttgtctctcgatgatcatcacacccgcattcgccgagctcaaacagcaagacgagaataacgcgagtaggaaccaggcgatcgaggagctggagaagtctatagccgtcgctgaggcggcgtgcccaggcatcacagataaaatggtgaaaaagctgatcgaaaaattccagaagtgttccgcggacgaaagcccttag

SEQ ID NO: 17361 - DNA, 522 bp, Artificial Sequence
  Description of Artificial Sequence: Synthetic coding sequence
atgcctcggaaagggacacagccgtccacagctcggcgacgggaagaggggccacctccccccagtcccgatggagctagcagtgatgctgagccggagccccccagcggaaggactgagagccccgccactgccgctgaaaccgcctctgaagaattggataaccggtccctagaagagattctcaattctattccaccaccacctccgccagccatgactaatgaggctggcgcgccgcggcttatgattacacacatcgttaatcagaacttcaagagctacgcaggagagaaaatcctcggaccattccataaaaggttctcttgcatcattggcccgaacggatcgggcaaaagcaacgtgattgatagcatgttatttgttttcggctaccgggcgcagaaaattaggtctaaaaagctttccgttctgattcacaatagtgacgagcacaaggatattcaatcctgtactgtggaggtacacttccagaagatcatcgataaggaaggagactag

SEQ ID NO: 17362 - DNA, 801 bp, Artificial Sequence
  Description of Artificial Sequence: Synthetic coding sequence
tagcctcgtgccgccgcgagagttagagctgcaggcgaggccctggagaggaggcgccgatggctcggacggctctccccttctgcaccaagaccccgcagagctcgcccctctcttagacgcgcttctgcctgggtacgtgacagggtagccgggcgccctggagctttacctgggtttcaggcctccggcgttgccggagaggcacagaaagccccaggccatcctgccgctcctgcccctgccgcctcatgcctcacggaagctgacgggcgcgtcttcttacatgctttccgcttggcactcatccagctccaaatttcatctataaaaagtgacaacgtgacaagagcttgtagctttatcagggaagccgcaactcagggagccaaaatcgtgtccctgccggaatgctttaactctccctatggagccaagtacttcccagaatatgcagagaagatccccggagagtccacccagaagttgagtgaagttgcgaaggagtgctcaatctatctgataggcggctccatccccgaagaagacgctggtaaactttacaatacatgcgccgtgtttggacctgacggtactctccttgccaagtatagaaaaatacatctcttcgatatagacgtgcctggcaagatcacctttcaagagagcaaaacgctgagtcctggagattccttctctacttttgacaccccctattgtcgagtcggactcggcatttgttatgacatgaggtttgcagagcttgctcagatatatgctcaaagaggcgaagcggtgtag

SEQ ID NO: 17363 - DNA, 216 bp, Artificial Sequence
  Description of Artificial Sequence: Synthetic coding sequence
atggactctttgcccgatgagttctttgtgcgacaccccgctgtagaggaccagcgtaaagaggaaactgagaacaaactcgagaagtcctcgggccagctgaataagcaggagaatgatattccaaccgacctcgttcccgtgaatctcttactggaggttaagaagctcttgaatgcgatcaacacgctcccaaagggcgtggtgccccattag

SEQ ID NO: 17364 - DNA, 2130 bp, Artificial Sequence
  Description of Artificial Sequence: Synthetic coding sequence
atgtcagtggagtcggagcagctaactggcgtcccactcgatgactccgcaattactccaatgtgcgaggtgaccggaggccgctcctactccgtatgcagcccgcgaatgcttaatcaatgccttgagtctctagttcagaaagtccagagtggggtggtgattaactttgagaaggctggacccgacccatcaccagtggaagatggccagcccgacatttcccgaccattcggctcccagccttggcactcatgccacaaactgatatatgttaggccgaatcccaaaacgggcgtgcccatcggccactggccagtccccgagagtttttggccggaccagaactcccccactcttcctcctcggacaagccatcccgtggtgaaattctcatgtactgactgcgagcctatggtcatcgataaattgcccttcgacaaatacgagctcgagccctctccgctaacccagtttattctggagagaaagtccccacaaacatgctggcaggtgtacgtgagtaattctgcgaagtactccgagctgggtcatccttttggctacctcaaggcaagcacagctctcaattgtgtgaaccttttcgtcatgccttacaactaccctgtacttcttccattgttggatgatctgttcaaggtacacaaggccaagccgacactgaagtggcgtcagtcttttgagagctacctgaagacgatgcctccatactatttagggcctctgaaaaaggctgtgaggatgatgggggcgccaaacttaattgccgattcaatggagtacggtctgagctactcagttatttcatacttgaagaagttaagccagcaggccaagatagagagcgaccgggtaatcgggtctgttggaaaaaaggtggtgcaggagacgggaataaaagtacgaagtcggtcccatggccttagcatggcttatcggaaagactttcagcaactgctgcagggcataagcgaggacgtcccgcatcggctgctcgatctgaatatgaaagaatacactggattccaggtggctcttctgaacaaggacctgaaaccacaaaccttccgaaacgcctatgacattccaagaaggaatctgctcgatcaccttacgcgtatgcgaagtaatttgctaaaaagtaccaggcgctttctcaagggccaggacgaagatcaagtccacagcgtgccaatagcgcagatgggcaactaccaagagtaccttaaacaggtcccatccccacttagggaactggacccggatcagccccgacgcctgcacaccttcggcaaccccttcaagctggacaagaagggaatgatgattgatgaggctgacgaattcgtagcagggccccaaaacaaacacaagcgaccaggcgaacccaatatgcagggtattcccaagcgccggcgatgtatgtcaccactcctgcgcggccgccagcagaacccggtggtcaataatcacattggaggaaaaggaccaccagctcctaccactcaagcccagcccgacctaataaaaccgttgccgctacacaaaatttctgagaccactaatgatagcattatccatgatgtggtggagaaccacgtggcggaccagcttagctcagatataactcccaacgccatggacaccgagttctcagcaagttccccagcttcccttctcgagagacctacaaaccacatggaggccctcggccacgaccatctcggcacaaacgatctgaccgtgggcggttttctcgagaatcacgaagaaccgcgcgataaagagcagtgcgccgaggaaaatattcctgcttccagtctgaataaaggcaagaaactgatgcactgccgcagccacgaggaagtcaatactgagctgaaggcccagattatgaaggagatccggaaacctgggaggaagtacgaacggattttcaccttactgaaacacgttcagggtagcctgcagactaggcttatctttctgcagaatgtgataaaggaggcgtcacggttcaaaaaaaggatgctgatcgaacagctggaaaatttcttggatgaaattcaccggcgggccaaccagattaatcatatcaacagcaactag

SEQ ID NO: 17365 - DNA, 387 bp, Artificial Sequence
  Description of Artificial Sequence: Synthetic coding sequence
atggcttcctccaataccgtgttgatgaggctggtagcttccgcctatagcattgcacagaaagccgggatgattgtgcggcgcgtgatagcagagggcgatctgggtattgtcgaaaagacctgtgccaccgacctgcagacgaaggccgataggctggcccaaatgagtatctgctcgtctctggcccgtaaattcccaaaactgacgatcatcggcgaggaggacctcccgtccgaagaagtggatcaagaattgatcgaagattctcagtgggaggaaatcctgaaacaaccatgtcctagccagtactccgctatcaaggaagaggacttggttgtctgggttgaccctctggatgggactaaagaatataccgaaggttag

SEQ ID NO: 17366 - DNA, 237 bp, Artificial Sequence
  Description of Artificial Sequence: Synthetic coding sequence
atgagatttatgatgatgagagccgagaattttttcatacttcggcgcaagcctgtggagggctatgatattagcttcttgattacaaattttcacactgagcagatgtacaaacataagcttgtggattttgtcatccactttatggaagaaatcgataaggagatttctgagatgaagctgtctgtgaacgcccgagcaagaatcgttgccgaggagttcctgaagaacttttag

SEQ ID NO: 17367 - DNA, 171 bp, Artificial Sequence
  Description of Artificial Sequence: Synthetic coding sequence
atggtcatggaaaagccaagccccttgctggtgggcagagagttcgtgaggcagtactacactttactaaacaaagcccctgagtacctgcacagattctacggccgtaattcgagttacgtccatgggggagtggacgcttcagggaaaccacaggaggccgtctactag

SEQ ID NO: 17368 - DNA, 357 bp, Artificial Sequence
  Description of Artificial Sequence: Synthetic coding sequence
atgaaaatctttgttggcaacgtggatggcgcagataccactccagaggagctggcagccttgttcgctccttacgggactgttatgtcatgtgccgtgatgaagcaattcgcattcgtgcatatgcgagaaaatgctggggcattgagagccatcgaggccctacacgggcacgaacttagacccggacgtgccctggtcgtggaaatgagtcggccacggccattgaacacctggaagatattcgtaggcaacgtatccgccgcctgcacctcccaggagctccgcagcctattcgaaagacggggtcgtgtcattgagtgtgatgtcgtgaagggaggaatgtgtgtagggtag

SEQ ID NO: 17369 - DNA, 438 bp, Artificial Sequence
  Description of Artificial Sequence: Synthetic coding sequence
atgtcttccccccgggactttagggccgagcccgtgaacgactatgaggggaacgatagcgaggccgaagatctgaattttcgtgagaccctgccaagctcttcccaagagaatacaccccgctctaaggtgtttgagaataaagtcaactctgagaaagtgaaacttagccttagaaattttccacataacgattatgaagacgtcttcgaggagccatctgagagcggatccgacccatccatgtggaccgcacgcggccctttccggagagatcgctggtcgagcgaggacgaggaggccgctggtccatcacaggcactgtcaccattactctcagtccagcaccacggctactccggccctaatgagcggacaaccttttggcatggaagtaacgaaggcgctgtgtcactacttctgagatattgtgcctag

SEQ ID NO: 17370 - DNA, 438 bp, Artificial Sequence
  Description of Artificial Sequence: Synthetic coding sequence
atgtggactgcgagagggccattcaggcgggaccgatggagctctgaggacgaggaagcagccgggcccagccaggcactgtcccctctactgtcggacacccggaaaatcgtatccgagggcgagctggatcagcttgcgcagatccggcctttgatctttaacttccacgaacagaccgccatcaaggactgccttaagatcttggaggagaaaaccgctgcttatgacattatgcaggagttcatggctctggagcttaaaaacctcccgggcgaatttaactcggggaatcagccaagcaaccgggagaagaatcgctacagagatattctgcctttccagcatcacgggtacagtggcccgaatgaacgcactacgttttggcacgggagtaatgaaggggctgtctcattgctgctgaggtactgcgcctag

SEQ ID NO: 17371 - DNA, 444 bp, Artificial Sequence
  Description of Artificial Sequence: Synthetic coding sequence
atgtggaagtttcccggggggttgtctgagcccgaggaagacattggggacactgccgtgagagaggtgttcgaggaaaccggcattaagtctgagttccgttccgtgctgtctatccgccagcagcatacgaatcctggagctttcggtaagtccgacatgtacatcatttgtcgactcaagccttactcctttaccatcaatttttgccaggaggagtgcctccgctgtgaatggatggacttgaacgacctggcaaaaaccgagaacactacgcctataacctctagggttgcacggctgttgttgtacgggtacagggaggggtttgacaagatcgatctcactgtagaggaacttcccgccgtttacactgggctgttttataaactatatcacaaagagctccctgagaactacaaaaccatgaagggtatcgactag

SEQ ID NO: 17372 - DNA, 300 bp, Artificial Sequence
  Description of Artificial Sequence: Synthetic coding sequence
atggatgagtctgctcttctcgatctgctagagtgtcccgtctgcctggaaaggcttgacgcctctgctaaagtgctgccatgtcaacacactttttgcaaaaggtgtttgttggggatagttggctcccgcaacgagctgcgatgccctgagtgcagaacattagtggggtcaggagtcgaagagttgcctagcaacatactgctcgtgagactgcttgatggaatcaaacagagaccctggaagccaggtcccggaggggggagcgggacgaattgcacgaacgctttaaggtcttag

SEQ ID NO: 17373 - DNA, 3675 bp, Artificial Sequence
  Description of Artificial Sequence: Synthetic coding sequence
atggccctacggccgggcgcaggcagcgggggtggaggagctgccggcgccggggcgggatccgccggtgggggcggtttcatgttccctgtggctgggggcattagaccccctcaagcgggactgatgccaatgcagcagcaaggtttccccatggtctcagtgatgcagcccaatatgcagggaattatgggcatgaattactcctcgcaaatgtcacaagggcctatcgcaatgcaggccggcatccctatgggcccaatgccagctgccggtatgccctatcttgggcaggctccttttctaggcatgcgcccacccggtccacagtatacacccgatatgcagaaacagttcgcggaggagcaacagaaacgtttcgagcagcagcagaagctcctggaagaggaaagaaaacggcgccagtttgaagaacagaagcagaaattgagacttctgtccagcgttaaacctaaaacaggcgagaaatcgagagatgacgccctggaggcaatcaagggaaaccttgacggtttttcacgagacgccaaaatgcatcctacccccgcaagccaccctaagaaacccggcgtgggagtatttccatcacaggatccagctcaaccaaggatgcccccctggatttataatgagtctctggttcccgatgcctacaagaaaatccttgagactacaatgaccccaaccgggatagacacagctaagttgtatccaatcctcatgtccagcggactcccacgagagactttggggcagatttgggcacttgccaaccggaccaccccaggcaagctaactaaggaggagctgtacactgtgctggctatgatcgccgtcacccagcgcggggtgccagcgatgtctccagatgcccttaatcagttccctgcagccccaatccccaccctctccgggttcagcatgaccctaccgaccccagtgtcccagccaacagtgattcccagtgggccggctggctccatgcccctttcccttggccagccagtgatgggaatcaatttggtgggaccggttggcggagccgctgcgcaggcgtcctccggatttatacctacctacccggcgaatcaagtggtgaagccggaggaggacgatttccaggatttccaagatgcaagcaaaagcggaagcctggacgactcattttccgactttcaggaactcccagcttctagcaagacctccaacagccaacatggtaatagcgctcccagtctccttatgcctttgcctggcaccaaggccctgccgagcatggacaaatacgctgtgtttaagggcatagccgccgacaaatccagcgagaatacagtgcctccgggcgatccaggcgataagtattctgccttccgtgaattagagcagacggcagaaaacaagccgctgggtgaatccttcgctgagttccgctcggcaggcactgatgatggattcacagattttaaaactgctgactcagtgtctccattagagcctcccactaaggacaagaccttccctcccagctttccatcaggcaccattcagcaaaaacaacaaacccaggtaaagaacccccttaacctggctgatcttgacatgtttagctctgtgaactgctcatccgagaaacccctgtccttctcagcagtttttagcactagcaaatcagttagtactccccagtctaccggttctgccgcaacaatgaccgcacttgccgcaaccaagacctctagtctggcagacgacttcggggagttctcattgtttggcgaatattcaggtctcgcacctgtgggggaacaggacgattttgcggactttatggcatttagcaattcgtcgatctcatcagaacaaaagcctgatgacaaatatgacgcccttaaagaagaagcaagtccagtgccattaacatcgaacgtaggatctacggtcaagggaggacagaactccactgcagcatcgacaaaatatgacgtttttagacagctgtccctggaaggttcagggttaggtgtagaagacttgaaagataacaccccgtctggaaaatctgacgacgatttcgcagactttcattcatcaaagttctccagtatcaatagcgataaaagcctcggtgaaaaagctgtggctttcaggcataccaaggaggacagcgctagtgtcaagtccctggaccttccttctataggcggtagctcggtgggaaaagaggacagcgaggatgccctgtcggtgcagtttgacatgaaacttgcagacgtgggcggcgacctcaagcatgtgatgtcggattcaagtctggatctgccgaccgtgtctggccagcacccccccgccgcagacatcgaagatcttaaatatgctgcatttggaagttactcctccaattttgctgtgtctaccttaacgagttatgactggtcagatcgtgacgacgcaacacagggccgtaagctctcccccttcgtcctgagcgcggggtccggatctccgtccgccaccagcatcttgcagaagaaggaaacttcatttggaagcagtgaaaacatcactatgacctccctgtctaaggtcactaccttcgtgagtgaggacgccctgcccgagactacctttccggccctggccagtttcaaggatacaatccctcagacctcagagcagaaagaatatgaaaatcgagattacaaagatttcaccaagcaggacctacccacagctgaacgttcccaggaggctacttgccccagtcccgcatcaagcggcgcctcccaggagactcccaacgagtgttctgacgactttggggagtttcagagcgaaaagcctaagatatccaaattcgacttcttggtagccacctcacagagtaaaatgaaatcaagcgaagaaatgattaaaagcgagctggcaacatttgatctatccgtccagggatctcacaaacgctctctgtccctcggggacaaagagatctcccggtctagcccctcacctgctctggagcagccttttagggaccggtctaataccttgaatgagaagcccgcgctgcctgtgatcagagataaatacaaggaccttaccggcgaggtagaggaaaatgagcgctacgcctatgagtggcagagatgtcttggatctgcgctcaatgtgataaaaaaggctaatgacacccttaacgggatttctagctcatcagtctgcaccgaggtgattcaatctgcccaaggcatggaatacttactgggagtcgtggaggtttatagggtgacaaaacgagtggaactaggaatcaaagctacagccgtctgttccgaaaagctgcagcagctcctgaaggatattgataaggtttggaacaacttgatcggtttcatgtctctcgcaactctaactcccgacgagaactcacttgacttctcctcctgtatgctgcgtcccggcataaagaacgcacaggagctggcgtgcggtgtgtgcctgctcaatgttgattctagatccagggcatttaactctgagaccgattcctttaagctcgcatacggcgggcaccagtatcacgctagttgtgcaaacttctggatcaactgcgtggagcctaaacctcccggtttggtcctgcccgatttgctgtag

SEQ ID NO: 17374 - DNA, 354 bp, Artificial Sequence
  Description of Artificial Sequence: Synthetic coding sequence
atggtgcaacgcctcacctacagaagacggctctcttacaacactgcgtctaataaaacccgactttccagaacgccaggaaacaggatcgtatatttgtacactaagaaagtgggcaaagctccaaagtctgcctgtggcgtgtgccccggtagacttaggggcgtgcgagccgttcgtcctaaggtgctgatgcgcctctcaaagaccaagaagcacgtatcccgcgcctacgggggctcaatgtgcgccaagtgcgtgcgggatcgcatcaagagggcgtttctgattgaggaacagaaaatcgtcgtgaaggtacttaaggcccaggcccagagtcaaaaagccaaatag

SEQ ID NO: 17375 - DNA, 621 bp, Artificial Sequence
  Description of Artificial Sequence: Synthetic coding sequence
atgagttctccccgagatttcagggcggagcccgtcaatgactacgaggggaacgacagcgaggccgaagaccttaacttccgtgaaacattacccagctcatcccaggaaaacactccccgatctaaggtttttgagaataaagtgaatagtgagaaagttaaactgtctctccggaactttcctcataacgattacgaggacgtttttgaggaaccttcagagagcggctcagatccgtccatgtggactgcccggggacctttcagacgtgaccggtggagtagcgaggacgaggaagccgcaggcccttcccaggcactgagcccactgctctcagatacacgcaaaattgttagcgaaggggaactcgatcagttagcacagatccgccctcttatattcaactttcacgaacaaacagctataaaggactgcctgaagatacttgaggagaagacagctgcttatgacattatgcaggagtttatgttcaatataatggatatagtggcccagatgagagaacagcggtctgggatggtacagaccaaggagcagtatcacttctgctatgacattgtgctggaggtacttaggaagttgctgaccctcgactag

SEQ ID NO: 17376 - DNA, 582 bp, Artificial Sequence
  Description of Artificial Sequence: Synthetic coding sequence
atggaggaaactatcaaagaccctcctacttccgcggtcctcttagatcattgccattttagccaagttatctttaactctgttgagaagttctacatccccggcggcgatgttacttgccactacacgtttacccagcatttcatccccagacggaaggattggatcgggatttttagggtgggctggaaaaccacccgcgaatactatacctttatgtgggtgacgctccccattgatttaaataataagagtgctaaacagcaggaggtgcaattcaaggcatattacttgcccaaagatgatgagtactatcagttctgctacgttgatgaggacggggttgtcagaggggcaagcattcctttccagtttcggcctgaaaatgaggaggatattctcgtggtgacaacgcagggggaagtggaggaaatcgagcagcacaacaaagagctctgcaaagagaaccaggaactaaaggactcctgcatatcactgcagaaacagaacagtgacatgcaggccgagttacaaaagaagcaggaagaactggagacactgcagagcataaacaagaagtag

SEQ ID NO: 17377 - DNA, 156 bp, Artificial Sequence
  Description of Artificial Sequence: Synthetic coding sequence
atggacttcttcagtagccatttattggctgactctagctccccagctacaaacagcagtcataccgatgctcatgaaattctggtgagtgattttttggtttcagatgagaacctccaaaagatggagaatgtcctagacctctggtcttcttag

SEQ ID NO: 17378 - DNA, 513 bp, Artificial Sequence
  Description of Artificial Sequence: Synthetic coding sequence
atgagtagtaacgagtgcttcaaatgtgggcggtccggacactgggcccgagagtgccccactggcgggggacgagggaggggcatgagatctcgcggtagaggatttcaatttgtgtcctccagtctacccgacatttgctacagatgcggggaatctggtcacttggctaaggactgtgacctgcaggaggatgcgtgctacaactgtggccgaggaggtcacatcgcgaaagattgcaaggaacctaagagagagcgggagcagtgctgttacaattgcggcaaaccaggccatctggcaagggactgcgaccacgcggacgaacagaaatgttattcctgtggagagtttgggcatatccagaaagattgtactaaagttaaatgctaccggtgtggagaaactggacatgtggctatcaactgttctaagacctctgaagtaaactgttatcgctgcggagaaagcggccacctagcgcgggagtgcacaattgaggctaccgcctag

SEQ ID NO: 17379 - DNA, 399 bp, Artificial Sequence
  Description of Artificial Sequence: Synthetic coding sequence
atgaatcaggaagaccttgatcccgatagcaccaccgacgtcggagacgtgacgaacaccgaggaagaactgatccgtgaatgtgaggaaatgtggaaagacatggaagagtgtcaaaataagctgtcactgatcggaactgaaacgctgaccgattccaacgcacagctcagtctcctgatcatgcaggtgaaatgcctgactgcggagctctcacagtggcaaaagaagacgccagaaacgattccgctgacggaggacgtgctcatcaccctcgggaaggaagaattccaaaagttgcggcaggatctagagatggtcttgagtacaaaggaatccaagaacgagaagctgaaggaggatctggaaagagagcagaggtggcttgacgaacagtag

SEQ ID NO: 17380 - DNA, 1095 bp, Artificial Sequence
  Description of Artificial Sequence: Synthetic coding sequence
atggtcaagttgtttataggtaatctccctcgcgaggccaccgaacaagagattcgcagcctgttcgagcaatatggcaaggttttagaatgtgatattattaaaaattacggatttgtgcatatcgaggacaaaaccgctgcagaagacgcgatcagaaacttacaccattataaactccacggagtgaacatcaacgttgaagccagcaaaaataagtccaaaactagtaccaagctacacgtcggcaacatctctcctacatgcacaaataaggaattacgggcgaagtttgaggagtacggtcctgtcatagaatgcgacatcgtgaaggattacgcgttcgtccacatggaaagggctgaggacgcagtggaagctatccgaggcctggataacaccgaattccagggaaagagaatgcatgtgcaactgtctaccagccggctcagaaccgcccctggaatgggggatcaatctggatgctaccgttgcggcaaagagggtcattggagcaaggagtgtccaattgatcggtcgggtagggtcgccgacctcactgagcaatacaatgagcaatacggcgccgtgcgcacaccttatacaatgagctatggcgactctctctactataacaacgcctacggagctctggacgcatattataaaaggtgtcgggcagcgagatcttacgaagctgtggccgctgctgccgcatcagtctacaattatgccgaacagaccctgtcacagctgccacaggtgcaaaacacagctatggcttctcacctgacttccacctcgctggacccgtacgaccggcacttacttccaacttcaggcgccgccgcgacagcggccgcggcggcagccgctgccgcagctgtcaccgccgcaagcacatcatactatggtcgcgatcgaagtcctctgagacgtgcaaccgctcctgtgcccacggtgggcgaaggctatggatacggacacgaatctgaactcagccaggcatcagcggcagctcgcaatagcttatacgatatggctcggtatgaaagagaacagtacgcagacagagcccgctacagtgcattctag

SEQ ID NO: 17381 - DNA, 420 bp, Artificial Sequence
  Description of Artificial Sequence: Synthetic coding sequence
atggccacaggcgaccttaagcgcagcctacggaatctagaacaggtactaaggttactgaattaccctgaagaggtcgattgcgtaggccttatcaaaggcgaccccgcagcctctctgccaatcatctcctactctttcaccagctactccccatatgtgaccgagctgattatggaaagcaatgtggaactgattgctaagaatgacctgcgcttcattgatgcggtgtataaacttttaagagaccagttcaattataagcctatcctgacaaagaaacaattcatacagtgtggattcgcagagtggaagatccaaatcgtgtgcgacatcctgaattgcgtgatgaagaaacacaaggagctctcatctctgcaaaagattcctagtcagcagcggaaaaagattagcagttag

SEQ ID NO: 17382 - DNA, 450 bp, Artificial Sequence
  Description of Artificial Sequence: Synthetic coding sequence
atggccaacatcgccgtgcagcggataaaacgggagttcaaggaagtgctgaagtctgaagaggttcgcttcataacaaaaatctggcaccccaacatctcttctgttactggggccatttgtctggacatactgaaggaccaatgggccgcagcgatgacactgcgcacagtgctgctaagcctgcaggctctgctggctgctgccgagcccgacgacccccaggatgcagtggtcgccaaccaatacaaacagaaccccgagatgttcaaacaaacagcgagactctgggctcatgtgtatgcgggggcgcctgtgtcttcccccgagtacacaaaaaaaatcgagaatctgtgcgcgatgggtttcgaccgcaacgccgtcatcgtggctctcagtagtaagtcctgggatgtcgaaacagccacagagctgttattgagcaactag

SEQ ID NO: 17383 - DNA, 597 bp, Artificial Sequence
  Description of Artificial Sequence: Synthetic coding sequence
atggtgatggaaaagccctcacccctgctggtgggaagggagttcgtgaggcaatattacactctactcaacaaggcaccagagtaccttcatcggttctatggccgaaatagctcatatgtgcacggcggcgtggatgcttccggaaaaccacaggaggctgtttatggccaaaatgatatccaccacaaggtgctctcactgaatttcagcgaatgccacaccaagatccgacatgtcgatgctcatgccactttatccgacggggtggtggtgcaagtgatgggcttgttgtccaatagtggccaacctgagagaaaatttatgcagacgttcgttctggctcctgaaggatcagtgccgaataagttctacgttcacaacgatatgttcagatacgaggatgaagtcttcggggacagtgaaccagaactggatgaagaaagtgaagatgaagtagaggaggagcaagaagaacggcagcccagtcctgagcctgtgcaggagaacgccaatagcggctactacgaagctcacccggtgacaaacggaatagaagagcctctggaggagtcttctcacgagcccgaaccctag

SEQ ID NO: 17384 - DNA, 150 bp, Artificial Sequence
  Description of Artificial Sequence: Synthetic coding sequence
atgatgctgggcaccgagggaggggagggcttcgtggtgaaggtccgaggactgccgtggagctgcagcgcggatgaggtgcagcgattcttcagtgactgtaagattcagaacggggcacagggtattcgcttcatttatacccggtag

SEQ ID NO: 17385 - DNA, 1266 bp, Artificial Sequence
  Description of Artificial Sequence: Synthetic coding sequence
atgatggaagacaataagcagctcgcattacgcatcgacggagcagtgcagagcgcgtcccaagaggtgaccaacctgcgggcagagctgacggcaaccaataggcgcctagcagagctctccggcggaggtggcccaggtcctggtccaggggctgccgcatcagctagcgcggccggcgacagcgccgcgactaacatggaaaacccacagcttggcgcccaagtcctgctcagagaagaagtgagccgcctacaggaggaagttcacctgctgagacaaatgaaagaaatgcttgcgaaagacctggaggaatcccagggaggcaagtcaagcgaggttttaagcgcgaccgaattaagggtgcagcttgctcagaaagagcaggaactcgctcgcgcaaaagaggcccttcaggccatgaaggccgaccgaaaacggcttaagggggaaaaaacagacctagtatcccagatgcagcaactgtacgccaccctggagagcagagaggagcagttgagagattttattcggaactatgaacagcatagaaaagaatccgaagacgcagttaaagcgctggccaaggaaaaagacttgctggaacgggaaaagtgggaactaagacggcaagcaaaggaagccaccgatcatgccaccgctctgagaagccagttggatctcaaagacaataggatgaaagaactcgaagctgagctggctatggcaaaacagtcattggccaccctgaccaaggacgtccctaaacgacactcattggctatgccaggcgagactgtgctgaacggaaatcaagaatgggtagtccaggcggatttacctctgactgctgctatccgccaatcccagcagacgctgtaccactctcatccccctcacccagcggatcggcaggccgtgagggtttccccttgtcatagtaggcagccatccgttatctcggacgcgagcgctgccgaaggagatcgctcctctacaccctctgacattaacagtccaaggcaccgtactcacagcttatgtaacggagattctccaggtccagtgcagaaaaacctgcacaaccctatcgtgcagtccctggaagatttagaggaccagaagagaaagaagaagaaagagaaaatggggttcgggtcgatttctagggtcttcgcccgcggcaagcagagaaagagtcttgaccctgggctctttgatgggaccgcacctgattattacatagaggaagacgcagattggtag

SEQ ID NO: 17386 - DNA, 1173 bp, Artificial Sequence
  Description of Artificial Sequence: Synthetic coding sequence
atggccaccggggatcttaaaaggtcccttcgcaatctggagcaggtcctgcgtcttcttaattatccagaagaggtggattgcgtgggcttgatcaaaggagacccggccgccagcctgcccataattagctacagcttcactagttactcaccttacgtgacagaactgataatggagtcaaacgtcgaactgatagcaaagaacgacctccggtttatcgatgccgtgtataaactgctgagagatcaattcaattacaagccaattctgaccaagaagcagttcatccagtgcggcttcgccgaatggaagatacagatcgtgtgtgacatcctgaattgtgtgatgaagaagcacaaggagctcagttcactgcagaaaattccgtcacagcagcgaaagaagatttcttcaggaaagtcagagccgccactaggcaatgagaaaataagcgccgaagccgtgggggtcgatattagcgggaggttcatgacatctggtaagaagaaggcggttgtaatacgccatctatataatgaggacaatgtggatatctccgaagacaccctgtccccgattacggatgtcaatgaggcagtggatgtgtcagacctcaacgcgactgaaatcaaaatgcccgaagtgaaagttccggagataaaggccgaacagcaggacgtgaacgtgaaccctgaaatcactgccttacaaactatgctggctgaatgtcaggagaacctgaagaaactcactagcattgagaagcgactagactgcctcgaacaaaaaatgaaaggaaaggtgatggtagacgaaaatacctggacaaacctgctctccagagtgacgctgctggagaccgaaatgttgctgagtaagaagaacgacgagtttattgagttcaatgaagtaagcgaagactacgccagctgctcagatatggacctgctgaacccgcatagaaaatccgaggttgagaggcctgctagcattccgttgtcttctgggtattcaactgctagctctgattccactccccgcgctagtaccgtgaactattgtgggcttaacgagataagtgaagaaactacaatccaaaagatggagcgcatgaagaagatgtttgaggaaactgctgagttgctgaagtgcccaaaccactacctgtag

SEQ ID NO: 17387 - DNA, 390 bp, Artificial Sequence
  Description of Artificial Sequence: Synthetic coding sequence
atgaagcgggggcggttgccatcatcgtcggaggactcagacgataacggatccttgtcaaccacttggtctcagaattctaggagtcaacatcggcgaagcagctgctcacgtcacgaggaccgcaagccttcagaggtgttccgtacagacctcattaccgccatgaaactgcatgattcatatcaactgaatcccgacgagtattacgtgcttgcggacccatggagacaggagtgggagaagggcgtccaagtgccagtcagtcccgggacaattccacaacccgttgcccgggtggtgtcagaggagaaatccctaatgttcattcgccctaagaagtatattgtgtctagcggctctgagcctcctgagctgggatatgtctag

SEQ ID NO: 17388 - DNA, 489 bp, Artificial Sequence
  Description of Artificial Sequence: Synthetic coding sequence
atggacttcttctcgtcccatctgttagcggacagctctagccctgccaccaattcttctcacacagatgcccacgaaatactagttagcgatttcctggtgagcgacgaaaacctgcagaaaatggaaaacgtgctcgatttgtggtcatccggacttaagactaacatcatcagcgaattatcaaaatggcggctgaatttcatcgattggcacagaatggagatgaggaaggaaaaagagaagcacgccgcacatctcaagcaactgtgcaatcagatcaatgaactgaaggagctccagaagactttcgagatctccattgggaggaaagatgaggtgatcagttccctgtcccacgcaataggaaaacaaaaggaaaagattgaactgatgaggaccttcttccattggcgaataggtcacgtcagagcacgccaggacgtctatgagggtaagctggctgatcagtattatcagcggacttag

SEQ ID NO: 17389 - DNA, 411 bp, Artificial Sequence
  Description of Artificial Sequence: Synthetic coding sequence
atgatcgtaaacgattacgagggcaatgacagcgaggctgaggacttgaactttcgcgaaacgctcccaagtagctcgcaagaaaataccccccggtccaaggtttttgaaaacaaggtgaattccgaaaaagttaaacttagcctccggaattttccccataacgactacgaagatgtctttgaggaaccttccgagagtggatccgatccctctatgtggacggcacgcgggccctttcgtagagatcggtggagcagtgaagacgaggaggccgcaggaccaagccaggccctttcccccttactgagcgtgcaacaccatggatactccggtcccaatgaacgcactacattttggcacgggtcgaacgagggagctgtgagcctccttttgcgatactgtgcttag

SEQ ID NO: 17390 - DNA, 321 bp, Artificial Sequence
  Description of Artificial Sequence: Synthetic coding sequence
atggcaagtcagctccaggtcttcagtccgccgagcgtttcaagctcagccttctgttccgccaaaaaactcaagattgagccctctggatgggacgtatcgggacagtctagcaacgacaagtactacacacatagcaagacactgccggccacgcaagggcaggccaacagttcccaccaggtcgcaaacttcaacattcctgcctatgaccaaggtctactattacctgctcctgccgtggagcacatcgtggttaccgccgctgattcctccggcagtgcggccaccagcaccttccagtcttcccaaaccctgtag

SEQ ID NO: 17391 - DNA, 411 bp, Artificial Sequence
  Description of Artificial Sequence: Synthetic coding sequence
atgaagcgcggtcgtcttccaagctcatcagaggactccgacgataacgggtccctgagtactacatggtcacaaaatagcagatcccagcataggcgctcctcgtgttcaagacatgaggaccggaagcctagtgaggtgttcaggacagatctgattacagccatgaagctccacgattcctatcagttgaatcccgacgagtactacgttctcgcagatccctggcggcaagaatgggagaaaggcgtgcaggtccccgtatcacccgggacaatcccgcagcccgtggctagggtcgtgtccgaagaaaaatccctgatgttcattaggcccaagaagtacatagtctcttccgggtccgaaccacctgagctagggtatgtcgacatcagaaccctggcagactag

SEQ ID NO: 17392 - DNA, 396 bp, Artificial Sequence
  Description of Artificial Sequence: Synthetic coding sequence
atggaggatggcacccctaaacatatcattcagatgaccggatttaagatggaagaaaaggaggctttggttaaactgcttttgaagctggactgcactttcatcaagtctgaaaagtataagaattgtactcacctcatcgcagagcgcctgtgcaagtccgagaagtttctggccgcctgtgccgcaggcaaatggattctcactaaggactacattatccactctgccaagtccgggagatggctggatgagaccacatatgagtggggatataagattgagaaggactcaaggtactccccccagatgcagtctgctcctaagcgctggagagaggagctaaagagaacaggagcccccggggctttccatcgctggaaagtggtcttatag

SEQ ID NO: 17393 - DNA, 1668 bp, Artificial Sequence
  Description of Artificial Sequence: Synthetic coding sequence
atgcgccttatcggtatgccaaaagagaaatacgaccctccggaccctcgccggatttacactattatgtccgccgaagaagtcgccaatggaaagaagtcccactgggccgagctggaaatcagtggacgcgtgagatccctgagcactagcctatggtcactgacccacttaaccgctctgcatctgaacgataactacctttcaaggattccaccagacattgctaaactccataacttagtttatcttgacctctcgtctaacaaactaagaagtctacctgccgaactcggaaatatggtatctttgagggagttgctacttaacaataatctacttcgggtgcttccttacgagctgggccgactattccagttacagacgctgggacttaaaggaaatccacttagccaggacatattgaatctctaccaggatccagatggcaccagaaaattgctcaacttcatgttagataatttggcagtccaccctgaacagctccctccaagaccttggatcacactgaaagaaagagatcagattctgccatctgcttcatttactgtgatgtgttataacgttctgtgtgacaaatatgcgactcgccagctgtacggttactgcccaagctgggccttgaactgggagtacagaaaaaagggcattatggaggagattgtaaactgtgacgccgacatcatctccctgcaggaggttgagaccgagcagtattttacactcttcttgcctgccctgaaagagagggggtatgatggttttttctcgcccaaaagtagagcaaaaattatgtccgagcaggagagaaaacatgtcgacggctgtgccatcttttttaagacagagaagtttacgcttgtacagaagcacactgtcgaattcaatcaggtcgctatggcaaactccgatggaagtgaagcaatgctgaacagagtcatgacaaaagacaatatcggcgtggccgtggtattggaagtgcacaaagaactgttcggggcgggaatgaagcctatccatgcggcagacaaacagctgctgatagtcgcaaacgcgcacatgcactgggaccctgagtactccgatgtcaagttgatccaaacaatgatgttcgtatctgaagtgaagaacattctggagaaagccagtagtcgacctgggagtccaaccgcggaccccaattctatcccactggtcctctgcgccgacctgaattctcttcctgattcaggggttgtcgaatatctgtcgaacggcggcgttgctgataaccataaagatttcaaagagctccgctacaacgagtgcttaatgaatttctcttgtaatgggaagaacgggagcagcgaagggcgcatcacacatggattccagctgaaaagtgcttatgaaaataatctgatgccctacaccaattacaccttcgacttcaagggcgtgattgattatatcttctacagtaagacacacatgaacgtcctgggcgtactcggtcccttggacccccagtggctggtggagaacaacatcaccgggtgcccacatccacacatccccagcgatcactttagtctcctgacccagctggaacttcacccccctttgctgccattggttaatggcgtccacttgcccaaccgtcgttag

SEQ ID NO: 17394 - DNA, 1635 bp, Artificial Sequence
  Description of Artificial Sequence: Synthetic coding sequence
atgaacacctcaatcccgtaccaacaaaatccgtataatccccgcgggtcgtctaacgtgatccagtgctataggtgtggggacacttgcaaaggagaagtggtccgggtccacaacaaccacttccatattcggtgcttcacttgtcaggtctgcggctgcgggcttgcacagagcgggtttttttttaagaatcaggagtacatatgtactcaggactaccaacagctatacggaactcgttgtgattcctgtcgggacttcattaccggtgaagttatcagtgcccttgggaggacctatcaccctaaatgctttgtgtgttcgctctgcaggaagccctttcctattggggacaaggtcactttttccggcaaagagtgcgtttgccaaacctgtagccagagtatggcatcctctaaaccgatcaagattagaggtccctctcattgcgccggttgcaaagaggagatcaagcacggtcagtccttgctcgccctcgataaacagtggcatgtgtcttgctttaagtgccagacatgctctgttattctgaccggcgaatatattagcaaggacggagtgccttattgcgaatcggactaccacgcgcaattcggcataaaatgcgagacttgcgaccggtacattagtggtcgggtactggaggccggcggaaagcattaccatcccacttgcgctagatgtgtgagatgccaccagatgttcacagaaggtgaagagatgtatttgactggtagcgaggtgtggcaccctatttgcaagcaggcagccagagccgaaaaaaagctgaagcatagaaggacgtccgaaacaagcattagccctcctggctcaagcatcggatctcccaacagggtaatttgtgacatctacgagaacctggatctcaggcagcgtcgagcatccagtccaggatacatcgacagtccaacctactcacggcagggtatgtcacccacattttccagaagccctcatcactactacaggtccggggacttatccactgccacaaaaagcaagacaagcgaagatatcagccagacctcgaaatacagtccgatttacagcccagacccatattacgcatctgagtccgagtactggacttaccacggcagtcctaaagtgcccagagctcggaggttcagcagcggcggcgaagaggatgattttgataggagtatgcacaagttacagtccggcatcggcaggctgattctgaaggaagaaatgaaggctcgcagtagcagctacgctgatccatggactccacccaggtctagtacttcatcccgagaggctctgcacactgccgggtacgaaatgtcactaaatgggagtccccgatcccactacctcgccgactccgatcctctcatcagcaagagcgcctccctgcctgcctacagacggaatggacttcatcgcacaccgagtgccgacctattccactacgactctatgaacgccgtgaattgggggatgcgtgagtataaaatctacccatacgagctattgctggtcaccacacgcgggagaaacaggctgcccaaggatgtggaccgaacccgattggaagggaatttctggaagtctggttgcttgtag

SEQ ID NO: 17395 - DNA, 393 bp, Artificial Sequence
  Description of Artificial Sequence: Synthetic coding sequence
atgggtcgcctggatggcaaagtcattattctgactgccgccgctcaaggaattgggcaggccgcagccctcgcttttgcaagagaaggcgcgaaggttatcgccacggacattaacgagtccaagcttcaggagctcgaaaagtatcctggcatacagacaagggtgctggatgttactaagaagaaacaaattgatcaattcgcaaacgaagttgagagattagacgtgttattcaatgtcgccggctttgtgcaccacggaaccgttctggattgcgaggagaaggattgggatttctccatgaatcttaacgtgaggagtatgtacctcatgatcaaagcatttctcccaaagatgctcgcacaaaaatccggcaatatcataaattag

SEQ ID NO: 17396 - DNA, 1119 bp, Artificial Sequence
  Description of Artificial Sequence: Synthetic coding sequence
atgcagggaccagccggcaacgctagccgaggcttaccaggtggcccgccatccactgtcgccagtggcgctggccgatgtgagagcggagcgttgatgcatagcttcggtatatttctgcaaggcttgctgggtgttgtggccttttcaaccctcatgttaaagaggtttcgggagccaaagcatgagcgacggccttggaggatatggtttttggacacaagtaagcaggccattggaatgctattcattcatttcgcaaacgtctatctcgccgacctgactgaggaggatccgtgtagtctttacctgataaatttcttgctcgatgctacggtcggcatgcttctcatctacgtgggcgtgcgggccgtcagcgtactcgtggagtggcaacaatgggagtccctccgctttggagaatacggagatcccctgcagtgcggggcgtgggtcggccagtgtgccctgtacatcgtgattatgatcttcgagaaatcagtagtatttattgtgctgctgatactgcagtggaaaaaagtcgccctcctgaaccccattgaaaaccccgatctgaagcttgctatcgtgatgcttatcgttcctttcttcgttaacgctctgatgttttgggtggtggataatttcttgatgagaaaaggaaaaaccaaggccaaacttgaagaacgaggcgccaatcaagatagcaggaatggctccaaggtgcgctatcgccgggcagccagccatgaagaatctgaatcagagattctgatctcagccgacgacgaaatggaagagagcgacgtagaggaagaccttcgccgactcactccgctcaaacctgttaaaaagaagaagcaccgcttcggactgcctgcgggcgctcaggaggctccgattaagaaaaaacggcctcccgtcaaagacgaggatcttaaaggcgcacgaggcaacctgactaagaatcaggagatcaaaagcaaaacttatcaggttatgcgagagtgcgagcaagccgggtccgctgccccttctgtgttttcacggactagaaccggcacagaaaccgtgtttgaaaaaccaaaggcgggccctactaagagtgtctttggctag

SEQ ID NO: 17397 - DNA, 507 bp, Artificial Sequence
  Description of Artificial Sequence: Synthetic coding sequence
atgatgttgggcaccgagggcggagagggctttgtagtgaaagtccgcgggttgccctggtcctgcagcgccgacgaggtccaaagattcttcagcgattgtaaaatacagaatggcgcacagggtatccgtttcatctacacccgcgaggggcggccttccggagaggctttcgtcgagttagaaagcgaagacgaagtgaaactggctttaaagaaggaccgggagacgatgggccataggtacgtggaggtgtttaaatcaaataatgtcgagatggactgggtactgaagcacaccggccctaacagtcctgatacagccaacgacggatttgtgagattaaggggcctcccatttggttgctctaaggaggagatagtccagtttttctctggtttagagatagttcctaacggaatcactctgccagtggatttccaagggcggagcaccggcgaggcatttgtacaatttgctagtcaggaaatcgctgaaaaagcctag

SEQ ID NO: 17398 - DNA, 9 bp, Artificial Sequence
  Description of Artificial Sequence: Synthetic coding sequence
atggcttag

SEQ ID NO: 17399 - DNA, 1131 bp, Artificial Sequence
  Description of Artificial Sequence: Synthetic coding sequence
atgacgactgtggtggtgcatgtcgattccaaggcagagctaactacacttttggaacagtgggaaaaggaacacggaagcggccaggacatggtgcccattttgaccagaatgagccaacttatagaaaaggagaccgaggagtaccgcaaaggggacccagaccctttcgacgaccgacaccccgggcgagctgacccagagtgcatgctaggccatctactccggattctgtttaagaatgacgactttatgaacgcactcgtgaatgcatacgttatgactagcagagagcctccacttaacactgcagcctgccgcttgttgctggacatcatgcccggcttggagactgcagtggtgtttcaggagaaggagggcatagtagaaaatctcttcaagtgggcaagagaagcggaccagccattgaggacatattccacggggctgctggggggcgccatggagaatcaggacatcgcagccaattatcgagatgaaaatagccaattagtcgccatcgtgctgcgcaggctgcgcgagttacagctccaagaggtagctctgagacaggaaaacaagaggccttctccacgcaaactgagtagcgaaccactcctgcctcttgacgaggaagccgttgacatggattacggagacatggcagtcgacgtggtggatggagatcaggaggaggcgagcggtgacatggaaatatcttttcacctcgactcaggccacaagactagcagcagggtgaactccactactaaaccagaagatgggggtctgaaaaagaataagtccgccaaacagggagatagagagaattttaggaaggccaaacaaaaacttggtttctcatcgtccgatcctgataggatgttcgtagagctgtctaactcttcttggtcagaaatgtccccttgggtgatcgggaccaactacactctgtatcccatgactcctgccattgaacagaggcttattttacagtatctcactcctttgggcgagtaccaggaactgctgccaatctttatgcaactgggctccagggagttgatgatgttttacattgaccttaagcagacaaacgacgtgcttctgaccttcgaggccttgaagtag

SEQ ID NO: 17400 - DNA, 504 bp, Artificial Sequence
  Description of Artificial Sequence: Synthetic coding sequence
atgagctctaatgagtgctttaaatgcgggagaagcggccattgggccagggaatgtccaactggggggggacgaggccgcggcatgagatcccgcggaaggggaggatttaccagcgacagggacatttgctacaggtgtggtgaaagtggccacctcgcaaaggattgcgatttgcaggaagatgcgtgctacaattgtggacgaggaggacatattgccaaggactgtaaagagcctaaacgggaaagagagcagtgttgttacaactgtggcaagcctggccatcttgctcgggattgcgaccatgcagacgagcaaaaatgttacagctgtggggagttcgggcacatccagaaggactgtacaaaggtgaagtgctatcgctgcggggagaccgggcacgtggccatcaattgctctaaaacctctgaggtgaactgctacaggtgcggtgaatcagggcacctggctcgtgaatgtaccattgaagctactgcatag

SEQ ID NO: 17401 - DNA, 999 bp, Artificial Sequence
  Description of Artificial Sequence: Synthetic coding sequence
atgtccgaggcgggagaagagcaacccatggaaacaactggtgctaccgaaaatgggcacgaagccgtccctgagggggagtctcctgcgggcgcgggcacgggtgccgctgcaggtgctggaggggcgaccgccgctcctccctcaggaaatcagaatggggccgagggcgatcagattaatgctagtaagaatgaggaagacgcaggaaaaatgttcgtgggaggtctcagttgggacaccagcaagaaagatctgaaggattacttcactaaattcggcgaggtggtggattgcactattaagatggaccccaatactgggaggtcccgaggatttggattcattctcttcaaagacgctgcctctgtggagaaagtgctagaccagaaagaacacagattggatggcagggtaattgatcccaagaaagccatggccatgaaaaaagatccagtcaagaaaatctttgtgggcggtttaaaccctgaagcaactgaagagaagattcgagaatatttcggagaatttggagagatcgaagctatagaactgccaatggacccaaaacttaataagcggagggggtttgtgttcataacttttaaggaggaggaacctgtaaaaaaggtgctggagaagaagttccatactgtgtcaggaagtaaatgcgagattaaggtagctcagcctaaggaggtctaccagcagcagcaatacggaagcggaggccggggaaatcgtaacagggggaatcggggaagcggtggaggaggcggcggtgggggacagtctcagagttggaatcagggctatggcaattattggaatcagggctacggctatcaacagggctacggcccgggatatggagggtacgattacagtccatatggctactacggatatggcccaggatatgactactctcagggctctaccaactacgggaagagccagagacgcggagggcaccagaacaattataagccatattag

SEQ ID NO: 17402 - DNA, 615 bp, Artificial Sequence
  Description of Artificial Sequence: Synthetic coding sequence
atgagtgacttaagaattacagaagcgttcctgtacatggattatctctgcttccgggccctctgttgcaaaggaccaccgcctgcaagacccgagtacgatttagtttgtattgggctcacagggagcggaaaaactagccttctgagcaagttgtgtagtgagtcacccgataatgttgtgtccactactggcttttccatcaaggcggtacctttccaaaacgcaattctcaatgtcaaagagcttggaggagctgataatatccgtaaatattggtcacgttactaccagggaagccaaggggtgattttcgtgcttgacagcgcgagttcggaggacgatctagaggcggcacggaacgaactgcactccgcgcttcagcatccccagctttgcacgcttcccttcctcattctggccaaccatcaggataaaccagccgctcgtagcgtccaggaaataaagaagtacttcgagctggagccactggccaggggtaaacgatggatcctgcagccttgttccctggacgacatggacgccctgaaggattcattctcacaactcattaatctcttggaggagaaggatcacgaggccgtgagaatgtag

SEQ ID NO: 17403 - DNA, 6315 bp, Artificial Sequence
  Description of Artificial Sequence: Synthetic coding sequence
atggagtctcaggagttcatcgtcctgtatactcatcagaaaatgaaaaagagcaaggtgtggcaggacggaatccttaaaataacccatctgggaaacaaagcaatcctgtatgacgataagggcgcttgccttgagagtctgtttcttaagtgcctcgaggtaaaacccggtgacgacctggagtcagatcggtacctcattacagtggaagaggtgaaagtagctggagctattggaatagttaagcagaacgtcaacaaggaggctcctgaactgaactctcggacattcatcagttcagggcgaagcctgggctgccaaccctctgggctgaagcgcaaattcacgggctttcaggggccaaggcaggttcccaagaaaatggtcattatggaatccggggagagcgccgcctctcatgaggctaaaaaaacagggcctacaatcttctccccattctgcagtatgcccccgctctttccaactgttggaaaaaaagatgttaacaacattctcgccgatccagagaacatcgtgacctataaaaatagggagagaaatgccatggactttagttcagtgttttctccctcctttcagatcaacccagaagttctgtgtgaggagaactatttttgctctccagtgaattcaggaaacaagttgtcagactcactccttactaatgagcccgttaaacgggattccctggccagccactactctggcgtgtcacagaatatcagaagtaaagcacagatcctagctctgttgaaaagcgagagttcctcaagctgtgaagaattaaactccgaaatgaccgagcattttccccaaaaacaacctcagggaagtctgaagattgccaccaagcccaagtatttgatccaacaggaagaatgtgcagagatgaagagtacagaaaacctgtactatcaacatcaaagcgagaacacgatgaggaataagtctagatgggctatgtacctctcctcacagagcagtccgatccatagcagtactgtcgacgggaacgatactgagagaaaaccaaaggctcaggaagatgacgtcaactcaaacctgaaggatctatcccttcagaaaatcatccaattcgtagagacttacgctgaggagagaaaaaagtacaacgtcgatcaatcagtcggaaataacgatccttcttggaatcaagaggtgaagctggaaatcccttcttttaatgagtcctcatcactccaagtaacctgttctagtgccgagaatgatggcattctgtcagaatcggacatccaggaggataacaagattccttttaatcaaaacgataagggatgcatcaaaggttccgtcctgatcaaggagaacgcacaagaggtgaatacgtgtggcactctcgaaaaagagtacgaacagtccgagagctcactccccgagctcaagcacttacagattgaaagttccaataacagtaggatctctgacgatattaccgatatgatctctgagagcaagatggataatgagtccctgaactccattcatgagtctctgtctaacgtgacccagccttttctggaagtgacttttaatttgaacaactttgagaccagtgatactgaagaagagtcccaggaatctaacaagatctcacaggactcagagtcctgggtaaaagatatcctggttaacgatggcaatagctgctttcagaagcggagcgaaaacacgaattgcgaggaaatcgaaggggaacacctacctttcctgacctctgtgtctgataagccaaccgtcacatttccggtgaaggagaccctaccttcccagttttgcgataagacctacgtgggcttcgatatgggcatttgcaagaccgaaaacacgggaaaagaaatagaggagtactccgatactctatccaacttcgagagctttaagtggacggacgctgtctacggcgataacaaggaagacgctaacaaacctatacaggaggtgcgcatcaactacgattttgccctgcctccaaataagtccaagggtatcaacatgaacctgcatatcccccacatccaaaatcaaatcgccgaaaactccaatttgttttctgaagatgcacagccacagccattcatcctaggttccgatcttgataaaaatgacgagcacgtgctgccaagcacctctagctccgacaactccgttcagctcttaaacacaaaccagaatcattacgagtgcatcgctctggacaagtccaatactcatatttcgaattccctcttctatcctctgggcaagaaacacctcatttccaaggacactgaagcgcatatcagcgaacctgaggatctgggaaaaataaggagccctccacccgatcacgtcgaagtggaaactgctagggaggggaagcagtattggaatcccagaaattcttcagaattatcagggttggtgaacactatttccattttgaaatcactgtgtgagcactcaaccgctctggacagcttggagattctcaaaaagaagaatactgtcttccagcagggcacccagcagacttatgagcctgattcgccgcccgaggtgagaaagccattcatcacggtggtgagtccaaaatcgccccacctccacaaagactcccaacagattctgaaggaggatgaggttgagttgtcagaacctctgcaatctgtccagttctcttcctccggcagtaaggaggaaacagcgtttcaagcagtcattcccaagcagatcgaacgaaaaacttgcgaccctaagcccgtggagttccagggtcatcaggtgaaggggagtgccacaagcggcgttatggtgcggggacactcatcccaactcggatgctctcagttccctgactcaactgaatacgaaaacttcatgacggaaactcctgagctgccctctacttgcatgcagatcgatttccttcaagtgactagcccagaagagaatatttccacattgtcacccgtgagtaccttcagcctgaactcgagagatgaggactttatggtggagttcagcgagacttccctcaaagcaaggacactcccggatgacctgcattttttgaatctagagggcatgaagaaaagccgcagtttggaaaatgaaaatctgcaacgcttgagcctgctctccagaacccaggtccctcttattacccttcctagaactgacggtcctccggatttggacagccattcctatatgatcaacagcaatacctatgagtccagcggatcgcccatgctaaatttgtgcgagaaatcggctgtgctgtcctttagtattgagcctgaagatcagaacgaaacattctttagtgaggaaagccgggaagttaatcctggagatgtgtcgctgaacaatatatcaacccagagcaagtggcttaaatatcaaaacacctcccagtgcaacgtcgctactcccaatcgggtcgacaagcgcatcacagatggattctttgccgaggcggtctcagggatgcacttccgcgacacaagcgaacgccagtcagacgctgtgaacgagagctcactggacagcgtgcacctccagatgatcaagggcatgctatatcagcaaaggcaggactttagctcacaagactctgtctcaaggaaaaaggtcttatccctgaacctgaagcagacaagcaaaactgaagagattaaaaatgtcttaggcggatcaacctgttataactactcggtgaaggatctgcaggagatctccggaagtgagctgtgtttcccgtctggccaaaagattaagtctgcataccttccccagaggcagattcatattcccgctgtcttccagtctcctgcccactataaacagacatttacttcatgcttaattgaacacctcaacatccttctgtttggcttggcccaaaacctccagaaggctctgagcaaggttgatattagcttttatacctcattgaagggggaaaagttaaagaacgccgaaaataatgtccctagctgccaccatagccagcctgccaagctcgtgatggttaaaaaggaaggaccgaataaggggcggctcttttatacctgtgacggtcctaaggcggatagatgcaagttctttaaatggttagaggatgtgactccaggctattccacacaagagggggctagacccggcatggtgctgtctgatataaaaagcattgggttgtacctcagatctcagaaaatccccctttacgaggagtgtcagctattggttaggaaaggcttcgactttcagagaaagcagtatgggaaactcaagaagtttaccaccgtgaatcccgagttttataatgaacccaagacgaaactctacttgaaactttctcgtaaagaacgctccagcgcgtacagcaaaaacgacctgtgggtggtgagcaagactctggacttcgagttggatacttttatagcatgctcggccttctttgggcccagctcaattaacgagatcgagattctgccgctgaagggctatttcccctccaactggcccaccaacatggtggttcatgccctgctcgtctgcaacgcatccaccgagctcacaaccctaaagaacatccaggactactttaaccccgccacactgcctctgacgcagtatctgctgactacttcctctcccactatagtctcaaacaagagggtttctaagagaaaattcatccccccagcatttaccaacgtgagtactaagttcgagctcctctcacttggggccacccttaagctggcctcagagctgatacaggttcacaaactgaataaggatcaggcaacagctttgattcagatcgcacagatgatggcctcccacgaaagcattgaggaggtgaaggaactgcaaacacacacctttccaatcacgattattcatggagtttttggggcaggtaaatcctacctgttggccgtggtcatactcttctttgttcagctgtttgaaaagtctgaggctcccacaattgggaacgcccgcccatggaaactgttgatcagtagctccacaaacgtagcagtcgacagagtcttgcttggcttgctgtccttaggctttgagaattttattcgcgtaggcagcgttcgcaagatagccaaacccattctaccgtactctttacatgctggctctgagaatgagtccgaacagctcaaggaattgcatgctttgatgaaagaggatttaacccccacagagcgagtttatgtccgcaagagcattgagcagcataagctgggcacgaatagaactctgctgaaacaagtacgcgtcgttggcgttacctgcgcggcttgtcctttcccatgcatgaatgacctgaaatttccggttgtggtactcgatgagtgtagtcagataactgagcctgcgtccttgctgcctatcgcaaggttcgaatgcgagaaactaatactggtgggagacccaaagcagttaccacccacaattcagggcagcgacgcagcacacgaaaacggccttgagcaaactcttttcgaccgtctttgtcttatgggtcacaagcctattctgctaaggacccagtacaggtgtcatcctgcaatcagcgcaattgcaaatgatttattctacaaaggggccttgatgaacggcgtcaccgagatcgagagaagccctctcctggaatggctcccaaccctctgtttctacaatgtcaaaggtctcgagcagattgaaagggataacagttttcataatgtagccgaagcaactttcaccctgaagctcattcaatctctgatcgcctcagggattgctgggtccatgataggcgtgattactctgtacaagagtcagatgtacaagctgtgccatctgctgtcagccgtggactttcaccaccccgacatcaagaccgttcaggtttccactgtggacgcttttcagggggcagagaaggagatcatcatcctgtcatgtgtgcggacccgccaagtgggcttcattgacagcgagaaaagaatgaatgttgcgctgacccgaggaaagcggcacctccttattgtcggcaacctggcttgtctgaggaaaaatcaactgtggggccgggtgattcagcactgcgaaggaagagaggatggtctgcagcacgcgaatcagtacgagcctcaactgaaccacctgcttaaagactactttgaaaaacaggtggaagagaagcagaaaaagaaaagtgaaaaggaaaaaagcaaagataagtcccattcttag

SEQ ID NO: 17404 - DNA, 567 bp, Artificial Sequence
  Description of Artificial Sequence: Synthetic coding sequence
atggccgcgactgctcgtgaggatggtgcatctgggcaggaaagagggcagcgcggctgcgaacattatgaccgcggttgtcttcttaaagctccatgctgtgataagctgtacacctgccggctctgccatgataataatgaggaccatcaactcgaccggtttaaagttaaggaggtccaatgtatcaactgcgaaaaaatccagcacgcccagcaaacctgtgaggagtgttctacactgttcggcgagtactattgcgacatatgccatttatttgataaggacaagaagcagtaccattgtgagaattgtggtatttgtaggatcggacctaaagaggattttttccattgcctgaagtgcaatctctgtctcgcaatgaatctgcaagggcggcataaatgcatagaaaacgtttcccgacagaactgccccatctgcctcgaagatattcacacctcccgagtagtggcccacgtgctaccctgtggtcacctgttgcaccggacgtgctatgaggaaatgttgaaggagtacgaccaggttctcgagactgcaggctag

SEQ ID NO: 17405 - DNA, 339 bp, Artificial Sequence
  Description of Artificial Sequence: Synthetic coding sequence
atggcaaccggggacctcaagcggtctctacgaaatttagagcaagtactgcgtcttctgaattatccagaagaggtggactgtgtcggactgattaaaggtgatcccgctgccagtctccccattatatcctacagtttcaccagctactcaccgtacgtcactgagctgatcatggagtccaatgtcgaactcattgccaaaaacgatctccgattcatcgacgccgtgtacaagcttttgcgcgatcaatttaactacaagcctattctgacaaagaagcagttcattcaatgcggattcgcggagtggaaaatacagatcgtatgcgatatctag

SEQ ID NO: 17406 - DNA, 363 bp, Artificial Sequence
  Description of Artificial Sequence: Synthetic coding sequence
atgtggaaggtggtgaacctcccaactgacctgttcaacagcgttatgaatgttggaaggtttactgaggaaatcgaatggctgaaatttctcgcactagcctgttcagcactgggcgtgacaattacaaagaccctgaaaatcgtgtgtgaggttctctcttgcgaccataatgggggactgccacgcattcctttttccacatttcagttcctgtatacatatattgcggaggttgacggagagatctgtgcgagccacgtcagcagaatgctcaactatattgaacaggaggttattggccctgacggtttgataacagtaaatgacttcacccaaaacccacgtgtgtggctggagtag

SEQ ID NO: 17407 - DNA, 2490 bp, Artificial Sequence
  Description of Artificial Sequence: Synthetic coding sequence
atggcgaaatataacacgggaggcaaccccaccgaagacgtcagcgtaaactcacgtccattcagggtcacagggcctaactcatcaagtggaattcaggctaggaaaaacttatttaacaatcaaggaaatgcaagcccccccgctggcccctcaaatgtgccgaaatttggttcacccaaacccccagttgccgtgaagccctccagtgaagagaagcctgacaaggagcccaagccaccttttcttaaacctactggcgccggacagcgattcggaaccccggcaagcctgaccacacgcgatccggaggcgaaagttggattcttaaaaccggtcggccccaagcccataaatttgcctaaggaggattctaagccgaccttcccctggccccccggaaataaaccaagcctgcactcagtgaatcaggaccacgaccttaagcctctgggaccaaagtctggaccaacacccccaaccagcgagaatgaacagaagcaggcctttcctaagttgacaggggtgaaagggaaattcatgtccgcgtcacaagacctcgaaccaaaaccactcttcccaaaaccagcctttggccaaaagccccctctgagtactgagaatagtcacgaagacgagtccccaatgaagaatgtatcatcctccaagggcagtccagcccctctgggggtgaggagcaaaagcggtcccttgaagcccgcccgcgaggactcagagaataaggatcatgccggagaaatttcctcactgccttttccaggggtggtcctgaaacccgcggcctcgcgaggtgggccaggattgtcgaagaacggcgaagaaaaaaaggaggaccggaagatcgacgcagccaagaatacctttcagagtaagattaaccaggaggagctggcatcaggaacccccccagcacggttcccgaaagctcccagcaaattgactgtaggaggcccatgggggcaatcccaggaaaaggaaaagggcgataaaaattctgccacccccaaacagaaaccactcccccccctcttcactctcgggcccccaccccccaagcctaaccgcccccctaatgtggatctgacaaaatttcacaaaacttcatcaggcaacagcacttcaaagggccagacgagctatagcaccacttccctgcctcctcccccgccctcacatcccgctagccagcccccattgccagccagccatccctctcagccccctgtacccagcctaccaccacgcaacataaaaccacccttcgatctgaagagcccagtgaacgaggataatcaagatggagtgacacactccgacggagctggaaatctagatgaagagcaggattcagagggcgaaacttacgaagacatcgaggcctctaaggaaagagaaaagaaacgggaaaaggaggagaaaaaaaggttggagctggagaagaaagagcagaaggaaaaagaaaagaaagagcaagaaattaaaaagaagttcaaactgactggtcccatccaggtgatccatcttgcaaaggcctgctgcgatgtgaaaggcggcaagaatgagttatccttcaaacaaggagagcagatcgagataatccggattaccgacaaccccgagggaaaatggctcggcaggaccgctcgtggttcctacggatatataaagaccacagctgtggaaatcgactatgatagccttaagctgaagaaggactccctaggtgctccctcccggccaatagaagatgaccaggaggtgtacgatgacgtggctgaacaagacgacatctcaagtcatagccagagcggctctggggggattttcccacccccccccgatgacgacatctatgatggcattgaagaggaagatgcggacgatggaagcacactgcaggtgcaggagaagtccaacacttggtcttggggtatcttaaagatgttgaagggaaaggacgaccgaaaaaagagcatccgcgagaagcccaaagtgtctgacagcgataacaatgagggatcgtctttcccagctcctcctaagcagctggatatgggagacgaggtgtacgacgacgtggatacaagtgacttcccagtcagcagcgctgaaatgtcccagggaactaacgtgggtaaagctaaaaccgaggagaaagacctcaaaaaactgaagaagcaggagaaagaggaaaaggacttccgcaaaaaattcaagtacgatggagagattcgcgtgctgtattctactaaagtgactacctccatcactagcaagaagtggggtactagggacctccaggtgaagccgggggagagtctcgaggtgatccaaaccacagatgatacgaaggtgctgtgcagaaatgaagaaggaaagtacggctacgtcttacgttcatacctggccgataacgatggcgagatctacgacgacatcgccgacggctgtatctatgataatgactag

SEQ ID NO: 17408 - DNA, 795 bp, Artificial Sequence
  Description of Artificial Sequence: Synthetic coding sequence
atgccagatagcgcacctgcgatggctgacaagatggatatgagtctcgacgatataattaagctcaaccggagccaaaggggcgggcgcggcggaggccgcggtcgcgggagagcgggaagtcaaggcggcagaggtggtggtgcacaggctgcagcacgggttaaccgcggcggtggtcctattcggaatagacctgcaattgcccgcggagccgccggcggtggcggcaggaatagacctgccccctactcgcggccaaagcaactgcccgataagtggcagcatgacctgtttgattctgggtttggcgggggggccggcgtagagacgggaggaaagttgttggtgtcaaatctcgacttcggtgtgtccgacgccgatattcaagagctctttgcggaatttggaactctaaagaaggccgccgtgcattatgacagatcaggccgctccctgggtaccgctgatgttcatttcgaacggaaagctgacgccctgaaagctatgaagcagtataatggggtgccgttagatggccgccctatgaacatccagctcgtgacctcacagatcgacgcccagagaaggcccgcccagagtgtgaaccgtggtgggatgaccaggaatagaggggctggggggtttggcggggggggcggcacacggaggggcacacgaggaggagcaagaggaagggggagaggggccggccgcaatagtaagcaacagctgtcggcggaggaattagatgcccagctcgatgcctacaatgcccgaatggacacaagctag

SEQ ID NO: 17409 - DNA, 312 bp, Artificial Sequence
  Description of Artificial Sequence: Synthetic coding sequence
atggccaagcatggcgctgacgagcccagctcccgatccgggagccccgacagagagggcagggccagtgaagatcggagcttgctccaccaaagactggctgttcgggaactgatcgacaccgaagtaagttacctgcatatgctgcagctgtgtgcctctgacatcagatctcgtttacagcagctaccgcagggggacctcgatgtgctgttctcgaatattgatgatattataaaggttaattctcgattcttgcacgacctccaggaaacagcgagcaaggaagaggagcaagttcaactggtgtag

SEQ ID NO: 17410 - DNA, 639 bp, Artificial Sequence
  Description of Artificial Sequence: Synthetic coding sequence
atgatgctcggcacagaaggaggagaggggttcgtagtaaaagtccgggggctcccctggtcatgttcggcggacgaggtccagaggttcttttccgactgtaagatacagaacggcgcccagggtatcagattcatttatactagagaggggcggccttcgggagaagcctttgttgagttggagagcgaggacgaggtcaaactggcattgaaaaaagatcgcgaaactatgggtcatcgctacgtcgaagtttttaagagcaataacgtggagatggattgggtgctcaagcacacaggacccaattccccagatacagctaatgatggattcgtccggctcagaggcctcccattcgggtgtagcaaggaggagatagttcagttttttagcggcctggagatcgtgcctaacggaatcacgcttcctgtggacttccaaggtagaagcacaggcgaagcctttgtgcaatttgcttctcaggaaattgcagagaaggccctgaagaagcataaagaaagaataggccatagatacattgaaatcttcaagagcagtagagcggaggttcgaacacactatgacccacctcgcaaattaatggcaatgcagcgcccagggccttatgacaggtag

SEQ ID NO: 17411 - DNA, 1020 bp, Artificial Sequence
  Description of Artificial Sequence: Synthetic coding sequence
atgtggaccgcacgggggcccttccggcgagacaggtggtcttccgaggacgaggaggcagcaggcccttctcaagctttgtcccctctcctttctgatacgcgcaagattgtgtccgaaggcgagctggaccagctggcacagattcgacctctcatcttcaacttccacgagcagaccgccataaaagattgtcttaagatcttggaagaaaagactgccgcttacgacatcatgcaggagtttatggccctggagctgaagaacctcccgggtgaatttaattccggaaaccagccaagcaatagagagaagaaccgatacagggacattctcccctacgacagtacgagggtgcccctggggaaaagcaaagattacattaatgcatcttatatccggattgttaattgtggcgaagagtatttctacatcgccacccaaggaccgttgttgagtacgattgatgacttctggcaaatggtgctggaaaacaactcaaatgtcattgccatgatcactcgggagatcgagggcggcattatcaaatgctaccactactggcctatctccctgaaaaagcctctggaactgaaacacttcagggtatttttagagaattaccaaattctgcaatacttcatcataaggatgtttcaggtggtagagaaaagtaccggcacaagccactccgttaaacagctgcagttcacaaaatggcccgatcacggaacccctgcatccgccgattcgttcataaaatacatcagatacgcccgcaagtcccacctgaccgggcctatggtggtccattgctccgccggcataggccgaactggggtgtttctgtgcgtggatgtggtgttctgtgccattgtgaagaactgttcatttaatattatggatatcgtggcccagatgagagagcaacgctctggaatggtgcagaccaaagagcagtatcatttctgctatgatattgtgcttgaggtccttagaaagctactaaccctggactag

SEQ ID NO: 17412 - DNA, 3213 bp, Artificial Sequence
  Description of Artificial Sequence: Synthetic coding sequence
atggcaggcgcgctccgtcgaggccgggccctcggctcccggccaagtggccctacggtgtcctctcgccgctccccacaatgccccgtggcacaagaagggctgggggcccggtcccggcctcgcgtggccccacggtccctagctaggtgcggtccgtcatcacgactgatgggttggaaaccaagtgaagccaggggacagagccagagtttccaagcgtcagggctgcagccccgcagcctgaaggcggcgcgtcgggcaaccggccggcccgatcggagtagagccgctcgcccaacgatggacccaagcgcccatcggtctagggcagcccccccaaatatggacccggaccctcaggcgggtgtgcaggttggtatgagagtggttagaggagtagattggaagtgggggcagcaggatggcggtgaaggaggggttggaacagttgtagagctaggcagacatgggagtccaagcaccccagatcggaccgtcgtggtccaatgggaccaagggactagaacaaactaccgcgctggataccaaggcgctcacgatcttctcttatacgataatgcccagataggcgttagacacccgaatatcatctgcgactgctgcaagaaacatgggctgagagggatgaggtggaagtgcagagtgtgtcttgattatgatctatgcacacaatgctacatgcataacaaacacgagcttgcccacgcgtttgatcgctacgaaacagctcactctaggcccgtgacactgtcaccccgccaaggactgcctagaatccctctcagggggatttttcagggggccaaagtcgttcgggggcccgactgggagtggggttcacaggatgggggtgaaggcaaaccaggtcgagtggtggacattcgaggttgggatgttgagacagggaggagcgtagccagtgtaacatgggcggacgggacgacaaacgtttatcgcgtgggccacaaaggaaaggtggacctcaagtgtgtgggggaagccgctggtgggttctactataaggaccatttgcctcgactaggcaaaccggcagaactgcagagaagggtctccgcggatagccagccgttccaacatggcgacaaagtgaagtgtctcctggatacggatgtcctccgggaaatgcaggaaggccacggaggctggaacccacgcatggctgagttcatcggtcaaaccggcactgtccatagaatcacagacaggggagatgtgcgcgttcagtttaatcatgagactcgctggacttttcacccgggcgcactgaccaaacaccactcattctgggtcggcgacgtagtccgggttattggcgacctggataccgtgaaaagactgcaggcagggcacggcgaatggaccgacgacatggctcctgcgctgggacgagtggggaaagtcgtaaaagtgtttggggatggtaacttgagggtggcagtggccgggcagaggtggacattcagccccagctgtttggtggcttacagaccggaggaagacgctaatctggatgtagccgagagagccagggagaataagtccagcctgagtgtggcacttgacaagctccgggcacagaaatctgatccggagcatccagggagactcgtagtagaggtggctctggggaacgccgcacgagccctagacctgctcagacgccgtcctgaacaggtcgataccaaaaaccaagggcgtacagcgctgcaggttgctgcttatctcgggcaggtcgaactgatccgactactgctgcaagcgagagctggggtagacctgcctgacgacgaggggaacaccgccctgcattacgccgctttaggcaatcagcctgaagctaccagggtccttctgagtgccgggtgccgggccgacgccatcaattccacccaatccactgcgctccatgtagcagtgcagagaggttttctcgaggtagtgagggctttgtgtgagagaggctgtgatgtaaacctgccggatgcacacagcgacactcctctccacagtgcaattagtgccggtaccggggcctcaggtatcgtggaggttctcactgaggtgccgaacattgatgttacagcaaccaacagccagggcttcaccctgttacaccacgcctctttgaagggccacgcgctagctgtgcgtaagattctcgcgagagccaggcaactggtggatgccaagaaagaggacggattcaccgctctgcatcttgcagccctaaacaatcaccgagaggtggctcaaattctcatcagggaagggaggtgcgacgttaacgtgagaaaccgcaaactacagtctcccctgcatctcgccgttcagcaggcacatgtgggcttagtacctctcttagtggatgctggttgttcagtgaatgctgaggacgaggagggggatacggctctgcacgtcgcactgcagcgccaccagctgctgcccttggtggctgacggcgcaggtggtgaccctggcccactgcagcttttgagtcggctccaggcatcaggtctcccaggaagtgctgagctgactgtgggcgcagctgttgcttgctttcttgcactcgagggcgccgatgtgtcgtatacaaatcaccgtgggagaagtcccctggacttagctgccgaaggacgcgtactaaaggcactccagggatgcgcacagcgtttcagagagagacaggcaggggggggggctgcccctggtccgcgacagacccttggcactcctaatacagtcacgaatctacacgttggcgccgcccctggtcctgaggccgcagaatgcttggtctgctcagaactcgcactcctcgtcttgttctccccgtgtcagcaccgcactgtatgtgaagaatgcgcacggagaatgaaaaagtgcattcgctgccaggtggtggtgagcaagaagctgcgtcctgatggatcggaagttgctagtgcggctcctgcaccaggccctcctcgtcagctggtggaggagctgcaaagccgatacaggcagatggaagaacgaattacatgtccaatctgcattgattcacacatacgcctggttttccagtgtgggcacggggcgtgtgccccgtgtggcagtgccctgtcagcttgtcccatttgccggcaacctatccgcgaccgaatccaaatttttgtatag

SEQ ID NO: 17413 - DNA, 957 bp, Artificial Sequence
  Description of Artificial Sequence: Synthetic coding sequence
atgtgtcgcactgccctgggggttaccacccttcaagaccttggagtttgctggcgaaaggagcatgatcccgcagagatgctcagagtgggcagagcagagttaggcgggtggaagccctcatgggaagcaatagtgaaggaagtcgccgcagcgactggtcacacagtggtgctggtagaccagaccgaggacatcctggctaaatcaaagaaaggaatcgaggaaagtttgagaaaggtagcaaaaaagaagttcgctgagaatctgaaagcaggcgatgaatttgtagagaaaacattatccaccatcgccaccagcactgatgccgcctcagttgtacacagcacagatttggtggttgaagctatcgtcgagaaccttaaagtgaagaacgagctattcaaacggctggataagttcgcggctgagcacacaatattcgcgtccaataccagttctttgcaaattacaagtatcgctaacgccacgactcgccaggaccgcttcgcggggctgcacttcttcaaccccgtccccgtcatgaagttagtggaagtcatcaaaacccccatgacctcccagaagaccttcgagagcctcgtggatttcagcaaggcactcgggaagcacccagtctcctgcaaagacacaccaggattcattgtgaatagactgctggtgccttacttgatggaggccattagactctacgagcgcggggacgcatcaaaagaggacatcgacacagcaatgaagcttggcgcgggctatcccatgggaccatttgagcttttggactacgtcggcttggacaccaccaaattcatcgtggatggctggcatgaaatggacgctgagaatcctctgcaccagccctccccatcattaaacaagctggtggctgagaataagttcggaaaaaaaacgggagaaggtttctacaaatacaaatag

SEQ ID NO: 17414 - DNA, 1044 bp, Artificial Sequence
  Description of Artificial Sequence: Synthetic coding sequence
atgaagcttaccagcgaaaagctgcctaaaaatccgttctatgcctcagtgtctcaatatgctgccaaaaaccaaaagttttttcagtggaaaaaggaaaaaactgactatacacacgccaatctggtggacaaggctcttcaactgctgaaagagcggatactgaaaggcgacactctcgcctatttcttgagaggacagctgtatttcgaagaagggtggtacgaagaggcactcgaacagtttgaagaaattaaggagaaagatcaccaggccacctaccaattgggcgttatgtattacgacggtctcgggactaccctggacgctgagaaaggggtggactacatgaaaaaaattttagatagtccatgccccaaagcccggcatttgaaattcgctgctgcatacaatttgggacgcgcttattatgaaggaaaaggcgtgaaaagaagcaacgaggaagctgagcgcctgtggctcatcgccgccgataatgggaaccctaaagcatccgttaaggctcaatcaatgttggggctatattattccaccaaggagcccaaggagctagaaaaggcattttactggcattctgaggcatgcggcaacggcaatctggagtctcagggtgcactgggattaatgtatctctacggtcagggaataagacaggatacagaggctgctttgcagtgccttcgcgaggccgctgaacgtggcaatgtgtacgctcagggaaacctggttgaatattactataagatgaaattctttaccaagtgcgtagccttcagcaagaggatcgctgactacgatgaggttcacgacatcccaatgattgcccaggttacggattgcctcccggaatttatcgggcggggaatggccatggcctctttttaccacgcaaggtgcctgcaactcggcttgggcattacacgagatgagactaccgctaagcactattactctaaagcctgtaggctgaaccctgccttagccgatgaactgcactctcttttaatccgccagcgaatatag

SEQ ID NO: 17415 - DNA, 108 bp, Artificial Sequence
  Description of Artificial Sequence: Synthetic coding sequence
atgccccagactttcagcggcggcagaggcttcgagctcgattcaggcagcgatgacatggatccgggacgtcccagacctccacgcgacccggatgagctgcactag

SEQ ID NO: 17416 - DNA, 1179 bp, Artificial Sequence
  Description of Artificial Sequence: Synthetic coding sequence
atgggcacgacttgcctccacctgggaactttggaacagtcattggtgttcgaaaacaaggtgaactcagaaaaggtgaaattgagccttaggaatttccctcataacgattacgaggacgtgttcgaggagccgtcagagagcggatccgatccaagcatgtggacagcaagaggacctttcagaagagatcgatggtcctccgaagacgaggaagctgccgggcccagtcaagctctgtcccctttgctatctgatacacgtaagatagtatccgaaggcgagctggatcagctggcccagattaggcctctgattttcaatttccatgagcagacggccatcaaagattgtctgaagattttagaggaaaaaaccgcagcctacgacattatgcaagaattcatggccctggagctgaaaaacctgccaggtgagttcaacagcggtaatcagccaagcaaccgcgaaaagaatcgttatcgcgatatcctgccttacgattccacgcgagtccctctcggtaagtctaaggattatatcaacgctagttacattagaatcgttaattgtggcgaggagtatttctacatagctacccaagggcccctgttgtcaactattgacgatttttggcagatggttttggagaataattctaacgttattgccatgataacacgtgaaattgagggaggcatcatcaagtgctatcattattggcccatcagtttaaagaagccacttgagctgaagcatttccgcgttttcctagagaactatcagatattacaatatttcataatcaggatgtttcaggtggtggagaaaagtaccggcacctcccactctgtcaagcagttgcaatttacgaaatggccagaccatgggactccagcttccgccgacagttttataaagtatattcgctacgccaggaagtcccacctaacaggccccatggttgtgcactgttctgctggaattggtagaactggcgtgttcttatgcgtcgatgtggtgttttgcgcgatagtcaagaactgtagctttaatattatggatattgttgctcagatgcgcgagcaacgttccgggatggtgcaaacgaaggaacagtaccatttctgctatgacattgtactcgaagtgctgagaaagttgctgactctggactag

SEQ ID NO: 17417 - DNA, 2052 bp, Artificial Sequence
  Description of Artificial Sequence: Synthetic coding sequence
atgaatacttccattccttaccaacaaaacccctacaatccaaggggcagttccaacgtgattcagtgctacagatgtggcgatacatgcaaaggggaagtggtaagggtgcataataatcacttccatatacggtgcttcacctgccaggtgtgcggatgcggcctcgcacaaagtggctttttcttcaaaaaccaggaatacatttgcacccaggactaccaacagctctatgggacccggtgcgactcctgtcgggattttattaccggtgaagtgatcagcgcactaggcagaacctatcatcccaagtgcttcgtgtgctcgctctgccgaaaacccttccctatcggagacaaagtgacattctccggcaaggaatgcgtctgccaaacctgcagtcagtccatggcgtcgtccaaaccgatcaaaatccgggggcctagtcattgcgccggctgcaaagaggaaattaaacacggacaatccttattagccctggacaagcaatggcatgtgtcctgtttcaagtgtcaaacctgttctgtgatcttgaccggagaatacatatcaaaagacggcgtcccatactgcgaatccgactatcatgctcagttcggaatcaagtgcgaaacttgcgatcgctacatatcagggagggtgctggaggcaggcggcaaacattaccaccccacatgtgcaaggtgcgtgcgttgtcaccagatgtttacagagggcgaagaaatgtatctcacagggagtgaagtttggcatcccatctgtaaacaggccgccagagctgagaaaaaacttaagcacaggcggacttctgagacaagcatctctcctcctggaagcagcatcggatctccgaacagggtaatctgtgcaaaagtcgataacgagattctgaactataaggatctggccgccctgcctaaggtaaagtctatctacgaagttcaacggccagatctcatcagttatgaaccccacagccgctatatgagcgacgagatgctcgaaagatgcggttatggggagagcctagggacactgtccccgtatagtcaggatatttacgagaacctggacctcaggcaaagacgagcctcatcccccggctatattgatagtcccacctactctaggcagggaatgtcgcctacattcagccggagtcctcatcactactaccgatctggaccagagtctgggcgtagttcgccataccattctcagctggatgtgaggtcctcaacaccaacgagttatcaagccccaaagcattttcatatccctgctggagactctaacatatacaggaaacccccgatttataagcgccacggcgatctgtctacggctacgaagtccaagaccagcgaggacatctctcagaccagcaaatactcacccatctacagccctgacccctattatgcatccgagagtgagtattggacctatcacggctccccgaaggtgccaagggcccggcgcttctcttcgggcggcgaggaggacgacttcgatcgctcaatgcacaaactgcaatctggaatagggcggctcatactgaaagaggagatgaaagctcggtcatcctcatacgccgacccctggactccaccacgttcctctacatccagcagggaagcgctacacacagctggttatgagatgtctctcaatgggtctccccgatctcattatctggctgactccgatcctcttatttccaaatctgcctcgctgccggcctacagaagaaacggcctgcatcggaccccgagcgcagatctgttccactacgattcaatgaacgcagtcaattggggcatgcgtgagtataagatctacccctatgaactgctactggtcacaacccgcggcaggaacaggctgcccaaagacgtggataggaccagactggagagacacctttcccaggaggagttctatcaggtattcggcatgacaatttcggagttcgatcggctcgctctatggaaaaggaatgagctgaaaaaacaggccaggctattctag

SEQ ID NO: 17418 - DNA, 99 bp, Artificial Sequence
  Description of Artificial Sequence: Synthetic coding sequence
atggacttcttttcttctcatcttctcgccgattcctcctcacctgccactaattcgagtcacacagacgcacacgaaatcctggtctcagacttctag

SEQ ID NO: 17419 - DNA, 858 bp, Artificial Sequence
  Description of Artificial Sequence: Synthetic coding sequence
atgagtgaagcaggtgaagagcagccgatggagactactggggcaacagaaaatggacatgaagccgtacccgaaggggagtcgccagcaggtgctgggacaggtgcagcagctggagccggtggtgccaccgctgctcccccttctggtaatcaaaatggcgccgagggtgaccagataaatgcctcaaagaatgaggaggatgcagggaagatgttcgtcggaggcctttcgtgggacacatcaaagaaagatttgaaagattatttcaccaagtttggagaggttgttgattgtacaattaagatggaccctaacacaggtcgaagcagaggtttcggctttatcctattcaaggacgccgcatcagtcgagaaagttcttgaccagaaagaacatagactggacggcagagtgatcgatccgaaaaaagcaatggcaatgaagaaagaccccgtgaagaagatctttgtgggcgggttaaaccctgaagcaacggaggaaaaaatacgagagtattttggcgaatttggcgaaattgaggcaatcgaactgcctatggatcctaaactgaacaagcgtaggggattcgtgttcataacattcaaggaagaggagcccgtgaagaaggtcctcgaaaagaaatttcacaccgttagcggatccaaatgcgaaattaaagtggcgcagcctaaagaggtgtatcaacagcagcagtatggctccggtggcagaggcaatcggaaccgggggaatcgcggttcaggcggcggcggtggcggaggcggccagggtagcacgaattacggtaaatctcagaggcgaggcggtcaccaaaacaactacaagccttattag

SEQ ID NO: 17420 - DNA, 354 bp, Artificial Sequence
  Description of Artificial Sequence: Synthetic coding sequence
atggtgcaaagacttacatataggaggagattgagctacaacactgcaagcaacaagacccggttatctaggactcctggcaatcggatcgtctacctctatacgaagaaagtgggcaaggcacctaagtcagcctgtggagtttgtccaggccgcctgaggggggtgcgcgcagtccgtcctaaagtgctgatgaggttatcaaaaaccaaaaaacatgtatctagggcgtatggcggctcgatgtgcgccaagtgtgtcagggacagaatcaagcgggcttttctgattgaggaacagaaaatagtggttaaggtattaaaagcccaggcccagtcacagaaagctaagtag

SEQ ID NO: 17421 - DNA, 7614 bp, Artificial Sequence
  Description of Artificial Sequence: Synthetic coding sequence
atggaggactttcgaggcattgcggaggaaagctttccgtcattcctgaccaacagcttatttggaaactcagggatactcgagaatgtgacgctttctagtaatctcgggctgccggtggctgtatctaccttggctcgggatcgatcttcaaccgataatcgctaccctgacatccaggcaagttatttggtcgagggaagattttcagtcccgtccggctcctcaccaggcagccagtccgacgctgagcctagggagcgccttcagctgagtttccaggacgatgacagcattagccggaagaagtcttacgtggaaagccagcgattaagcaacgcactatccaaacaaagtgctctccagatggagacagctgggcccgaagaggaacctgccggtgctaccgaaagcctccagggacaggatcttttcaacagggcatcacctctggagcaggcccaggattctcctattgattttcacctgcagtcttggatgaacaacaaggaaccaaagatcgtcgttctggacgccggcaagcattttgaggacaaaacccttaagtccgacctgtcccacaccagcctcctcgaaaatgaaaagctgattctgccaacgtctctggaggactcatccgatgatgacatagacgacgagatgttctacgacgaccacctggaagcctatttcgagcaacttgccatacccgggatgatctatgaggaccttgagggacctgaaccccccgagaagggatttaagctccctacgaatggcctgcgccaagctaacgagaatggcagtctgaattgtaaattccagtctgagaataactcttctctaatcagtcttgattcccatagctcagagaccacccataaggaatccgaagagtctcaggtgatttgtctcccagggacctccaattccattgggacgggcgactcaaggcgttacactgatggcatgttacccttcagcagtggaacttggggtacagagaaggagatagagaacctcaaggggattgtgcccgatctgaatagtgaatgcgcatctaaggacgtcctcgtgaaaaccctgcgagcaatagacgtgaaactgaactcagataattttcacgatgcaaacgctaatcgcggaggattcgacctcacagacccagtaaaacagggtgccgaatgtccccatcagaacaagactgtcctacatatggatggatgccttgatactgagacaccaacagtcagcatacaggaaaatgtcgacgtagcgtctctgaaacctatcagtgattcaggtataaacttcacggatgcaatctggtctcccacttgtgagagacgtacttgcgaatgccacgagtcaattgagaaaaacaaagacaaaacagacctgccacagtcagtggtctatcagaacgaagagggtcggtgggtgactgatctggcctactacacctcattcaatagcaagcaaaatctgaatgtctctctgtctgacgagatgaacgaagactttcgcagcggaagtgaagctttcgaccttatcgcacaggacgaggaagaattcaacaaagaacaccagtttatccaggaagagaacatagatgcccacaatacttccgtagcactcggagatacttcctggggtgccacaatcaactattctctgctcagaaaatcccgtagtacgtctgatctagacaaggatgacgcctcttacctgaggctcagcctgggcgaattctttgcccagcggtctgaagccctggggtgtttgggtggcggaaataacgtgaagcggccctctttcgggtacttcatcagatcccccgagaagagggagccaatcgctttgattaggaagtctgatgtgtccagaggaaatctcgagaaagagatggcgcacctgaatcatgatctgtacagcggagatttgaacgagcaatcacaggcccaactttccgagggttccattacgctacaggtagaagccgttgagtccacctcgcaggtcgatgaaaatgatgtaacacttaccgcagacaaaggtaaaactgaggataccttctttatgagcaacaaaccgcaacggtacaaagataaactccccgacagcggagactccatgctgcgcatcagtacaattgctagtgccatcgctgaagcatctgtgaacactgatcctagtcagctggccgcgatgatcaaggccctaagcaacaagactcgggataagacattccaggaggatgagaagcaaaaagactacagccatgtacgtcactttctcccgaacgatcttgaaaaatcaaacggatcaaacgctctggacatggagaagtacctcaaaaaaacagaggtttctagatatgaatccgctctggagaacttcagcagggcatcaatgagcgatacttgggatctatcattgcctaaggaacagaccactcaagacattcatcccgtagatttgtccgccaccagtgtcagcgttcgagcccccgaggaaaatacggctgccattgtctatgttgaaaacggagaatccgagaatcaagagtcattcaggaccattaacagtagtaactccgtcacgaacagggaaaataactccgccgtggttgacgtaaaaacctgcagtattgacaacaaactccaagatgtggggaacgatgaaaaagccacatctatctcaacaccttccgacagctatagtagtgtgcggaatcctagaattacttctctatgcctgctcaaggactgtgaggagatccgtgacaaccgagaaaaccaacgccagaatgagtgtgtcagcgaaatatcaaacagcgaaaagcacgtgaccttcgaaaaccatcgcattgtgagccccaagaatagcgatctgaaaaacacttcgccagaacatgggggtaggggttcggaggacgagcaagaatcttttaggccttccacctcccctcttagtcactcctcccccagtgagatctctggcaccagcagttccgggtgtgcgctcgagtctttcgggtcagcggcacaacagcagcagcccccctgcgaacaggaattgagcccactggtgtgcagtcccgctggcgtttctagattgacatatgttagtgagccggaatctagctacccaaccacagctactgatgatgccctggaggacaggaaaagcgacattacctccgagctctcaaccaccatcatacaaggtagtccggccgcattggaagagcgagccatggaaaaacttcgagaaaaggtgcccttccagaaccgcgggaaagggacactgtccagcatcattcagaacaactccgacacaagaaaggcaacagagactactagcctatcaagtaaacccgagtatgtgaagcccgattttcgatggagcaaagacccctcatcgaaatccgggaatttgcttgagacctcagaagtcggctggacttcaaaccctgaggagctggacccgatcagattagccctactggggaaaagcggtctgtcttgtcaggtgggaagtgccacctcacatcctgtgagttgtcaagaaccaatcgatgaggaccaacgcatctcccccaaagacaaatctaccgcgggaagagaattttctgggcaggtgagtcaccagactacaagcgagaaccagtgtactccaattcccagcagcacagttcactcaagtgtcgcagacatgcaaaacatgccggcggccgtgcatgcactccttacccagccatctttgagtgctgcacccttcgcccagaggtaccttgggacattgccatccaccgggagcaccacgctgccacagtgtcacgccggtaacgccactgtttgtggatttagtggcggcctcccctatcccgcagtcgccggggaacctgtgcagaacagtgtggctgtgggcatttgcctggggagcaacattgggtccgggtggatgggcacttctagtctgtgtaacccctatagtaacacactgaatcagaatctgctgtctaccactaaaccctttccagtgccttcagtgggtacaaactgcggcatcgaaccttgggattctggggtgacctcggggctcgggtctgtgagagtgcctgaagagctgaaactgcctcacgcatgttgcgttggaatagcgagtcagacactgctgtccgttctcaatcctactgacaggtggcttcaagtcagcattggcgtgctttctatttccgtcaatggtgagaaagtcgacctgtcaacttacagatgccttgtttttaagaacaaggccattattcgacctcatgccaccgaggaaattaaagtgttgtttattccatccagcccgggcgtttttcggtgcaccttttctgtggcaagttggccatgtagcactgacgccgaaactatcgtgcaagctgaggccctggctagcacggtcactttgacagcaatcgccgagtcacccgttatcgaggttgagaccgaaaagaaggacgtactcgactttggcgatctgacatacggcgggtggaaggccttgcccctaaaattgatcaaccggacacatgccacagtccctatccgacttatcattaacgccaatgccgtcgcttggaggtgtttcacctttagcaaagaaagcgtgcgggctcctgtggaggtagctccttgcgctgatgtcgtgacgaggctcgcagggccatccgtggtgaaccacatgatgcccgcctcatatgacggacaagatcctgaattcctcatgatctgggttctgtttcattcccccaaaaagcagattagttctagtgatatcctggattctgccgaggaattctcagccaaagtggacattgaggttgactccccaaatcccacacccgtcctcaggtcagtgagcctgcgcgctagggcaggcattgctaggattcacgccccgagggacctgcaaaccatgcatttcctggcgaaggtggcaagctcacgtaaacagcacctaccactgaagaacgcaggaaatatcgaggtgtacctggacattaaggtgccagagcaagggtcccacttcagcgtggacccaaaaaacctgctgttgaaacccggggaggagcacgaggtgattgtttctttcacgcctaaagacccagaagcctgcgaggagcgtattctgaaaatctttgtgcagccttttggtcctcagtacgaagtggtattaaaaggcgaagttatcagcagcggctcaaaacccctcagtcctgggccatgcctggatattcctagcatcctgtcaaataaacagttcctggcgtggggcggtgttcctctgggccgcacccagctgcaaaagctagctcttagaaacaatagcgcttcgacgacccagcacttgcgtcttttaattcgcggccaggatcaggactgttttcaactacagaatacttttggatctgagcagcgacttacatccaactgtgaaatccggatacatccaaaagaggacatcttcatttccgtcttgtttgcaccaacacgcttgtcatgcatgctcgcacgtctagagattaagcagctaggtaatcgcagtcagcctgggatcaagttcactattcctttgagtggatatggaggcacctctaatttaattctggagggagtgaagaagctgtccgactcgtatatggtgaccgtgaatgggctggttcctggaaaagagtctaagattgtgttcagcgttcgaaacactggatccagagccgcgttcgtcaaggcagttggattcaaggatagccagaaaaaggtcctcctcgatcctaaagtactcaggatcttccctgataaattcgtgctgaaggagcgtacccaggagaatgtaactctgatttataatccaagcgaccgcggcatcaacaacaagacggccactgagctctcaaccgtctacctgtttggcggggatgagatcagtcgccagcaatataggcgagcactgcttcacaagcccgaaatgatcaaacaaatactacccgaacactcagtcctgcagaatatcaactttgtggaggccttccaagatgaactgctcgtgacagaggtgtatgacttgcctcagagacccaacgatgttcagctgttctatggatcaatgtgtaaaatcatccttagtgtgattggcgagttccgagattgcatctctagtcgggagtttctccagccgagctcaaaagcttcgctcgagagcacaagtgatctcggcgcgagtggcaagcacggaggaaacgtgtccctagacgtattaccggtgaagggccctcagggatctccactattgtccagggctgctagacctcccctggaccagcttgccagcgaggagccttggaccgtgttacccgagcacctgatccttgtagctccttcgccctgtgatatggccaaaacaggacgcttccagattgttaataatagcgtgcggcttttgcgcttcgaactctgctggcctgcccactgcctgactgtgactcctcaacatggctgcgtcgccccggagtctaagctccagattcttgtgtcgccgaacagctcactgagcactaagcagtccatgttcccctggtccgggctcatctacattcactgtgacgatggacagaagaagatcgttaaggtacaaatccgcgaggacttaacacaggtggagttactgaccaggctcacctcaaagccatttggaattctatcgcctgttagcgagccgtcggtgtcccacctcgtgaaaccaatgacaaaacctccatcgacaaaagtggaaattcgcaataaatctatcacgtttccgacaaccgaaccgggcgagacgtccgaaagctgcctcgagctggagaaccatgggaccacagacgtcaaatggcatctgagctccctggcaccaccctatgtgaagggagttgatgaatctggggacgtgttccgtgcaacttacgccgcctttaggtgttccccaatttctggtttgttggaaagccatggtattcagaaagtctcaataacctttctgccaagaggaaggggcgactacgcgcagttctgggatgtggaatgtcatccactgaaggagccgcacatgaagcacacgcttcggttccagctgtccggccagtctatcgaagctgagaacgagccggaaaatgcctgcttgagcacagattccctgatcaaaatcgaccacttagtcaaaccacggcgtcaagccgttagcgaggctagcgcaaggatccccgagcagttagatgtgacagcacggggcgtgtacgccccagaggatgtctacaggttccgccccacctccgttggtgagagcagaacacttaaggtgaacctcagaaacaattcattcattacacactcccttaaatttctgtctccgagagaaccattctatgtcaagcatagcaagtactcattacgagcccaacactacatcaatatgccagttcaattcaagccaaagtcagcaggcaagttcgaggcccttttggtgatccaaacggacgaaggcaagtcaattgccatacggttaattggcgaggcacttggaaagaattag

SEQ ID NO: 17422 - DNA, 90 bp, Artificial Sequence
  Description of Artificial Sequence: Synthetic coding sequence
atgttgtgctggggaaacgctagcttcggacaactcggtctgggaggcatagacgaggagatcgtgttagagccgcgcaagagcgactag

SEQ ID NO: 17423 - DNA, 66 bp, Artificial Sequence
  Description of Artificial Sequence: Synthetic coding sequence
atggccaagtataacacaggaggaaacccaactgaggatgtcagtgtgaactctagacccttttag

SEQ ID NO: 17424 - DNA, 261 bp, Artificial Sequence
  Description of Artificial Sequence: Synthetic coding sequence
atggaggctgatatcatcaccaacctacgttgcagactgaaagaagccgaagaggagagacttaaggcagcgcagtacggactgcagctggtggagtcacagaacgagctgcagaaccagctggataagtgccggaatgaaatgatgacaatgacagagtcttacgagcaagaaaagtacacactccagcgggaggtcgagctgaaaagcaggatgctggagtcgctttcctgcgaatgtgaggccatcaaacagcaatag

SEQ ID NO: 17425 - DNA, 1983 bp, Artificial Sequence
  Description of Artificial Sequence: Synthetic coding sequence
atggtgacttccttgaatgaagacaacgagtcagtcacagtggaatggatcgaaaacggtgacactaaaggtaaagaaattgacttagagagtattttttccctcaaccctgatctggtccctgacgaagagattgagccatcaccagaaacccctcctccgccagcgagctcagctaaagtgaacaagatagtcaagaaccggcgaacagtcgcctccattaaaaatgatccaccaagtcgtgacaacagagtggtgggcagtgccagagcgcgccccagccagtttccagaacaaagcagcagcgcccagcagaatgcccgccgaaagtctaattgtgtaaaggaggtggaaaaactacaggagaagcgggaaaagaggagactccagcagcaagagctcagggagaagcgtgcccaggacgtagatgctactaaccccaactacgagatcatgtgtatgattcgggatttccgtgggtccctagattaccggccactaaccactgctgaccccatagatgagcatcggatttgcgtgtgcgtgcgtaagcgccctctgaacaaaaaggagacccagatgaaggatctggatgttatcaccatcccttctaaggacgttgtaatggtacatgagcccaagcagaaggtggatctgactcggtatctggaaaaccagacctttcgctttgactatgcattcgatgattctgcccccaatgagatggtctaccggttcaccgctaggcccctcgtggagaccatctttgagagaggcatggctacatgctttgcctatggacagaccggatctggcaaaacacacacaatgggcggcgacttctccggcaaaaaccaggactgttctaaaggcatttacgccctagctgccagggacgtattcctcatgctgaaaaaacccaactataagaagctggaactccaagtctacgccaccttctttgaaatttactcgggaaaggtgttcgatttgcttaacagaaagacgaagctgagagtgttagaggacggcaaacagcaggtccaggtcgtgggactgcaggaaagggaggtcaagtgtgtggaagacgtgttaaaattgatcgatatcgggaactcctgccgcactagcgggcagacaagcgctaatgcgcatagctcccgctcacacgcagtcttccagatcattctacggcggaagggtaaactgcatgggaaattcagtctgattgatttggcaggcaacgagcgcggagcagatacatctagcgccgataggcaaactagactggagggcgccgagatcaataaatccctcctggcgctgaaagagtgtatcagggcgttagggcgcaataaaccacatacgccgtttcgggcttctaaattaactcaagtcctgcgggactcgtttattggagagaacagccgcacctgtatgatcgcaactatcagcccaggcatggcgtcctgtgaaaatacccttaacacactcaggtacgcaaatcgggtgaaagagcttacagtggaccccaccgctgcaggagatgtgaggccaatcatgcaccatcctcccaatcagatagacgacctcgagactcagtggggggtcggatcaagccctcaaagggacgaccttaagctgctctgcgaacaaaatgaggaagaagtgtctccccagctgtttacatttcacgaggcagtcagtcaaatggtcgagatggaagagcaggtggttgaggaccaccgcgccgtattccaggagagcatcaggtggctggaggatgagaaagctctccttgaaatgaccgaggaagtagactacgacgtcgactcgtacgcaactcagctcgaggctatccttgagcagaagatagacatcctgaccgagttgagagataaggtgaaatcattccgagctgcactccaagaagaggaacaggcaagcaaacagattaatccaaaaaggcccagagcactatag

SEQ ID NO: 17426 - DNA, 207 bp, Artificial Sequence
  Description of Artificial Sequence: Synthetic coding sequence
atgtctagtccaagggatttccgggctgaaccagtgaacgactatgaaggcaatgacagcgaggccgaggacttaaatttcagagagactcttcctagctcttcccaggagaatactccacgaagcaaggtcttcgaaaataaggtcaattctgagaaggtaaaactctccctccgtaacttcccacataatgattacgaagactag

SEQ ID NO: 17427 - DNA, 294 bp, Artificial Sequence
  Description of Artificial Sequence: Synthetic coding sequence
atgaatggacgagccgacttccgagagcccaatgccgaggtccccagaccaatcccacacattggacccgactacataccaaccgaagaggagcggagggtgtttgcggagtgtaacgatgagtccttttggttcaggagtgttcctctggcggcaacctctatgctcattacccagggacttatctcaaaaggcattctgtcatcacacccaaagtatggaagtatacccaaactaattctggcctgcatcatggggtattttgctgggaaactgagctatgtaaagacttag

SEQ ID NO: 17428 - DNA, 309 bp, Artificial Sequence
  Description of Artificial Sequence: Synthetic coding sequence
atggtcatggaaaagccttcccctctgttggtgggcagggagtttgtacgacagtattacacactgcttaacaaagctcctgagtacttacacaggttctacggacggaactcttcatatgttcacgggggagtggacgcgtctgggaagcctcaggaagccgtgtacggtcagaatgatatccaccacaaggtgctgtctctgaacttcagcgaatgccacacaaaaattcgccacgtggacgcccacgccacactgagcgacggcgttgtagtgcaggtgatggggcttttgtctaactccggttag

SEQ ID NO: 17429 - DNA, 597 bp, Artificial Sequence
  Description of Artificial Sequence: Synthetic coding sequence
atggggacaacttgtctgcatctcgggacacttgagcaatctcttgtttttgagaataaggtcaactccgagaaagttaaactgtctctcaggaattttccacacaatgactacgaagatgttttcgaggagccgtcagaaagtgggtccgatccatccatgtggacggctcgcggcccttttaggcgggaccgctggtccagcgaggacgaggaggcagctggcccgtcccaagctcttagtccgcttcttagcgacacccgaaaaatagtcagcgagggggaactggatcagctcgcacagattaggcccctaatttttaatttccacgaacaaacagccatcaaggactgcttaaagatactggaggagaaaaccgccgcatacgacattatgcaggagtttatggctctggagcttaagaacttgcccggcgagttcaactccggtaatcaaccttctaatagagagaaaaataggtatcgcgatatccttccttttcagcaccatggatacagcggcccgaacgagcgaaccactttttggcacgggtcgaatgagggagccgtgagcctcctcttgagatactgtgcgtag

SEQ ID NO: 17430 - DNA, 384 bp, Artificial Sequence
  Description of Artificial Sequence: Synthetic coding sequence
atgaggcccctggatatcgtagaactggcagaaccagaagaagttgaggtgctggaacccgaggaggatttcgagcagttccttctgccagtgatcaatgaaatgagagaggatatcgcctcactgactagggagcacggccgggcctacctcagaaatagaagcaagttatgggagatggataacatgttgatacaaatcaaaacacaggtcgaagcttccgaggagtccgccctgaatcacttgcagaaccccggagatgccgccgagggtcgggccgccaaaagatgcgagaaagccgaagagaaggctaaggagattgcaaagatggcagagatgttagtggagctggtaaggcgcatcgaaaagagcgaatcctcctag

SEQ ID NO: 17431 - DNA, 426 bp, Artificial Sequence
  Description of Artificial Sequence: Synthetic coding sequence
atggtgatggaaaagccttcgccactactggtcggtagagagtttgtgcgccagtattacactctgctcaacaaagctcctgaatacctccaccggttctacggcagaaattcttcctatgttcacggcggtgttgatgccagtggaaaaccacaagaagccgtttatggccagaacgacatccatcacaaagttctgtctctgaattttagcgagtgccatactaagatccgtcacgtagacgcccacgctaccctcagcgatggggtggtggtgcaggtgatgggactgctgtctaattctggccagcccgagcggaagttcatgcagactttcgtactggctcctgaaggaagcgtccccaacaagttctacgtccataatgatatgtttaggtacgaggatgaagtgttcggagattcttag

SEQ ID NO: 17432 - DNA, 135 bp, Artificial Sequence
  Description of Artificial Sequence: Synthetic coding sequence
atgctgttactcgactgtaatcctgaagtggacggtctcaagcatttacttgaaactggagcttctgtaaacgctccccctgacccatgtaagcaatcccccgtccacctcgcagcgggttccggattggcgtag

SEQ ID NO: 17433 - DNA, 399 bp, Artificial Sequence
  Description of Artificial Sequence: Synthetic coding sequence
atgaaacgcggccgattgccaagttcttccgaggattcagatgacaatggatctttgagcacgacctggagccagaactccagaagtcagcatcgcaggtcgtcttgctcgcggcacgaagatcgtaaaccgtctgaggtgtttcgcactgatcttatcaccgccatgaagctccacgactcttaccagctaaatccggacgagtactacgtgctggcggatccatggcgccaagaatgggaaaagggcgttcaagtgcccgtgagccccgggactatcccacagccagtcgcccgcgtcgtgagcgaggaaaaaagccttatgttcattagaccaaaaaaatatatcgtgagctccgggtccgagcctccagaactggggtatgtagacattcgatag

SEQ ID NO: 17434 - DNA, 972 bp, Artificial Sequence
  Description of Artificial Sequence: Synthetic coding sequence
atgcggacggcagacagagaagcccgcccggggctgccatccctcctcctgctgctcctggcaggcgccgggctgagcgccgcctcccccccagcggccccccgtttcaacgttagtttggatagcgttccagaactgcgttggttgcccgtgctcagacattacgatctggacctggtgcgggcggctatggcgcaggtgataggcgacagggtgccaaagtgggtccacgtgctgatcggaaaagtcgtacttgagctcgagaggttcctgcctcagcctttcaccggggaaatcagaggaatgtgcgatttcatgaacttatctcttgctgactgtctacttgtgaacttagcctacgagagcagcgtgttttgcacctctattgtggcacaagattctcggggtcatatctatcatggccgaaatctcgattaccctttcggaaacgtgctgaggaaattgactgtggacgtccaattcctgaagaatggtcagatagcctttactggcactacctttataggctacgtgggactctggacagggcaatctccacataaattcacagtcagcggcgatgaacgtgataagggatggtggtgggagaacgcaattgccgccttgttccggcgtcatatccccgtttcctggctgatccgagctacgctcagcgagagcgaaaatttcgaagcagctgtgggaaagctggcaaaaacgccgctgatcgcggacgtgtactacattgtggggggcacctccccccgcgaaggggtggtgattacgcgaaacagagatggacctgctgatatctggcccctggatccgttgaacggcgcctggtttcgagttgagaccaattacgaccactggaagcccgccccaaaggaagacgaccgaagaacatctgcgatcaaggctctgaacgccactgggcaagccaatctgtcactggaagctctttttcaatag

SEQ ID NO: 17435 - DNA, 312 bp, Artificial Sequence
  Description of Artificial Sequence: Synthetic coding sequence
atggctcagaccgataaacccacctgcatccccccggaactgcctaaaatgcttaaagagttcgccaaggcagctattcgtgcacaaccccaggatttaatccagtggggtgccgactatttcgaggcactgagcaggggcgagaccccccccgtgagggagcgaagcgagcgggtcgcgctgtgcaactgggccgagctcacacctgagctcctcaaaattctccactctcaggtcgctggaaggctgataatcagagcggaggaactcgcccagatgtggaaggtcgttaacctcccaactgatctatag

SEQ ID NO: 17436 - DNA, 540 bp, Artificial Sequence
  Description of Artificial Sequence: Synthetic coding sequence
atggaagatggcactccaaaacacatcatccagatgaccggcttcaagatggaagagaaggaggcacttgtgaagctgctgctcaagctggattgtactttcataaagtccgagaaatataagaattgtacccatctgattgccgaacggctctgtaagtccgaaaagtttcttgctgcctgtgcagccggaaaatggattttgaccaaagattacatcattcacagtgccaagtcaggccggtggctagacgagacaacttacgagtggggctataagatcgaaaaggattctcgctactcaccccagatgcagagcgcccccaaacgatggagggaggaactgaagcgcactggtgccccaggcgcttttcatcgctggaaggttgtcttgcttgttcggaccgacaagagaagcgactcactcattagaaagaaatttaggatgatgaaaatcccaaagccaattcttttcgggttaaatatagccatgaaaaaacagacgaagatcagcggtaagatgcaggacttcctgaaatag

SEQ ID NO: 17437 - DNA, 453 bp, Artificial Sequence
  Description of Artificial Sequence: Synthetic coding sequence
atggaagccgacattatcactaacctgcgttgcagactgaaggaggccgaggaggagaggctaaaggctgcccagtacgggttgcagcttgtggaatctcagaacgagctgcaaaatcaattggataagtgccggaacgagatgatgactatgacagaatcgtacgagcaggaaaagtacaccctgcagcgagaggtggagctgaaaagcagaatgctggagagtttgtcgtgcgagtgtgaagccattaaacagcagcagaagatgcacctcgagaagctggaggaacagttgtcaaggagtcacgggcaggaagtgaacgagctcaaaaccaagatcgagaaactcaaggtggaactagatgaggcgaggttgtccgagaagcagctgaaacaccaggtggatcaccaaaaggagttactgtcctgtaagagcgaggagctccgggtgtag

SEQ ID NO: 17438 - DNA, 738 bp, Artificial Sequence
  Description of Artificial Sequence: Synthetic coding sequence
atgaacggacgagccgatttccgggaacctaacgccgaagtgcctagaccgatcccccacataggtcctgactacatcccaacagaggaagagagaagggtcttcgccgagtgcaatgatgagagcttctggttcagatccgtgccgctggcagcgactagtatgttaataacacagggcttgattagcaagggcattctgagttcccatcccaagtatggctctattcctaagttaatactcgcctgtatcatgggctacttcgcagggaagttatcctatgtgaaaacttgccaggagaagtttaagaaacttgagaacagtccattaggagaagcccttaggtccggccaggcacggagaagtagcccacccggacattactaccaaaagtcaaagtatgactcttctgtcagcggccagtcatctttcgtgacctccccagccgcagataatatagaaatgctgccgcattacgaaccgatcccttttagcagtagtatgaatgaaagtgctcccaccggcatcaccgatcacattgttcaaggccctgaccctaacctcgaagagtcccctaagcgtaagaacatcacctacgaagagctcagaaataagaacagagaaagctacgaggtatcactcactcagaagacggatccttcagtcaggccaatgcacgagagggtccccaaaaaggaggtcaaggtcaacaaatacggtgacacatgggatgagtag

SEQ ID NO: 17439 - DNA, 180 bp, Artificial Sequence
  Description of Artificial Sequence: Synthetic coding sequence
atggtgatggagaagccatcacctctcctggtgggcagagagttcgtgcgccagtactacaccctcctgaataaggcccctgagtatttacacagattttacggccgtaattcctcctatgttcatggcggggtggatgccagcggaaaaccacaggaggcagtctacgggcagaactag

SEQ ID NO: 17440 - DNA, 597 bp, Artificial Sequence
  Description of Artificial Sequence: Synthetic coding sequence
atgggaaccacctgcctgcacctgggcaccttggagcaatcattggtgtttgaaaacaaggtaaactctgaaaaggtgaaactatccctgagaaattttccgcacaacgattatgaggacgtgtttgaagaacccagcgaatctggatccgaccccagcatgtggacggcacggggcccctttcgccgcgaccggtggtcttctgaagatgaagaggcagcgggaccgtcacaggctctgagcccactcctatccgatacacggaagatcgtgagtgagggagagctggatcaacttgcccaaatcagaccactgatctttaacttccacgaacaaactgccatcaaggactgtctgaagattttggaagaaaaaacggctgcctacgatattatgcaggagttcatggctttagagctcaaaaatttgcctggagaattcaactccggaaaccagccttcaaaccgtgagaagaatcgctaccgggatattctgcctttccagcatcatggctatagtgggcccaacgaacgaactaccttttggcacggctccaatgaaggcgccgtctcactcctcctgcgctattgcgcgtag

SEQ ID NO: 17441 - DNA, 465 bp, Artificial Sequence
  Description of Artificial Sequence: Synthetic coding sequence
atggccagcgcatccgccagaggaaaccaagacaaagatgcacatttccctccgcccagtaagcagtcactattattctgccccaagtcgaaactgcatatccaccgagccgagattagtaagattatgagggagtgccaggaggaaagtttctggaagagggcactccccttcagccttgtcagtatgctcgtgactcaagggcttgtgtaccagggctacctggcagccaattcccgctttggcagcctgcctaaggtggctcttgcaggccttctggggtttggtctcggaaaggtatcatacatcggggtgtgccagtccaagttccacttcttcgaggatcagttacgcggagccggctttggaccgcagcataatcgtcactgcctgctcacttgcgaagagtgcaaaataaagcacggccttagtgaaaagggtgactctcagccgtccgcctcgtag

SEQ ID NO: 17442 - DNA, 2520 bp, Artificial Sequence
  Description of Artificial Sequence: Synthetic coding sequence
atgtcagtagtgggaattgatctcggattcctgaactgctacatcgccgttgctcgatccggcggcatcgaaactatagccaacgaatactctgaccgatgtactcccgcctgcattagcctggggagccgcacaagggcaatcgggaatgctgccaaatcccaaatcgttactaacgtccgcaacactatccacgggttcaagaagctgcacggacgctcctttgacgaccccatagtgcagacagaacgaattcggttaccctacgagttgcagaagatgcccaacggaagtgccggcgtgaaggtgaggtacctcgaggaagaaaggccctttgctatcgaacaggttactgggatgctgttggctaagctgaaggagacgagcgaaaacgcactgaagaaaccagtggccgattgtgtgatttccattccatcattctttaccgatgcggagcgaaggtctgtgatggctgctgcacaggtggctggacttaactgtctgcgactgatgaacgagacaaccgcagttgccctggcctacggtatttataagcaggacctcccacccctggacgaaaaacctcggaatgtggtgtttatagatatgggacacagtgcataccaggttctggtgtgtgcttttaataaggggaaactgaaagttctggccactaccttcgacccttatttaggcgggcgtaatttcgacgaagcactggtggactacttctgcgatgagttcaaaaccaagtacaaaattaatgtgaaagaaaatagtcgagctctgctgaggctctatcaggaatgcgagaagcttaaaaaactgatgtcagccaatgcctccgatctgcctctgaatatagaatgcttcatgaacgatttagatgtatcctccaaaatgaatagggcccagttcgaacagctatgtgcctccctgctggcccgggtagagcctcctcttaaggccgtcatggagcaggccaatctgcagcgcgaagacatttcatcaattgagatcgtcggcggcgcgacgcgtatcccagccgtcaaggagcaaattaccaaattttttctgaaggatatcagcaccactttgaacgcggacgaagctgtggcccgcggatgtgcgttgcagtgcgcgatactgtccccagcttttaaggtgagggaattttccatcacggatcttgttccctattcaattactctgcgctggaaaacctcttttgaggacggatccggagaatgcgaagtcttttgtaagaatcacccagccccgttttcaaaggttatcacatttcataaaaaagaaccattcgaactggaggcattttacaccaatttacacgaagtcccatacccagatgcacggatcggctcttttacgattcagaatgtgtttcctcagtctgatggggattcctctaaggtcaaagtcaaggtgagagttaacatccatggaatattctcagtggccagcgcatctgtgattgaaaaacaaaatttggagggtgatcactccgatgcccccatggagaccgagacctcttttaaaaatgagaataaagataacatggataagatgcaggttgatcaggaggaaggacaccaaaagtgccacgccgaacatacgcccgaagaagaaattgaccacacgggcgctaaaactaagtctgcggtaagcgataaacaggatcgactgaaccaaaccttgaagaaaggcaaggtgaagtccattgatctgcccatccagagcagcctgtgcagacagttgggacaggacctgctcaattcatatattgaaaacgagggaaagatgatcatgcaggacaagttagaaaaggagagaaatgacgccaagaatgctgttgaagaatatgtctacgactttagggatcgactgggaaccgtctatgagaagttcattacccccgaggatctcagtaaactttcagcggtgttggaggacacagaaaactggctttacgaggacggggaagaccagcccaagcaggtgtatgtggacaagcttcaagaactcaagaaatatggccaacctatacagatgaagtacatggagcatgaggaacgcccaaaagccctgaacgatttggggaagaagattcagttggtgatgaaggtgatcgaggcgtatcggaataaagatgagcgatacgatcatctggacccaaccgaaatggaaaaggtggaaaaatgcataagcgacgctatgtcctggctgaacagcaaaatgaatgcacagaataagctctccctcacacaggaccctgtcgtgaaggtgagtgaaattgtcgccaagtcaaaggaactcgataatttctgcaaccccatcatttacaaacctaagcccaaggccgaagttcccgaagataaacctaaggcaaattcagagcacaatggacctatggacggtcagagtggaactgaaacaaaatccgacagtacaaaagatagcagccagcacacaaagtcctcaggcgagatggaagtcgactag

SEQ ID NO: 17443 - DNA, 54 bp, Artificial Sequence
  Description of Artificial Sequence: Synthetic coding sequence
atggatgaaggaatggaaatctcttcagagggaaactcgctgatcaaggcttag

SEQ ID NO: 17444 - DNA, 2394 bp, Artificial Sequence
  Description of Artificial Sequence: Synthetic coding sequence
atgggggtgtccagactcatggatctccttgccgactccagagaagtcatccgcaatgacggcgtgcttctcctacaggccttaacacggagtaacggggcaattcagaagattgtcgctttcgagaatgctttcgaacggctcttggacattattagcgaggagggaaatagcgacggaggcattgttgttgaggattgtttaatcttgcttcaaaatctgttgaagaataataatagtaaccagaactttttcaaagaaggaagttatatccagagaatgaagccctggttcgaggtgggcgacgaaaatagcgggtggtcagcccagaaagtcaccaacctgcaccttatgctccaacttgtgcgggttttggtgagtccaaccaatccgcccggagctacatcaagttgccagaaggcaatgtttcaatgcggccttctccagcagctttgcacaatactgatggccacaggggtcccagctgatatactcacggagactataaacacagtgtctgaggtgatcaggggatgccaggtgaatcaggattactttgctagtgtgaatgctcctagcaacccaccgaggccagctatcgtggtactactgatgtctatggtgaacgagcgccaacctttcgtcctgaggtgtgccgtgctgtattgcttccagtgcttcctgtacaagaaccagaaaggccagggtgaaattgtcagtaccttgcttccatccacaattgacgccacaggaaattcagtctccgcaggacagctgctgtgcgggggccttttctccaccgatagcctctcgaattggtgtgcagccgtggctcttgctcatgccctacaggagaacgcaacccagaaagaacagcttctaagggtacagttggccacttcaatcggaaatccaccggtgagtctgttacagcaatgcacgaatattttaagccagggcagcaagatccaaactcgggtggggctgctgatgttgctgtgcacttggcttagtaattgccccattgccgtcacacacttcctgcataacagcgctaacgttcccttcctgacaggtcagatcgctgaaaatctcggagaagaagaacagctagtgcagggactttgcgctttactgctgggaattagcatttactttaatgataattctctggagagctacatgaaggaaaagctgaaacagctgattgagaagcggattggaaaagagaatttcatcgagaaattgggttttatttctaaacacgaactgtacagcagagccagccaaaagccacagcccaattttccgtccccagagtatatgatcttcgatcatgagtttaccaaattggtgaaggaactagagggggtcatcactaaggctatttacaagtctagtgaagaagacaagaaggaagaggaggtgaagaagacactggagcagcacgacaatattgtgacacactacaaaaacatgatcagggaacaggacctgcaactggaagaacttcgccaacaggtgagcaccctgaaatgtcagaacgagcagttgcagaccgccgtgactcagcaagtgtctcaaatccagcagcacaaagatcagtacaacttattgaaaattcagttgggcaaagacaatcagcaccaaggaagctactcagaaggcgctcaaatgaacgggatacagcccgaggagatcggccgattaagggaagagattgaagaactaaagcgaaaccaggaacttcttcagtctcaactcaccgaaaaggactccatgatagagaacatgaaaagctcccagacctcaggcactaacgagcagagctcagccatcgtgagtgcgcgtgattcagagcaggtagcagagctgaagcaggagctggcaacactgaaatcccagctgaatagtcagagtgtggaaataaccaagcttcagacggaaaagcaggaactgctccagaagaccgaggctttcgcaaagtcagtcgaagttcagggtgagaccgagactatcatcgcaactaaaactactgacgtggaaggacgcttgtcagctctgctccaggagaccaaggagctcaaaaatgagatcaaggcgctgtccgaagaacgaacagcaattaaggaacagctggactcttccaactcaaccattgccattctgcagacagaaaaagataagctggagctggagataaccgacagcaagaaggaacaggatgacctgttggtactgctcgccgaccaagaccagaagattctgagtttgaagaataagctgaaagacctcggacacccggtggaagaagaagacgaactcgagtccggggatcaggaggacgaggacgatgagtcggaggaccccgggaaagacctggatcatatctag

SEQ ID NO: 17445 - DNA, 441 bp, Artificial Sequence
  Description of Artificial Sequence: Synthetic coding sequence
taacgacacctgcgtgcaacccctaacacgcgcggcagtgccaggttgctgtgcgccgaaatgcccaagaaggctggggccactaccaaaggtaagagccagagtaaagaacccgaaagacctttaccccccctcggtccagttgccgttgaccctaaggggtgcgttacaatcgccatccatgcgaaaccagggagtaaacagaatgccgtgacagatctgaccgctgaggccgttaacgtggcaattgccgcaccgccttcagagggcgaggcaaacgccgagttatgtagatatctctctaaggttctcgaattacgaaagtcagatgtagttctggacaaaaagctgagggatcttcttaagatcgttccatgcaaactagccaccaggacccagatattaggtttactcgtagaatgtagcttctcccgtttgtag

SEQ ID NO: 17446 - DNA, 243 bp, Artificial Sequence
  Description of Artificial Sequence: Synthetic coding sequence
atgaatggacgtgctgactttcgcgagcccaacgccgaagtgcctcgcccgattcctcatatcggacccgactacatcccaacagaggaagagcgaagagtattcgctgaatgcaatgacgagtctttctggtttagaagcgtccccctggccgcaacatcaatgctcatcacacagggactcatatctaagggcatcctgtcgtcccatcctaagtatggaagcattcctaaactgatatag

SEQ ID NO: 17447 - DNA, 360 bp, Artificial Sequence
  Description of Artificial Sequence: Synthetic coding sequence
atgaaaagaggacgcctgccgtcttctagcgaggactctgacgataatggctccctttccactacctggtcacagaacagcagatcccaacacagacgctccagctgctcacgtcatgaggatcgtaagccctctgaagtgtttaggaccgacctgattacggctatgaagctccacgacagctatcaattaaaccccgatgaatactatgtgctcgccgatccctggcggcaggagtgggaaaaaggcgtgcaagtgcccgtgtcccctggaactatcccacagcctgtggcacgggtagtgtccgaggagaaatccctgatgttcatccgccctaaaaagtacatcgtctccagttag

SEQ ID NO: 17448 - DNA, 69 bp, Artificial Sequence
  Description of Artificial Sequence: Synthetic coding sequence
atggctaaatataatactggcggcaaccctacggaagatgtgagcgtgaactctcggcccttccgctag

SEQ ID NO: 17449 - DNA, 1059 bp, Artificial Sequence
  Description of Artificial Sequence: Synthetic coding sequence
atggctgcagccgtgcggcaggatctggcccaactcatgaacagttctgggagccataaagacttggctggaaagtatcgccagattctggaaaaggccattcagctgagtggagccgaacagcttgaggcactgaaggcattcgttgaagctatggtcaatgagaacgtctcattagtcatcagcaggcaacttttaactgacttctgtacacacctgccaaacctgcctgattccactgccaaagagatctatcatttcacactggagaagattcagccacgtgtcattagtttcgaagagcaggtcgcctctatcagacagcatctggcttctatctacgaaaaggaggaagactggagaaatgccgcgcaggttctcgtcgggataccactagaaaccggtcaaaaacaatacaacgttgactacaaactggagacgtacctcaaaatcgccagattgtacctggaggacgacgaccccgtacaggcagaggcatacattaacagagcttcattacttcaaaatgaatccacaaacgagcagctgcagatccactacaaggtatgctacgcccgcgtcctagactaccgccgcaaattcatagaagccgcccagagatacaatgagctctcatacaaaaccatcgtgcacgagtctgagcgcctcgaagccctgaaacatgcactccactgtaccatcctggccagcgcgggccagcagcgtagtcgtatgctcgctacgcttttcaaggacgaaaggtgccagcagctggcggcttatggtattctcgaaaagatgtatcttgacaggataatccgcggtaaccagctacaggagttcgcggcaatgctcatgcctcaccagaaggccacaacagccgatgggagtagtattttggatagggccgtcatcgaacacaacctgctaagtgcgtctaagttgtacaacaatattactttcgaagagctgggtgctctgctggagatcccggctgccaagcacgagaagccttgtcagcgggggatcagccggtcaaatcactttgtatctaaatag

SEQ ID NO: 17450 - DNA, 378 bp, Artificial Sequence
  Description of Artificial Sequence: Synthetic coding sequence
atggtcatggagaaacctagccccctgctcgtgggccgggaatttgttcgccagtattatacactacttaataaagccccagagtacctgcaccgattttacggcagaaacagctcctacgtgcacggcggcgtagatgcgagtggcaaaccgcaagaggccgtgtacggacagaatgatatccaccacaaggtgctgagcctgaacttcagcgaatgtcacactaaaatccgccacgtggacgcacacgcgactttgtcagacggcgtggtggtgcaggtcatgggccttctgtcaaacagcgggcagccagaaagaaagttcatgcagacattcgtattagcacccgaaggctctgttcccaacaagttttattag

SEQ ID NO: 17451 - DNA, 657 bp, Artificial Sequence
  Description of Artificial Sequence: Synthetic coding sequence
atgaacgggcgggcagattttagggagcccaatgccgaggtaccgcgaccgattccccctgtgcctctggctgccacctctatgctgatcacccagggcctgatctcgaaggggatactgtcttcacacccaaagtatggctctatccctaagttaatactagcatgcatcatgggctacttcgcggggaaattgagctatgttaaaacatgccaggagaagtttaaaaagctggagaattccccactgggcgaggccctgcgcagcgggcaggctagacgatctagcccccccggtcattactatcagaagtcgaagtatgactcatccgttagtggccaaagctcttttgtgacatcacctgccgccgacaacatagagatgctgccacactacgagcctattccattttcctccagcatgaacgagtcggccccaactgggattacagatcatatcgtgcagggaccagacccgaatcttgaagagtcccctaaacggaagaacatcacttatgaggagctccgtaataaaaacagagaaagttacgaggtttccctcacccaaaaaactgacccatccgttcgccctatgcatgaacgcgttcctaagaaagaggtcaaggtgaataagtacggtgacacttgggatgagtag

SEQ ID NO: 17452 - DNA, 243 bp, Artificial Sequence
  Description of Artificial Sequence: Synthetic coding sequence
atgaatggtcgggccgatttcagggaaccaaatgccgaggtgcctaggcctatcccgcatataggacccgattatattcccacagaggaggagcgaagggtgttcgctgaatgcaacgatgagagcttttggttcaggtctgtgccgcttgccgcaaccagcatgctgattacgcagggtctgatcagcaagggcatcttatcgagccacccaaagtatggatctattcctaaacttatatag

SEQ ID NO: 17453 - DNA, 654 bp, Artificial Sequence
  Description of Artificial Sequence: Synthetic coding sequence
atgatagtaaacgactacgaggggaacgattcagaggccgaggacctgaacttccgggagacccttccaagttcctctcaggagaatacccctagaagcaaggtgtttgagaataaggtgaactctgagaaagtgaaattgtcccttaggaatttccctcataacgattatgaagacgtgtttgaagagccaagcgagtccggaagtgatccttcgatgtggacagccaggggcccctttagacgtgacaggtggagttctgaggacgaggaagccgccggaccttctcaagctttgtccccgctgctcagtgacactaggaaaattgtctccgaaggcgagcttgaccagctggcgcaaatccgccccctcatcttcaatttccacgaacagaccgccatcaaagactgtttaaagatactggaggagaagacagccgcttacgacatcatgcaggaatttatggcacttgaattaaaaaacctgcccggggagttcaactccgggaatcagcctagcaatagggagaaaaaccgatacagggacatcctaccttttcagcaccacggctactccggccccaacgagaggacaactttttggcatggatctaacgaaggggccgtaagtctgctgctgcgctattgtgcatag

SEQ ID NO: 17454 - DNA, 351 bp, Artificial Sequence
  Description of Artificial Sequence: Synthetic coding sequence
atggggcggttggacggtaaagtgataattctcactgccgcagctcaaggcattggacaggcagccgccctagcgtttgcacgcgagggtgctaaggtcatcgccactgacataaatgagtcaaagttacaggagctggagaaataccccggaatccagacccgcgtgctggacgtgacaaagaaaaagcaaatcgaccagttcgcaaacgaggtcgaaaggttggatgttctgtttaacgtggccgggttcgtgcaccacggaacagttctagattgcgaagagaaagattgggatttttccatgaacttgaatgtccgttccatgtacctgatgatcaaagccttttag

SEQ ID NO: 17455 - DNA, 504 bp, Artificial Sequence
  Description of Artificial Sequence: Synthetic coding sequence
atgaaggcaattaagaagagcctgaccgaggaggagtatctctacctggacttttcccaccaaacagaagggtgtatcttcccactgcacacttcagtgacactgtttctactgagttattgcgactgcaaaattttcaagatttgtctggtagtcactaaggaggtgtctagagatagcagtctcctcagagatgacctgattcaggatgtggaaatccaaattatttctcgacaggaactgccccctatcgtccagaattgctgtctgcccgctgttgtggaaagatctgacaacttctgccgtgccggcctggccgtggtgctcagacacataatccagaagtcatatgaggctgacccactgaaaaaagagttgctcgaattgctcggatttaaaaaaacttgcttgaaagcatgtgctgaggtgtctcaatggacacggctctgcgaactgaccattcctcttgcaattgaaaacttcctgcgggagtcttcagactag

SEQ ID NO: 17456 - DNA, 933 bp, Artificial Sequence
  Description of Artificial Sequence: Synthetic coding sequence
atgtcacagcagctcaaaaagcgcgctaagacacgccaccagaagggactaggagggcgcgctccctccggcgccaagcccagacagggtaagtcgagccaggatctgcaggctgagatcgaacctgtcagtgctgtgtgggctctgtgtgacggatacgtctgttatgagcctggcccccaggcactgggaggggatgatttcagtgattgttatatagaatgtgtgattcgcggagaatttagccaacctattctcgaggaggatagccttttcgaatctctcgagtacttgaaaaaaggcagcgagcagcagttgtcccagaaggtctttgaagcaagctccttagagtgcagtcttgagtacatgaaaaagggtgtgaaaaaagagctcccgcagaagatcgtgggagagaatagcctggaatatagcgagtacatgacaggtaagaaattaccacctggtggcatccccggcatagatttatccgaccctaagcagttagctgaattcgcacgcaagaaaccacccattaataaggaatatgactctcttagtgcgatcgcctgtcctcagagcgggtgcacgcgcaaactgcgcaaccgcgccgcactgcgaaagcacctcctgattcacggaccacgggaccacgtctgcgccgagtgtggaaaggcttttgtggagtcttcaaaattgaaacgacactttctcgtccacacaggcgagaaacctttccgatgcacatttgaggggtgtggtaaacggttcagccttgattttaacctgcggacccatgtgcgcatccacaccggggaaaaaagatttgtttgccctttccagggctgtaaccggaggttcattcagagcaataacctgaaggcccatattttaactcacgccaacacaaataagaatgaacaggagggcaaatag

SEQ ID NO: 17457 - DNA, 237 bp, Artificial Sequence
  Description of Artificial Sequence: Synthetic coding sequence
atggtgatggagaagccttccccattattagtgggtagagagttcgtgcggcaatattacactctgctgaataaagcaccagagtacttgcaccgcttctatggtagaaactcctcatatgtccacggaggcgtggatgcctccgggaaaccccaagaggctgtttatggccagaacgatattcatcataaggtcctatctctgaatttctccgagtgtcacaccaagatcaggtag

SEQ ID NO: 17458 - DNA, 681 bp, Artificial Sequence
  Description of Artificial Sequence: Synthetic coding sequence
atgagctctcctagagatttcagggcggaaccagtcaacgactatgagggcaatgactccgaagcagaagatttgaactttagggagaccctgccaagctcctcacaggagaacacgccacgtagcaaagtttttgaaaataaagtcaactctgaaaaagtgaaactcagtctgcgcaactttccacacaacgattacgaagacgttttcgaagagccctctgagtccggcagcgatccttcaatgtggaccgcacgtgggccatttaggagagaccgttggagcagcgaagatgaagaggccgccggaccatctcaagccttaagcccactattgagtgatacccgtaagatcgtgagcgaaggagaactggaccagcttgcccagattagacctctcatctttaacttccatgagcagacagctatcaaggactgtctgaagatccttgaggagaagactgcggcatatgatataatgcaggagtttatggccctggagcttaaaaatctgccaggggagttcaacagcgggaaccagccaagtaatcgcgagaagaatcgctatcgggatattctgccatttcagcaccacggctactcaggacctaacgaacgaaccactttttggcatgggtccaacgaaggggctgtgagccttcttctgcgatattgcgcctag

SEQ ID NO: 17459 - DNA, 1020 bp, Artificial Sequence
  Description of Artificial Sequence: Synthetic coding sequence
atgtggaccgctcgcggaccctttaggagggaccgatggagctcagaggatgaggaggctgccggcccttcccaggcgctctctccactcctcagcgacacccgcaagatagtgtcagagggtgaacttgaccagctggcccagattagaccccttatcttcaacttccatgaacaaacagcaatcaaggattgcttgaagatactggaggaaaaaacggctgcctatgacattatgcaggagtttatggccttggagctgaagaatctgcccggggagtttaacagtggcaaccagccatcgaacagagaaaaaaacaggtatcgagatatactcccttacgactccacccgcgtgccactgggcaagtcgaaggattatatcaacgcgtcctatatacgcatcgtaaactgtggggaagagtatttctacattgccacacagggacccctgttgtccactatagatgatttttggcagatggtgctcgaaaataattccaatgtaatcgcaatgatcaccagggaaatcgagggcggaattataaagtgttatcattactggcccatttcattaaaaaaacccctggagctgaagcatttcagggtttttctcgaaaactaccaaatcctgcaatacttcatcataagaatgttccaggtggtcgaaaaatccactggcaccagtcactccgtgaagcagctgcagtttacaaagtggccagatcatgggactcctgccagcgcagattcttttattaagtatatccgctacgcgagaaagtcacatctcacggggccaatggtggtacactgttctgctgggatcggccggaccggcgtatttctctgcgtggatgtggtattctgtgctatagtgaaaaattgttcgttcaacatcatggatattgtggcccagatgagagaacagcgctctggtatggtgcagacaaaggagcaataccatttttgttatgatatcgtgctggaagttctgcgaaagctgctgaccttagactag

SEQ ID NO: 17460 - DNA, 1179 bp, Artificial Sequence
  Description of Artificial Sequence: Synthetic coding sequence
atgggcaccacatgcctgcacttaggtactctggaacaatcattagtttttgaaaataaagtcaattcagagaaggtgaaactgagcctgagaaattttccacataatgactacgaagacgtgttcgaagagccctcagagagtggctccgacccctctatgtggaccgcccgcgggcccttcaggcgagacaggtggagtagcgaagacgaagaggccgcaggtccctcacaagcgctctctccattgctgagcgacactcgcaagatagtgtccgaaggagagttggaccaactggcccagattagaccgctcattttcaatttccatgagcagaccgctattaaagattgtcttaagatactggaggagaagactgccgcctatgacatcatgcaggagtttatggcactggagcttaaaaatctaccaggagagtttaattctgggaaccagccgtccaatcgggaaaagaaccggtaccgggatatccttccatacgactcaacaagagtacccctgggaaagtcgaaagattacatcaatgcttcatatatacggatcgtgaactgcggggaagagtacttctatatagcgactcaggggcccctgctgtcaacaatcgatgacttttggcagatggtcttggaaaataacagcaacgttatcgccatgattacacgtgagatcgaagggggaatcattaaatgctaccattattggcctatctcactcaagaaacctctggagctgaaacacttccgcgtgtttctcgaaaattaccaaatcctgcaatacttcattattaggatgtttcaagtcgttgaaaagtccaccgggacttcacactcagttaagcagttgcagtttacgaaatggcccgaccacggaacacccgcttctgccgactcgtttatcaaatatattcgttacgccagaaagtctcatctcactgggcccatggtggtccattgtagcgcagggattggaaggaccggtgtgttcctgtgtgtggacgtagtcttctgtgcaatcgtgaaaaactgtagtttcaacatcatggacatcgtggcccagatgagagagcagcgctccggtatggtgcagaccaaggagcagtatcacttctgctacgatatagttcttgaagtattacgtaagctgctgaccctcgactag

SEQ ID NO: 17461 - DNA, 654 bp, Artificial Sequence
  Description of Artificial Sequence: Synthetic coding sequence
atgattgtgaacgattatgaaggtaatgactccgaagctgaggatttgaacttcagggagacccttccctcatcaagccaggagaacactcctcgttctaaagtttttgaaaataaggtgaactccgagaaagtcaaactctcacttaggaatttcccccacaatgactatgaggacgtctttgaagaaccaagcgagtctgggtccgacccctccatgtggactgccagaggtccgttcagacgggacaggtggtcctccgaagatgaagaagccgcaggcccctctcaggccttatcccctcttttgagtgacacaaggaaaatcgtgtctgaaggcgagctggaccagctggcgcagatcaggcctttgattttcaacttccacgagcagaccgcaatcaaggactgcttaaaaatccttgaagagaagactgctgcttacgatattatgcaggaatttatggcgctcgaactcaagaacttacctggagagttcaacagcgggaaccagcctagcaaccgagaaaagaacaggtaccgagatatacttccattccagcaccacggttatagcggccccaacgagagaactaccttttggcacgggtccaatgagggtgccgtatctttgctcctcagatattgcgcctag

SEQ ID NO: 17462 - DNA, 438 bp, Artificial Sequence
  Description of Artificial Sequence: Synthetic coding sequence
atgtggacagcccgcggtccctttcgaagggacagatggtcaagcgaggatgaggaggctgcaggaccctcacaggccctgtcaccgctcttgagcgacacacgcaagatcgtctcggaaggggagcttgaccagctcgctcagattcggcctctgatttttaactttcacgaacaaactgccattaaagattgtctgaagatcctggaggagaaaaccgctgcgtacgacatcatgcaggaattcatggccctggagttaaaaaacctgcccggcgaatttaactctgggaaccaacccagtaatcgggaaaaaaatcgctaccgggacatacttccttttcagcaccatggctactctgggcctaacgagagaactaccttctggcatggatctaatgaaggagctgtatctctattactccggtactgtgcctag

SEQ ID NO: 17463 - DNA, 207 bp, Artificial Sequence
  Description of Artificial Sequence: Synthetic coding sequence
atgtctagcccccgcgattttcgagccgaacccgtgaatgactatgagggcaacgacagtgaggcagaggatctcaacttccgcgagaccctgccctcaagctcacaggaaaacaccccccgatcgaaagtcttcgagaataaggttaactcagaaaaggtgaaattgtctcttagaaactttccacataacgattacgaagactag

SEQ ID NO: 17464 - DNA, 525 bp, Artificial Sequence
  Description of Artificial Sequence: Synthetic coding sequence
atggccaagtataacacaggaggtaatcctaccgaagacgtcagcgtgaattcccgaccctttcgcgtgaccggacctaactcttctagcgggattcaggccagaaagaatctgtttaataatcaaggtaatgccagtccccctgcaggcccctccaacgtgcctaagtttgggtcaccaaaacctcctgtcgctgtgaaaccgagttcagaggagaaacctgacaaagagcccaaaccaccatttctcaagccgaccggcgctggccagagatttggcacaccggcgtcactgaccactcgggatcccgaggctaaagtaggtttcctcaaaccagttggccccaaacctataaacctgcctaaggaagacagcaagcccaccttcccatggccccctggtaacaaaccaagtttacacagcgtcaaccaagatcatgatttgaaacccttggggccaaagagcggaccaacccccccaaccagcgaaaacgagcagaaacaggctttccctaaacttacttag

SEQ ID NO: 17465 - DNA, 405 bp, Artificial Sequence
  Description of Artificial Sequence: Synthetic coding sequence
atgagcgatgacgccggagatactctggccacaggagacaaagccgaggtcacagagatgcccaactccgactcactcccagaagacgctgaggtccactgtgatagcgcggcagtgagccacgagccgacccccgccgacccgaggggagagggacacgaaaacgccgccgttcagggagcaggcgcggctgctatagggccgccggtgcagcctcaggatgccaatgctcttgagccccctctcaacggcgacgtgacagaggacactctggctgagtgcatcgactcagtaagtctggaagcggagcctcgatccgagattcccttacaggaacagaactacctggctgtagactcacccccttctgggggaggttgggctgggtggggaagctgggggtag

SEQ ID NO: 17466 - DNA, 432 bp, Artificial Sequence
  Description of Artificial Sequence: Synthetic coding sequence
atgaagcgtggaaggctacccagttcttccgaagatagtgatgataatggcagtctgtccactacttggagtcaaaatagtcggtctcagcatcggaggtcttcttgctccagacacgaggaccggaagccttccgaagtattcagaacagatctcattaccgcgatgaaactgcacgacagctaccagttgaatcccgacgagtattacgtcctggctgacccctggcgccaggaatgggagaaaggcgtccaggtgcccgtgtcacctggcacaattccacagccagttgcccgggtggtgtcggaggaaaagagccttatgttcatcaggcctaaaaaatatatcgtgtcgtcaggatccgagccccccgaacttggctacgtggacattagaacactcgccgattctgtgtgtcgctacgatctgtag

SEQ ID NO: 17467 - DNA, 1200 bp, Artificial Sequence
  Description of Artificial Sequence: Synthetic coding sequence
atggactttttctcttcacatctgcttgcagactcatctagcccggccacaaacagctcccatactgatgcgcatgaaattttagtgtcggattttctggtcagtgacgagaacctgcagaagatggaaaacgtactggacttgtggtcgagtggtctgaagacgaatattattagcgaactgtccaagtggcggctgaactttatagactggcaccgaatggagatgaggaaggaaaaggagaaacatgctgcacacctgaaacaactgtgcaaccagatcaatgaactcaaagaactgcaaaagacgttcgagatctctattgggcgtaaagacgaggtgatcagttctctgtcccacgccattgggaaacagaaggagaaaatcgaactgatgagaacctttttccattggagaatcggccatgtgagagcaagacaggacgtgtatgaaggtaagctcgcggaccaatattatcagagaacacttctgaagaaggtgtggaaagtgtggcggtccgtggtccagaaacagtggaaagacgtagtcgagcgtgcatgtcaggcaagggcagaggaagtctgtattcaaatttctaatgattacgaagcaaaggtggccatgctttcgggggcgctcgagaatgccaaggctgaaatccaaaggatgcagcacgaaaaagagcacttcgaggactctatgaagaaagcgttcatgcggggagtttgtgccctgaatctagaggcaatgaccatctttcagaaccgaaacgatgccggcatcgactcaacaaataacaagaaggaggagtacgggccgggcgttcagggtaaggaacactctgctcacctggacccttcagccccccccatgccattgccagtcacatcccctttactcccctcaccaccagcggctgtcggcggagctagcgccacggctgttccttccgccgcgtctatgaccagcacgcgcgccgcctctgcttcgtccgttcacgtgcctgtcagcgccctcggggctggtagtgcagccaccgccgccagcgaggagatgcagacaatcccacaggcaacagctgctaagtaccctagaacgatccatcccgaaagctctacgtcggccagccgcagcctcggaacaaggtccgcccatacccagagcctgacgagcgtacattctatcaaagtggtagattag

SEQ ID NO: 17468 - DNA, 240 bp, Artificial Sequence
  Description of Artificial Sequence: Synthetic coding sequence
atggatgagtccgccctgctggacctcttagaatgtccagtgtgcctggaacggcttgatgcgagcgctaaggtcttgccttgccagcacaccttttgtaagcgttgtctattagggatcgtcggatccaggaacgaactgcgctgccctgaatgtcgtaccctcgtggggagtggagtagaggaactcccatcgaacatcctgctggtgagactgcttgacggcattaagcagagatag

SEQ ID NO: 17469 - DNA, 621 bp, Artificial Sequence
  Description of Artificial Sequence: Synthetic coding sequence
atgtcgagcccacgtgacttccgggccgagccagttaacgattacgaagggaatgattccgaggctgaggatctcaattttagggagacattgcccagcagttcgcaagagaacacaccgagatctaaggtcttcgagaataaagtgaattcagaaaaagttaaactgtccctcaggaactttccacacaatgattacgaggacgtctttgaggagccatccgagagcggatctgacccttctatgtggaccgccagaggccctttccgcagagacaggtggtcctcagaggacgaagaagccgctggaccttctcaagctctatctcccctcctctccgacacccgcaagatcgtatcggagggggaattagatcagcttgcacagatccggccacttatttttaactttcatgagcaaacggctatcaaagactgcttgaaaatcttagaggagaaaacagccgcatacgatattatgcaggagttcatgttcaacatcatggatatcgtggctcagatgagagaacagcgatccgggatggtgcagaccaaggagcaatatcatttctgctacgacattgtcttagaagtgcttagaaaattgctcacattggattag

SEQ ID NO: 17470 - DNA, 501 bp, Artificial Sequence
  Description of Artificial Sequence: Synthetic coding sequence
atgaaggcgattaagaagtccctcaccgaggaagagtatctgtatctggatttctcccaccagactgaagggtgcattttccctctacatacttcagttaccctgttcctgctgagctactgtgattgcaaaatctttaagatctgtctcgtggtgacaaaggaggtttcaagggactcaagcctcctccgggacgatctgattcaagacgtcgagattcagattatctcccggcaggaacttccgccgatcgtgcagaactgttgtctgccggcagtcgtggaacggagcgacaatttttgccgagcaggcctggctgtggtccttcgacatatcatccaaaagtcctacgaggctgacccactgaaaaaagaactgctggaattgctcggttttaagaagacatgcttaaaagcttgtgccgaggtctctcagtggacacggctctgtgaattgacaattcccctcgccattgaaaattttttacgagaatcctcatag

SEQ ID NO: 17471 - DNA, 363 bp, Artificial Sequence
  Description of Artificial Sequence: Synthetic coding sequence
atgtggaaagtggttaacctgccaacagatcttttcaactcagtcatgaatgtcgggcgctttaccgaggagattgaatggctgaagttcttggctctggcctgtagcgccctcggagtaactattacaaagacactgaagatcgtgtgcgaggtccttagttgcgaccataatgggggcctacctcgaattccattttcaaccttccagtttctctacacttatattgcagaggtggacggcgagatctgcgcatctcacgtgagcagaatgctcaattacattgagcaggaggtgatcgggcccgacggtttgataaccgttaatgactttacacaaaatccaagggtatggctcgaatag

SEQ ID NO: 17472 - DNA, 351 bp, Artificial Sequence
  Description of Artificial Sequence: Synthetic coding sequence
atggtgatggaaaagcctagccccctgcttgttggcagagagtttgtgaggcagtactacactcttctaaataaggcacccgaatatctccacaggttctatggacgcaactcctcttacgttcatgggggggtggacgctagtggcaagccacaggaggccgtctacggccagaacgacatacaccacaaagtattatctttaaatttttcagagtgccacacaaaaataagacacgtcgatgctcatgcgactctgtcagacggagtggtagtccaggtgatggggctgttgagcaattctggacagcccgaaagaaagtttatgcagacattcgtgctggctccctag

SEQ ID NO: 17473 - DNA, 480 bp, Artificial Sequence
  Description of Artificial Sequence: Synthetic coding sequence
atgtccgatcataggtacggggacggcggaagcactttccagagcaccactggacattgcgtgcacatgcgaggactgccctacagggcgacggaaaacgatatttacaattttttctcccccctgaatcccgtgcgtgtccatatcgagatcggtccagacggcagagtcactggcgaagcagacgtggagttcgctacacacgaagacgcagttgccgcaatgagcaaggacaaagcaaacatgcaacatcgttacgtagagctgttcttgaattctaccgcaggagcttcaggcggcgcgtatggcagccagatgctcggcggaatggggctttcaaaccagtcaagttacggtgggccagcctctcagcagctgtccgggggctacggcgggggatatgggggccagagcagcatgagcggctatgatcaggtgctgcaggaaaacagctcggactttcagagcaacatcgcatag

SEQ ID NO: 17474 - DNA, 411 bp, Artificial Sequence
  Description of Artificial Sequence: Synthetic coding sequence
atgatcgtcaatgattacgaggggaacgactctgaggcggaagatcttaacttccgggagacacttccctcgtcatctcaggaaaatacaccccggtccaaagtgtttgaaaataaagtcaatagcgaaaaagtgaagctctcattacgcaactttccccacaacgattatgaggacgtgtttgaggagccctctgagagcgggtccgatccttccatgtggaccgcacgcgggcctttccggagagaccggtggagcagcgaggacgaggaggcagccgggccctcccaggccctatcaccccttctctcggtgcagcaccatggctactctggtcctaatgagcgcaccaccttttggcacggatctaacgaaggagccgtaagccttctcttacggtattgcgcatag

SEQ ID NO: 17475 - DNA, 462 bp, Artificial Sequence
  Description of Artificial Sequence: Synthetic coding sequence
atgaaactaacgagcgagaaactgcccaagaaccctttctacgctagcgtgagccaatacgccgctaaaaatcagaaattttttcagtggaaaaaggaaaagactgattacacacatgccaatctggtcgataaggcccttcagttactgaaggaaaggatcctgaaaggggatacactggcctattttctgcgggggcaactctatttcgaagaggggtggtacgaagaagccctagaacagttcgaggagataaaggaaaaggaccatcaggccacttaccaactgggagttatgtattatgacggcctggggaccacattggatgcggaaaagggcgtggactacatgaagaaaatcctagatagcccttgtcccaaagcgagacacttgaaatttgcagctgcatacaatttggggcgggcctactatgagggtaagggcgtgaaacgtagcaattag

SEQ ID NO: 17476 - DNA, 489 bp, Artificial Sequence
  Description of Artificial Sequence: Synthetic coding sequence
atggaggccttgcttgagggcatacagaacagaggccacggcggagggtttctcacttcatgcgaggcggagttgcaggaattgatgaagcagatcgatattatggtggcccataagaagagcgaatgggagggcaggacgcatgctctggagacgtgtcttaagatacgggaacaggaactgaaaagccttcggagccagctggacgtcacccacaaagaggtggggatgctgcaccagcaggtggaggagcacgaaaagattaagcaagagatgaccatggagtataagcaggaattgaagaagctgcatgaggaactgtgcatcctcaagagatcatacgagaaactgcagaaaaaacagatgagagagttccggggtaacacaaagaaccacagggaggaccgcagcgagatagagaggctgaccgccaaaattgaggaatttaggcaaaaatccctggactgggagaaacagcggttgatatag

SEQ ID NO: 17477 - DNA, 1530 bp, Artificial Sequence
  Description of Artificial Sequence: Synthetic coding sequence
atgaagcgcggaaggctgccctcctcatctgaagactcagacgataacggaagcctaagtaccacctggagccagaattcaagatcccagcatcgccggagttcctgctctcggcacgaggacagaaagcccagcgaggtgtttcgcacggacctgattactgctatgaagctgcacgactcctaccagctgaaccccgacgagtactacgttctggctgacccctggcgtcaggagtgggagaagggcgttcaggtccccgtgtcccctgggacgattcctcagccagtggcccgtgttgtcagcgaggagaaatccctcatgttcattcgccccaaaaaatacattgtgtcctccgggagtgagcccccggaactgggctacgttgatatccggacactggcagatagcgtttgccggtatgatctgaacgacatggacgctgcttggcttgaactaacaaatgaagagtttaaagaaatgggaatgcctgaattggatgagtacactatggaacgcgtccttgaagaatttgaacagcgctgctatgataacatgaatcacgcgatcgagactgaggaaggcctcggcattgagtacgatgaggatgtggtatgcgacgtatgccagtctccagacggagaggacggcaacgagatggtattctgcgacaaatgtaacatctgtgtgcatcaggcctgctatggtatcctgaaagtacccgagggttcatggctgtgtcgtacgtgcgctctgggagtccagccaaaatgcctcttgtgtccgaagaaaggtggagccatgaagcccacacgaagcggcaccaaatgggtgcatgtttcatgcgccctttggattccggaggtcagtattggatcccccgaaaaaatggagcccatcaccaaggtatcccacatcccttcctctagatgggcgctagtgtgctccctatgtaacgagaaattcggagcctctattcagtgttctgtgaaaaattgtcgcacggctttccatgttacctgcgcttttgacagagggttagaaatgaaaaccatacttgccgaaaatgatgaggtgaagtttaaatcttactgtcctaagcacagtagccacagaaagccagaagaatcccttggtaagggggctgctcaggagaatggcgcccctgagtgctctcctaggaaccccctggaacccttcgcatctttagaacaaaatagagaggaggcacacagagtgtctgtgcggaaacagaagctgcaacagctggaagatgaattctacacgttcgttaatcttctggatgtggctagagccctgaggctgccggaggaggtggtagactttttataccagtactggaaacttaagcggaaagtgaactttaataagcctttgatcactcctaaaaaggacgaggaagataatttggctaaacgggaacaggatgtgctgtttagaaggctccagcttttcacacatcttcgacaggatctggagcgtgttatgatagacacagatacactgtag

SEQ ID NO: 17478 - DNA, 90 bp, Artificial Sequence
  Description of Artificial Sequence: Synthetic coding sequence
atgaacggaagagctgatttccgagagcctaatgccgaggtcccacggcccattccgcatataggccccgattacattcccaccgaatag

SEQ ID NO: 17479 - DNA, 1236 bp, Artificial Sequence
  Description of Artificial Sequence: Synthetic coding sequence
atgatcgtgaacgattatgaagggaacgactccgaggccgaggacctgaattttcgcgagacccttcccagctcgtcccaagagaacacgccacgttccaaagtgtttgaaaacaaagtgaactcggaaaaggtcaagctgagcttgcgtaatttccctcacaatgattacgaggatgtgttcgaagaaccttccgaatctgggtcggatcccagtatgtggaccgcccgcggtccttttcgtagagaccgttggagtagcgaagacgaggaagctgcgggcccctcccaggcactttctccactgctcagcgacacacgtaagatcgtctccgaaggcgaactggatcaactggcacagattaggccactgatcttcaacttccacgaacagaccgccattaaggactgtctgaagatcttagaagaaaagactgcagcatatgacatcatgcaagaatttatggctctggagttgaaaaatctgcccggagaattcaacagtggaaatcagcctagcaaccgggagaaaaataggtatagagacatcctcccctacgatagcacacgcgttccacttggcaagtcaaaagactatattaacgcatcgtacattcggatcgtaaactgcggagaagagtatttttacatcgccactcagggcccactgctgtccacaatagacgatttctggcagatggttttggaaaataacagcaacgtcattgccatgataacacgagagatagaaggaggaataatcaaatgttatcactattggccaatttccctaaaaaagccccttgagctgaaacatttcagggtgttcttggaaaactaccagattctgcagtacttcatcattaggatgttccaggtggtcgaaaagtcaaccggtactagccatagtgttaagcaattgcagttcacaaaatggccagatcacggcacacctgcctccgctgattccttcatcaaatacatcagatacgcgcggaaaagccacctgaccgggcctatggtggttcattgtagtgccggaattggtcgtactggggtcttcctctgtgtggacgttgttttttgtgccatagtgaagaactgcagttttaatatcatggacattgtagcccagatgcgagagcagcgctccgggatggtgcaaacaaaggagcaatatcacttctgctacgatatcgtgctcgaggttctgagaaaactcctgactcttgactag

SEQ ID NO: 17480 - DNA, 300 bp, Artificial Sequence
  Description of Artificial Sequence: Synthetic coding sequence
atggtcatggaaaagccctcgccccttcttgtgggaagagagttcgtgcgccagtattacaccctattgaacaaagcaccagagtatctccaccgtttctacggtcgaaactcgagctacgtgcacggtggcgtcgatgccagtggcaagccccaggaggcggtttatgggcagaacgacatccaccacaaggtcctgtcactgaattttagtgaatgccacactaagatcagacatgtcgacgcacatgcaacacttagcgacggagtagtcgttcaggtgatgggattgctcagttag

SEQ ID NO: 17481 - DNA, 705 bp, Artificial Sequence
  Description of Artificial Sequence: Synthetic coding sequence
atggcctcttccgccaaatccgctgagatgcctacaatctccaaaaccgtgaatcccactcccgacccccaccaggaatatctcgacccaagaataaccatagcactgtttgagatcggttctcattcccccagcagttgggggagcctgccctttctgaaaaattcatctcatcaggtgaccgaacagcagaccgcccaaaagtttaacaatctgctgaaagaaatcaaggacatcttaaagaatatggccggctttgaggagaagatcacagaggcaaaggaactgtttgaagaaaccaatatcacggaagatgtctcggcccacaaagaaaacatccggggactcgacaaaattaacgagatgctaagtacaaatctgccggtctccctcgctccagaaaaggaggacaacgagaagaagcaggagatgatactggagaccaatatcacagaagacgtgtccgcccacaaggagaacattcgtgggctggacaaaattaatgagatgttgtcaacaaatctgccagtctctctggctcctgagaaggaagacaatgaaaagaagcagcaaatgattatggagaaccagaattctgagaatactgcacaggtattcgcccgtgacctggtgaacagactggaagagaagaaggtcctcaacgagactcaacagagtcaagagaaggccaagaatagactatag

SEQ ID NO: 17482 - DNA, 1095 bp, Artificial Sequence
  Description of Artificial Sequence: Synthetic coding sequence
atgtacttttgttggggcgccgattcccgcgagctgcaaaggaggcgaacagctggaagtcccggcgctgagttactgcaggcagcatctggtgagcggcacagtttgttgctgctgactaatcatcgcgttctcagctgtggagacaatagcaggggtcagttgggcagaagaggggcacagagaggggagctccccgagccaatccaagccctagagactctcatcgttgacctcgtctcctgcgggaaggagcacagcttagctgtttgccacaagggccgagtttttgcctggggcgcaggatctgaaggccagcttggaattggcgaattcaaggagatctccttcacacctaagaagataatgacgctgaacgatataaagatcatccaggtgagctgtggacattatcacagtctcgcactgagtaaggactctcaggtgttcagctggggaaaaaactcccacgggcagctgggcctcggcaaagaattccccagtcaagcgtcgcctcagcgcgttcgcagcttagagggcattcctcttgctcaggtggctgccggtggggcccacagctttgctctgtcactatgtggtacctcatttggctggggttctaatagtgccggtcagctcgctctctctggtcggaacgtccctgtgcagtcaaacaagccgctgtcagtgggcgccttgaagaacctcggggttgtgtacatctcatgtggggatgcccatacggccgtcttgacacaggatgggaaagtcttcacgttcggtgataaccggtctggccaacttgggtattccccaacaccagagaaaagagggcctcaactcgtggaaagaatcgacggcttagtgagccagattgactgtgggtcttaccatacattagcttacgtgcataccaccggccaggtggtttcctttgggcatgggccgtccgacacatccaagccgacgcatccagaagccctcaccgaaaacttcgatatctcctgtctgatcagtgccgaggatttcgtcgacgtgcaggtgaaacacatctttgccggtacttatgccaactttgtcaccacgcaccaatag

SEQ ID NO: 17483 - DNA, 348 bp, Artificial Sequence
  Description of Artificial Sequence: Synthetic coding sequence
atggccaaatacaatacgggaggcaatcccactgaggatgtttccgtgaactcaagaccgtttagagtcactggtcctaactcttcctcaggaattcaggcacgcaagaaccttttcaataatcaggggaacgcgtccccaccggccggtccctccaatgtcccaaaattcgggtccccaaagccccccgtggccgttaagccctccagcgaggagaagccagacaaggagcctaaacctccttttctgaagcccacaggtgcaggacagcggtttggcacccccgcaagcctgaccacccgggaccccgaagctaaggtcgggttcctgaaacccgtggggccgtag

SEQ ID NO: 17484 - DNA, 486 bp, Artificial Sequence
  Description of Artificial Sequence: Synthetic coding sequence
atggccggaatcctccggctggtggtgcagtggcctcccggaagactacagacagtcaccaagggtgtcgaatccctgatctgcaccgattggatcagacataaatttaccagatcacgcatacctgagaaagtgttccaggcatcgccggaagatcacgagaaatatggcggagaccctcaaaacccccataaattacacatcgttacgaggattaagtcaacgaggcgacgaccctattgggagaaagatattataaaaatgttgggattagagaaggcgcacacgccccaggtacacaagaacatcccgagcgtgaacgcgaagctaaaagtagttaagcacctgatcagaatcaagccactcaagctcccacagggtctgccagccgaggaaaatatgagcaacacctgccttaagtctactggcgaactggtggtccaatggcacctcaaacccgtggagcagaaggcgcacgagtcctag

SEQ ID NO: 17485 - DNA, 516 bp, Artificial Sequence
  Description of Artificial Sequence: Synthetic coding sequence
atgaacggccgcgcagactttagagagcccaatgccgaggtaccgcgtccaattccacatatcggacccgactacattcctaccgaggaggagcgaagagtctttgccgaatgcaacgacgagtctttttggttccgctcagtgccattggcagctacttccatgctgatcactcaaggcctcatttccaagggcatcctgtcttcacatccaaaatacggcagcattcccaagctgattttagcctgtataatgggctatttcgcagggaagctttcctacgtcaaaacctgtcaggagaagttcaaaaagctcgaaaactcccctctcggagaagccctccggtcgggtcaggcacggcgaagttcccccccaggccactactatcaaaagagcaaatacgattcttcggtgagcggacagtcatccttcgtgacctcccctgccgctgacaatatcgagatgctgccgcattatgagccaatacctttttcaagctcaatgaacgaatcgtag

SEQ ID NO: 17486 - DNA, 438 bp, Artificial Sequence
  Description of Artificial Sequence: Synthetic coding sequence
atgtcaagtccccgcgattttagagcagaacctgtaaacgattatgaggggaacgatagtgaggcagaggacctgaacttcagagagaccctgccttcttcttcccaggaaaataccccgaggagcaaagtgttcgaaaacaaggtgaattcagagaaggtgaagctgagtctgcgcaattttccccacaacgactatgaagatgttttcgaagagccttccgaaagtgggtctgacccatctatgtggacagcacgtggtcctttccggcgcgatcgttggagctctgaagacgaggaagctgcaggcccctctcaggcactatcgcctctgctgtccgtgcaacaccatggctattcaggtccaaatgaaagaaccaccttctggcacggatccaatgaaggagcggtctcactattgctccgttattgtgcttag

SEQ ID NO: 17487 - DNA, 243 bp, Artificial Sequence
  Description of Artificial Sequence: Synthetic coding sequence
atggtcaccagcctgaacgaggacaacgagtccgtgacagttgaatggattgagaatggtgacactaaggggaaagagattgatttggaatctattttttccctgaatcctgaccttgtacctgacgaggagattgagccatcacctgaaacacccccaccacctgccagctccgccaaggttaacaagatcgttaagaacagacgaaccgttgcttccatcaagaacgacccacctagttag

SEQ ID NO: 17488 - DNA, 123 bp, Artificial Sequence
  Description of Artificial Sequence: Synthetic coding sequence
atgaaagcaatcaagaagagtttgaccgaagaagagtatctgtacctggatttttcccaccagaccgaggggtgcatctttcccctgcacacaagcgtgaccctgttccttctgagctactag

SEQ ID NO: 17489 - DNA, 192 bp, Artificial Sequence
  Description of Artificial Sequence: Synthetic coding sequence
atggaagcgctactcgaggggatccagaatcgcggtcatggcggaggcttcctgacctcctgcgaggctgaattgcaggaactcatgaaacagatcgacatcatggtggctcacaaaaagtcagagtgggaaggccgcacccacgcgctcgagacctgtctgaaaatcagagagcaggagctgaaatcatag

SEQ ID NO: 17490 - DNA, 594 bp, Artificial Sequence
  Description of Artificial Sequence: Synthetic coding sequence
atgtggaccgccaggggacctttccgccgagataggtggtcgtcagaagacgaggaggcggccggtccctctcaagctctgagccctctcctgtcagacaccagaaagatcgtgtcagagggagagctggatcagctggcccagatccggcctctgatcttcaattttcacgagcagacagcgattaaggactgcctcaagattttggaggagaagacagcggcctatgacattatgcaggagttcatgaccgggacgtcgcacagtgtcaagcagctgcagtttaccaaatggccagatcacggcacccccgcttctgcggactcttttattaagtacataagatacgcgcggaaatctcacctgaccggccctatggttgttcattgctctgccggtatcggacggacaggggtattcctctgtgtggacgtggttttctgcgcgattgtgaagaattgctccttcaatatcatggacatcgtggcccagatgcgcgagcagcggtctggaatggtgcaaacaaaagaacagtatcatttttgctacgatattgttctcgaggtgctgaggaagcttctgacactggactag

SEQ ID NO: 17491 - DNA, 2529 bp, Artificial Sequence
  Description of Artificial Sequence: Synthetic coding sequence
atgaaaaggggtagactgcctagctcttcagaggactctgacgataacggttccctatccaccacctggtcccaaaacagccggtcacagcacaggcgatctagctgctcccggcacgaggatcggaaaccgagcgaagtgtttcggactgatttaatcaccgcgatgaagttacacgactcctaccagttgaatcctgacgagtattacgtcctggctgatccctggagacaagaatgggagaagggagtccaggttccagtgtctccaggcactatccctcagccagttgcacgtgtggtatctgaggagaagtcactcatgtttataagaccaaagaagtacattgtgtcatctggaagcgagcccccggaactcgggtacgtagatatacgaacactggccgacagcgtctgcagatacgacctcaatgatatggacgctgcctggttggagctgactaatgaggagtttaaggagatgggcatgccagagcttgacgagtatacaatggaacgggttctggaggaattcgaacaaagatgctatgataatatgaatcacgcaatagagactgaggaaggtttggggatcgaatacgatgaggatgttgtgtgcgatgtttgtcaatcaccagacggcgaggacggcaacgagatggtcttttgcgataagtgtaacatttgcgttcatcaggcttgttacggcatcttaaaggtgccggagggtagctggttgtgccgtacttgcgctctcggggtacagccgaaatgtctcctatgtcctaaaaaggggggggccatgaagcccactcgctccgggacaaagtgggttcatgtgagctgcgcactgtggattccggaggtctctatagggtcccccgaaaaaatggagccaattaccaaggtcagccacatcccctcatctcgatgggccctggtgtgctcattgtgtaacgaaaaatttggcgcctctatccagtgcagcgtcaagaattgccgcaccgcttttcatgtcacgtgtgcctttgacagggggctggagatgaagaccattttggcagagaatgacgaagtaaaattcaaaagctactgtccgaaacacagtagccatcgaaagcccgaggagagtcttggaaaaggagccgcgcaggagaacggggcaccggagtgttctcctcggaatccgctcgaaccttttgcgagcttggagcaaaaccgcgaagaagcccatagagtctcagtgaggaagcagaagctgcaacaactcgaagacgagttttacacttttgtcaatctgttggatgtagccagggcgttacgactgcccgaggaggtggtcgactttctgtaccagtattggaagctcaagcgcaaggtcaattttaacaaacccttgattactcccaagaaggacgaggaagacaacctggctaagcgcgaacaggacgtgctattccgccgtcttcagttattcacccacctaaggcaggacttagaacgcgttcgaaatcttacgtacatggttacccgaagggaaaagatcaaacgctcggtgtgcaaggtgcaagagcagatcttcaatctttacacgaagctcttagaacaggagagagtgagcggcgtgccttccagctgctcttcctccagcctggaaaatatgctgctctttaatagcccatctgtcggtccagatgctcccaaaatcgaagatctcaaatggcatagcgctttcttccggaagcagatgggaacatccttggtacattctctgaagaagccccataagcgggaccctctacagaattcaccagggtcagaaggaaagaccctgctgaaacagcctgacctgtgtggccgcagagagggaatggtggtccctgaaagtttccttggcctcgagaagacattcgccgaagcccgccttatttcggctcagcagaagaacggggtggttatgccagaccacgggaagaggcgcgataatcgatttcactgtgacctcattaagggagatctgaaagacaaatcttttaaacagtctcataaacccctgcgatctaccgatgtaagccagcgccatctggataacacccgcgcggcaacatctccaggggtcggacagagcgcccctggaactagaaaagaaatcgtgcctaagtgcaacgggtcattgatcaaggtgaactataaccaaacagcggtgaaggtcccgaccaccccagcatctccggtgaagaactggggggggtttcgcatccccaagaagggtgagcgtcagcagcaaggggaggctcacgacggagcctgccatcagcacagcgattatccttaccttggcctggggcgagttcccgcgaaggagcgtgcaaaatcaaaactcaagagtgataacgagaatgacgggtacgttccggacgtggagatgagcgattctgagtctgaggcaagtgaaaaaaagtgcatccacacatcaagtaccatttctaggaggacggacatcattaggcgctctatccttgcctcatag

SEQ ID NO: 17492 - DNA, 2490 bp, Artificial Sequence
  Description of Artificial Sequence: Synthetic coding sequence
atggccaaatacaacaccggaggtaacccaaccgaggatgtctcggtgaactcgcggcctttcagagtgacaggaccaaactcaagcagcggtatccaggcccggaagaatctgttcaacaatcaaggaaatgccagccctcctgccgggccaagtaatgtgccaaagtttgggagccccaaacctcctgtagctgtgaaacccagtagtgaagaaaagcccgataaggaaccaaagcctccatttcttaaaccaaccggcgcagggcagcggttcgggactccggctagcctcacaactagagacccagaggccaaagtaggattcctgaaacctgtggggcctaaaccaataaacctgcccaaagaggattcaaaacctaccttcccttggccccccggtaacaagccctctctgcattctgtcaaccaggaccacgatttgaagcccctggggccgaagtccggccctactccacctacgtcggagaatgagcagaagcaagctttcccaaagctgactggagtgaaggggaaattcatgtccgcgtcccaggatttggagccgaaaccgctattcccaaagcctgctttcggccagaaaccacctctgagtactgaaaatagtcacgaggacgagagtccaatgaagaacgtgtcgtcctcaaaaggttcacccgctcctctgggggtgcggagcaagagcggaccactgaaaccggcgagggaagattcagagaacaaggatcatgcaggcgaaatttctagtctgcccttcccgggagtggtgctgaaaccagccgccagcagaggcggcccaggattatccaagaatggggaagaaaagaaagaggatcggaagatcgacgctgccaagaacacattccagagtaaaattaatcaggaggaacttgcatcaggcacacctcccgcaagatttcctaaagctccctctaagcttaccgtcggcggtccatgggggcagtcgcaggaaaaggagaagggagataaaaatagcgccaccccaaagcagaaacccctccctccattatttacactcggacccccaccaccgaagcccaacaggccgcccaacgtggacctgaccaagtttcacaagacttcatccgggaactccacttccaagggccagaccagctactccaccacttccttacctccaccgccaccttctcatcctgcatcccaacctccgttgccagcctcccatccttctcagccacccgttccatctctccccccaagaaacattaagcccccttttgatctgaagtcccccgtcaacgaggacaaccaggacggagtgactcattcagacggggctgggaacttagatgaagagcaggacagtgaaggagagacctacgaggatatcgaagcctcaaaggagcgggaaaagaagagagagaaggaagagaagaagcggctggagttggagaagaaggaacagaaggaaaaggaaaagaaagaacaggagatcaaaaaaaagttcaaattgaccggaccaatccaggttatccatctagcaaaagcctgttgtgatgttaagggagggaagaacgagctctcctttaagcagggagaacaaattgagattattaggatcaccgacaatcctgaggggaagtggctgggccgcactgcccgcggatcatatggctatatcaagactactgccgttgaaattgactacgatagtcttaaacttaaaaaagatagcctgggggctccatcacgacccattgaggacgaccaggaagtgtacgacgacgttgcggagcaggatgatattagttcccacagtcagtccggctctggcggcatatttcctccaccacctgacgacgatatttatgacgggattgaagaagaggatgccgatgatggtagcacacttcaggtccaggagaaatcaaacacttggtcatgggggattctgaagatgctgaagggcaaagatgacagaaagaagagcattcgggagaagcctaaggtatccgactctgacaacaacgagggaagtagtttccccgcccctcccaaacagttagacatgggagacgaagtgtacgatgacgtggatacctcagatttcccagtgagctcagccgagatgtctcagggcacgaacgtgggaaaagctaaaacagaggaaaaggacctcaaaaagctgaaaaagcaagagaaagaagaaaaggactttcgtaagaaattcaaatatgacggggagatccgcgtgctctactcgacaaaggtgactacttcaataactagcaagaagtggggcacccgggaccttcaggtgaaacctggtgaatcgctcgaggtgatccagacaacggatgatactaaggtgttgtgcagaaatgaggaaggaaaatacggctatgtgctgagatcatacttggcggataatgatggcgagatttacgacgatatcgccgatggttgcatttatgacaatgactag

SEQ ID NO: 17493 - DNA, 810 bp, Artificial Sequence
  Description of Artificial Sequence: Synthetic coding sequence
atgattgtcaatgattacgaaggcaatgactccgaggccgaggatcttaatttcagggagacactcccctcctccagccaggagaacactccaagatcgaaggtgtttgagaacaaagtcaattcagagaaagtcaaactgtctctgcgaaattttccgcacaatgactatgaggatgtgttcgaagagcctagtgagtccggctcggacccatctatgtggactgcccgcggcccttttaggcgggatagatggtctagtgaggacgaggaggcagccgggcccagccaagcactctccccactgctgtcagacacgcgtaagatagtgagcgaaggtgagctggaccagctcgctcagattcggccactgatattcaactttcatgagcagactgcgatcaaagattgcctgaagatcctagaagaaaaaacagctgcgtacgacatcatgcaggagtttatgactggcacttcacactctgtgaagcagctacagtttacaaagtggccagaccatggaacaccagcttccgcagatagttttatcaaatacatcagatatgcaagaaagagtcacctcacgggccccatggtggtccactgctcagcggggatcggtaggacaggtgtgttcctgtgcgtcgacgtggtgttctgtgccatcgtgaagaattgtagtttcaatattatggatattgtagcccaaatgcgagagcaaaggagcggaatggttcagacaaaagagcagtatcacttttgctacgacatagtgcttgaagtactcagaaagctccttaccctggactag

SEQ ID NO: 17494 - DNA, 492 bp, Artificial Sequence
  Description of Artificial Sequence: Synthetic coding sequence
atgatgttgggcaccgaggggggtgagggcttcgttgttaaggtcaggggacttccgtggtcctgctccgccgacgaagtgcaacgtttcttttccgactgtaaaattcagaacggggctcagggtatccggttcatctacacaagagaaggacggcccagtggcgaagcatttgtcgagttggagtcagaagacgaggtgaaattggctcttaaaaaagacagagagaccatgggacacagatacgttgaagtgtttaagtccaacaacgtggaaatggattgggtcctcaagcacaccgggcccaacagcccggatactgccaacgacggctttgtacggctccgcggcctcccctttgggtgcagtaaagaggagatcgtgcagtttttttccggattagagatcgtacctaacggtatcaccctgcctgtggattttcagggcagaagtaccggggaagcttttgtgcagttcgccagccaggagtag

SEQ ID NO: 17495 - DNA, 759 bp, Artificial Sequence
  Description of Artificial Sequence: Synthetic coding sequence
atggccgccactgcacgagaagatggggcaagcggtcaggagagggggcaacggggctgcgagcactatgacagagggtgcctgctcaaggctccttgctgtgataagctttatacttgtagattgtgtcacgataacaatgaggatcatcagcttgatcgctttaaagtaaaggaggtccagtgcatcaattgcgaaaagatacaacatgcccagcaaacctgcgaagaatgtagcaccctcttcggcgagtactactgcgacatctgtcacctgtttgataaggataaaaagcagtaccactgcgaaaactgtggaatttgtcgtatcggaccgaaagaagatttcttccactgtttgaagtgcaacttgtgtctagcaatgaatctccagggacggcataagtgcatcgaaaacgtctcgagacagaattgtccaatttgcctggaagatatccacacatctcgagtggtcgcccacgtcttgccttgtggccacctcctccaccggggttacagatgcccactctgtatgcacagcgccctcgatatgactcgctactggcgtcagctcgatgatgaagtggctcagacccccatgcccagtgagtaccaaaatatgacagtggacatactctgtaatgattgcaatggtaggagcactgtgcagttccatatattgggaatgaaatgcaagatctgcgaatcttataataccgctcaagcagggggacgacgaatctccctggatcaacagtag

SEQ ID NO: 17496 - DNA, 594 bp, Artificial Sequence
  Description of Artificial Sequence: Synthetic coding sequence
atgtggacagcgaggggcccctttaggcgggacaggtggagttcagaggacgaggaggctgccgggccctctcaggccctgtcccctctgctgtccgacactcgcaaaattgtctcagagggcgaactggaccaattggcccaaatacgccctctgatctttaacttccacgagcaaacagctatcaaggactgcctcaaaattttggaggaaaaaaccgccgcctatgacatcatgcaggaattcatgaccggcacctcccactcagtgaagcagctgcagtttactaagtggcctgatcacggaacgcctgccagtgcggatagctttattaagtatatcaggtacgcaaggaagagtcatctgacagggcctatggtggttcattgttccgccggaataggccgcacaggcgtttttctttgcgtcgacgttgttttctgcgctatagtgaagaattgcagcttcaatattatggatatcgtggcccagatgcgcgaacagcgctctggaatggtacaaaccaaggaacagtatcatttttgttatgacatcgttctggaagtgttaagaaagctattgactctggattag

SEQ ID NO: 17497 - DNA, 4203 bp, Artificial Sequence
  Description of Artificial Sequence: Synthetic coding sequence
tgacctccacccccccccccaccaatgtggaaccccatgattccagcttttgatctcttccagggcaaccatggcttcgtggccccagtcgtgacgacagctgctcattggaggtcggtaaactacacgttcccgccctctgtaatctcgcacacatcaccaacgaaggtatggcgaaataaggacggaacaagtgcgtaccaggtccaggagacaccagtgtcacaagtagtgcggaagaaaacttcctatgtgggtctcgtcttagtgttgctgcgaggcctgccaggctccggaaaaagctttctggcacggactctgcaggaagataaccctagtggagtcattttatcaaccgatgattatttctacatcaacggacagtaccagttcgatgtcaagtaccttggagaagcgcatgagtggaaccagaaccgtgctaaagaggcctttgaaaagaagataagcccaattattatcgataacactaacctgcaggcttgggaaatgaaaccttatgtagcactgtcccagaaacacaagtacaaggtcttgtttcgagaacctgatacgtggtggaagtttaagccgaaagagctagcacggagaaacattcacggggtgtctaaagagaagattacccgtatgcttgagcactaccaacgcttcgtaagtgtgccaatcataatgtcctcctccgtgcccgagaaaatcgagcgcattgagttatgtgcatactcatgtgaagatagaagcacttccccaagggatgacgaggacattatctccgagaaggaagaaaacattctcagtctgagccttaaacacttggagtttacggaggagaaaaacttggacgtcacaaaggagaccatgctgccagaaaatgtggcttatctgagcaatgccgacttgaacaagcggcgtaaagagatctccgatatgaacccatcgatccagagtgccctcatcttagagactcctcacatgtacttctccgactcggagtctaagctgcaagcgacagacaagtccgagaatgagcagatagagatggtagccgttaaaggatatagcaagacggacactgattcaagtatggagcgggtctccccttccacttgttgctccgagaacaatcaagaggattgtgatttggcgaactccggaccgttgcagaatgaaaagtccagtccaggtgagatcgtggaggaacgcgccacagtgaccaagaaagcctttggcaagcagaaatccaagagcacactagagaagttcccccgccatgagctgtcgaactttgttggtgattggccggtcgacaagacaattggtcaaaggactaaacgcaacaggaaaactgagaagacctcatccgtgcaaagtgacaaaaagtacaactacccccaaagtcacaagttagtcaattctgtcagcgtgaacaccgattgcgtccagcagagagggtcaccccatgaaagcgtggaggacggtaggaagtcccaatgtgatgacgcaagcgaaccattgaactcctataagtatgatgcctacaaaaatatcgataagaacagcttcaacatcatgggcgattggccgagcagtgattcactggcccagcgtgaacaccggtcccggatgcctaaaaccggactgtccgagcctaacctggaaatcggcacaaatgacaagatgaatgagatcagcctgtctaccgctcacgaagcctgttggggcacaagttcccagaagcttaaaacattaggcagtagcaacctaggcagctcggaaatgctgctgagtgaaatgacatgcgagagtcagacttgcctatcaaagaagtcccatgggcaacatactagcctacccttgacattcacaaattcagctcctaccgtctctggcgtagtggagccacagacgctagctgagtgtcaggagcagatgcctaaacgcgaccctgggaaagaggtcgggatgtgcactcaaacagaacctcaggacttcgccttgctgtggaagattgaaaaaaacaaaatttcaatatccgatagcatcaaagtactaactggacgacttgatgggttcaagccaaaagtgtttaacataaatacgaaatcggatgtccaggaagcgatcccttacagggtgatgtatgacaaaagcacgttcgtggaagagtcagagctaacatctgctgacgaatcagaaaatcttaacatcctctgcaaactgtttggatccttttcactggaagctcttaaggacctgtatgagcgctgtaacaaagatataatctgggctacatctctcctcctagatagtgagaccaagctttgtgaggacaccgaattcgaaaacttccagaaatcatgtgacgggagtcaaatcgggccctttagcctgggactgaaccttaaggagattatcagccaacgagggaccctggagaactctaatagtccagtacccgagttttcacacgggatcggaatttccaacgctgattcgcagtccacatgcgacgccgaaagggggaattccgagcaggcagagatgagagcagtgactcctgagaatcacgagtccatgacgtccatttttccctcagcagcggttgggctgaagaacaacaacgatatcctccccaacagccaggaagaacttctctactcgagcaagcaatcctttcccggcatcctgaaggcaacaactccaaaggatatgagcgagacagagaagaaccttgtggttactgagactggcgataatatacatagtcctagccatttttccgacatcttcaacttcgtgtctagcactagcaaccttgaactcaatgaggagatctattttactgactcactggaaataaagaggaacgagaactttcccaaggattatgtgaaatttagcgacgaggaggaatttatgaacgaagacgagaaagaaatgaaagagattctcatggcaggtagttctcttagcgccggagtaagtggcgaagataaaacggagatactgaatcctacaccagcaatggcaaagtcactaacaatagactgtctcgaactagcattgccccccgaactcgcatttcagctgaacgaattattcgggccagtggggatcgacagcggctctttgaccgtggaggattgtgtggtccacattgatttaaatctggccaaggtgatacatgagaagtggaaagagagcgtgatggaaagacagcggcaggaagaggtttcctgtggaaagtttatgcaagacccgtccctcgtgggtcacacaggcctcgataatccggaacagaaatctagccaaaggactggtaaaaagcttcttaagaccctgacagcctcagaaatgctgccactccttgaccattggaacacccaaacaaagaaggttagtttgcgcgaaatcatgtccgaggagatcgccctgcaggagaaacacaatctcaaacgtgagaccctgatgtttgagaaggactgtgccacaaagctgaaagagaagcagctgtttaaaatttttcctgccataaaccagaatttccttgtcgacattttcaaggaccacaattacagcttagaacataccgtgcagttcctgaattgtgtgctcgagggcgaccccgtgaagactgtcgtggcgcaggaattcgtgcaccaaaatgagaatgtcacgtcccacaccgggcagaagtccaaggaaaagaaggattttgaatacccggactatgatgactatagggcagaggcctttctgcaccagcagaagcggatggaatgttactccaaggccaaggaggcctatcgtatagggaagaagaacgtggccaccttctatgcccagcaggggacccttcatgaacaaaaaatgaaggaagctaatcaccttgccgccatcgagattttcgagaaagttaatgctagcttgctgcctcagaacgttctggatctccatggcctccatgtggatgaggccctcgaacaccttatgcgcgtgctggagaagaagacggaagaattcaagcagaatggcggtaagccctacctctctgttatcaccggacggggcaatcacagtcaaggaggtgtagcccgtatcaaacctgctgttatcaagtaccttatctcccactctttcagattttcagagatcaagcccggctgcctgaaagttatgctgaagtag

SEQ ID NO: 17498 - DNA, 237 bp, Artificial Sequence
  Description of Artificial Sequence: Synthetic coding sequence
atgctgtgttggggctactggtcactcggccagccaggtattagcaccaatctgcagggtatcgttgcagaaccccaagtttgcggattcatttctgatcgaagtgtgaaggaggttgcttgtgggggaaatcactctgtatttctgctggaggatggtgaggtttatacttgcggtctgaacaccaaagggcagcttggccatgagcgagaaggcaacaagcccgagcagatttag

SEQ ID NO: 17499 - DNA, 738 bp, Artificial Sequence
  Description of Artificial Sequence: Synthetic coding sequence
atgaatggcagagccgacttcagggaaccaaacgcagaggtgcccagaccaataccacatattggaccagactatatccccaccgaagaggagaggagagtcttcgccgagtgcaacgatgaatctttctggttccgatctgtgccactcgccgccaccagcatgcttataacccagggacttatttcaaaaggcatcctgtcctcacaccctaagtacggaagtatccctaaacttatcctcgcatgtattatgggatacttcgcaggaaagctcagctatgtgaagacctgtcaggagaaatttaagaagctggaaaacagccctctgggtgaagcattgcgctcagggcaagctcggagatcctcaccacctgggcattattatcaaaaatcaaaatacgacagctctgtatctgggcagtctagtttcgtgaccagtcccgccgccgacaatatcgagatgcttccccactacgagcctatcccattctcgtcaagcatgaacgagtctgctccgacaggtattacagaccatatcgtgcaaggtccggatcccaatctggaggagtcaccgaagaggaagaacattacatacgaagagttgaggaacaaaaacagagagtcttatgaagtgagcctcactcaaaagacagacccttctgtgaggcctatgcatgagagagtccccaaaaaggaagtgaaggttaataaatacggagacacctgggatgagtag

SEQ ID NO: 17500 - DNA, 2112 bp, Artificial Sequence
  Description of Artificial Sequence: Synthetic coding sequence
atggaagctttgctcgaagggatacagaacagagggcacggcgggggctttttgacatcctgtgaagctgaattacaggagctgatgaagcaaattgatatcatggttgctcacaaaaaatctgaatgggagggcagaactcacgccctggaaacctgcctgaaaattcgggagcaggaactgaagagtttacgatctcaactcgatgtgactcacaaggaggtcggtatgttacaccagcaagtcgaggaacatgagaagatcaaacaggagatgactatggagtataaacaggagctgaagaagctgcacgaggaactctgcattttgaagagatcttacgaaaaactgcagaagaagcagatgcgcgagttccgcggcaacacaaagaaccatcgggaggaccgatccgagatcgaaagattaaccgccaaaatcgaggaatttagacagaaaagcctggattgggagaagcagaggctcatataccaacagcaggtgagctccctggaagcccagcgaaaagccttagccgagcagtctgagattatccaggcacagctggtcaatcggaagcagaaattggagtctgtggaactcagcagccagagtgagattcaacacctgtcttctaagctggagcgtgccaacgacactatttgcgctaacgaactcgaaattgaacggttgacaatgagagtgaacgacttggttgggacatcaatgaccgttctgcaagaacagcagcaaaaggaggaaaaattgagggagagcgaaaaacttctggaggccctgcaggaggaaaaacgagaactcaaagctgctctgcagtcccaggagaatctcatccatgaggcaagaatccaaaaggaaaaactgcaggagaaagtgaaggccacaaatacccagcacgccgtagaagccatcagacctcgagaggagtcgctggccgagaagaagtacactagtcagggtcagggcgatttggactctgtgctgtcccaattgaacttcacacatacttctgaggacctgctgcaagctgaggtcacgtgcttggagggctcgttggagtcggtctctgcaacctgcaagcagctgtcgcaagagctcatggagaagtacgaagagcttaaaagaatggaggctcacaataacgagtacaaagcggaaatcaaaaaattgaaggaacagatcctgcaaggcgagcagtcatactcaagcgcgctggagggcatgaagatggagatcagccacctcacccaggagctgcaccagcgcgacatcaccatcgcttccacaaagggcagttcatccgacatggaaaagagattaagggctgagatgcagaaggccgaagacaaggcagtcgaacacaaggaaatactcgaccaactagagagcctcaagctcgaaaatagacacctttccgagatggtgatgaagcttgagttaggactgcatgaagcgaaagaaatctctctcgccgacttgcaagagaactatattgaggccctgaacaaactggtctccgagaaccagcagttacaaaaagatctgatgaacactaagagccagctcgagattagtactcagatgtgtaaaaaacaaaatgaccgcatatttaagcccactcactctaggaccaccgaattcaagaatacagaatttaaaccaacgcacggacagcatagacacgatggtattaaaacagaacattacaagactgatctgcattcccctagagggcaagcttccgactctatcaacccgatgtcgagagttcttagccctctgagccctcagatttcgccctgcagtagcacccggtccttgaccagttacagcctctgcaagacacattcactcccctccgctttggataccaatgaggcaaatttctcagacactatgagtgagtcaatgaatgaccaggaggagtttatttcctcgtgtagcctgccagttagccccttgggtagcatcgccactcgattcctggaggaggaggagctgcggagccatcatattcttgagagactggatgcgcatattgaggagttgaaacgggaaagcgagaaaacagtgcggcagttcacagctctcaagtag

SEQ ID NO: 17501 - DNA, 573 bp, Artificial Sequence
  Description of Artificial Sequence: Synthetic coding sequence
atggcaggcaccgcgaggcatgaccgggagatggctattcaagctaagaagaagcttactactgccactgaccccattgagcgtctgagactccagtgcctcgcacgtggctctgcagggatcaaggggctgggacgagtattcagaattatggacgacgataataaccgcaccctggattttaaagagttcatgaaaggattgaatgattatgctgtcgtgatggaaaaagaagaggtcgaagagctgtttcgtagatttgacaaggatggtaatggtaccattgattttaacgagttcttgcttacccttagaccccccatgagcagggctcgcaaagaagtcatcatgcaggctttccgcaagttggacaaaactggtgacggcgtcatcacaatcgaagacctccgcgaggtctacaatgctaagcaccaccccaaataccagaatggcgagtggtccgaggagcaggtgtttaggaagttcttggacaactttgactccccatatgataaagatggcttggtaacgccagaggagtttatgaattactacgcaggcgtgtccgcttag

SEQ ID NO: 17502 - DNA, 231 bp, Artificial Sequence
  Description of Artificial Sequence: Synthetic coding sequence
atgaccccaccccagcagccaccacctttgcgatctgagccaggaactctgggctcagctgcgagctcttatagtccattagggctcaacggggtgcccggaagcatttgggactttgtaagcggtagtttctcaccgagccccagtccgatcctctctgctggaccgccttccagcagctcggcctcacctaacggggccgagctggccagagtccggcgccagctttag

SEQ ID NO: 17503 - DNA, 108 bp, Artificial Sequence
  Description of Artificial Sequence: Synthetic coding sequence
atggctactctggtggtgaacaagctgggcgctggggtggattcagggagacaaggcagcagagggactgctgtggtgaaggttctagaatgcggagtgtgtgaatag

SEQ ID NO: 17504 - DNA, 477 bp, Artificial Sequence
  Description of Artificial Sequence: Synthetic coding sequence
atggaagcagacatcatcaccaatctgagatgtagactgaaggaggctgaggaggagcggcttaaagcagcccagtatgggctccagctggtggaatcccaaaacgagctgcagaatcagctggacaaatgcaggaatgaaatgatgaccatgaccgagtcatacgagcaggagaagtacacattgcaaagagaggtcgagctcaagtcacgcatgctcgaaagccttagttgtgagtgtgaggctatcaaacagcagcagaagatgcatttggaaaagttggaagaacaactgtccaggagccatggacaggaagtcaacgagttgaaaacaaaaatcgagaagctcaaggtcgagctcgatgaggccagattatctgaaaagcagctgaagcatcaggtggaccatcagaaggagctgctttcttgcaagtctgaagaactcagagtgatgagtgaaagggtgcaggagtcgtag

SEQ ID NO: 17505 - DNA, 393 bp, Artificial Sequence
  Description of Artificial Sequence: Synthetic coding sequence
atggcacagacggacaagcctacctgcatccctccagagctgccgaaaatgctgaaggagttcgccaaggcagccatcagggctcaaccccaagatttgatccagtggggcgccgactattttgaggccttatcgagaggtgagactccacccgtgcgagagaggagtgagagggtagctctctgcaactgggccgaactgaccccggagctgctgaagatcctgcattctcaggtagccgggaggttaatcattcgcgctgaggagttggcgcagatgtggaaagtggttaacctacccaccgacctctttaacagcgtgatgaacgtgggacggtttacagaggaaatcgagtggctgaagttccttgctctggcctgctccgccctctag

SEQ ID NO: 17506 - DNA, 693 bp, Artificial Sequence
  Description of Artificial Sequence: Synthetic coding sequence
atggaggccgatatcataacaaatctcagatgccgcttgaaggaggcagaggaagaacgactgaaagccgcccagtatggtctgcaactggtggagagtcagaacgagttgcaaaatcagctggacaagtgccggaacgaaatgatgaccatgaccgagagctacgagcaggaaaagtacacactgcagcgcgaggttgaacttaagagccgcatgcttgagtcactcagctgtgagtgtgaggccattaaacagcaacagaagatgcatctggagaaactcgaggagcagttgagccggtcgcacggacaggaggtgaacgagctcaaaacaaaaatcgagaagctgaaggttgagctggacgaggcgcgcctctcagagaagcaactcaagcatcaggtggaccatcaaaaggaactcctgtcgtgcaaaagtgaagagctgagggtgatgagtgaacgcgtgcaggagagcatgtcatcagagatgctagccctgcagattgagctgaccgaaatggaatccatgaagaccacccttaaagaggaggtcaacgagctacagtatcggcaggagcaattagagcttttgattacaaatctgatgcgacaggtcgatcggctgaaggaggaaaaggaggaacgtgaaaaagaagcagtttcgtactataacgccctagagaaggctaggtag

SEQ ID NO: 17507 - DNA, 639 bp, Artificial Sequence
  Description of Artificial Sequence: Synthetic coding sequence
atggctcagaccgataagcccacctgtattccacctgagctgcctaaaatgctgaaggagttcgcaaaagcggcgatccgtgcccagcctcaggatctgatccagtggggggctgattacttcgaagcactctctcggggtgagactccgcccgtgcgcgagaggtcagagagggtggctctgtgtaactgggccgagctgacacctgaactcttaaaaatcctccatagtcaggtggcaggcagacttattatcagagcagaggagctggctcagatgtggaaggtcgttaatctgccgaccgacctcttcaatagtgtgatgaacgtcggaagattcaccgaagaaattgaatggttgaaattcttggccctggcttgctctgcacttggagtgaccattaccaagaccttgaaaattgtgtgcgaggtgctgtcctgtgatcacaacggaggcctgcccagaatccccttcagcacttttcagttcctgtatacttatatagcagaggtggacggagaaatctgtgctagtcacgtcagtcggatgctcaattatatagagcaagaggtcattggacccgatgggcttatcaccgtcaacgattttacccagaatccacgagtgtggctcgaatag

SEQ ID NO: 17508 - DNA, 2844 bp, Artificial Sequence
  Description of Artificial Sequence: Synthetic coding sequence
atgaacttcctgaggggggtcatgggtggacagagcgccggtcctcagcacaccgaggctgagacggtgcgaggcgcagcagaccctaaagtaacctccagttgtggccttaagtttcggcacagcttccggctggtcaagcacattctctaccatgtaactatcaacgtgtacagtgattctgagattatcggctacgccctggacacactctacaacattatctcgaacgaagaggaagaagaggttgaggaaaactctacaagacagtcagaggacctcggaagtcagttcacagagattttcatcaagcagcaggaaaacgtcacgctgctactgtcgctcctggaggaattcgacttccatgttcgctggccgggtgtgaaactgctgacttccctgttgaaacaattgggaccgcaggttcaacaaataatccttgtgtcacccatgggggtgagtcggctaatggatcttctagctgattctagagaagttattaggaacgacggcgtattactcctgcaggcgctgactcgatctaatggggctatccagaagatcgtcgcatttgaaaatgcatttgaaaggctgctggacatcatcagtgaagagggtaacagtgatggagggatcgtggtggaggactgtcttattttgctgcagaaccttctcaaaaataacaactctaatcagaacttttttaaggaggggagttatatccagcggatgaagccatggttcgaagttggggacgaaaactccggctggagcgcccaaaaagtaactaatcttcatctgatgctccagctcgtgagggtgctcgtgagcccgaccaacccccccggggctacttccagctgtcagaaagctatgtttcaatgcgggctcttacaacagctttgtaccatcctgatggccactggagtcccggctgacatcctgaccgagactatcaacacagtgagtgaggtcatcagggggtgtcaggtgaatcaggactactttgcttctgtgaatgctcctagcaaccctcccagaccggcaatcgttgtgctcctgatgtcaatggtcaatgagaggcagccgtttgtgcttcgctgtgctgtgttgtattgcttccagtgcttcctctacaagaaccaaaaaggtcaaggagaaattgtttccactcttctcccttctactatagatgcgacaggcaacagcgtgtccgcggggcaactgctctgcggcgggctgttcagcaccgatagcttgtctaattggtgtgcggcagtggccctggcgcatgcattacaggagaacgcgactcagaaagagcagttgttgcgagtccaactggctacatctattggtaaccctcccgtgtccttactgcagcaatgtacgaatatcctgtcccaaggctcaaagatccagaccagagtcggcctactgatgctcttgtgcacgtggttgtcaaactgcccaatcgccgtcacccattttttgcacaactctgcaaatgtcccatttcttactggccagatagcagagaacctgggagaggaggaacagttggtgcagggcctgtgtgcactcctgttaggcatctctatctattttaacgacaactcattggaatcctacatgaaggagaagctgaagcagttaatagaaaagcgaatagggaaagagaatttcattgagaagctcggttttatttcaaaacatgaattgtactctcgggccagccagaagccacagccaaatttcccaagcccagaatacatgattttcgaccatgaattcaccaagctggttaaagaactggaaggggtgatcactaaggctatctacaaatcttccgaagaggataaaaaagaagaagaggtcaaaaaaactctggagcaacacgacaatattgtgacacattataagaacatgatcagggagcaggacttacagcttgaagagcttagacagcaagtctccacactcaagtgtcagaatgagcagctccagaccgcagtcacacagcaggtttcccagattcagcagcataaggaccagtacaacctgttgaagattcagttaggcaaagacaaccagcatcagggcagctactcggaaggagcccagatgaacgggatccaacctgaggaaattggtcgactgcgagaggagattgaggaattgaagcggaatcaggaactgctacaaagccagctgaccgagaaggattccatgatcgagaacatgaaatccagccagacctccggtacgaacgagcagagctcggccatcgtctccgcgcgggactctgagcaggttgccgaacttaaacaggaactggctactctgaaaagtcaactcaatagccagtctgttgagatcaccaagctgcaaacagaaaaacaggaactattgcaaaaaaccgaggcttttgcaaaatcagtggaggtccagggggagaccgagaccatcattgcaaccaagacgacagatgtcgaaggcaggctatcagcactcctccaagaaaccaaagaactgaagaatgagattaaggccctgtccgaagaaagaacagccataaaagagcagctagatagctcgaatagcacaattgcgattcttcagacggaaaaggacaaattggagctagaaatcacggattccaaaaaggaacaggacgacttgctggtgctcctggcagaccaggatcaaaaaattctcagtcttaaaaataagctcaaggacctaggtcatcccgtggaggaggaagatgaactcgagtcaggagatcaggaggacgaagacgatgagtccgaagacccgggaaaggatctcgatcatatttag

SEQ ID NO: 17509 - DNA, 1095 bp, Artificial Sequence
  Description of Artificial Sequence: Synthetic coding sequence
atggtgaaactgttcatcggcaacttgccccgggaggccactgagcaggaaattcggtcactgttcgagcagtatgggaaagtgttagaatgcgacattatcaagaattatggatttgtgcacatcgaggacaagaccgcggcagaagacgccatccggaacctgcatcactacaaactccacggcgttaacattaacgtggaagcaagtaagaacaagagcaagacttcaactaagcttcatgtcggaaacattagccctacatgcacaaacaaagagttgcgggcaaaattcgaggagtacgggcccgtgatcgaatgcgacatcgtaaaggattatgcattcgtccacatggagagagcagaggatgcggtcgaggctatcagaggcctggacaacaccgagttccagggtaagcggatgcatgtgcagctcagcacctccagactaaggacagcccccggaatgggcgatcagtcagggtgctaccgctgcgggaaggaagggcactggtccaaagagtgcccaattgaccgtagtggacgagtggcagacctgaccgagcagtacaacgaacagtatggtgcggttagaacaccttataccatgtcatatggggattctctctattacaataacgcttatggggcattggacgcatattacaaaaggtgtcgggctgcgcggagctatgaggcagttgccgcagctgcagccagcgtctataattatgccgaacagactctgtctcagctcccacaggtgcagaacaccgcgatggccagtcatctcacttctactagtctcgacccatatgataggcatctgctccctacctccggggctgcagccaccgccgcggccgcagcagcagccgctgcagcagtgactgcagcaagtacttcttattacggacgggatcgctccccgttacgaagggctacagcacctgtgcccacggttggggagggatatgggtatggacacgaatctgagttgagccaagcctctgctgctgctcggaatagcctgtacgatatggccaggtacgagagggagcagtatgctgatagagcccgctattcagcgttttag

SEQ ID NO: 17510 - DNA, 1236 bp, Artificial Sequence
  Description of Artificial Sequence: Synthetic coding sequence
atgattgtcaatgactacgagggcaatgattcggaggccgaggacctgaactttagggaaacactgccctccagttcacaggagaacacccctcgatccaaggtctttgagaataaagtcaactctgagaaagtcaaactgtctttgagaaacttcccacataacgactacgaagatgtttttgaggagccttcagagtccggctctgatccttctatgtggaccgcacgcggccctttcaggagggacaggtggagcagtgaggatgaagaggctgccggccctagtcaggcactgagtcctctcctgtcagacacacggaagatcgtttcagaaggcgaacttgatcagcttgcacagatccggccactcatcttcaattttcacgaacaaaccgctatcaaagactgcctgaagatccttgaagaaaagactgccgcttatgacataatgcaggaatttatggctttggaactgaagaacctgccaggcgaatttaacagcgggaatcaaccgagcaatcgtgaaaaaaatcgctaccgagacatcctaccatatgattcaacacgcgtgcccctcggcaagtcaaaagattatatcaacgctagttatatcagaatagtgaattgcggagaggagtacttctatattgcgacccagggcccgctactcagcaccattgacgatttttggcagatggtgctggagaataattccaacgtaattgcgatgatcacgcgggagatcgagggaggcattattaagtgctaccattattggcctatcagcttgaagaagcccttggagctgaagcatttccgcgtatttctcgaaaactaccaaatcctgcaatattttattattcgcatgttccaggtggtggagaagtccacaggcacctcgcactccgtgaagcaactacagtttaccaagtggcccgaccacggaacacccgccagtgccgacagctttattaagtacatacgctacgcgaggaagtcacatctgacgggcccgatggtagtacactgctctgcgggcattggtcgaacaggggtttttctgtgcgttgatgtcgtgttctgtgcgatcgtaaagaactgttcatttaatattatggatatcgtggcacaaatgagggagcagaggagcggaatggtgcagactaaggaacaatatcatttttgctacgatatagtccttgaagtgctccggaagcttttgaccctggactag

SEQ ID NO: 17511 - DNA, 810 bp, Artificial Sequence
  Description of Artificial Sequence: Synthetic coding sequence
atgatcgtgaacgattatgaaggaaatgacagcgaagccgaagacctgaatttccgcgaaacgttacctagtagtagccaggagaacacaccgcgcagcaaagtctttgaaaataaagtgaacagcgaaaaggtgaaactgagtctgcgtaattttcctcacaatgattatgaagacgtcttcgaggaaccgtcagaaagtgggtccgaccctagcatgtggactgcccgtggacccttcagaagagaccgttggagctctgaggacgaggaagccgctggacctagtcaggctctcagccctctgctaagcgatacaagaaagattgtgagcgagggcgagttggaccagttagcacagattcgccccttgatctttaatttccatgagcagaccgcgattaaggactgtctcaagattttggaagagaagactgcagcctacgatatcatgcaggaattcatgactggtaccagtcatagtgtaaagcaacttcaattcaccaagtggcccgatcatggtacaccagcctccgcagacagctttattaaatatattcggtacgctcgtaagagtcacctgaccggccctatggtggtacattgttctgctggaattgggcgcacaggcgtgtttctgtgcgtcgatgttgttttctgtgccatcgttaaaaattgcagctttaatatcatggatatagtggctcagatgcgagaacagagaagtggcatggtgcagacaaaagagcagtaccacttctgctacgacatcgttctggaggtgctgcggaagctcctgaccctggattag

SEQ ID NO: 17512 - DNA, 360 bp, Artificial Sequence
  Description of Artificial Sequence: Synthetic coding sequence
atggcctctcagctccaggtgttcagtccaccctccgtctcaagtagtgcattttgctccgcaaagaagttgaaaatcgaacctagtggttgggacgtcagcggccagtcttccaatgacaagtattacacccactctaagaccttgcccgccactcagggccaagccaacagtagccaccaggtcgccaatttcaatatccctgcctacgatcaggggcttctgctgcccgctccagccgtggagcatattgtcgtcactgccgcggattccagtggctcggccgccacaagtacctttcaaagttctcagaccttgactcacagatcaaatgtctctctgttggaaccttaccagtag

SEQ ID NO: 17513 - DNA, 339 bp, Artificial Sequence
  Description of Artificial Sequence: Synthetic coding sequence
atggctaccggcgatctgaagcggagtcttcggaacctggaacaggtgttgaggctgctgaactatccagaggaagttgattgcgtgggcttaatcaagggcgaccctgctgcatccctacctattatcagctactcttttacctcttatagtccttatgtgaccgagctgataatggagagtaatgtggaattaatagccaaaaacgatttacgcttcatcgacgccgtgtacaagctgttgagggatcagttcaattacaaaccaatcctcactaaaaaacagttcatccagtgtggttttgccgagtggaagattcagatcgtttgtgacatatag

SEQ ID NO: 17514 - DNA, 54 bp, Artificial Sequence
  Description of Artificial Sequence: Synthetic coding sequence
atgaaacgggggcgcctgcccagctcctccgaggatagcgacgacaatgggtag

SEQ ID NO: 17515 - DNA, 810 bp, Artificial Sequence
  Description of Artificial Sequence: Synthetic coding sequence
atgaatcaagaggatttagatcccgattctaccactgatgttggtgacgtgaccaatactgaggaggagctgatccgggaatgtgaggaaatgtggaaagatatggaagagtgtcaaaacaaattatccctgattggcacggaaacactcaccgactccaacgcccagctgagccttttgatcatgcaggtgaaatgccttacagcagagctatctcagtggcaaaaaaagactccagagaccatccctcttaccgaggacgtcttgatcaccctgggcaaagaagaattccagaaattgaggcaggatcttgagatggtgctatcaacaaaagaaagtaagaatgagaagctgaaggaggatctggaacgcgagcagcggtggctcgatgaacagcagcaaatcatggaaagtctgaatgtactgcatagcgagcttaagaacaaggtagaaaccttctcagaatcaagaatctttaacgaactgaagacaaaaatgctaaacataaaggagtacaaggagaagctgctgtctaccctcggcgaatttctcgaggatcattttccgcttcctgacagatctgtgaaaaagaaaaagaagaatatccaggaatcttccgtgaacctgatcaccctgcatgagatgctggaaatccttattaaccgcctgtttgacgtacctcacgacccctatgtgaagatcagtgatagcttttggcccccttatgtcgaactgctgttaaggaacggcattgcccttcgacaccccgaggacccaacaaggattagactagaggcattccatcagtag

SEQ ID NO: 17516 - DNA, 339 bp, Artificial Sequence
  Description of Artificial Sequence: Synthetic coding sequence
atgaatggaagagccgattttcgtgaaccgaacgcagaggttccaagacccatcccacacatcggaccagattacattccgacagaagaagagcggagggtgttcgccgaatgcaacgatgagagcttctggtttaggtctgttcctcttgcagcaacttctatgctgataacccagggcttaatttctaaaggtattctgagctcccacccgaagtatgggtctattcctaagttaatcctggcttgcattatggggtatttcgccggaaaactcagctatgtgaaaacatgccaagaaaaatttaaaaaactggagaactctccgctgggcgaatag

SEQ ID NO: 17517 - DNA, 687 bp, Artificial Sequence
  Description of Artificial Sequence: Synthetic coding sequence
atggaggaacagccacagatgcaagatgcagacgaacccgctgattccggcggtgagggtagggccggagggccccctcaggtggccggagcccaggcagcctgttcagaagatagaatgacactcttactgaggctgcgagcccaaacaaagcagcaattgctggaatacaaatctatggtggatgccagcgaagaaaagaccccggagcaaatcatgcaggaaaaacaaatcgaggcaaagattgaggacctcgagaatgagattgaagaggtcaaagtggcatttgagatcaagaaacttgccctcgactcagtcctgatggacaacatgaaacatctgctagaactcaataagctgatcatgaaaagccagcaagaaagttgggaccttgaggagaaactccttgacatacgaaagaagaggctgcagctcaagcaggccagtgagtccaagcttttggagatccaaaccgagaagaataaacagaagatcgacctggatagtatggagaattccgagaggataaagattattaggcagaaccttcaaatggaaatcaagataacgacagtgattcagcacgttttccagaaccttatcttggggagcaaggtaaactgggccgaagatcccgcattaaaggagatagttctgcagctggaaaaaaatgtggatatgatgtag

SEQ ID NO: 17518 - DNA, 2352 bp, Artificial Sequence
  Description of Artificial Sequence: Synthetic coding sequence
atggctaaatataacactggagggaatcccaccgaggatgtctccgtgaattcacggccctttagagtaaccgggccaaattcatcatcaggcatccaggcacgaaagaacctgttcaacaatcagggcaatgcgtccccacccgccggcccctcaaacgtgcccaagtttggctcacctaagcccccagtggccgttaagcccagctccgaagagaaaccagacaaggaaccgaagccccccttccttaaacccactggggccgggcagcgcttcggtacacctgcttctctgactacccgtgatcctgaggctaaggtcgggttcctgaagcccgttggcccaaagcccattaatttgccaaaagaagactcgaagcctacttttccctggcccccggggaataagcccagtctccattctgttaatcaggatcatgatttaaagccattagggcctaaatcagggcctaccccacccacatcagagaacgagcagaaacaagcgtttccaaaacttacgggggtgaaagggaaatttatgagtgctagccaggacctcgagcccaagcccctgttccccaagccggcattcggacagaaaccgcctctcagtaccgagaacagtcacgaggacgaatctccaatgaagaatgtctccagttccaaaggctcccccgctcctctaggagttaggagcaagagcggcccgctaaaacctgcccgcgaggattcagaaaacaaagaccatgccggcgagatcagttctctccctttcccgggggtcgtattgaagcctgccgcaagccgtggtggccccggactgtccaaaaacggtgaggaaaagaaggaagataggaaaatcgacgccgccaagaatacattccaaagcaaaataaaccaggaggagctggccagcgggacaccaccagctcggttcccaaaagcaccaagcaaactcactgtgggaggtccttggggccaatcacaggaaaaggaaaagggcgataagaactctgctacacccaaacaaaaaccactaccacccctgttcaccctgggccctccaccccccaagcccaaccgacctcctaatgtggatcttacgaaattccacaaaacgagcagcggtaacagcacctctaaggggcagacctcctattcaacaacctccctgcctccaccaccacccagtcaccccgcctcccaaccaccactgcctgcaagccatccaagccagccccctgttccatcattgccaccccgaaatatcaagccaccatttgaccttaaatctcccgtgaatgaggataaccaggatggagtaactcactctgatggggccggcaaccttgatgaagagcaggatagcgagggcgaaacatacgaggacattgaagcatccaaggagcgcgaaaagaagcgcgaaaaggaagagaaaaagaggctggagctggaaaagaaagagcaaaaagagaaggagaagaaagagcaggagatcaaaaagaagtttaaacttacagggccaattcaggtgattcacctcgcaaaagcttgctgtgatgtcaaaggaggcaagaacgagttgagctttaaacagggagagcagatcgagatcatccgtatcactgacaatccagaaggaaaatggttaggcagaaccgcccggggttcctacggatatattaagaccacagccgtggaaatcgactatgattctctgaaactgaaaaaggattcactgggcgcccccagtcgccctatcgaagatgatcaggaggtgtacgatgatgtcgctgagcaggacgatatctccagtcattctcagtctggatccggtgggattttcccccccccaccggatgacgacatctatgatggcatcgaggaggaagacgccgacgacgggtttcctgccccccctaaacagctggatatgggtgatgaagtgtatgatgatgtggacacatcagactttcctgtctcttccgcagaaatgagtcagggcaccaatgtgggtaaagcgaaaaccgaggagaaagatctgaaaaagctcaagaaacaggagaaagaggagaaggattttcggaagaaatttaaatatgatggcgaaatccgggtcttatactcaactaaggtgaccacttctatcacaagtaaaaagtgggggacaagagaccttcaggtcaagccaggtgagtccctggaagtgatccaaaccactgatgacaccaaagttctatgtcgaaacgaagagggaaaatatgggtacgtgctgcggtcgtatctcgccgacaacgacggcgaaatctacgacgacattgcagatggttgtatatatgataacgactag

SEQ ID NO: 17519 - DNA, 393 bp, Artificial Sequence
  Description of Artificial Sequence: Synthetic coding sequence
atgatgctgggtacagagggtggcgaaggtttcgtggtgaaagtacgaggactgccctggtcctgcagcgctgatgaggtccagaggttcttttcggactgtaaaatccaaaacggggcccagggtataaggtttatctatacccgcgagggacgcccctcaggcgaggcatttgtggaactggaatccgaagacgaagttaaacttgccctaaagaaggatcgagaaactatgggtcaccgctatgtggaagtatttaaatctaataacgtcgaaatggactgggtcctaaaacacacaggccccaatagccccgacaccgccaacgacggctttgtacggctgagagggctaccttttggctgttccaaggaggagatagtgcagttctag

SEQ ID NO: 17520 - DNA, 267 bp, Artificial Sequence
  Description of Artificial Sequence: Synthetic coding sequence
atggaagccgatatcattactaacctgagatgtagactcaaggaggccgaagaggaacggctgaaagctgctcaatacgggctgcagctggtggagtcacagaatgagctgcaaaaccagctcgacaagtgtagaaatgaaatgatgaccatgacagagtcttatgagcaagagaaatatactttgcagcgagaagtggagttgaagtccaggatgctcgaaagcctgtcttgcgagtgtgaggccattaagcagcaacagaagtag

SEQ ID NO: 17521 - DNA, 1902 bp, Artificial Sequence
  Description of Artificial Sequence: Synthetic coding sequence
atgaaagctatcaaaaaaagcctgaccgaggaagagtatctctatctggacttttcccatcagactgagggttgcatcttcccactgcatactagtgtcaccctttttctgctttcatattgtgattgtaaaatctttaaaatctgtctggttgtgactaaggaagtgagccgtgatagttcccttctgagggacgacttgatccaggacgtggaaattcaaatcatctcccgccaggagctacctcccatcgtgcagaactgttgcttaccagcggtggtggagagatccgataacttctgtcgggccggtctggctgtggtgctgcggcatatcattcagaagagctacgaagctgacccattgaaaaaggaactgctggagcttctgggattcaaaaagacctgtcttaaggcatgtgcagaggtatcccagtggacaaggttatgcgagctcacaatcccactcgccatcgagaactttcttcgcgaatctagcgaccagccgcctacaatacccgtggagatcctgcaactggagaaaaagctgtcagaacctgtccgcgtgcacaacgatgacaagctccgccgccagaaactgaagcagcagaaagcagatggagtgggccctcccctgacaaagggcaaggcgaaaagcaaggtccatacacaggaaacctccgagggactggatagctctagtaaatccctcgaactcaaagtcgcattttctaagcttactgtgcaggaggaacctgccacaacaaacagagagccctcccacatccgcaaggccaaggccagcgatctgccccctttggagcacgtgtttgcggaaggcttgtacttcacgctggctgacatcgttctgttgccatgcattcaccactttctcgttataatcagtcgcaagttttccgagaagctcgtggaattccccctcctcgcttcttggtatcagaggatccaggaggtgccaggggtcaagacagccgcatctaaatgcggcatacagttcttgcaccttcccaagctactgacaacatccacagagcaacatcctaacctgtgtgaggtccctggcgtggaagaacaatctgatcctctattcatcggcgggccccggcctaccatggcaaaactcatggaaaaaggcatcgaagtcatgttcagcccacacccctgccccacctggactttagactggaatgtgctacccgccgccgtgagcccgaaggaggggaaaatgagctccgaccgcgccctaagaaagcagcagcaactgaacaatttagtttacgtggtcaccaatcaggctaagcccggggaccggattgttgatttctgttcgggcggagggcacgttgggatcgttctcgcccacatgctgcccagctgtcaggtaaccttaatcgagaacaaagagctcagccttataagggccaagaaaagatccgatgaattgggccttagcaacatctggtttatccaggcaaatatggaatactttaccggaatgttcaatataggcgtggcactgcacgcttgtggcgtggccacagatatggttatcgagcattgtatcaagactcgtgcaagctttgtgacctgcccttgctgttacgggtttatccagaatacatccaaatttaactttcccaagtccgaacaatttaaaaagacgctatcctacaaagaacacatgatcttgtgccgattcgccgatcaaacagcagttcagttaccacctcagcgaagactgatcggcaagcagtgtatgtgtctcgtcgacctggatagggcccgagccgccgaagaatgtgggtacagcgtgcaagtgatcagcatggaaccggaatcctgcagccccaagaacaacatgatcgtgggagtgcccatttag

SEQ ID NO: 17522 - DNA, 597 bp, Artificial Sequence
  Description of Artificial Sequence: Synthetic coding sequence
atggcaaccggcgatctcaagcggtccctacggaacttggaacaagtcttgagactgcttaactaccccgaagaagtggactgtgtggggctgatcaaaggggatcccgccgcgagcttgccgataatttcctattcgtttacctcttatagcccctatgtgacagaactgattatggagtctaatgtggagctgatcgctaagaacgacctgcggtttatagacgcagtttacaagctgctgcgtgatcaattcaattacaagcccattctgacaaagaagcagttcattcagtgtggatttgcagagtggaagatccaaattgtgtgtgatattctgaattgtgtgatgaagaaacataaggagctctccagccttcagaagattccctcccagcaacgtaaaaaaatctccagcgggaagtccgaaccccccctggggaacgagaaaatctccgcagaggccgtgggggtggacatttccgggaggttcatgaccagcggaaagaaaaaagccgtcgtaattcgtcatctgtataatgaagacaatgtggacataagtgaagacactctgtctccaatcactgacgtgaattag

SEQ ID NO: 17523 - DNA, 336 bp, Artificial Sequence
  Description of Artificial Sequence: Synthetic coding sequence
atggtgatggaaaagcccagccctctgctcgttggtagggagttcgtacgccaatactataccctactgaataaggccccagagtatctgcataggttttatggtcgcaatagttcatacgtgcatggtggcgtggacgctagtggaaagcctcaggaggcagtctatggccaaaatgacatccatcacaaagtcttgtcactcaatttcagtgaatgtcatacgaagatcagacacgtggacgcccacgccacactgagtgatggcgtggtagtccaggtaatggggctgctgtccaattctggccagcctgaacgcaagttcatgcagacttag

SEQ ID NO: 17524 - DNA, 681 bp, Artificial Sequence
  Description of Artificial Sequence: Synthetic coding sequence
atgagttctccaagggacttccgcgccgaaccagtgaatgattacgagggaaacgacagcgaggccgaggatcttaattttagggaaactcttccaagcagttctcaagagaacactccaagatccaaagtcttcgaaaacaaggtgaactccgaaaaggttaagctttccctgaggaactttccacataacgactatgaggacgtgttcgaagaacctagcgagtctggcagcgatcctagtatgtggacagcaagggggcctttccggagagatcgatggtcaagcgaagacgaggaggcagcgggcccaagtcaggcattatccccactattgtcagacacacgcaagatcgtgagcgagggtgagctggaccagcttgcccagatcagaccattaatcttcaacttccacgaacagaccgccatcaaggactgtttgaaaatactggaggagaaaacagctgcttacgacatcatgcaggaatttatggctctcgaattaaagaatctacccggcgaatttaattctggaaatcagcccagcaacagagagaaaaataggtatcgggatatcctgcccttccagcatcacggctactctgggccaaatgagcgtactaccttctggcacggcagcaacgaaggcgcggtgtcactcctgcttaggtactgcgcctag

SEQ ID NO: 17525 - DNA, 1872 bp, Artificial Sequence
  Description of Artificial Sequence: Synthetic coding sequence
atgagcgatgaagtgttttccaccactctagcatataccaaatctccaaaagtgacgaaacgaacaacatttcaggacgagttgatcagggcaatcacggctaggtcagcgagacagcgaagctctgaatactcagatgatttcgatagtgacgaaatcgtaagcctaggcgactttagcgataccagcgccgacgaaaattctgtcaataagaagatgaatgattttcatatcagcgacgatgaagagaagaacccctccaaactcttattcctgaagacaaacaagtccaatggtaacatcactaaggacgaacccgtttgcgccataaaaaatgaggaagaaatggcacctgacgggtgcgaagatattgtggtaaagagtttcagtgagagtcaaaacaaggacgaagagtttgaaaaggacaaaataaaaatgaaaccaaagccacgcatcttatccatcaagtccacatcaagtgcggagaacaacagtctcgatacagacgatcatttcaaaccttccccgagacccagaagtatgctgaagaagaaatctcacatggaagaaaaggacgggcttgaggataaggagaccgccctgagcgaagaactcgaactgcacagcgcaccaagcagtctgcccactccaaatgggatccagcttgaggccgaaaagaaggcctttagcgaaaatctagatccagaagacagctgcttaacgtccctggccagctcgagcctaaaacaaattctgggcgacagtttctcccccggttctgaaggaaacgcatcgggcaaagcagatcatgtcacaactgctgtcgagaaaagcaaagaatcccaggtgacggctgacgacctagaagaagagaaagcaaaggctgaattgattatggacgatgacaggaccgtagacccccttctgagtaagtctcagagcattctgatctccactagcgccactgcgagttctaagaagacaatcgaagatcgcaacattaagaacaagaagagcacaaataatcgggcttcctcagccagtgccagactcatgacatctgaatttctgaaaaaatcatcatccaagcgacgcactccttcaactactacctcctcccactatctgggcactctaaaagtgctcgaccaaaaaccctcccagaaacaaagcattgaacccgatagagcagataacattcgtgccgccgtctatcaggaatggctcgaaaagaaaaatgtgtacctgcacgagatgcatcgtatcaagagaatagaatccgaaaacctgcgtatccagaatgaacagaaaaaagccgccaagcgagaagaagccctggcgagtttcgaggcatggaaggcgatgaaggagaaggaagccaagaaaattgccgcaaaaaaaagattggaggagaaaaacaagaagaagactgaagaggagaatgctgcacgaaaaggggaggcattgcaagccttcgagaagtggaaggagaaaaagatggagtacctcaaagaaaaaaacaggaaggaacgagagtacgagcgggctaagaagcagaaggaagaagagactgtcgctgagaaaaagaaagacaacctcacagcagtggagaaatggaacgagaaaaaagaggcattcttcaagcagaaggaaaaagaaaagataaacgagaagcggaaggaggagctgaaacgcgcagagaaaaaagataaagacaagcaggctattaatgaatatgagaagtggctggaaaacaaagaaaagcaggaaagaatcgagagaaagcagaagaagcggcactcatttctcgaaagcgaggcattacctccttggagcccaccttcccgcaccgtatttgctaaagtgttttag

SEQ ID NO: 17526 - DNA, 255 bp, Artificial Sequence
  Description of Artificial Sequence: Synthetic coding sequence
atgatgttggggactgagggaggggaagggtttgttgtaaaggtcaggggcctgccttggagctgcagcgcagacgaagtgcagaggttcttttctgattgcaagatacagaatggagcccaaggaatcagatttatttacacaagagagggacggccaagcggggaagcttttgttgaactggaaagcgaagatgaagtgaaacttgccctgaagaaagatagagaaacaatggggcaccgatatgtggaatag

SEQ ID NO: 17527 - DNA, 993 bp, Artificial Sequence
  Description of Artificial Sequence: Synthetic coding sequence
atggatcagggagacactccaactctggaggaggatctgaagaaattgcagttgagcgaattcttcgacatttttgagaaggagaaggtagacaaagaggcactagcactctgcacggacagagaccttcaggagattggaatacccttgggacccaggaaaaagattctgaattacttttccacccgcaagaactcaatgggcataaagcgccccgccccgcaaccggcctccggcgcaaatatacctaaggagtcagagttttgtagctcttccaacacacgtaacggagactatctcgacgtgggcatcggtcaagtcagcgttaagtacccccggctgatttacaagcccgagattttttttgcattcggaagcccgatcggcatgttcttgacagttcgggggctgaaacgaatcgacccaaattaccggttcccaacatgtaagggattttttaatatataccatcccttcgatcccgtcgcgtacaggatcgagccaatggttgtgcccggagtggagtttgagcccatgcttatcccacaccacaagggaagaaaaagaatgcacctggaactcagggaagggctaaccaggatgtccatggacctgaagaacaatctcctcggttctctccgcatggcctggaagtctttcaccagagctccatacccagccctccaagcatcagagactcctgaggagacagaggccgagccagagtcaacgtccgagaaacctagcgatgttaacacggaggaaacctctgtcgccgtgaaggaagaagtgttgccaatcaacgtcggaatgcttaacgggggacagagaattgactacgtgttgcaagaaaagccaatcgagagcttcaacgaatatctgtttgccctccagtcacacttatgttattgggagtcagaggataccgtcctattggttctaaaggagatctatcagacacaaggtatcttcctggaccagccccttcagtag

SEQ ID NO: 17528 - DNA, 1383 bp, Artificial Sequence
  Description of Artificial Sequence: Synthetic coding sequence
atggacagtgaactcatgcactctatcgtgggcagctatcacaagccccccgagcgggtttttgtaccttccttcacacagaatgaaccctctcagaactgtcaccctgctaacctggaagtgacatctcctaaaatcctccactcccccaattctcaggcactgatactggcgctgaagacactccaggaaaagatacacagactcgaactcgaacgcactcaagccgaagacaatttgaatatcctgagcagggaggctgcccagtacaagaaagcactggagaacgagactaacgagagaaacttggctcatcaggaactgatcaaacaaaaaaaggacatctctatccaactttcttctgctcaaagccgctgtactcttcttgaaaagcagctggagtacaccaagcgcatggtgttgaatgtggaaagggagaaaaacatgatcctggaacagcaggcacagctacaaagagagaaagaacaggaccagatgaagctgtacgctaagttagaaaagcttgatgtcttggaaaaggagtgctttcggctcaccaccacccaaaaaaccgcggaagataaaatcaagcacctggaggaaaaactgaaagaggaagaacatcagcgaaagcttttccaggacaaggcatctgaactgcaaacgggattggaaattagcaagatcataatgtcctcggtgagtaacctgaagcacagcaaagaaaagaaaaaaagctccaagaagacaaaatgcatcaaaaggcgccccccatggcagatctgctcaaagttcggtgccctgccatttgtggccgagaagatgagacagcacagggacccacatatcctgcagaagcctttcaacgttaccgagactaggtgcttgcccaaaccctctaggaccacatcttggtgcaaggctattccccccgattccgaaaagagtatctcgatttgcgacaatctttctgagctgcttatggcgatgcaggacgagcttgaccagatgtcaatggaacaccaggagcttctcaaacagatgaaggagactgaaagtcattccgtgtgcgacgatatagaatgtgagctcgagtgtcttctgaagaagatggagatcaaaggagagcagatcagcaaactgaagaaacatcaagacagtgtctgtaaactgcagcagaaggtccagaattctaagatgtccgaagctagcggcatccagcaggaagacagttatcccaaagggtccaagaacatcaagaacagccctagaaagtgcctgactgacacaaacttgttccagaaaaactccagcttccatcccatacgcgttcacaacttgcagatgaagcttcgccgggacgacatcatgtgggagcagtag

SEQ ID NO: 17529 - DNA, 1068 bp, Artificial Sequence
  Description of Artificial Sequence: Synthetic coding sequence
atgaccggctcagcagccgacacacatcgttgcccccaccctaagggcgcgaagggcacacggtcacgctcttcgcatgctagaccagtgagcctggcaacctccgggggctcagaggaggaggataaagacggaggtgtgctgttccatgttaacaaaagcgggttcccaatcgacagccacacatgggagagaatgtggatgcatgtggccaaggtgcaccccaaaggcggcgagatggtcggagctatcaggaatgccgccttcctggccaagccctccattccccaggtacctaattacaggctctccatgaccattcccgattggctccaagccatccagaactatatgaagactctacaatacaatcacactggcacccagttttttgagattagaaagatgaggccactatctgggctcatggaaactgccaaggaaatgacgagggagagcctccccattaaatgcttagaggcggtaattctcggtatctatttaactaatggtcagccctcaatcgaacgtttccccatttcctttaagacgtacttctccgggaactatttccaccacgtcgtgctcggaatatactgtaatgggcggtatgggagtctcggcatgtcacgccgcgctgagctcatggataagcctcttacctttcgaaccctcagcgacctgatttttgatttcgaagactcctacaaaaagtacctccacaccgtcaagaaggtgaaaatcggactgtacgttccacacgagcctcactcgttccaacccatcgaatggaaacaactagttctgaatgtgtcgaagatgttgagagcggatattcgtaaagaattggagaaatatgctcgtgacatgaggatgaagattctgaagcccgcttccgcacacagccctacccaggtgcggtctcgcggcaaatcccttagccccaggcggagacaggcctcaccacccaggcggctgggccgacgggagaagtctccagctctgccggagaaaaaggttgccgacttgtctacactgaatgaggtgggctaccagatccgcatctag

SEQ ID NO: 17530 - DNA, 384 bp, Artificial Sequence
  Description of Artificial Sequence: Synthetic coding sequence
atggcctctaatcataaaagttccgcggcacgaccagtctcacgcgggggggtggggctcacaggacggcctccatctgggattcggcccctatccggcaacatcagggtggccacagctatgccacctgggactgctcggcctggctcacgtggctgcccaatcggaacgggaggggtgttgtcctcccagataaaagtcgcccacaggccagttactcaacagggattgactggaatgaagaccggcactaagggcccgcagaggcaaattctggacaagtcctactacctagggctactgcgttccaaaattagcgagctgaccactgaagtgaataagcttcagaaaggcattgagatgtacaaccaagagaattcttag

SEQ ID NO: 17531 - DNA, 510 bp, Artificial Sequence
  Description of Artificial Sequence: Synthetic coding sequence
atgcacaagcttcagagcgggatcgggcgccttatcctaaaggaggagatgaaggctagatcaagctcgtacgccgacccatggaccccccccaggtccagtacctcttcgcgcgaggctcttcatactgctggctatgagatgtctctgaatggtagtccaaggagtcattacctcgccgattctgaccccctgatctctaagtcggctagtcttccagcctaccgaaggaatggcctccacaggacccctagcgcggatctatttcactacgactctatgaatgccgttaactgggggatgagagagtacaagatttacccttacgagctgcttctcgtcaccactagagggcgtaatcgactccccaaagacgtcgatcggactcgcctcgagagacatctgagccaggaagaattctatcaagtctttggcatgactattagcgagtttgaccgtctcgcactctggaaaaggaacgaattaaagaagcaggccagacttttctag

SEQ ID NO: 17532 - DNA, 144 bp, Artificial Sequence
  Description of Artificial Sequence: Synthetic coding sequence
atggcatccgtcttatcacgcagattaggcaagaggagcctgctcggcgcccgcgtgctgggccctagcgctagtgaaggaccttccgccgcacccccaagcgaacctctgttagaaggagcagctcctcagccattcacttag

SEQ ID NO: 17533 - DNA, 558 bp, Artificial Sequence
  Description of Artificial Sequence: Synthetic coding sequence
atggacgacagtataaataataggtttagttacgtaacgcacgaagacatttgcaactgtttcaacggcgacaccctgctggccatccaggctccttccggcacccaactggaggtgcccatacccgaaatgggacagaatgggcaaaagaaataccagattaaccttaaatcacactccggcccgattcacgtgctcctaattaacaaggaaagctcaagtagtaaacccgtcgtgttccccgtgccaccccctgatgatctgacccagccttcgtcacagtcgcttaccccagtgacaccccagaagagctccatggcaactcaaaatcttcccgagcagcatgtgagcgagcgctctcaggcactgcaacagactagtgcgaccgacataagtagcgcaggttctatcagcggggatattattgatgaactgatgtcgagcgacgtttttcctcttttgcgtttaagcccaacaccagctgatgattacaacttcaatctggacgataacgaaggcgtttgcgatctttttgacgttcagattctcaattactag

SEQ ID NO: 17534 - DNA, 492 bp, Artificial Sequence
  Description of Artificial Sequence: Synthetic coding sequence
atgcccagtatcaagctccagagctcagatggcgaaatctttgaagttgacgttgagatcgctaaacagtcagtgactattaaaacaatgctggaggacctcggcatggacgacgaaggcgacgatgatccggtccccctgcctaatgtcaatgcagcaatcctgaagaaagtgatacagtggtgtactcatcataaggatgacccgcctccccctgaggatgatgaaaacaaagaaaaacggacagacgacattccagtctgggaccaggagttcctgaaggtagaccagggcacgcttttcgaactcatcctcgctgccaattatcttgatatcaagggtctgctggacgtgacatgtaagacagtcgccaatatgattaaaggtaagacgcctgaagagataagaaagacctttaatatcaaaaacgattttaccgaagaagaggaagcccaagtaagaaaggaaaaccaatggtgcgaagaaaaatag

SEQ ID NO: 17535 - DNA, 915 bp, Artificial Sequence
  Description of Artificial Sequence: Synthetic coding sequence
atgtccaagagaaggaggctgaaacaaggagaaccaattatgacgggcaagactcagacaagcaacgttaccaacaagaatgatcccaaatccattaattccagagtgttcatcggcaatctgaacaccgcaatagtgaagaaagtggacatcgaggcgatcttcagcaagtatgggaagatcgtaggttgctcagtccataaaggctatgccttcgtccagtacatgagtgagcgccacgctcgggctgcagttgccggggagaacgctagggtcatagccggccagcccctggacatcaatatggctggagaacccaaaccctatcggcccaaacccggcaacaagaggcctctatctgcattgtataggctggaatctaaggagccctttttgtcagtgggaggctacgtgttcgattatgattattatcgggatgatttctataataggttgttcgactatcatggccgagtgccacctcccccaagggccgtaatccctctgaaacgccctcgtgtcgcagtgactacaactcgccggggaaaaggggtcttcagtatgaaaggtggttctcggtcaacggcatctgggtcaaccggcagtaagctgaagagtgacgagctgcagaccatcaagaaagaactgacccagattaaaaccaaaatagactccttgctcggcagactggagaagatcgagaaacaacaaaaagcggaagctgaggctcaaaagaagcaattagaggagagtttggtgctgatacaggaagagtgcgtgagtgaaattgctgatcactccacggaagagccagctgaaggaggacctgatgccgacggagaagagatgaccgatggaattgaggaagacttcgacgaggatggcgggcatgagcttttcttacaaataaagtag

SEQ ID NO: 17536 - DNA, 405 bp, Artificial Sequence
  Description of Artificial Sequence: Synthetic coding sequence
atgccatctgctgaggcaaagctgaagaaaaatagatgcgctaactgctttgactgccccgggtgtatgcatacattatctacacgggcaacaagtattagtactcagctgccagacgaccccgcaaagaccaccatgaagaaggcatactacctcgcatgcggcttttgccggtggaccagtcgcgatgtcggaatggcagataagagtgtggctagcggaggctggcaggagcccgaaaacccccacacgcagaggatgaacaagctgatcgaatattaccagcaactggcacaaaaagaaaaagttgaacgggatcgcaagaaattggcaagacggcgaaactacatgcccttggcattcagcgataaatacggcctggggactcgcctacagagaccctag

SEQ ID NO: 17537 - DNA, 1230 bp, Artificial Sequence
  Description of Artificial Sequence: Synthetic coding sequence
atgtggcgcgtcatcgagcccccctgccccggcgcccctagtaccgagaacggtaagagtgtccattggaaactaggggcggataaggaagtgtgggtgtgggtcatgggcgaacatcacctcgacaagccgtacgatgtgctatgcaacgagatcattgcagagcgcgctagactgaaggccgagcaggaggccgaggagccaaggaagacccattcggaggagttcacaaacagcctaaagactaaatcccagtaccacgacctgcaagctccggacaaccagcaaaccaaggatatctggaaaaaggtggctgagaaggaggaactggagcagggctcacgccccgcccctacccttgaagaagagaagattagaagcctgtcaagttcgtcaagaaacatacagcagatgctggctgactcaataaataggatgaaggcgtacgcctttcaccaaaaaaaagaaagtatgaagaagaaacaggacgaggaaataaaccaaatcgaagaagaacggacaaaacaaatctgtaaatcgtggaaggaggactctgagtggcaggcgtccctgagaaagagcaaagctgccgatgagaagaggcgctcccttgcaaagcaggcccgggaagattacaaaagacttagtctgggagcgcaaaaggggagggggggagaacggcttcagagtcccctgagagtcccacagaaaccagagcgcccccctctgccccccaaaccgcagtttttaaactccggagcatatcctcagaagcccttgcgtaaccaaggagtagttcgaacactgtcttcaagcgcacaggaggatataatcagatggtttaaggaggagcagctcccactgagggccggttaccagaagactagcgacactatcgccccgtggttccacgggattctgactcttaaaaaagcgaacgaactcttgttgtcaaccgggatgcctggttcctttctgatccgtgtgtccgagcgaatcaagggttacgccctgagttatctctccgaagacgggtgtaaacacttcctgattgatgccagcgccgacgcttatagtttcctcggcgtagatcagctacagcatgcaactctcgccgatctggtggaataccacaaagaggagccaattactagcctcggtaaagagctgcttctctacccatgtggtcagcaggatcagctgcccgattacctcgagctctttgagtag

SEQ ID NO: 17538 - DNA, 390 bp, Artificial Sequence
  Description of Artificial Sequence: Synthetic coding sequence
atgtccgacaaaagtgatctaaaagccgagctggagaggaaaaaacagagactcgctcagatcagagaggagaagaagaggaaagaggaggagaggaaaaaaaaagaggcagatatgcagcagaaaaaggaacctgtgcaggacgacagcgatttagaccgcaagaggcgcgagaccgaagcacttctgcagagcatcggcataagcccagagcctcccctcgtccctacccctatgtccccttcgtctaagtccgtcagtaccccgtccgaagccggaagccaggactccggcgatctgggaccccttactcggactctgcagtgggacacggatccatcggtgctgcagctccaatccgattccgagctcggatacatgagtgcttag

SEQ ID NO: 17539 - DNA, 780 bp, Artificial Sequence
  Description of Artificial Sequence: Synthetic coding sequence
atggttggcagggaaaaggagttgtccatccacttcgttcctgggtcctgcaggctcgttgaagaagaagtgaatattcctaaccgtcgggtcctggtcacgggtgccactggactactgggcagggccgtgcataaggaattccagcagaacaactggcacgcagtgggctgtggctttcggcgcgccaggcctaaatttgaacaggtgaatttactggatagcaatgccgtgcaccatattatccatgacttccagccacatgttatcgttcattgtgcagctgagcgacggcccgacgtggtcgaaaatcaacccgatgctgcatctcagttaaacgtggacgctagcgggaatctcgccaaggaggccgcagctgtgggagcgttcctgatttacatcagctcggactatgtcttcgatggcactaacccgccctacagggaggaagatattcccgcccccctgaatttgtacggaaagacaaaactggacggggaaaaagccgtcctggaaaataaccttggggcggctgtcctgcgcatccccattctatatggtgaggttgaaaagctcgaggaaagcgccgtgacagtgatgtttgataaggtccagttttctaacaaaagtgctaatatggaccattggcagcagaggttcccaactcacgttaaagacgtggctacagtttgtcgccagctggcagaaaagcggatgcttgtcagaaggatcccggagtcctgtctgtccgaagggcccctctgcctatttcatgcctag

SEQ ID NO: 17540 - DNA, 549 bp, Artificial Sequence
  Description of Artificial Sequence: Synthetic coding sequence
agctatgactcaactttttcctatgtcactcatgaagacatctgtaactgcttcaatggcgatactcttctggccattcaggcaccgtctggtacccaactggaggtgcccatccctgagatgggccagaacggtcagaagaagtaccagattaatctcaagtctcactccgggcccatccacgtattgttgatcaataaggagagttcgtctagtaaaccagtagtcttcccagttcccccgcccgatgaccttacacagccctccagtcaatccctgacccctgtgactcctcaaaaatccagtatggccacccaaaacctccctgaacaacacgtgtctgagagaagccaggccctacagcaaacaagcgctaccgatataagtagcgccgggtccatctctggcgatattattgatgaactgatgtcttccgatgtctttccactgctcagactcagcccaacacctgccgatgactacaacttcaacctggatgacaacgagggtgtgtgtgacctctttgacgtccagatcctgaattattag

SEQ ID NO: 17541 - DNA, 162 bp, Artificial Sequence
  Description of Artificial Sequence: Synthetic coding sequence
atggacagcgaactgatgcactcaatagttggctcctaccacaaaccgcccgagagagtattcgtgccaagctttacacagaacgagccttctcagaactgccaccctgctaacctggaggtaacctctccaaagatcctgcacagcccaaattcacaatag

SEQ ID NO: 17542 - DNA, 3018 bp, Artificial Sequence
  Description of Artificial Sequence: Synthetic coding sequence
atggctggcgccctgagaaggggcagggcactagggtctagaccctccggtcccactgtttcctccagacggtcaccccagtgtccggtcgcccaggagggcctcggagctcgaagccgtcctcgggtggctcctaggtctttggcccggtgtggcccgagctcccgcctcatgggatggaagccctctgaggccaggggccagtctcagtccttccaggcatcagggttgcagccacggtctcttaaagccgcaagacgggctactggtcggccagatcggtcaagagctgctcggcctactatggacccctcggcacatcggagtagagcagcacctccaaatatggaccccgatcctcaggcaggggtccaggttgggatgcgcgtcgtcaggggagttgattggaaatggggacagcaagacggaggggagggaggtgtggggaccgtcgttgaacttggcaggcacggcagcccttcaacacccgaccgcaccgtggtggttcaatgggaccagggaacgcggaccaactacagggcaggttaccagggcgcccacgatctgctgctgtatgacaatgcacagatcggtgtgaggcaccccaacattatttgcgattgctgcaaaaaacatgggttgcgcgggatgcgttggaagtgtcgtgtttgtcttgactatgacctttgcacccaatgttatatgcacaataagcacgagctggctcacgcctttgatcgctatgagacagcccattcacggcccgtaaccctgtcaccccgacaggggctgccccgaatccctctgcggggcatttttcagggcgcaaaagttgtccgcgggccagattgggagtggggatctcaggatggcaagccagcggagctgcagaggagggtgtcagcagacagccagcctttccagcatggggacaaggtcaagtgcttgcttgacacggatgtgctccgcgaaatgcaagagggacacggaggttggaacccgcgcatggccgagtttatcggccagaccggaacagttcataggattactgaccggggtgatgttagggtccagttcaaccatgaaactagatggactttccaccctggcgccctcacaaagcatcactccttttgggtgggggatgtcgtgcgggtgatcggcgacctggacaccgtgaaacgcctgcaggctgggcacggtgaatggactgatgatatggcccccgctttagggcgagtggggaaggtcgtgaaggtgtttggagatggaaatctgcgtgttgctgtcgctgggcagcgttggactttctctccatcttgtctggtggcttaccgcccagaagaggacgccaacctagacgtggctgaacgcgccagggaaaacaagtctagcctgagtgtggccttggataaactccgtgcgcagaagtccgatcccgaacacccaggtcgcttggtggtggaggttgcattgggcaatgccgccagagccttagacctcttgcggcgacggcccgagcaggtggacaccaagaatcaggggagaactgcgctgcaggtagcagcttacctaggccaggttgagctaatcagacttttgcttcaggccagggccggggtggatttaccagacgatgagggcaatactgccctccactatgctgcactagggaaccaacctgaagccacacgagtgttgctatcagccggctgccgggccgacgccatcaactccacccagtctactgctttgcacgtcgccgttcagaggggattcttggaggtcgtgcgggcgctgtgcgagcgcggctgtgacgtgaatttgcccgacgcccattcagacactccccttcactctgcgataagcgctggcacgggcgcgagtggcatcgtagaagtcctgacggaagtgccaaatattgacgtgaccgcaactaacagccaaggattcacattactgcatcacgccagcctgaaaggtcacgctttggcagtacgcaaaatattggcccgggccaggcagcttgttgacgcgaaaaaagaggacggatttacagctttacatctggccgctttaaacaaccaccgtgaggtcgcccagatcctcattagagagggccggtgtgatgtaaatgtccggaaccggaagctccagagccctttgcatttggccgtccagcaggcccatgttggcctggtgcctttattagtggatgccggatgtagtgtgaatgctgaggacgaagaaggagacactgccctccatgtggccctccagcgtcaccaacttctcccgcttgtggccgacggcgcagggggcgaccctggacctctccagcttctgtcccgcctgcaggccagtggactgccagggtccgctgagctcacagtgggtgccgcagtcgcttgcttcttagccctcgagggcgctgatgtgagttacactaaccatcgagggcggtctcctctcgacttagctgccgaagggcgggtattgaaggctttgcagggctgtgcccagaggttccgagagcgccaggcaggaggaggagccgcaccagggcctcgccagacgctcggaacgccaaataccgtcactaatctccacgttggcgcagcgcctggccctgaggctgccgagtgcctcgtgtgtagtgagctggcactgttggttctgttctctccatgccaacatcggacggtgtgtgaggagtgtgccagacggatgaaaaagtgtatccgttgccaggttgtcgtttcaaaaaaactcaggcctgacgggtcagaggtagcttctgcggcacccgcccctgggccacctagacagctggtggaggagttgcaatccagatatagacagatggaagaaagaataacatgcccaatctgtatcgattcacatattcgcctggtgttccagtgcggccacggtgcatgtgccccgtgcggttctgcactcagtgcatgccccatctgtcgacaacctattagagatagaatacagatatttgtgtag

SEQ ID NO: 17543 - DNA, 294 bp, Artificial Sequence
  Description of Artificial Sequence: Synthetic coding sequence
atggcctcaagcgcagagcttgatttcaatttacaggcactgctggagcaactgtctcaggatgagctgtcaaaattcaagagcctcatccgaactatctcccttggcaaagaacttcagacagtccctcagactgaggtggataaagccaacggcaaacagctcgtcgaaattttcacatcccactcatgctcatactgggccggcatggcagccatccaggtgttcgaaaagatgaatcaaactcacctatctggccgcgctgatgaacactgtgtgatgccgccaccatag

SEQ ID NO: 17544 - DNA, 693 bp, Artificial Sequence
  Description of Artificial Sequence: Synthetic coding sequence
atggattctgagctcatgcatagcatagtcgggagctaccacaaaccacccgaacgggtgttcgtgccttctttcacacagaacgaaccgtcccagaactgccatcccgctaatctagaagtgacaagtcccaaaatcctgcactctcctaattctcaggctctgattctcgcactgaagacccttcaggaaaagatccacaggttggagctggagagaacacaggctgaagataacctgaacattttatctagagaagccgctcagtataaaaaggcgctcgagaacgaaaccaacgaacgaaacctcgctcaccaggaactcataaagcagaagaaggatatttcaatccagctgtcatcggcgcaaagtagatgcacgctgttggagaaacaactggagtacactaaaagaatggtgctcaatgtggaacgggagaagaatatgattttagaacagcaggctcagcttcagcgcgaaaaggagcaggaccagatgaaactctacgccaaactcgaaaaactggacgtactagagaaagagtgctttaggctcacaacaacgcagaaaactgccgaggacaagatcaagcatctcgaggagaaactgaaagaagaagagcaccaaagaaagctttttcaagataaggcttcagaacttcagactggcctcgagatttccaagatcatctag

SEQ ID NO: 17545 - DNA, 624 bp, Artificial Sequence
  Description of Artificial Sequence: Synthetic coding sequence
atggatcgaggggagcagggtctgcttcgaaccgacccggtacccgaggaaggggaagatgttgcagcgacaatctccgccactgagaccctttctgaagaagagcaggaagagctgcgaagagagctcgcgaaggtggaggaagaaatacaaacattgtcacaggttctggccgccaaggagaagcacctagccgaaatcaagcgtaagttgggaatcaactctcttcaggagctgaaacagaatatagccaaaggctggcaggacgtgaccgctacttctgcctacaagaagacatctgagaccctttcacaggcggggcagaaggcatccgctgccttcagctccgtgggttctgtcattacaaagaagctcgaagatgtgaagttgcaggctttcagccactcattctctatcagaagcattcagcacagcatctcaatgccagccatgcgtaatagccccacctttaagtcattcgaggagaaagtcgagaatcttaagagcaaagtcggcggaacgaaacccgcgggcggcgacttcggcgaagtactgaattcagccgcaaacgccagcgcaaccacaaccgagccccttccagagaaaacccaagaatccctctag

SEQ ID NO: 17546 - DNA, 387 bp, Artificial Sequence
  Description of Artificial Sequence: Synthetic coding sequence
atgaaatttaatccatttgtcacaagcgatcgctccaagaatcggaaaagacactttaacgcccctagtcacgtccgccggaaaatcatgagcagtccactgtctaaggaactgagacagaagtataatgttagatccatgcccatccgcaaggatgatgaagtgcaggtcgtgcggggacactataagggacagcagattggtaaagttgtccaagtatatcggaagaagtacgtgatctacatcgagcgtgtgcagcgggagaaagccaacgggactactgtgcatgtgggcatccatcccagtaaggttgtgatcacacggctgaaattggataaagaccgaaagaagattctggaacgtaaggccaaaagccgacaggtgtag

SEQ ID NO: 17547 - DNA, 126 bp, Artificial Sequence
  Description of Artificial Sequence: Synthetic coding sequence
  Description of Combined DNA/RNA Molecule: Synthetic coding sequence
ggcttgacaaagcagctcctcgatgacacaattggcattcaccctacctgcggagaagtgtttactaccctggagataaccaagagctcgggactggacatcacccagaagggctgcugagggtag

SEQ ID NO: 17548 - DNA, 1365 bp, Artificial Sequence
  Description of Artificial Sequence: Synthetic coding sequence
atgctgaagcaaatcctgtcagaaatgtacatagatcctgatctgttggcagagctgagcgaagagcagaagcagatcctgtttttcaagatgcgtgaggagcagatccggagatggaaagaaagagaggccgctatggaaagaaaggagtccttacccgtaaagccaagacctaaaaaggagaacgggaagtctgtgcattggaaactcggggccgacaaagaagtgtgggtgtgggtgatgggggagcaccacctggacaagccatacgatgtcctttgcaacgagattatcgccgagcgcgccaggctgaaagcagaacaggaagcagaggaaccacgtaagacacattccgaagagttcacaaattctcttaaaacgaagtcccagtaccatgatttacaagcaccggacaatcagcagacgaaagacatctggaagaaagtggctgaaaaggaggaacttgagcaggggtcccggcctgcgcccaccttggaggaagagaagatacgaagcttaagtagtagttctcgcaacatccaacagatgttggctgattctatcaacaggatgaaagcatacgcatttcaccagaagaaggagagcatgaaaaagaagcaagacgaggaaatcaatcagattgaagaagagcggaccaagcagatatgcaaatcgtggaaggaagatagcgaatggcaggccagtttacggaagagtaaagccgctgatgaaaaacggaggtccctagctaaacaagcgcgtgaagattataaacggctgtccctcggtgctcagaagggtcgaggtggagaaagacttcaaagccccttgcgagtgcctcaaaagcctgagcgacctccactgccccctaagccccaattcctgaatagcggtgcttacccacagaaacccctgaggaaccagggggtggttagaacactgtccagcagcgctcaggaggacattatcagatggttcaaggaggagcaacttccactgcgggccggataccaaaagacgagcgacacgatcgccccctggtttcacggcatcttaaccctgaaaaaggctaatgagttgctgctctccactggaatgcccggcagtttcctgatacgggtctcagaacgcataaaaggatatgctctctcatatttgtcagaggacgggtgcaaacactttctgattgacgcatctgcagacgcctacagcttcttgggggtagatcagttacaacatgcaacactagctgatttggtcgaatatcataaggaggagcccataacctcccttggcaaggagctgcttctttacccttgcgggcagcaggatcagcttcctgattatttggagctattcgagtag

SEQ ID NO: 17549 - DNA, 438 bp, Artificial Sequence
  Description of Artificial Sequence: Synthetic coding sequence
atgaagtttaacccctttgtgacgagcgataggtctaagaaccgtaagaggcactttaacgccccaagccatgtgcggagaaaaattatgtctagtcccttatctaaggagctccgccagaagtacaacgtgaggagtatgcctattcggaaggacgatgaagtgcaagtggtgaggggccattacaaagggcagcaaataggaaaggtagtacaggtgtacaggaaaaaatacgtaatttacattgagcgggtgcaaagggagaaagctaatggcacaaccgttcacgttggcattcatccgagtaaagtcgtcatcacgagactgaaattggataaagatagaaagaaaatccttgagcgcaaagccaagagcagacaggttggaaaggagaaaggcaaatataaggaagaactgatagagaagatgcaggaatag

SEQ ID NO: 17550 - DNA, 621 bp, Artificial Sequence
  Description of Artificial Sequence: Synthetic coding sequence
atggactcagagttaatgcattcaatcgtcggttcataccataagccgccagagagggtctttgttcctagcttcacacagaacgaaccatcccagaattgccacccagctaatcttgaagtgacctccccaaaaatccttcactcccccaattcacaggctctcattcttgctctgaagactctacaagaaaaaatccaccgtttggaattggaacgaacccaggccgaggataatctgaatatcctgtctagagaggctgcacagtataaaaaagcgcttgagaatgagacaaacgaaaggaatttggcacaccaagaacttattaaacaaaagaaggatatttctatccagttatctagcgcccaatccagatgcacattgttggaaaagcagctggaatacaccaagagaatggtgctgaatgtcgagagagagaagaatatgatcttagaacagcaagctcagctgcagcgagaaaaagaacaggaccagatgaaactgtatgcaaaactggaaaagctggacgtactggaaaaagagtgctttaggttgacgactacacagaaaacagctgaggataagataaaacacttggaggaaaagctgaaagaggaatag

SEQ ID NO: 17551 - DNA, 1050 bp, Artificial Sequence
  Description of Artificial Sequence: Synthetic coding sequence
atggaagaccctcagagcaaagagcccgcaggtgaggccgtagcacttgcccttctcgaatcccctaggccggagggcggcgaggagccccctcggcctagccccgaggagacccagcagtgtaagtttgatggacaggagactaagggttcaaaattcatcacctcgagtgcctccgatttcagcgatccggtgtacaaagaaatcgccataactaacggctgcattaatcggatgagcaaggaggagctgcgggccaagctcagtgaatttaagctggaaacaaggggggtgaaggatgtcctgaaaaaaagactgaaaaactactacaagaagcagaaactgatgctgaaggaatcaaatttcgctgacagctactacgattacatatgtatcattgatttcgaagcaacctgtgaagaagggaatcctccagagttcgttcacgagattattgagtttccggttgtgttgctgaacacccacacacttgagattgaagatactttccagcagtatgtacgcccagaaatcaacacacagctttccgacttttgcatcagcctgacaggaattacccaagatcaggtagatcgcgctgatacatttccccaggtcctgaaaaaagtgatcgattggatgaagctaaaggagctgggcactaagtacaagtattcactgctgacagacggttcttgggacatgtctaaatttctcaacatccagtgtcagttgtctcgcctgaagtatccaccattcgccaagaagtggataaacataaggaaatcttatggaaatttttataaagtcccacgctctcagaccaaactcaccatcatgctggaaaagttgggcatggactatgatggaagaccccattgcggcctcgatgattcaaagaacatcgctcggatagccgtaaggatgctccaggacggctgcgagttgagaataaacgaaaagatgcacgcaggacagcttatgtctgttagctcatctttacccatcgagggtactccaccaccccagatgcctcactttcgcaagtag

SEQ ID NO: 17552 - DNA, 429 bp, Artificial Sequence
  Description of Artificial Sequence: Synthetic coding sequence
atgccctctattaagctgcagagctctgacggagagatcttcgaggtagatgttgagattgcaaaacaatctgtgactatcaaaacaatgctcgaagatctcggtatggacgatgagggtgacgacgaccccgtccctttgcctaacgtgaacgccgccattcttaaaaaagtgattcagtggtgtactcaccataaagatgacccacccccgcccgaggatgacgaaaataaagaaaagcggaccgatgacatacccgtgtgggaccaggaattcctgaaggtggaccagggaaccctttttgagctcatcctggccgccaattacctggacatcaaagggcttctggatgtgacctgtaagactgtggctaacatgatcaaaggaaaaactcccgaagagatccggaagacctttaatattaagtag

SEQ ID NO: 17553 - DNA, 375 bp, Artificial Sequence
  Description of Artificial Sequence: Synthetic coding sequence
atgtccgccactgtagtggatgcagtaaacgcagcccctctgtcaggtagcaaggagatgtctctggaggaacctaaaaagatgactcgcgaagattggaggaaaaagaaagagctggaagagcagcgcaaactgggtaatgccccagctgaggtcgatgaagaaggcaaggacattaatccccatatccctcagtacatcagtagcgtaccttggtacatcgacccttctaaacggcctactttgaaacaccagagaccacaacccgagaagcagaagcagttttcgagtagcggagagtggtataaacggggagtgaaggagaattccattattacgaaataccgcaaaggagcctgtgaaaactgcgggtag

SEQ ID NO: 17554 - DNA, 750 bp, Artificial Sequence
  Description of Artificial Sequence: Synthetic coding sequence
atggtagatagactggccaattctgaggctaatacccggcgcatctcaatcgtagagaattgtttcggcgctgccgggcaaccactcacaatacccggcagagtgctgatcggcgagggcgtactcacgaagctttgcaggaagaaaccaaaagcacgccagttttttctttttaacgacatccttgtctacggaaatattgtgatccagaagaaaaagtataataagcaacatatcattcccctggaaaatgtgactatcgactctatcaaagacgagggcgatctgagaaatgggtggctaattaaaactcctactaagtccttcgccgtgtacgcagctacagctactgagaaatcagagtggatgaatcacatcaacaaatgcgtgacagatctgctcagtaagtccggaaaaactccaagcaacgaacacgctgcagtgtgggttcctgatagtgaagccactgtgtgtatgaggtgtcaaaaggcaaaattcacacctgtcaacagacgccaccactgtcggaaatgtggattcgtggtatgcgggccatgttcggaaaagaggtttctgctcccctctcagtcatcaaagcccgtgagaatttgtgatttctgttatgatctgttgagcgccggagatatggctacatgccaaccagccaggagtgatagctacagtcagtcactcaagtcaccgcttaatgacatgagcgacgacgatgacgacgatgatagttccgactag

SEQ ID NO: 17555 - DNA, 120 bp, Artificial Sequence
  Description of Artificial Sequence: Synthetic coding sequence
atgaagttcaacccctttgtgacaagtgaccgctctaaaaaccggaagcgccactttaacgcaccttcccacgttaggagaaaaataatgagcagccctttaagcaaggagctgaggtag

SEQ ID NO: 17556 - DNA, 1401 bp, Artificial Sequence
  Description of Artificial Sequence: Synthetic coding sequence
atgggttggatcactgaggacctgatccggagaaatgcagaacataatgactgcgtcattttttcacttgaagagctgagcctccaccagcaggagatagaacgtctggagcatattgacaaatggtgtcgggaccttaaaattctttaccttcagaacaatctaatcgggaaaattgaaaacgtgtctaagcttaagaagctagaatacctcaaccttgcactcaataatatcgagaaaatcgagaatctggaaggctgtgaagagctcgccaaactcgatttaaccgtgaacttcataggggagctctcatcgatcaagaatcttcagcataatattcacctaaaggagctgttcctgatggggaatccatgtgcctccttcgatcattacagggaattcgttgttgcaactctgccccaactgaaatggctggatggtaaagaaatcgaaccatcagagcggatcaaggctctgcaggattattccgtgattgaacctcagatccgcgagcaagagaaggaccactgcctgaagcgggctaagctcaaggaggaagcacagaggaagcaccaggaggaagacaaaaacgaggacaaacgatcgaacgctggatttgacggacggtggtacacagacatcaatgccacgctaagctccctggaatctaaggatcacctccaagctccggacactgaggagcacaataccaagaaactggataacagtgaagatgacctcgagttttggaataaaccttgcctcttcacaccggaatcccgcttagaaacgctacggcatatggaaaagcaaaggaagaagcaggagaaactgagtgaaaaaaagaagaaggtcaaaccaccccggacactgattaccgaagacgggaaagccttaaacgtgaacgaaccgaaaatcgattttagtcttaaagataacgagaagcagatcatcttggatctggctgtttacaggtatatggatacctctcttatcgacgttgacgtgcaacctacttacgtccgagtgatgatcaagggtaaaccctttcaactggtactgccagccgaggttaaacccgatagctctagcgcaaagcgttcgcaaactacagggcacctggtcatttgtatgccgaaggtgggagaggtaatcaccggcggtcagagggcgttcaaaagcatgaaaacgacaagtgatcggagccgtgaacagaccaatacacgaagtaagcacatggaaaagctagaggtggacccctccaagcattcctttcctgatgtgacaaacatagtgcaggagaagaagcacacccctaggcgcagacctgaaccgaagatcattcccagtgaggaggatcctacattcgaggacaatccggaggtcccacccctgatctag

SEQ ID NO: 17557 - DNA, 528 bp, Artificial Sequence
  Description of Artificial Sequence: Synthetic coding sequence
atggcctcaaaccataaaagttcggctgcacgccccgtgagtcgtggtggtgtggggctgactggccggccccccagcggtataagacccctaagcggcaacatacgggttgcaactgccatgccccctggtaccgctcgaccaggttcgaggggctgcccaataggtaccggaggagtgttaagctcccagattaaagtcgcacatcggcctgtgactcagcagggcctcacgggaatgaaaactggaaccaaaggacctcagcggcagattctcgacaaatcttactatcttggacttctgaggtccaagattagcgaacttacaactgaagttaacaagctgcagaagggtatagagatgtacaatcaggagaactccgtgtatctgtcatatgagaaacgcgcagaaacactggccgtggagatcaaggagctgcagggccagcttgcagactacaacatgttggttgataagctgaacacgaataccgaaatggaagaggtaatgaacgactacaacatgtag

SEQ ID NO: 17558 - DNA, 438 bp, Artificial Sequence
  Description of Artificial Sequence: Synthetic coding sequence
atgaagttcaacccatttgtcacatcagaccgctcaaagaaccggaaacggcatttcaacgcaccctcacatgtgcggaggaagatcatgtcttcacctctgagtaaagaacttcgccagaaatataacgtgcggagcatgccgatcaggaaagacgatgaggtccaggtggtaagaggacactataaagggcagcagatcgggaaggtggttcaggtgtatcgtaaaaagtacgtcatttacattgagcgggtgcagcgggagaaagccaacggcacaaccgtgcacgttggcattcacccttctaaggtggtgattacccgcctcaagctcgataaggataggaagaaaatcctggaacgcaaagctaaatcacgccaagtaggcaaggaaaaggggaaatataaggaggagctgatcgagaagatgcaagaatag

SEQ ID NO: 17559 - DNA, 2136 bp, Artificial Sequence
  Description of Artificial Sequence: Synthetic coding sequence
atgtcaagcgtgcagtcacagcaagagcagctctcacagtccgacccgtctccttcacctaacagctgctcttcgtttgaactgattgacatggacgcagggtctctgtatgagccggtaagtcctcactggttttattgcaaaataatagactcaaaagagacatggatcccatttaattccgaagattctcagcaactggaagaagcttattcttccggcaaagggtgtaacggacgagttgtgcccactgatggcggtcgttacgacgtacatcttggcgagcggatgagatacgccgtgtactgggacgagctggcttctgaggttcgacgctgtacctggttttataagggggacaaagataataagtacgtcccatactccgagtctttttcccaggtcttggaggagacctatatgttggccgtcacattagacgagtggaagaagaagcttgagtcccctaacagagagatcatcatcctgcacaacccgaagcttatggtgcactatcaacccgtggccgggagcgatgactggggtagcacacccactgaacagggccggccacgtactgttaagagaggggtggaaaacatctcagtggacattcactgtggagagcccctgcagattgaccatttggttttcgttgtgcatggcatcgggcctgcctgcgatctgagattccgctcaatagtccagtgtgtgaatgatttccggagtgtcagcctaaatctgctccaaacacattttaaaaaggcacaagaaaaccagcagatcggtcgggtggagttcttaccggtgaactggcattctcccctgcatagcacaggggtcgatgtggatctacaacgaatcacacttcccagtatcaacagacttagacacttcaccaacgatactatcttggacgtcttcttctacaatagccctacttattgtcaaaccatcgtggacacggtggccagtgaaatgaacagaatatataccttatttctgcaacgaaatcccgatttcaagggtggagtgagcattgccgggcattccctagggtctctaatactgttcgatattctgaccaatcagaaggatagtctcggtgacattgattcagaaaaagattccttgaacatcgtgatggaccagggcgacacacccacactcgaggaggacttgaagaagttacaactcagcgagtttttcgatatattcgagaaagagaaggtggacaaggaggccctagccctttgtactgaccgtgacttgcaggagataggaattccattgggtccccggaaaaaaatcttaaattatttctctactaggaaaaattccatgggcatcaagagacccgctccccagccagcatcaggagcgaatatcccgaaggagagtgagttctgctcttccagtaacacgaggaatggtgactatctcgacgtcgggatcgggcaagtgtccgtgaaataccctcgtctgatctacaagccagagatcttcttcgcctttggctcccccattggcatgttccttactgtccgaggacttaaaaggatcgaccctaattatagattcccaacatgcaaagggttcttcaacatttatcaccctttcgatcccgtagcctaccggattgagcccatggtggtccctggcgtggaattcgagccaatgctgattccacatcataagggtaggaaacggatgcacctcgaactccgagagggcttgacacggatgtcaatggacctcaagaacaacctcctgggctctttgcggatggcctggaagtcctttactcgcgccccctatcccgcactccaggcgtctgagactcccgaggagactgaggccgaacctgagagcacatccgagaaaccatctgacgtgaacaccgaagagacgagtgtagccgtcaaggaggaggtactccccattaatgtcggcatgttgaatggcggccagcgaattgattatgtgttgcaggagaagcccatagaaagcttcaatgagtatctcttcgccctacaaagtcatctgtgttactgggagtctgaggacacagtactcttggtcttaaaagaaatctatcagacgcaggggatttttctcgaccaaccccttcagtag

SEQ ID NO: 17560 - DNA, 471 bp, Artificial Sequence
  Description of Artificial Sequence: Synthetic coding sequence
atggcatcagtgctctcgaggcgtctgggcaaaagaagcctgttaggggctcgggttctcgggcccagcgcgtcagaggggccaagcgccgcccctccttcagagcctctgctcgagggcgcagccccccagccgttcaccacctctgacgatactccttgtcaggaacaaccaaaggaagtgctgaaggctccttccacttccgggctccagcaggttgcatttcagccagggcagaaggtatatgtatggtatggagggcaggaatgcacggggctagtggagcagcacagttggatggaaggccaggtgaccgtgtggctgctggagcagaaattgcaggtctgctgccgagtggaggaagtgtggctggcagagcttcaagggccttgcccccaagcaccccctctggagcccggggcccaggcccttgcctacaggcctgtaagccgtaatattgacgtcccttag

SEQ ID NO: 17561 - DNA, 309 bp, Artificial Sequence
  Description of Artificial Sequence: Synthetic coding sequence
atgccaagcattaaactccagtcctctgatggagaaatctttgaagtggatgtcgagatcgccaaacaatccgtgacaataaagaccatgctggaggatctcggaatggacgatgagggcgatgatgaccccgtcccgttacctaatgtcaatgcagcaatcctgaagaaggtgattcagtggtgcacccaccataaagacgatccaccacctccagaggatgacgagaacaaagaaaaacggaccgacgatattcccgtctgggatcaagagttcttaaaggtggatcaaggcacacttttcgaatag

SEQ ID NO: 17562 - DNA, 465 bp, Artificial Sequence
  Description of Artificial Sequence: Synthetic coding sequence
atggccgatgacttggattttgagacaggtgatgccggcgcctctgctacctttcccatgcagtgcagcgcacttcgtaagaatggttttgtagtcttaaagggctggccctgcaagatagtggagatgagtgcatccaagaccggcaagcacgggcacgctaaagttcacctggtaggcattgatatcttcacaggcaaaaaatacgaggacatatgcccatccacccacaatatggatgttcctaatatcaagagaaatgattttcaattaatcggtattcaggatggctatctttcactgttacaagactccggcgaagtccccgaggacttaagacttccggagggagatctggggaaggaaatcgagcagaaatatgattgcggggaggagattttaataacagtgctgtctgccatgaccgaggaggcggcagtggccattaaggccatggccaaatag

SEQ ID NO: 17563 - DNA, 306 bp, Artificial Sequence
  Description of Artificial Sequence: Synthetic coding sequence
atgagcgcaactgtggtggatgcagttaatgctgccccattgagtggcagcaaagaaatgagtcttgaagagcctaagaaaatgactagggaggattggcgtaaaaaaaaagagctcgaagagcagcgcaaattaggtaacgcccccgcagaggtcgatgaggagggtaaggatatcaacccacacattccacaatacatcagtagtgtcccttggtatattgacccatctaagaggccaacactcaagcatcagaggcctcagccggagaaacaaaagcagttctcaagcagcggggagtggtag

SEQ ID NO: 17564 - DNA, 3201 bp, Artificial Sequence
  Description of Artificial Sequence: Synthetic coding sequence
atggccggggcactccgacgtgggagagccttaggttccagaccttctggacctactgttagcagcaggagaagtccacaatgtcccgtagcccaggagggcctcggggcaaggagcaggcctcgggtggcccctagaagcctggctaggtgtggaccgtcatcacgtcttatgggatggaaaccatcagaggcgaggggccagtcgcagagcttccaagcttctggacttcaaccccgaagtttaaaggctgcgagacgagccactgggaggcctgaccggagcagagcggctcgtccaactatggacccgtctgcccacagaagcagagccgctccccctaacatggatcctgacccacaggccggtgtacaggtggggatgcgagtcgttaggggagttgattggaagtgggggcagcaggatggcggcgagggcggcgtgggcaccgtggtggagttgggtcgacacggcagcccttcgacacccgatagaacagtggtggtgcaatgggatcaggggacccggacgaattacagagccggctaccagggcgctcatgatcttctgttatatgataacgcacagataggcgttcgtcacccaaacatcatctgtgactgttgcaagaaacacgggctccgcgggatgcgatggaaatgtagagtttgtctagattacgatctatgcacccagtgttatatgcataataagcacgagttggctcacgcattcgacagatatgaaacagcccacagccgcccagttactctgtcacctagacaggggttgcctagaatccctctgcggggcatttttcagggcgctaaggtagtacgggggccagactgggagtggggctctcaggatggaggcgaagggaaacctggacgggtggtggatatcagagggtgggatgtggaaaccgggaggtctgtggccagcgtgacatgggccgacggtacaaccaatgtttatcgcgtaggtcataaaggcaaagttgacctgaagtgcgttggcgaggctgcaggaggattttattacaaggaccacttgcctcgtctgggcaagccagcagaactgcaacggcgtgtgtcagccgattcgcagcctttccagcacggcgataaggtgaagtgtctactcgacacagatgtcttaagagagatgcaggaagggcatggagggtggaatcctagaatggcagaaacagggaccgtgcaccgcatcacagaccggggagacgttcgggttcagtttaatcacgaaaccagatggactttccaccctggcgcgcttacgaaacaccactctttttgggtcggtgacgtggtgcgtgtgatcggagacctggacaccgtgaagaggctgcaggccgggcacggcgaatggacagacgatatggcgcccgcattgggacgggtgggtaaggtcgtcaaggtctttggagacggcaatttacgcgttgccgtcgcggggcagagatggaccttcagcccatcatgccttgttgcctacagacctgaagaagatgctaaccttgacgtggcagagcgagctagggaaaataagagctcactgtcggtggccctggacaagctgcgggcacagaagtcagatccggaacatcccggcaggctggttgtcgaagtggctctcggcaatgccgcccgggccctggatctcctgagacgacggccggaacaggtcgatacaaagaaccagggtcggactgcgctccaggtcgccgcctatctgggccaggtggaactaatcaggttgctccttcaggctagggccggcgtggatctgccagacgatgaaggtaacaccgccttgcactacgctgcactcggcaaccagcctgaggctacccgggtgctgctgtctgccgggtgcagggccgatgcaattaattcaacacaatctacagcgctgcacgtcgccgtccagagggggttcctcgaggtggtccgggccttgtgtgaaagaggctgcgatgtcaacttaccagacgctcatagcgacactcccctgcactctgccataagcgcgggtacgggcgccagcgggatcgtcgaggtcctcaccgaagtaccaaatattgacgtgaccgcaaccaactcccagggatttacacttctccaccacgcctcactgaagggccacgcattggccgttcggaagatcttagctcgggcccgccaactcgttgacgcgaaaaaggaagatggttttacggcactgcatctcgccgcacttaataaccatagagaagtggcacagattttgataagggagggacgctgcgacgttaacgtcagaaacaggaaactgcagtcgccactgcatctcgccgtgcagcaggctcacgtgggactggttccacttctagtcgatgcggggtgctcagtgaatgccgaggatgaggaaggcgataccgcactgcacgtggcactgcagcggcatcaactgctcccgctggtcgccgacggcgctgggggtgatcctggaccgcttcagctactgtccaggctgcaggccagtgggcttcccggatcagccgaactgaccgtgggggcagctgtagcctgctttctcgccctagaaggagcagacgtatcttatacaaatcaccgaggtcggagcccactagacctggcagctgagggcagggtcctaaaagctctccagggatgtgcgcagcggtttcgcgagcgtcaggccggcggcggcgccgctcccggtcctcgacaaactctgggaacgccgaatactgtgactaatttgcatgtaggcgccgcgccgggacctgaggccgccgagtgcctggtctgcagcgagctggcgctgctcgtgctgttcagcccttgtcaacatcggactgtgtgtgaggagtgcgcccgccgcatgaaaaagtgtatccgatgccaagtagtagtgtccaagaagctgagaccggatgggtcggaagtggcctccgctgcgcccgcgccaggcccacctaggcagctggtcgaggagttgcagtctcgctatagacaaatggaagaacgcatcacatgcccgatatgtatcgatagtcatatccggttagttttccagtgtggtcatggcgcatgtgccccctgcgggagcgcactcagcgcttgccccatttgtcgccagcccattcgcgaccgcatccagatttttgtttag

SEQ ID NO: 17565 - DNA, 348 bp, Artificial Sequence
  Description of Artificial Sequence: Synthetic coding sequence
atgatgctgggcacagagggtggggagggatttgtagtgaaggtgagaggcctgccttggtcctgctcggccgatgaggtgcaacgattctttagcgactgcaaaatccagaacggtgctcaggggatcaggtttatctacaccagagaggggaggccatccggcgaggcgttcgtggagctggagagcgaagacgaggtgaagctggctctgaaaaaggaccgggagacgatggggcataggtacgtggaggtttttaagagcaataatgttgagatggactgggtgttaaaacacaccggccctaatagcccagacaccgcaaacgacggttttgtgagactgtag

SEQ ID NO: 17566 - DNA, 375 bp, Artificial Sequence
  Description of Artificial Sequence: Synthetic coding sequence
atggcttctgtactcagcagacgactcgggaaacgaagcctgttaggcgctcgagtcctcggaccaagcgcctccgaaggccctagtgccgcaccaccaagcgagcccttgctggaaggggcagcacctcaacctttcacgacatcagacgataccccctgccaggaacagcccaaagaagtattgaaagctccatctacctcaggtctgcagcaggtcgcattccaacctgggcaaaaggtctacgtttggtacggcggacaggagtgcactgggcttgttgagcaacacagctggatggagggccaagtgaccgtgtggctgttagagcagaagctgcaggtgtgctgtagagtagaggaggtttggctgtag

SEQ ID NO: 17567 - DNA, 438 bp, Artificial Sequence
  Description of Artificial Sequence: Synthetic coding sequence
atgaagtttaacccctttgtgacttccgacaggtccaagaatcgcaaacggcactttaatgcgccctcacatgtgcgtcgcaagattatgtcatcccctttatctaaggagttgcgccaaaaatataacgttaggtctatgccaataagaaaggacgacgaggtgcaggtcgtcagagggcattacaagggacagcagatcggcaaggtcgtacaggtgtaccgaaagaagtatgtgatctatatcgagcgcgtccagcgggagaaggcaaacgggacgacagttcacgtcggaattcatccgagcaaggtggtgatcacaaggctcaaactggataaggatagaaagaaaattctggagcgcaaggcaaaaagccgtcaggtcggtaaagagaaggggaagtacaaagaggagctcatcgagaagatgcaggagtag

SEQ ID NO: 17568 - DNA, 339 bp, Artificial Sequence
  Description of Artificial Sequence: Synthetic coding sequence
atggactctgagcttatgcacagcattgtggggtcctatcacaagccacctgagcgagtgttcgttccatccttcacccaaaacgaaccctctcaaaattgtcaccccgccaacctggaagtgacaagtccgaagatactgcacagccctaactcacaagctctgattctggctctgaaaacactgcaagaaaagattcaccgactcgagctggaacggacccaggccgaagataacctgaatattctttctcgggaagccgcacagtacaagaaggctttagagaatgaaactaatgagaggaatctggctcaccaggagttaatcaagcaaaagtag

SEQ ID NO: 17569 - DNA, 345 bp, Artificial Sequence
  Description of Artificial Sequence: Synthetic coding sequence
atgccttccgccgaggcaaagctgaaaaagaatcgatgcgccaattgcttcgattgccccggctgtatgcacacactcagcacacgtgctacctccattagcacacagctgcccgacgaccctgctaaaacgactatgaaaaaggcatattatttagcatgcggtttttgccgctggacgtccagagatgtggggatggcggacaaatccgtcgccagcggtgggtggcaggaacctgaaaatccacatacccaacgcatgaataaacttatcgagtactatcaacagcttgcacagaaagaaaaagtagaacgcgatagaaagaaactggctcgtaggcgctag

SEQ ID NO: 17570 - DNA, 648 bp, Artificial Sequence
  Description of Artificial Sequence: Synthetic coding sequence
atgccgggagaagctaccgagacagtccctgctactgagcaagagctaccgcagagtcaagccgagacaggctccggcaccgcaagcgattctggtgaaagcgtgcccggtatcgaggaacaggattcaactcagacgacaacccagaaggcctggttggttgccgccgccgagattgatgaggagccagttgggaaagccaagcagtcacggtctgagaaacgggctcgaaaggcgatgagcaagctggggctgctgcaggtaaccggcgttactagagtcaccatctggaagtcgaaaaatattctgtttgtcattactaaattggacgtctacaaaagccctgcctccgatgcatatatagtgtttggtgaggccaaaatccaagatctttcccagcaggctcagctcgccgctgccgaaaaattccgggtgcaaggcgaagctgtgggcaacatccaagagaatacccagactcccaccgtgcaagaggagtctgaggaagaggaggtagacgagacaggcgtggaggtgaaggatgtgaaactggtcatgagccaggctaatgtatccagggccaaagcggtgcgagcccttaagaacaactccaacgacatagttaatgccattatggagctgactgtgtag

SEQ ID NO: 17571 - DNA, 432 bp, Artificial Sequence
  Description of Artificial Sequence: Synthetic coding sequence
atgtcagctacagtcgtcgatgccgtgaacgccgctccccttagcgggtctaaggagatgtcactagaggagccgaagaagatgacacgagaagactggaggaagaagaaagagctggaggaacagcgcaagttaggtaatgcacctgctgaagtggatgaagaaggcaaggatataaatccccacatcccacagtacatttccagcgtcccgtggtacattgacccatctaagcgccctaccttaaagcaccagagaccccagcctgagaagcagaaacagttttcctctagcggagagtggtataaaaggggggtgaaagagaacagtattatcactaagtatagaaaaggcgcgtgcgaaaattgtggggctatgacacacaagaaaaaagactgttttgaaagaccgcgtcgggtcggagcaaaatag

SEQ ID NO: 17572 - DNA, 567 bp, Artificial Sequence
  Description of Artificial Sequence: Synthetic coding sequence
atggccagcgttctgtcccggaggctggggaagaggtcactgctgggcgcccgggtccttggaccatctgcttccgagggccccagcgctgctcccccaagtgaacccctgctagaaggagctgccccacagcctttcacaacctcagacgacactccatgtcaggaacaacccaaggaggtcctcaaagcaccatcaaccagtggtttgcagcaagtggcatttcagccaggacagaaggtgtatgtgtggtacggaggccaggagtgcactggactggtcgaacagcacagctggatggagggacaggtgacagtgtggctactggagcagaaactgcaggtgtgctgtagggtagaagaggtttggctcgcggagctacaggggccatgcccccaggccccacccctcgaaccaggagcccaagcgctggcttatagaccagtgagtaggaacatcgacgtaccaaagcggaaaagtgatgccgtggagatggacgagatgatggctgccatggtgctcacttcactgtcatgttccccggtagttcagtctccgccaggatag

SEQ ID NO: 17573 - DNA, 87 bp, Artificial Sequence
  Description of Artificial Sequence: Synthetic coding sequence
atgatgctcgggaccgaggggggggagggattcgtggtcaaagtgaggggtttaccttggtcttgttccgcagatgaagtgcaatag

SEQ ID NO: 17574 - DNA, 87 bp, Artificial Sequence
  Description of Artificial Sequence: Synthetic coding sequence
atggactcagaactgatgcacagcattgtcggcagctaccacaagccgccagaaagggtctttgtccccagtttcacccagaactag

SEQ ID NO: 17575 - DNA, 1074 bp, Artificial Sequence
  Description of Artificial Sequence: Synthetic coding sequence
atgggaggagccgtgtcggctggggaagacaatgatgacctgattgacaatctgaaagaagctcagtacataaggaccgagagggtggaacaggcctttagagctatcgacagaggtgattattacttggaggggtatcgtgacaatgcgtacaaagacctggcatggaagcatggaaacatccatctttcagcaccttgcatttactctgaagttatggaagcgctgaaactgcaacctggactttcctttttaaacttaggctccgggacgggatacctttctacgatggtcggtctgatactgggacccttcgggattaaccacgggattgaactccactccgacgtggtggaatatgctaaagaaaagctggaaagcttcattaagaatagcgactcctttgataaatttgagttttgtgagcctgcattcgtggtcgggaactgcctccaaatagcctccgacagccatcagtatgacaggatctactgtggcgccggagtgcagaaggaccacgaaaactacatgaagatcctactgaaggtgggaggcatcctggtgatgccgatagaggatcagctcacccaaataatgagaacggggcagaatacttgggagagcaagaacatattagccgtgtccttcgccccgctcgttcaaccttccaagaatgacaacgggaaaccagattccgttgggctgcccccctgcgccgtccgtaatcttcaggatcttgcccgcatttacattcgacggaccctccggaatttcatcaatgacgaaatgcaggctaagggaataccgcaaagagccccaccaaaacggaaacggaagcgtgtgaagcagaggataaacacgtatgtgttcgtggggaatcaattaataccacaaccattggactctgaggaggacgaaaaaatggaggaggataataaggaggaggaggaaaaggatcacaacgaggcgatgaaaccggaagagcccccccagaatcttttacgagagaagatcatgaaacttcccttgcccgagtcccttaaggcctacctcacctacttcagggataaatag

SEQ ID NO: 17576 - DNA, 483 bp, Artificial Sequence
  Description of Artificial Sequence: Synthetic coding sequence
atgcccagcatcaagctgcaatctagcgacggagagatctttgaagtcgacgtggagattgccaagcagtccgttacaatcaagaccatgctagaagacctgggcatggacgatgagggggatgatgaccctgtcccgctgccgaatgtgaacgcagcaattctgaagaaagttattcagtggtgtacacaccataaggacgatcccccgcctcctgaggatgatgagaacaaggagaaacggacagacgacatccctgtgtgggatcaagaattcctaaaagtcgaccaaggaaccctcttcgaattgattttggctgcaaattacctcgatatcaaggggctgcttgacgttacttgcaaaaccgtagccaacatgatcaaagggaagacgccggaggaaattcggaagacattcaacattaaaaacgacttcacagaagaagaggaagcacaggtaggcagcacccaattctgtctttag

SEQ ID NO: 17577 - DNA, 342 bp, Artificial Sequence
  Description of Artificial Sequence: Synthetic coding sequence
atggatagtgagttgatgcactctattgtcggcagctaccacaagccacctgaaagagtgttcgttccgtcttttacacagaacgagccttcacagaattgccatcccgctaatctggaggtgacctccccgaagatactccactctcctaactcacaggccctgatcctggcgctgaaaacgctgcaggaaaaaatccatagactcgagcttgaacgcacacaggctgaagacaacctcaacattctgtccagagaagctgcccagtataaaaaagctctagagaatgagaccaatgagagaaacctggctcatcaagaactcataaaacaaaaaaagtag

SEQ ID NO: 17578 - DNA, 309 bp, Artificial Sequence
  Description of Artificial Sequence: Synthetic coding sequence
atggccagcgtgctgagccggcggctgggcaaaaggagtctgttaggcgcccgggtgttaggtccttcagcctctgaggggccatccgctgccccgcctagcgaacccctgctagaaggagccgccccacagcctttcacaacctccgatgatacaccatgtcaagagcaacccaaagaagtactgaaagctccttcaacgtccggccttcagcaggttgcttttcaacccggccaaaaggtatatgtctggtatgggggacaggagtgtaccggcctggtggagcaacactcctggatggaagggtag

SEQ ID NO: 17579 - DNA, 492 bp, Artificial Sequence
  Description of Artificial Sequence: Synthetic coding sequence
atgccttctattaagctgcaaagttccgacggcgagatatttgaagtggacgtcgagattgccaaacagtcggtgaccataaaaactatgctggaggacctcgggatggatgatgagggcgacgacgaccctgttccactcccaaatgttaacgccgccatcctaaagaaggtaatacagtggtgtactcatcacaaagatgatcctcctccccctgaagacgacgaaaataaggagaagaggaccgacgatatacccgtctgggatcaggagtttctcaaggtggatcaagggacattgttcgagctgattttggccgcaaactatctcgacattaaggggctactggatgttacctgcaagacagtggcgaacatgatcaagggcaagacccctgaggaaatccggaagacatttaacatcaaaaatgatttcacagaggaagaggaggcccaggtcagaaaggagaatcagtggtgcgaggagaaatag

SEQ ID NO: 17580 - DNA, 441 bp, Artificial Sequence
  Description of Artificial Sequence: Synthetic coding sequence
atgtgcccaggcaactggctgtgggcctccatgacatttatggcgcggttcagcagatcctcttctcggtctcccgtacgaacaaggggaactctggaagagatgcctacagtccagcaccccttcctaaatgtgttcgagcttgagagattattgtacactggcaaaacggcatgtaaccacgctgatgaagtttggcccggcctctacttgggggatcaagatatggcaaataaccggcgcgagcttcgccgcctaggcatcacccatgtcctgaatgccagtcactcccgatggcggggtacccctgaagcttatgagggcctgggcatcaggtatctcggcgtggaggcccacgattctcctgccttcgatatgtcaattcatttccagactgcagctgattttatacatcgggcccttagccagccaggtggctag

SEQ ID NO: 17581 - DNA, 1542 bp, Artificial Sequence
  Description of Artificial Sequence: Synthetic coding sequence
atggcctccgtgttgtcccgaagactcggaaagcggtccctcctgggagcccgggtactgggcccaagcgcaagcgagggaccgtctgccgcgcccccgtctgagcctttgctcgagggtgcggctcctcaacctttcactacatccgatgataccccttgccaagagcagccgaaggaggtgttgaaagccccaagcacatccggattgcagcaagtggccttccagcctgggcagaaggtgtatgtctggtacggtgggcaggagtgcactggccttgtggaacagcatagctggatggagggccaggtgacagtgtggctgctggagcagaagttgcaggtctgttgtagggtggaggaggtgtggctggccgagctgcagggcccctgtccacaggctccacccctggagcccggagcccaggcactggcttataggcccgtgtcccgcaatatcgacgtgccaaagcgcaaaagtgatgctgtggagatggatgaaatgatggccgcgatggttctgaccagcctgtcatgctctcccgtggtgcagtctccacctgggactgaagctaatttctcggcatcccgggcagcatgcgatccatggaaggaaagtggggacatatctgactcaggtagctctaccacttcaggtcactggagcggcagcagtggcgtgagcaccccaagtcctcctcatcctcaggcttcccccaagtacctcggagatgccttcgggagccctcagaccgaccacggctttgagaccgacccagatccctttctgctggacgaacccgcccctagaaagaggaagaattctgttaaggtgatgtataagtgcttgtggcccaactgtggcaaggtgcttcggtcgattgtcggcatcaaaagacacgttaaagctctgcatctcggggacacggtggatagcgaccagttcaaaagagaagaggacttttactatacagaggtacagctgaaagaggagtctgccgccgccgcagcggcagcagccgccggaactcctgtccctggaaccccaactagtgagccagcccccacaccctccatgaccggcctgcccttgtcagccctgcccccaccccttcataaggcacagtcatcaggccctgaacaccctggccccgaaagctctctgccctcaggcgctctgagcaagtccgctccagggagcttctggcatatccaggccgaccacgcctatcaggcactcccaagcttccagataccggtgagcccacacatttatacatctgtatcctgggctgctgcccccagtgcagcttgctccctgtccccagtgagatcacgaagcttgtccttcagcgagcctcagcagccagcccctgcaatgaaaagccaccttattgtaacctctccaccccgggctcagagtggggcgagaaaagctaggggcgaagctaaaaagtgtaggaaggtctacgggatcgagcaccgagaccagtggtgcacggcctgtagatggaaaaaggcctgccagcgctttctggactag

SEQ ID NO: 17582 - DNA, 438 bp, Artificial Sequence
  Description of Artificial Sequence: Synthetic coding sequence
atggctgtgtccacgggggtgaaggtgccccgaaacttccgcctgttggaggagttagaggaaggccaaaaaggcgtaggcgatggcacagtttcctgggggttggaggacgatgaagatatgacgcttacaaggtggacagggatgataatcggtcctcctcgcactaattatgaaaaccggatttattctcttaaggtcgaatgcgggccaaagtatcccgaggctccgcccagtgtgaggtttgtgactaaaataaatatgaatggtatcaataactcctctggtatggttgacgcaaggtcgatccccgtgttagcaaagtggcagaacagctatagtattaaagttgtgttgcaggaactgcgtaggctgatgatgtctaaggaaaacatgaaattgccccagccccctgagggccagacctataataactag

SEQ ID NO: 17583 - DNA, 1542 bp, Artificial Sequence
  Description of Artificial Sequence: Synthetic coding sequence
atggcatccgtactgagcaggcgactcggaaaacggtccctccttggcgctcgcgtgttaggtcccagcgccagcgaaggcccctccgcagctccaccttcagagccccttctcgagggggccgcccctcagccattcactacttccgacgatacaccttgccaggagcagcccaaagaggtccttaaggctccatccacgtcagggttacagcaggtcgcattccagcccggacaaaaagtgtatgtttggtacggcggccaggaatgtaccggcctcgtagagcagcacagctggatggaaggccaggttactgtatggttgctggagcaaaagttacaagtgtgctgtcgagtcgaagaagtctggctggcggagctgcaaggcccgtgtccgcaggcacctcctttggagccaggcgcacaggctcttgcataccggcccgtgtcgaggaacatcgacgtccctaagaggaaatccgatgctgtcgagatggacgaaatgatggctgcgatggttctgacatcactatcttgctcgcccgtggtccagtcccctccaggcactgaagccaacttttccgcatcaagggccgcctgtgacccatggaaagagtccggcgatattagcgattccgggtcctcgacaacgagcggtcattggtccggatcatctggtgtatccacacctagcccccctcaccctcaagcaagccccaaatatctcggcgacgcatttggctccccccagactgatcacggctttgaaaccgatcccgacccattcctgctcgatgagccggcacccagaaaaagaaaaaattcagtgaaagttatgtataagtgcctgtggccaaattgtggaaaagttcttcgctcaattgtaggcatcaagcgtcacgtgaaggccttgcaccttggggataccgtggattcggaccagtttaaacgcgaggaggacttctactatacggaggtgcaactgaaggaggagagtgcagcagcagctgcagcggccgcggctggcacccccgtccccggcactccaacctcagaaccggccccgactccgagtatgacgggtctcccactgtcagcactccccccacccctgcacaaggcacaatcctctggccccgagcatcctggacctgagtcgagtctcccatccggagcactttctaaatccgcccctggctctttctggcacattcaagctgatcacgcataccaggccctcccaagtttccagatccctgtgtccccccatatatacacttctgtatcatgggccgctgccccatccgctgcctgttctctttctccagttaggtctaggagcctgtcctttagcgagccccagcagcctgcacctgcgatgaagtcccaccttatcgtaacaagtccaccacgcgctcagtccggtgctcgcaaggcacgcggggaggctaagaagtgcaggaaggtctacgggatcgaacaccgtgatcagtggtgcaccgcatgccgatggaagaaggcctgtcagcgctttctggattag

SEQ ID NO: 17584 - DNA, 57 bp, Artificial Sequence
  Description of Artificial Sequence: Synthetic coding sequence
atgccctccataaaactccaaagtagtgacggggaaatattcgaagttgacgtatag

SEQ ID NO: 17585 - DNA, 1935 bp, Artificial Sequence
  Description of Artificial Sequence: Synthetic coding sequence
  Description of Combined DNA/RNA Molecule: Synthetic coding sequence
gttgccagtgaagggtctgtccgtcgtccctccggccccgtgcctgctccccaaccccctgcttttagattcgtgtctcgccctggacgcgcccggtccgaaagcgaaaccctggagagatcccccccccagtcaccagggcctggtaaagccggtgacgcacctaaccgccggagcggccacgtccgaggagcacgggtgttgtctcccccgggtcggagagctcgattgtccagccccggaccttctaggtcctcagaagctagagaggaactgcgccgccacctcgtcggccttatcgagaggagccgcgtcgtcatattctctaagagctactgtccccattctacaagggttaaggaacttttcagttcacttggggttgagtgcaatgttctggagctggaccaagtggatgatggcgcacgggtgcaagaagtactgagcgagattactaaccagaagaccgtgcccaacattttcgttaacaaggtgcatgttggaggctgcgatcagaccttccaggcatatcagtccggactgttacagaagctgcttcaggaggatctagcgtacgactatgatctgatcattattggaggggggtcaggaggactgtcatgtgccaaagaagcggcaatactgggtaagaaagtgatggtacttgacttcgtcgtcccaagcccccaggggacgagttggggcttgggggggacatgcgtaaacgtgggctgtatacctaaaaagctgatgcaccaggcggcgctcctcgggcaagccctatgcgacagtcgcaagtttggctgggaatataaccagcaggtcaggcataactgggaaacaatgacaaaggcaatccagaaccacattagctctctgaattggggttaccgacttagcctgcgcgagaaagctgtggcgtatgtgaattcgtacggagaattcgtggagcatcacaagataaaggcaacaaataagaaaggccaggaaacgtactataccgccgcccagttcgtcatcgcaaccggagaaaggcccaggtatctcggcattcagggagacaaggaatactgtatcacttccgatgatttattttctcttccctattgcccaggtaagacactcgtggtcggcgcaagctatgtcgctctggaatgtgcgggcttcctggcaggtttcgggctggatgttacagtaatggtgcggtccatcctgctccggggtttcgatcaggagatggctgaaaaggtcgggagctacatggagcagcacggtgtgaagtttctgaggaagtttatccccgtaatggtccagcaacttgagaagggctcacctggcaagctcaaggtgctcgccaagagtacagaaggcaccgagaccattgaaggggtgtataatactgttctgctcgcaattggcagggacagctgtaccaggaagatcgggctggagaagatcggcgttaaaattaacgagaaatcaggaaaaatccctgtcaatgacgtggagcagacaaatgtaccgtacgtgtatgctgtgggggacatcctcgaagacaaacctgagctgacacccgtggcgatccagtcaggtaaactactggcccagcgtttattcggagcctcccttgagaaaatttaccacactctgttctggccactggaatggactgtggctggtcgagagaacaatacctgttatgctaagataatctgtaataagttcgaccacgaccgagtcatcggctttcacatcctcggccccaacgcgggcgaggtgacgcagggcttcgccgctgccatgaagtgcggcctgacaaagcaactactcgatgacacgattggaatccatcccacgtgtggggaggtcttcacaactctggagattacaaagtcttcaggtctggatattacccagaaaggttgtugagggtag

SEQ ID NO: 17586 - DNA, 1338 bp, Artificial Sequence
  Description of Artificial Sequence: Synthetic coding sequence
atgaacaagggcattagcagtattcccattaacctacgagtgtacagtccacacgtgctgaatctcactctgattgacttacccggaataacaaaggtccccgttggggaccagcctccagatattgagtatcaaattcgtgagatgatcatgcagttcatcactcgggagaattgcctgatcctggccgtaactcccgcgaataccgatctggcaaattctgatgcacttaaattggccaaagaggtggatccacaggggctacggacaatcggggtgatcacaaagctggacctcatggatgagggtactgacgctcgggatgtgttggagaataagttgttgcctctgcgcagagggtatgtgggtgtagtgaaccggtcccagaaggatattgatggcaagaaggacatcaaagcggccatgctggccgaacgcaagttcttcttatcgcacccagcctatcgccacatagcagatcgcatgggaactcctcatttacaaaaggtgcttaaccaacagctgacaaaccacatccgggatacactgcctaatttcagaaacaaattacaaggacaactcctatccatcgaacacgaggtggaagcctataaaaatttcaagcccgaggacccgaccaggaagacgaaagccttactccaaatggtgcaacagtttgccgtggacttcgagaaacgcattgaaggctctggcgatcaagtggacacgctggaactgtccggtggggctaagatcaatagaatcttccacgagcgatttccatttgagattgtcaagatggaattcaacgagaaagaactcagacgcgaaatttcttatgcaataaaaaacatccacggaatccgaacaggattgttcacccctgatatggctttcgaagcaattgtaaagaaacagatcgtcaaactgaagggtccatccctgaaatcagtggacctggtcatccaggagcttatcaacacggtaaagaagtgtaccaagaagttagccaacttccctcggttgtgcgaggagacagagaggattgtcgcaaaccatattcgggagagagaagggaagactaaggatcaagtgcttcttttgattgacattcaggttagctacatcaacacaaaccatgaggactttattggattcgccaatgcccagcagaggagtagccaggtgcataagaagactaccgtcggcaaccaggtcatccgcaaaggctggctgacgatttcgaacatcgggatcatgaaaggtggatctaagggctactggttcgtattgaccgctgaaagcctctcttggtacaaggatgatgaggagaaatag

SEQ ID NO: 17587 - DNA, 1560 bp, Artificial Sequence
  Description of Artificial Sequence: Synthetic coding sequence
atgctgcagctgatggactctggcattaccatatgccttaggaacggagctgccagcgtattcaaaaagaaggagtggtctacacagggggaagagaataagcaagactccaagctaaagaaactgtccgaggattcgttgacaaagcagccagaagaagtgtttgatgtgttagaaaagttgggcgagggtagttacggaagcgttttcaaggccattcacaaggagagcggtcaggtcgtggccatcaaacaagtgcccgtggaatctgatctgcaggaaattataaaggagatatccattatgcagcagtgtgacagtccatacgtggtgaagtactacggcagctatttcaagaacacggacctgtggattgtgatggaatactgtggggccgggtccgtgagtgacatcatcagacttaggaacaagacactaatcgaggacgagatcgcaaccatcttgaaaagcacactgaagggtctcgaatatctgcattttatgcggaagatccatcgtgacataaaagccggaaatatcctacttaacaccgaaggacacgctaagcttgcagacttcggggttgctgggcaactgacagacactatggccaaacggaacacagttatcggtacccctttctggatggcccctgaggtgatccaagaaatcggctataattgtgtggcggatatctggagcctgggaattacctctatcgagatggccgaggggaagcccccttatgctgatatccatcccatgcgggccattttcatgatcccgacaaacccgccaccgaccttccggaagccggagctatggtctgatgactttaccgatttcgtgaaaaaatgtttagttaaaaacccagaacaacgcgcaactgcaactcagctcctgcagcacccttttattaaaaacgccaagcctgtctcgattctgcgtgatcttataactgaggccatggagatcaaggccaaaagacacgaagaacaacagcgcgagctcgaagaggaggaagagaactctgatgaagatgaactcgacagtcatactatggtcaagacatctgttgaatctgtgggcactatgagggctacatctacgatgtctgaaggggcccagactatgattgagcataactcaacgatgttggaatccgacctgggcaccatggtgattaatagcgaggatgaagaagaggaggatggaacaatgaaaagaaatgccaccagtccacaggtccaacggccatccttcatggactattttgacaagcaggactttaagaacaagtctcatgagaattgtaatcaaaacatgcatgagcccttccccatgagcaaaaatgtgtttccagacaactggaaagtgccccaagacggagacttcgattttctcaagaatttgagtctagaggagctgcagatgaggctgaaagccttagaccctatgatggaacgcgaaatagaagagctgcgccagagatatacagcgaagaggcaacctatcttggacgctatggacgccaagaaacgcagacagcagaatttctag

SEQ ID NO: 17588 - DNA, 1392 bp, Artificial Sequence
  Description of Artificial Sequence: Synthetic coding sequence
atgaagatcatggattctgaactgatgcacagtatagtcggatcttaccacaaaccacctgagagagtgtttgtgcctagctttactcagaacgaaccatcgcagaactgccaccctgctaatctagaagttaccagcccaaaaatcctccattccccgaattctcaggccttgatactggcactgaagacccttcaggagaaaattcaccgcctggagctcgagcggacacaggctgaggataatttgaatatcctgtccagagaagcggcacagtacaagaaggccctcgaaaacgagacaaacgagcggaaccttgcacaccaagagctcataaaacagaagaaagacattagtatccaattgtctagtgctcagtcccgttgtaccctgttggaaaaacaactcgaatatacgaagcgcatggtgttgaacgtggagcgcgagaaaaacatgattctcgaacagcaggctcagctccaacgtgagaaagagcaagaccaaatgaagttgtatgccaagctggagaaactggatgtgctggagaaggaatgtttccggctcacaacaactcagaagacagctgaagataagatcaaacacctcgaagagaaactgaaggaagaagaacaccaaaggaagctgtttcaagacaaagctagtgaactgcagacggggctggagatttccaagatcattatgagtagcgtgagtaatctgaagcattcgaaggaaaagaaaaagagctccaagaaaactaagtgcattaagcgccgacccccttggcagatttgctctaagtttggagctctacctttcgtcgcagaaaaaatgagacagcacagggatcctcatattctacaaaagcctttcaacgtaaccgagacgagatgcctgccaaaacctagtcgtactacatcatggtgtaaggcaatacctccagactccgaaaaatcaatttccatctgtgacaacctgtccgaattgctcatggctatgcaggacgaactcgatcaaatgagtatggaacatcaggagctgttgaagcagatgaaagagacagaaagccatagcgtctgtgatgacatcgagtgcgagctggaatgtctgctgaaaaaaatggagataaaaggtgaacaaattagcaaactgaaaaaacaccaggacagcgtctgtaagctccagcagaaggtccaaaacagcaaaatgtcagaagccagcggaattcagcaagaggacagctaccctaagggttctaaaaacattaagaactcaccgaggaagtgtctgactgacaccaatctgttccagaaaaactcctcattccaccccatccgagtacacaacttgcaaatgaagctgcgcagagacgatatcatgtgggaacagtag

SEQ ID NO: 17589 - DNA, 1050 bp, Artificial Sequence
  Description of Artificial Sequence: Synthetic coding sequence
atggaggacccgcagtctaaggagccagctggggaggcagtcgccctggctctgctcgagagccctaggcccgagggtggcgaagagcctcctcgcccaagtcccgaagaaacccagcaatgcaagtttgatggacaggagacgaagggatctaagttcatcacctcctcagcctccgattttagtgaccccgtgtacaaagagatcgctatcacgaacggctgcatcaataggatgagtaaggaagaactccgggctaaactcagcgaattcaagctcgagaccagaggcgtgaaggatgtgttaaaaaaacgcctcaaaaactactacaaaaagcagaaattgatgttgaaggaaagtaattttgcagacagttattacgactacatttgcatcatcgattttgaggccacatgcgaagagggcaatccacctgagttcgtccacgagataatcgagtttccggtggtgctactcaacacacacaccctagaaatagaggatacctttcagcagtacgtcagaccggagataaatacccaactgagtgatttctgtatcagcttgaccggcatcactcaggatcaggtcgaccgtgccgatacttttccacaggtcctgaaaaaagtgatcgattggatgaaattgaaggagcttggtaccaaatacaaatactccctcctcactgatggctcctgggacatgtctaaattcctcaatattcagtgccagctgagtaggttaaagtaccctcccttcgccaagaagtggatcaatattcgtaagtcatacggaaacttctacaaggtgccccgatctcagaccaagttaacaattatgcttgagaagctcggtatggattatgatggacgcccgcattgtggtctggacgattccaaaaacatagcacgcatagcggttcggatgctccaggatggttgtgagctgcgtattaatgaaaagatgcatgccggccagttgatgagcgtgtcctcatctctacccattgaagggacgcctcctccccagatgccccactttagaaagtag

SEQ ID NO: 17590 - DNA, 636 bp, Artificial Sequence
  Description of Artificial Sequence: Synthetic coding sequence
atgtgccccggaaactggctctgggcatccatgacttttatggcacgattctctcggtctagctcgaggtcacccgtcaggactcgaggaacgctggaggaaatgcccacagtccagcaccctttcctgaacgtgtttgagctcgaacgtctactgtacactgggaagactgcttgcaaccacgcagacgaggtgtggcccggcctgtacctgggagatcaggatatggccaataatcggagagaactgagacgactggggataacgcacgtactgaacgctagtcatagccggtggaggggcaccccagaggcctatgagggactgggaatacggtatttgggcgtcgaggctcatgattcccctgcattcgatatgagtattcatttccagacagctgctgacttcatccacagggctctgagtcaacccggtgggaagatactcgtgcattgtgccgttggtgtgagtcgctccgcaactctcgtcttggcatacctgatgttgtatcaccaccttactctggtcgaggccatcaaaaaagtgaaggatcacagaggcatcattcccaatagaggctttctaagacaattgctagctctagatagacgcctgcgccagggcctggaggcttag

SEQ ID NO: 17591 - DNA, 438 bp, Artificial Sequence
  Description of Artificial Sequence: Synthetic coding sequence
atgatcccaatttggaaacaacaggctcggcctggcgatggaccagtgatttgggattaccatgtggtgctgctgcatgtgtcctccggcggtcagaatttcatctacgatttagatacagtgctgccctttccctgtctgttcgacacatacgtggaggacgcattcaaatctgacgacgatattcacccccagttccgcagaaaatttcgtgtcattcgagctgactcttacctcaaaaacttcgcttctgatcgatcgcacatgaaggactctagcgggaactggagagaacccccccctccgtatccttgcatcgaaactggcgatagcaaaatgaatctcaacgacttcatctccatggaccctaaagtgggatggggggcagtgtacaccctctcagagtttacacacaggttcgggtctaagaattgctag

SEQ ID NO: 17592 - DNA, 258 bp, Artificial Sequence
  Description of Artificial Sequence: Synthetic coding sequence
atgtccgacaagtcggacctgaaggctgaactggagaggaaaaagcaacggctagctcagataagagaggaaaagaagaggaaagaagaggaacgcaagaagaaagaagccgatatgcagcaaaagaaggagcccgtccaggatgattccgacttggatcggaaaaggcgcgaaacagaggcgctgctccagtctatcgggataagccctgaacctcctctggtccctaccccgatgagcccctcgtcaaagagctag

SEQ ID NO: 17593 - DNA, 588 bp, Artificial Sequence
  Description of Artificial Sequence: Synthetic coding sequence
atggactctgaacttatgcatagtatagtagggtcctaccacaagccccctgaaagagtctttgtcccttctttcacgcagaatgagccatcccagaactgccatcctgccaacttggaggtcaccagccccaagatactgcattctccaaattcacaagcgctgatactcgccctgaaaacactgcaagagaaaatccatagactggaacttgagcggacacaagccgaggacaacctcaacattctgtccagggaagccgcacagtacaaaaaggcacttgaaaacgagaccaatgagaggaatcttgcgcaccaggaattgattaagcaaaaaaaagacatttcgatacagttgtcctcagcacagagccgatgtacacttctcgagaaacaactcgaatatactaaacgcatggtcctgaacgttgaaagagagaagaatatgatcctcgagcagcaagctcagctgcagagggagaaggagcaggatcagatgaagctctatgcaaaactcgagaagctggatgttctggagaaagaatgcttccggctgaccaccacccagaaaacagccgaagataaatag

SEQ ID NO: 17594 - DNA, 1272 bp, Artificial Sequence
  Description of Artificial Sequence: Synthetic coding sequence
atggaggacaaacgaagcctcagcatggcacggtgcgaggaacgaaattctagaggacaggaccatggcctcgagcgtgtgccgtttcccccacaactgcagtcagaaacgtacttacatccagcagatccctcacctgcatgggatgatccaggctcaactgggagtccaaacctgcgactgcttaccgaggaaattgcctttcagcctctggctgaggaagcatcctttcgaagaccccaccccgacggagatgttcccccccaaggcgaggacaatctgctttccttgccattcccgcagaaactgtggagactggttagctcaaatcagttcagttctatatggtgggacgattccggagcctgtagagtaataaatcagaaattgttcgaaaaagagatactcaaacgcgacgtcgcacataaagtctttgccactacctcaatcaaaagcttcttccgccaactgaacttatatgggttccggaaaaggaggcagtgcacctttagaacctttacgaggattttttctgccaagcggcttgtgagcattctgaacaaactcgaattttactgtcatccatattttcagagagactcgccacatctgctcgtgcggatgaagagaagggtcggggttaagagtgctcccaggcaccaagaggaggataaaccagaggccgccgggagctgtctggcgcccgctgacaccgagcaacaggaccacacgtcaccaaatgagaatgatcaggtgacccctcagcaccgggaaccagcagggcccaacacacagatcagatccggatctgcaccgcccgctacccccgtcatggttcccgacagcgctgttgcttccgacaacagccctgtgactcagcccgcaggggaatggtccgaagggtcgcaggcccatgtaaccccagtcgcagcagtccccggcccggctgcgctgcctttcctttatgtgccagggtccccaactcaaatgaattcctatggcccagtcgtggccctgcctaccgcatctcgatccactctggctatggacacgacaggactgccggctcctggaatgctgcctttctgccacctgtgggtgccagtgactcttgtagcagctggcgcggcacaacccgccgcttcaatggtgatgttcccccatttacccgccctgcatcaccattgccctcactctcataggacatctcaatacatgccagcctcggatgggcctcaagcctacccagattacgccgatcagtctacctag

SEQ ID NO: 17595 - DNA, 2097 bp, Artificial Sequence
  Description of Artificial Sequence: Synthetic coding sequence
  Description of Combined DNA/RNA Molecule: Synthetic coding sequence
ggagtgggtggccgtggcgagagactcccaagaggcttcgcccgcgtcgtacgggtggcctcagaaggcagcgttcgccggccctccggccctgttcccgcccctcagcctccagccttccgctttgtgtccaggcccgggcgcgcgcgctccgagtccgaaactctggagagatccccaccccagtcgcctgggcctgggaaagctggagacgcaccaaaccggcggtctgggcacgtgcgtggggccagggtactgtctccacctgggcgccgcgcaaggctgtcttccccgggcccgtcccggagtagcgaggcacgggaagagctacggcggcatctggtcggactgattgagcgctccagagtggtcatcttcagtaaatcctactgtccccactcaacccgagtcaaagagctcttctcaagtctcggggtcgagtgtaacgtgttagagctggatcaggtagacgacggtgcccgggttcaggaggtgctgtctgaaatcacaaatcaaaaaactgtcccaaatatcttcgtcaacaaggtccacgttggggggtgtgatcagacattccaggcataccagagtggtctgctccaaaagctccttcaggaggacctggcttacgactacgacctgattattatcggcggtggctcgggcggcctttcttgtgccaaagaggctgctattctggggaaaaaggtgatggtgctcgattttgtggtgcccagtcctcaaggaacatcctgggggctgggtggaacttgtgtgaacgttgggtgtatccctaaaaagctcatgcaccaggcagctttactgggccaggccctttgtgatagtcgaaagttcggctgggagtacaaccagcaggtccgacacaactgggagactatgacaaaggccattcagaaccacataagcagcttaaattggggctaccgattgtcgctaagggagaaggctgtggcttatgttaattcttatggggagtttgtggaacaccacaaaatcaaggccacgaataaaaaaggccaggaaacctactatacagccgctcagtttgtgatcgcaacaggcgagaggcccaggtaccttggcatccagggggacaaggagtattgtatcaccagtgacgacctattctcgctcccttactgcccaggaaaaacacttgttgtgggggccagctacgtggctttggagtgtgcggggttcctggccggattcggccttgatgttacagtcatggttagatccatcctcctcagaggttttgaccaggaaatggccgaaaaagttggcagctacatggagcagcacggtgttaagttcttaaggaagttcattccagtgatggtccagcaattggaaaagggatcgcctggcaagttgaaggtactggctaagtccactgaaggcactgaaacaatagaaggagtctacaacacggtactgctcgccattggacgcgacagttgtacccgtaagataggactggagaagattggagtgaaaatcaacgaaaaaagcggaaaaataccagttaatgatgtagagcagactaacgttccatatgtatatgctgtgggcgatattctggaggacaagccggagctgactccagtggccatacagagcgggaaattgctggcccagcgccttttcggagcgagcctagagaaatgcgactacataaacgtccccactacagtatttacccctctagagtacggttgttgcggtctgtcagaggaaaaggccatagaggtatacaaaaaagaaaacttagaaatttatcacactctcttttggccattagagtggactgtggcaggccgggagaacaatacctgctacgctaaaatcatttgtaataaatttgatcatgaccgggtgattgggttccacatcctgggtcccaatgccggtgaggtgactcaagggttcgccgccgccatgaagtgcggactgacaaagcagctgctcgatgacactattggaattcatcctacctgcggcgaggtgtttacaacactggaaataaccaagtcttccgggttggacatcacccaaaagggctgcugaggttag

SEQ ID NO: 17596 - DNA, 609 bp, Artificial Sequence
  Description of Artificial Sequence: Synthetic coding sequence
atgaccggctccaattctcacatcaccatactgacgctgaaagtcctgccccatttcgaatcactcggcaaacaggaaaagattcccaataaaatgagtgcattcaggaatcactgtccccacctcgattccgtcggggaaataactaaagaggacttgattcagaaatccctcggtacttgccaagattgcaaggtacagggccctaacctctgggcttgcctggaaaacaggtgctcatacgtggggtgtggtgagagccaagtggatcacagtaccatccactcgcaagagacgaagcactacctgacggtcaacttaaccacccttcgggtgtggtgttacgcttgcagcaaggaagtcttcctagaccggaagctgggaacacaacctagtctaccccatgtgcgacagccccaccaaatacaggagaacagcgtacaggacttcaagatccccagtaatacaacgctgaagacccctttggtagcagtctttgacgatctagacattgaagccgacgaagaggatgagctgagggcacggggcctgaccggcctcaagaatattggtaacacctgttacatgaacgccgcgctacaggcctag

SEQ ID NO: 17597 - DNA, 1443 bp, Artificial Sequence
  Description of Artificial Sequence: Synthetic coding sequence
atggagacagaccttaatagccaggacaggaaagacttagacaagtttattaagttcttcgccttaaagacagtgcaggtgatagtgcaagctcggctgggagagaaaatttgcactaggagctcgagttctcccactggctccgattggttcaacttagctattaaggacataccagaggtgacacacgaggctaagaaagctttagctggtcaattacccgccgtaggccgctcaatgtgtgtggaaatcagcctcaagactagtgagggagattctatggaactcgaaatctggtgtctcgagatgaacgaaaagtgtgataaggaaattaaggtgagctacaccgtttataacagactcagccttttgctgaaatctcttctcgcaatcacgcgcgttaccccagcctatcgcttgagccggaaacagggccacgagtacgtgatactgtacagaatctacttcggcgaggtgcaactgagcggactgggagaagggtttcagacagtccgagttggcaccgtgggtacacctgtaggaacaataactctttcatgcgcgtaccgtatcaatctcgcctttatgagtactagacagtttgagcggactccgccaatcatgggcatcataatagatcatttcgtggacaggccctatccatcaagctccccaatgcatccatgcaattacaggactgccggcgaggataccggtgtgatttacccttctgtggaggattcccaggaggtttgcactacctcattctccacatcgccaccatcccagctcatggtccccggcaaagagggaggggtccctttagctccgaatcagccagtgcacggtacgcaggccgaccaggagagactggcaacttgtacaccgtcagaccgaactcactgtgccgcaaccccaagctcatcggaagacacagagaccgtctctaactctagcgaaggtcgtgctagcccccacgacgtactggaaacgatcttcgtcaggaaagtcggagcctttgttaataaaccaattaatcaggtgactctgactagtctggacataccttttgcaatgtttgcaccaaaaaacctagagcttgaggataccgatcctatggtgaacccacctgattcaccggaaactgaatcccccctccagggaagtttacacagtgatggctcctccggaggaagctcaggtaatacacacgatgacttcgtaatgatcgatttcaagccagccttttcaaaggacgatatactcccgatggacctgggaacattctatagggagttccagaaccctccccaacttagttcattgtcgatagatatcggggcgcagtcaatggccgaggatctcgacagtttgcccgagaaactggcggtgcacgaaaagaatgtacgggagttcgacgctttcgtagagacactgcagtag

SEQ ID NO: 17598 - DNA, 309 bp, Artificial Sequence
  Description of Artificial Sequence: Synthetic coding sequence
atgctcagtgaagaagagaaggaggagctgaaggcagaactggtgcaactcgaggacgaaatcactaccctgcgacaggtgctatcagccaaagagaggcatctcgttgagataaagcagaaattgggaatgaacctcatgaacgaactcaaacagaacttcagtaagtcttggcacgacatgcaaaccacaaccgcgtataagaagactcacgaaactctctcccacgccggtcagaaagcaaccgctgctttcagcaacgttgggaccgcaatctcaaagaagtttggggacatgaggagaaaatag

SEQ ID NO: 17599 - DNA, 318 bp, Artificial Sequence
  Description of Artificial Sequence: Synthetic coding sequence
atgagccagagcggcgctgtcagctgttgcccgggtgctacgaatggcagcctcggccgaagtgacggcgtagccaagatgtccccaaaggacctgttcgagcagcgaaaaaaatatagcaacagtaacgtgattatgcacgagacttcccaataccatgtgcagcatttagcaacttttatcatggataaatcagaagccatcacttctgtcgatgatgccatccgcaagctggtgcagcttagtagcaaagagaaaatctggacgcaggaaatgttacttcaagttaatgatcaatctctgcgtctgctggactag

SEQ ID NO: 17600 - DNA, 222 bp, Artificial Sequence
  Description of Artificial Sequence: Synthetic coding sequence
atgtccgccttccggaatcattgcccgcatctggatagcgtgggggagataacgaaagaagacctgattcagaaatctctgggtacgtgtcaggactgcaaggtgcagggaccaaacctctgggcctgcttagagaaccgctgctcttatgtaggctgcggagagtcacaggtggaccactctacgatccattctcaggagactaaacactacctgacgtag

SEQ ID NO: 17601 - DNA, 276 bp, Artificial Sequence
  Description of Artificial Sequence: Synthetic coding sequence
atggcaatgactgtggtgaccaaagaaaaaaacaaaaaggtccccactatcttcctctcaaaaaaacctagagagaaagaggttgattccaaaagccaggttatcgagggcatcagtaggctgatctgtagtgccaagcaacaacagacaatgctgagagtctctatcgacggggtggagtggagtgatataaagttcttccaactggccgcccagtggcccactcacgtgaaacattttcccgtggggcttttttcaggctcaaaagctacatag

SEQ ID NO: 17602 - DNA, 2535 bp, Artificial Sequence
  Description of Artificial Sequence: Synthetic coding sequence
atgttctggaaattcgacctgcacagctcgtctcacatcgacactctcctggagagagaagacgtaactctcaaggaactgatggacgaggaagacgtcctccaggaatgcaaggctcagaatcgtaagctcattgaattcctcctgaaagctgagtgcctggaggatttggtgtcttttattattgaagagccccctcaggacatggacgagaagattcgctacaagtatcccaatatatcatgtgaacttctgaccagcgacgttagtcaaatgaacgaccgcttgggagaagatgaatcgctgctgatgaagttgtactctttcctgctgaatgattcccctcttaaccctctgttggcgtcttttttttcgaaagtgctaagcattctgatttcccggaaaccggagcaaatcgtagatttcttgaaaaagaagcatgattttgtggacctgattatcaagcacattgggacctccgctataatggatttgctccttagacttcttacctgtatagagccgccccaacctcggcaggatgtgctgaattggctcaatgaggagaagattattcaaaggctcgtcgaaatagtacacccaagccaggaagaggaccggcacagtaatgcgagccagagcttatgcgaaattgtaagattgagccgcgatcaaatgcttcagatacagaatagtacagagccagatccgctcttagccacgctggagaagcaagagatcatcgaacagctgctttctaatatctttcacaaggaaaagaatgagagtgccatcgtaagtgctatccaaatcctgctgaccctcctcgagacaagaagacctacttttgagggccatattgagatatgtccacccggaatgagccactccgcttgcagcgtgaacaagtcagtgttggaagccattaggggccggttaggatcattccacgaactactgttggagcctccgaaaaaaagcgtgatgaagacaacgtggggtgtcctggatccaccggtgggcaacaccagactgaacgtgattcgattaatcagtagcctgctgcagaccaatactagctccatcaacggggacctgatggaacttaactccatcggggtgatacttaacatgttcttcaaatacacttggaacaactttctgcatacccaggtcgagatctgcatcgcccttatccttgccagtccattcgaaaacacagagaacgctactattacagatcaggactccactggagacaacttgcttttgaagcacttattccaaaaatgtcagcttattgaacgcattttggaagcatgggagatgaacgaaaaaaaacaggcagagggagggcggagacacggatatatgggccatctgactaggatagccaactgcatagtgcacagtacagataagggccctaacagcgctcttgtacagcagctcattaaggacctgccagacgaagtgagagagcgctgggagactttctgtacttcttccctgggcgagacaaacaagaggaacactgtagacctggctttctcggactaccagatgcagcagatgacttccaatttcatcgatcagttcggattcaacgatgagaaattcgctgatcaggatgacatcgggaacgtgtcattcgaccgcgtgtcggacattaacttcacactgaacaccaacgagtccggaaacattgctctctttgaagcctgctgtaaagaaaggattcagcaatttgacgatgggggctcagatgaagaagacatctgggaagaaaaacacatcgccttcacccctgaaagccagagaagatcctcctctgggtcaacagactctgaggagtccactgattcagaagaagaagacggggctaaacaggatctcttcgagcctagctctgccaacactgaggataaaatggaggtggacctgtcagagccccctaactggagcgctaattttgatgtgccgatggaaaccacacacggcgcacctctcgactccgtgggatctgacgtgtggtcaactgaggagcctatgcctaccaaagagactgggtgggcttctttcagcgagttcacctcctcactttccaccaaggattccttgcggtcaaacagtccggtggaaatggaaacatcgacagagcctatggaccctctaacgccctcagcagccgcattggctgttcaacccgaggccgccggatcagtggcaatggaagcatcctcggacggagaggaagacgctgaatccaccgacaaggtgacagagacagtgatgaatggtgggatgaaggagactctttcactaaccgtagatgccaagaccgagacggctgtctttaagagcgaggaagggaagctctccacttcccaagatgccgcttgtaaggatgctgaggagtgcccggagaccgcagaagcaaaatgtgccgctccccgacctccttcatcatccccggagcagcgaacaggccagccgtcagctccaggtgatacaagtgtgaacgggccagtgtag

SEQ ID NO: 17603 - DNA, 2604 bp, Artificial Sequence
  Description of Artificial Sequence: Synthetic coding sequence
atgttttggaaattcgacctacattcttccagtcacatcgatactttactcgagcgcgaggacgtgacgctcaaagagctgatggacgaggaagacgttctgcaggagtgtaaagcacaaaaccggaagctgatcgagttcctgctgaaggcagaatgtctcgaggacctggtttctttcattatcgaagaaccaccacaggacatggacgaaaagattcgttacaaataccccaatatcagttgtgaactgttgacctcagacgtcagccagatgaacgacaggctgggtgaggacgaaagcctcctaatgaaactgtactcgttcctccttaatgatagccccctcaatccacttctagcctcctttttctctaaagtcctaagcatactcattagtcggaaaccggagcagatcgtggattttttgaaaaaaaagcatgacttcgtggatctgatcatcaagcatattggcacttcagcgatcatggatcttctgctgcgattactgacctgtatcgaacccccccaaccacggcaggatgtcctgaattggctcaacgaggagaagatcattcaacgcttggtcgaaattgtgcacccgtcacaagaggaagacagacacagcaacgccagccaaagcctctgcgagatagtgcggctcagtagggaccagatgctgcagatccagaatagcactgagccagacccactcctcgccacgcttgagaaacaggagatcatagagcaactactctctaatatctttcacaaagaaaaaaacgagagcgccatagtctctgccatccagatcttgctgacgctgctggaaactcggagacccaccttcgaaggccacattgagatttgcccccctggaatgtcacactctgcgtgctccgttaacaagtctgtactggaggcaattagagggcgactggggagctttcatgagctcctgctggaaccccccaaaaaaagtgtcatgaagacaacctggggagtgctggacccgccggtaggcaacacgcgtctgaatgtcatacggctgatcagtagtctgctgcagacaaataccagttcaattaacggagacttgatggagttaaactccatcggtgtcatcctcaacatgttttttaaatatacatggaacaatttcctgcacactcaggttgaaatctgtatagcactaattcttgcttcaccatttgaaaatacagagaacgcaaccatcaccgaccaggatagtactggcgacaacctcctgctgaaacatctcttccagaagtgtcagcttattgagcggatcctggaggcctgggagatgaatgaaaagaagcaggccgaggggggtcgcaggcatggttatatggggcatctaactagaattgccaattgcattgttcattctaccgataagggtcccaatagcgctctcgtgcaacagttgataaaagatcttccggatgaagtgcgtgagagatgggagaccttttgtacgtccagcctgggcgagacgaacaagcgaaatactgtcgacctggttaccacctgtcatattcactcatctagcgacgatgaaattgactttaaagaaactggtttttcccaggactctagcctgcagcagatgcagcagatgacttccaattttattgatcagtttggctttaatgatgaaaagtttgcagatcaggacgatatcggaaacgtcagcttcgatcgtgtgagtgacatcaacttcaccctcaatactaatgagagtggcaacattgctctcttcgaagcgtgctgtaaggagaggatacagcagttcgacgatggaggtagcgacgaagaagacatctgggaagaaaagcacatcgcttttacccccgagtcacaaaggagatctagttctggtagcacagactcagaagagagcacggattccgaagaggaagacggtgctaagcaagatctgtttgaaccgtcaagcgccaacacggaggataaaatggaagtagacttatcggagccgcctaactggtcagccaatttcgatgttcccatggagaccactcacggggctcctctcgattctgtaggctccgatgtatggagcaccgaggaacccatgccgacaaaggagacaggttgggctagcttttccgaatttaccagcagtctgagcactaaagacagtctgcggagcaattctcctgttgagatggaaacaagcactgaacctatggacccactgacgccaagcgctgctgcattggcagttcaacccgaggccgcaggcagtgttgctatggaggccagcagtgacggagaggaggacgccgaatcgaccgacaaggtgactgagactgtgatgaacggggggatgaaggaaacacttagcctcaccgtggacgctaaaaccgagacggccgtcttcaagtcggaggagggtaagctttccaccagtcaggacgccgcttgcaaggatgccgaggagtgtcctgaaacagcggaggctaagtgcgcggcacctaggccgccaagcagcagcccagagcagcggactggccagccaagtgcccccggtgatacatccgtgaacggtccagtgtag

SEQ ID NO: 17604 - DNA, 174 bp, Artificial Sequence
  Description of Artificial Sequence: Synthetic coding sequence
atgacatctaagaagttggtgaattccgtcgccggctgtgcagatgacgccttagccggacttgtggcgtgtaacccaaacctacaacttctccaaggccatcgcgttgcgctcagatcggacctcgattccctcaaaggtagagtagcactgctgagcggaggggggagctag

SEQ ID NO: 17605 - DNA, 2709 bp, Artificial Sequence
  Description of Artificial Sequence: Synthetic coding sequence
atgtttccagctctcgaaacacacctgaagcagacaattccggatccttatgaggactttatgtatcgccacctgcagtactacggctactttaaggctcagaggggctccctcccaaactctgccacacatcagcatgtgaggaagaataacccgcagtgccttttgaatgggtctctcggggagaaggatgacttaatacccgatacactgcagaaagagaaattactgtggcctatctcacttagtagcgccgtgcatcggcaaatcgaagctatcaatagggacttccactcgtgtctcggttggatgcagtggcgtggattgagttcactccagcctcccccgccccggtttaaagatagcccagctagcgcatttagagtggccggaattacagattcccatatgctgagcctgccacacctgaggagtcgacagttgctgtatgacgaactcgacgaagtgaacccccgactgcgggagccccaagaactattttctatcctatccacgaagcgaccattacaagcaccccgctggccaatcgaatgcgaagttatcaaagagaatattcaccacattgaatgggcccccccccaaccggagtatttctaccaaccaaaggggaacgagaaggtacctgagatcgttggcgagaagaaagggaccgtagtataccagctcgactctgtccctatagagggttcctacttcacttctagccgggtaggtggcaagcgcgggatcgttaaagaactggccgtcactcttcaaggccctgaggacaacacgttgttgttcgagtccagatttgagtcgggtaatcttcagaaagcagtccgtgttgacacatatgagtacgagctgactctgcggaccgatctgtatactaataagcacacccagtggttttactttagagttcagaataccaggaaggatgccacctatcggttcacaatcgtaaatctcctgaaacctaaatccttatacaccgtaggcatgaagccactcctgtatagccagcttgacgccaacacacgaaacatcggctggaggcgagagggcaacgagatcaagtattacaaaaataatactgacgatggacagcagcccttttattgcctcacctggacaattcaattcccctacgatcaggacacatgtttttttgcccatttctacccatatacttacaccgatctgcagtgctatttgctgtctgtcgcaaataacccaatccagagccagttctgcaaactgcagaccctctgcaggtcccttgccggcaatacagtgtacctgctgacaattacgaaccccagccagacccctcaggaggcagctgctaaaaaagctgtagtgctgagcgcaagggttcatccgggtgaatccaacggctcatgggttatgaagggatttctggacttcatactatctaattctccagacgcacaactcctccgagacattttcgtgttcaaggttctacccatgctaaatcctgacggcgttatcgtgggcaactaccgctgcagcctcgccgggcgcgacctgaaccgccattacaagaccatactcaaagagtcattcccatgcatttggtacactcgaaacatgattaagcgcctgctggaggaaagggaggttcttctgtactgcgactttcacggtcactcccgcaagaataatatcttcctgtatggatgcaacaacaacaaccgaaaatactggctgcatgagcgcgtgtttccccttatgctctgtaaaaacgcacccgacaagttttctttccattcttgtaactttaaggtgcagaaatgtaaagaaggtactggtcgcgtcgttatgtggcggatgggaattctgaatagttacactatggaaagtacatttggcggctcaactctcgggaataagagagacacccatttcactatcgaagatctaaagtcgctcggatatcatgtttgcgacactctgttggacttttgtgacccagatcagatgaagtttactcagtgcttagctgagctcaaagagctgctgaggcaagagatacacaaaaaatttcacgagctcggtcaagatgtggacctggagggttcctggagtgacatttctctctctgacattgagagtagcacaagtggctctgattcaagtctgagcgacggtctgcccgttcaccttgctaacatagccgacgaactcacacagaagaagaagatgttcaagaaaaagaaaaagaaaagccttcaaacaagaaaacagaggaacgaacagtaccagaaaaaaaacctgatgcagaaactgaagctgacagaggacacatcagaaaaggccggcttcgcctctactcttcagaagcaacccacatttttcaaaaactccgagaatagctcctttctgcccatgaaaaacgagaatccccgccttaacgaaaccaacctgaacagacgcgacaaggacacccctctggaccccagcatggccacactcatccttcctaaaaataaaggccgcatgcagaataagaaaccaggctttactgtgagctgctcacccaagcgaacaattaattctagccaggagccagctcctgggatgaagcccaactggccaagaagtaggtacccagcaacaaaacgggggtgcgctgcgatggccgcctatccttctttacacatctacacctacccttag

SEQ ID NO: 17606 - DNA, 537 bp, Artificial Sequence
  Description of Artificial Sequence: Synthetic coding sequence
atgaacaggaggcggaaatttctgctggccagcgtcctggcgctgcagaacagtagctttatttatcccagctgtcagaagtgtttttccagaatcatcctggttagcaaacgcagtaattgtcccaagtgtggaagcactggtgagtcaggtaatgccaattatcgctataagctgagtcttaaagtggccgagtccaataaattattcgtgattacggtatttggctcttgcctggatacattttttggtctgaccgcgacaggacttcatcggtatattcaggatccaaataagattcctgagaccctggacaacgatacaactcagaacttgctgaccaaggcagtggaaacctgctttgtaggccagagttttatcttcggagtcaccaatttcgagaaccagccaggacagggcagcgatgcctctaactttctccagcaatgctctgatcacaaacgcaaagccaaagccctagttgcatgtcagattgtgctacccgatcccgcaacccaggacgccaaaaccaagtag

SEQ ID NO: 17607 - DNA, 441 bp, Artificial Sequence
  Description of Artificial Sequence: Synthetic coding sequence
atggttgcaatggctgaggcagaggccggagtcgcagtcgaggtgcgtgggcttccccccgcggtgcctgacgaactactcacattgtatttcgagaaccgcagacgttccggggggggcccagttctgtcttggcagcgccttggatgtggtggcgtattaacatttagggagcccgccgacgcagagcgagttctggcgcaggctgaccacgaactgcatggagcacagctttccttgcgaccagcaccacctcgcgcccctgcccgtttgctactgcaggggctgccaccaggtactacaccccaacgtctggagcagcacgtgcaggctttgctacgggccagcggcctgccggtgcagccttgctgtgccctggcctctccgaggcccgatagagctctggtgcagcttcctaagccgctgagtgaggcaggatag

SEQ ID NO: 17608 - DNA, 348 bp, Artificial Sequence
  Description of Artificial Sequence: Synthetic coding sequence
atggctggaaggcccctgcggataggtgaccagctggtcctcgaggaagattatgacgagacctacataccgagcgagcaggaaattctcgaattcgctcgggagattggtattgatcctatcaaggagccagaactgatgtggctcgcccgagaaggtatcgtggctccacttcctggcgaatggaaaccctgccaggatattaccggtgatatctattactttaattttgctaacggccagagtatgtgggaccacccatgtgacgagcattaccggagtcttgtgatccaggagcgagccaagctttcgacaagcggagccattaagaaaaagaagaagaaatag

SEQ ID NO: 17609 - DNA, 1191 bp, Artificial Sequence
  Description of Artificial Sequence: Synthetic coding sequence
atgcgaacttcatataccgttacactgccagaggatcctcccgcagccccctttcctgctttggccaaggagctaagaccccgcagccccctgtctcctagtctgttactcagtacctttgtgggactgctcctgaacaaggccaaaaattccaaaagcgctcagggtttagcgggactgcggaacctcggcaacacttgctttatgaattccattctacaatgcctcagtaatactcgcgagctgagagactattgcctgcaacgcctgtatatgcgtgacctacaccatggatctaatgcccatactgcactagtcgaggaattcgcaaaactgattcaaaccatctggaccagctcacccaatgacgtcgtttccccgtccgaattcaaaactcaaatccagcgatacgcccctaggttcgttgggtacaaccagcaggacgctcaagagtttctgaggttcctgctcgatggacttcataacgaagtgaaccgagtcacactcagaccaaaaagcaatccagagaacctagaccacctgccagacgatgagaaaggtcgccaaatgtggaggaagtacttagagagggaagattcacggatcggcgatctgtttgtaggccaactcaagagcagcctgacatgcacagactgcggttactgctctaccgtcttcgatcctttttgggacctatccctgcccatagccaagcggggttacccagaagtcacgttaatggattgtatgcgactgtttacgaaagaggacgtgttggacggggacgagaaacctacttgttgtcgatgccgcggcaggaagaggtgcatcaaaaagtttagcatccagaggttccccaagattttggtgctgcatctcaagagattctctgaaagccggatcagaacctcgaaactcacaacctttgtgaattttccactccgagacttggacttgcgcgaatttgcttcagagaacaccaatcatgccgtttacaacctctatgctgtgtctaatcactcagggacaacaatgggcgggcactataccgcctattgtcgatctcccgggactggggagtggcacaccttcaatgacagttccgtcactccaatgtcttcatctcaggtaagaacctccgacgcatatctgctgttctatgagctggcatctcccccctcccggatgtag

SEQ ID NO: 17610 - DNA, 633 bp, Artificial Sequence
  Description of Artificial Sequence: Synthetic coding sequence
atggctgcgtctgtcgagcagcgggaaggcaccatacaggttcaaggtcaagcccttttttttagggaagctttgcccggctccgggcaggcacggttttcagtgctcctgttacatgggattaggttttcgagcgagacttggcagaatttgggcacactgcaccgcctggcccaggccggttaccgggcggtggcgatcgacttacccggtctgggtcattctaaagaggcagccgctccggcccctattggggagctcgctccaggctctttcctcgccgccgtggtggatgcactcgaactggggccacccgtcgtgatctcaccaagcctgtccggtatgtattcgctgccattcctgaccgcacctggatcacagctgcccgggtttgttcctgttgccccaatctgtacagataagataaacgccgctaactacgcctcagtgaaaacgcctgccctcatagtgtacggtgaccaggatcccatgggccagaccagtttcgaacacttaaagcagctgcctaatcatcgcgtcctgatcatgaaaggcgccgggcacccctgctatttggataagccagaggaatggcacaccggcttactcgacttcttgcaggggctgcagtag

SEQ ID NO: 17611 - DNA, 1428 bp, Artificial Sequence
  Description of Artificial Sequence: Synthetic coding sequence
atggagctctggcaggcagccctttccaccctgaaccccaaccccaccgactcgtgtccgttgtaccttaattatgcaactgtggccgccttgccatgtagagtgtctaggcataacagtccatcagccgcccatttcatcactcgcttggttcgtacatgcctccctccaggggcacacaggtgcatcgtgatggtgtgtgaacagccagaggtatttgccagcgcttgcgcgctggcacgggcattcccgttgtttacccaccgatctggagcctcacgccggctcgagaaaaaaacagtgaccgttgaattcttccttgttgggcaggacaatggccccgtggaagtgtccaccctccagtgtttggctaatgcaaccgatggggtacggctcgctgcgcgcatcgtggatacaccgtgtaatgagatgaatacagacacattcctagaagagatcaataaggtgggcaaggagctcggaatcatccccactattattcgcgatgaagaattaaaaacccgcggatttggtggtatttatggcgtggggaaggcagctctgcatccccccgcactggcagtgttaagccacactcctgatggcgccacacagacgattgcctgggttggaaagggcatcgtttatgacactggcggtctttcaataaaaggaaagactacaatgccaggtatgaagcgcgactgcgggggagccgcagccgtcctgggtgcctttagggcagcaatcaagcagggcttcaaagataaccttcatgccgttttctgcttggcagaaaattctgtgggccccaacgccacccgccccgatgacattcatcttctctacagtgggaaaacagtcgagataaacaacactgatgcagagggtaggctggtgctcgcggatggcgttagctatgcatgtaaggatttaggagcggacattatcctcgatatggcgaccctcaccggcgcacaggggatcgcgactggaaaatatcatgccgccgtcctgaccaactcagcagagtgggaagcagcttgtgtcaaagcaggcaggaagtgcggggacttagttcaccccttggtttattgccccgaactgcatttttcagagttcaccagcgctgtggccgatatgaagaatagcgttgccgaccgagataattcaccctccagctgcgctggcctttttattgcttcccacatcgggtttgattggcccggcgtctgggtacatctcgatatcgcagcccctgtgcacgccggcgagagagcaacaggattcggagtcgccctgcttttagccctgttcggccgagccagcgaggaccccttgctgaaccttgtatcccccctcggctgcgaggtcgacgttgaggagggggacctagggagagattccaagagacggaggctcgtgtag

SEQ ID NO: 17612 - DNA, 537 bp, Artificial Sequence
  Description of Artificial Sequence: Synthetic coding sequence
atggtagccatggcagaagcagaggcaggcgtggcggttgaggtcagagggttgccccccgccgtgcccgatgaattactgactctctattttgaaaaccgccggaggtcaggcggagggcctgtgctttcctggcaacgactcggatgtgggggggttttgacctttcgcgagcctgcagacgccgagcgggtcctggcccaggcggatcatgagttgcacggagctcagctcagtctgagacctgcacctccgcgcgcaccagccagactgttattgcagggcctgcctccaggcacaacaccacagaggctggagcaacacgtgcaggctctgttgagggctagtgggctcccagtccagccatgctgcgccctcgcttctcctcggcctgacagggcactcgtccagctgccgaaacccctttccgaagccgacgtgcgtgtactggaggagcaggcacagaatcttggcctcgaaggcacgcttgtgagtctggcgagggtacctcaggcgcgtgcagttcgggttgtgtag

SEQ ID NO: 17613 - DNA, 1893 bp, Artificial Sequence
  Description of Artificial Sequence: Synthetic coding sequence
atggagaaggtgctgggctgcgagctcctgaaaggactgaacgtcctggacctgggactgaatatggagattctggaagaacagatgctgcacgagatactctgccgagaataccccgagttggagacccgctggcaggatctcaagatcagagccttggacacttgcaaggccgtggaggcagccgaggaaaggctgctgacgatgctcctattccagaatcctaaaagacagaaaccagcaaagtttctccggaatatcgttcgggcacaaggcaagctctgtcaattgagagcccactgcgaggaactggaggggcagaagctccaggagatggtgctgtgggcaccctatcggcctgttgtatggcacgggatggctatggtgaaagcgctgtcacagctgcaaaacctcctgcctctattttgcatgtcccccgagaactggttggcggtaactaagcaggccctggacagcatgaagcctagagaaataaatcacggcgaggacctagctagccacctgctgcagctacgggcccacctcaccagacagctgttaggcagcacggtgacagccctcggcctcactcaggttccgctcgtgggggcactgggcgccctggcccttctacaggcaactgggaaggcctcagagctcgagcgtttagccctgtggcctggtctagctgccagtccctcgacggtccacagtaagccagtgtctgacgtggcaagaccagcatggctggggcctaaggcttggcatgaatgcgaaatgctagaattactgcctccattcgtgggcttgtgcgcctcgctggctggccatagtagtgcgtggcaggcgtatcttagcctgagcagcacagtgctgggcccagcacccggccctggtccagaacctttgagtctgctccaaaagctgattctgtggcgtgtgctcaggcccgaatgcctggctggcgccttagctgacttcacaacctcgctcttaggaagacccttggatgagaacacatatgctccaaccatgccattcaaacattctcaagctacacagcccatgttgatcctgcttccgccaccaggccacccttcagccacactacatccattaaccgtgattcaaaaattagcggctaagtatcagcagggacagaaacagttacaggtgatcgccttgggatcagaagcatgggatcctgtttctgtggtggtgtctaccctgagccaagctatgtatgagggccactggctagtgctggacaactgtcatctaatgccccactggcctaaagaactccttcagctgcttctagagctcctcgggagggcaaaagtggtcgcagatctcgagtctgagcaattgctcgatcaacccgagagccggaatgtgtcgaccgtgcatcgagacttccggttgtggctgattgtccccgctgagtcttcagcctctctcccagctgtgctgacccagcatagcatgcccgtattctggaaccagtctctcgagctgggtcacgttctgatcgactccgtcgagctcgcccagcaggtgctgtacatgcagccacccacacaagctctgcccttgctccttctgcacgggctgctcttacaccgacagttgtatgggacccgcttacaggcacatcgaggacggtggtctcaggtgactcttacacaagtccttcagacacaggatcagctgtgggccagtctttccaatccccgcgccgctatgcaggaactagcaggcgaaacacttcctctgccattaggggtcatttcaccccaagaaagtctggaggaaggcggtggaggcattcaattcacagcactggtcctggccgtagttgaaactgagggaactgggaccgaacgactatag

SEQ ID NO: 17614 - DNA, 1488 bp, Artificial Sequence
  Description of Artificial Sequence: Synthetic coding sequence
atggagttgcacgggggcaatcgcgggggctaccaacccaaggctctagagcaatccggttgctggctctggcaggctgcactgtcaaccctcaacccaaatcccacagactcttgtcccctgtacttgaactatgccaccgttgccgcgctgccctgtagggtttctcggcacaactcgcccagtgctgcccacttcatcacccggttggtgaggacctgcctgcccccaggcgcccataggtgcatcgtgatggtttgtgaacagcccgaggtgttcgcttccgcttgcgccctcgcccgcgccttcccactttttactcaccgctctggtgcatcaaggcggcttgagaaaaagaccgtgaccgtagagttcttccttgtgggccaggataacgggccagtggaggtttcaactctgcagtgtctggccaacgccacagacggggtccgcctcgccgctagaatagtggacaccccttgcaatgagatgaatactgataccttcctggaggaaatcaataaagtcgggaaggagctgggaattatccccaccatcatccgcgacgaagagttgaagaccagaggattcggggggatctatggcgtgggcaaggcggcgctgcacccccccgctttggccgtgttgagtcacacgcccgacggtgccacccagaccattgcctgggtgggcaaaggcattgtgtacgacaccgggggcttgtccattaaaggaaaaacaaccatgcccggcatgaagagggattgcggtggggccgccgccgtgcttggcgcgtttcgcgcagctattaagcaaggctttaaggacaacctgcacgcagtgttttgtctggcggagaacagtgtcggacctaacgccaccaggccagatgatatccatctgctttattccggaaagactgttgagattaacaacactgacgccgaagggcgattagttctggctgacggcgtgtcgtatgcctgtaaagatctaggcgctgatattattctggacatggctacactgactggggcccagggaatcgcaaccggaaaatatcatgctgctgtcctgactaactccgccgagtgggaagccgcgtgcgtgaaagccggacgcaaatgcggggacctagtgcacccactggtgtattgtcccgagctccattttagtgagttcacctctgctgtggccgatatgaaaaatagtgtggccgatcgggacaactccccaagcagctgtgctggtttgttcatcgcatcccatatcggtttcgactggcctggtgtgtgggtgcacttagatatcgctgctcccgtacacgcgggcgagagagcaaccgggtttggggtggccttgttgctggccttgtttggtagggcctccgaggacccgctcctgaacctcgtgtcaccgctcggctgcgaggtagatgtggaagaaggtgatctgggccgggatagcaagcgcagacgcctcgtgtag

SEQ ID NO: 17615 - DNA, 618 bp, Artificial Sequence
  Description of Artificial Sequence: Synthetic coding sequence
atggagacagatctgaacagccaggaccgaaaagacctggacaagtttatcaaattttttgcacttaagactgtccaggtcatcgtccaggcgagactcggggagaaaatttgtacccggagttccagcagcccgactgggtcagactggttcaacctcgcaatcaaagacattcccgaagtgacacatgaggccaagaaggctcttgctggtcagctgcctgcagtggggaggtctatgtgcgtggagatcagtctgaagacaagcgagggagatagcatggagctagaaatctggtgcctagagatgaatgaaaagtgcgataaagagattaaagttagttacaccgtttacaacagactgagcctcttactcaagagtctcctggccatcacccgggtaacgcccgcttataggctgtccaggaagcaaggacacgaatacgtcattctttataggatttactttggtgaagtgcagctatccggactgggggagggtttccagacagtgcgcgtggggacagtggggacaccggttggtacaattacactctcgtgtgcttaccggataaatctggcttttatgtccacccggcagtttgagcgtacaccttag

SEQ ID NO: 17616 - DNA, 117 bp, Artificial Sequence
  Description of Artificial Sequence: Synthetic coding sequence
atggccgcgtttaagctggactttctccccgaaatgatggtcgatcattgttcactgaattcctcgccagtaagcaaaaagatgaacggaaccctcgatcaccccgatcagccttag

SEQ ID NO: 17617 - DNA, 1554 bp, Artificial Sequence
  Description of Artificial Sequence: Synthetic coding sequence
atggaaactgacctgaacagccaggaccggaaggacttggacaagttcatcaaattttttgcgctgaagaccgtacaggtaatcgtgcaggcgcgccttggcgagaagatatgcactaggtcctcctcttccccaacaggatctgattggttcaatttggctataaaggacatccccgaagtaacacatgaggccaagaaagctctcgccggccaactgcctgcagtgggacgttctatgtgcgtcgagatctccctaaaaacctctgaaggagacagtatggaactggaaatttggtgtttggaaatgaacgaaaagtgtgataaggagataaaggtgtcatacaccgtatataatagactatccctcctgctcaagagcctgttagctattaccagagtgaccccggcttataggctatcccggaagcaaggtcacgagtatgttattctctaccgcatctattttggcgaggtgcagctgagtggcctcggagagggattccagacagtgagggtggggaccgttggcaccccagtggggactatcacgttgtcgtgtgcttatagaattaacctggcctttatgtctacccgccaatttgaaaggaccccaccaatcatgggtattatcatcgatcatttcgtcgaccgcccatatccaagcagtagccccatgcatccttgtaattatcgtacagcaggcgaagacactggggttatctaccccagcgtggaggactctcaagaggtttgcacaacaagctttagtacatcaccgcctagtcaacttagcagctctcggctttcataccagcccgccgccttaggtgttggaagtgctgacctggcatacccagtcgtgttcgccgcaggactcaacgccacacatccacatcagttaatggtcccaggcaaagaaggaggggttcccctggccccaaaccagcccgtgcatgggacacaggcagatcaagagcggttggcgacctgtacaccaagtgataggacccactgcgctgcgactcctagcagcagcgaggacaccgaaacagtctcaaacagcagcgagggacgcgcttcccctcacgacgtcttggaaacaatttttgtacgcaaggtgggcgcctttgtgaacaaaccgatcaaccaggtgacgctcacctcactggacattccctttgcgatgtttgcaccaaaaaacttggaattagaagacactgatccgatggtgaaccccccagacagtcctgaaactgagtctccactgcaagggtccttgcactctgatggatcctctggcgggtcctccgggaacacccatgacgactttgtgatgattgacttcaaacccgccttctctaaagacgacatccttccaatggacctgggcactttttaccgggagtttcaaaatccaccccaattatcttccctatccattgatattggcgcccagagtatggccgaggatctggactcccttcccgaaaaattagcggtgcacgagaaaaacgtgagagaattcgacgcttttgtcgagacacttcagtag

SEQ ID NO: 17618 - DNA, 768 bp, Artificial Sequence
  Description of Artificial Sequence: Synthetic coding sequence
atggagcgtagtgggcagcgtgtgactacctgggactgcgaccaggggaagcactcagattcggctcagaaaaatgagagagagagtatcaggcagaagctagcacttggctcttttttcgatgacgggcccggcatctacacatcctgtagcaagtcgggcaagccgagcctgagctcacgccttcagtcagggatgaatcttcaaatttgctttgtgaatgactctggatccgacaaggacagcgatgcggatgacagcaagactgagacctcgctcgacacccctttaagccccatgagtaagcagagctcctcatatagcgatcgagacacaacagaagaggagagcgaaagcctagacgatatggattttttaaccaggcagaagaaattgcaggccgaggccaaaatggccctggccatggctaagcccatggccaagatgcaggtcgaggtggagaagcagaaccggaagaaatcccctgttgcagacctcctccctcatatgccccacatctcagagtgtctcatgaagaggtctctgaaaccaaccgacctgcgggacatgactatcgggcagctacaagtgatcgtgaatgacctccatagtcagattgaatcactgaacgaggagttagtgcaactcctcctgattcgcgacgaactgcacacagaacaggacgcaatgttggtggatattgaggacctgacgcgccacgccgagtcacaacagaagcacatggccgaaaagatgccggcgaagtag

SEQ ID NO: 17619 - DNA, 78 bp, Artificial Sequence
  Description of Artificial Sequence: Synthetic coding sequence
atgtcgcagtctggggctgtaagctgctgcccaggggcgacgaacgggtctttagggaggtccgatggagttgcgtag

SEQ ID NO: 17620 - DNA, 360 bp, Artificial Sequence
  Description of Artificial Sequence: Synthetic coding sequence
atggtgctagaaggtaaccccgaggtgggctctcctaggaccagcgatctgcagcatcgggggaacaaaggcagctgtgtcttaagtagtccaggcgaggacgcacagcctggagaggaaccaattaaatatggagagctcatcgtcttgggatgttgtgaggaaggcggggaggagacagaagctcagaggggagaggtcaccggccctcgggcacacagctgctataatggatgcctggcctctggagacaagggccgacggaggtcgaggctggccctatctcggcgctcacatgctaatggagttaagccagacgtgatgcaccatatcagcaccccattggtttccaaggcctag

SEQ ID NO: 17621 - DNA, 348 bp, Artificial Sequence
  Description of Artificial Sequence: Synthetic coding sequence
atggccggacgacctcttcggatcggagaccagctagttttagaggaagattacgacgagacttatataccatctgaacaggagattctggagtttgctagggagatcggaatcgaccccatcaaagagccggagctgatgtggctggcgagagagggcattgtggcccctctgccgggtgagtggaagccctgccaagacatcacaggcgatatatactacttcaacttcgccaatggtcagtccatgtgggatcacccatgcgatgagcactaccgttctcttgtaatccaggaaagggccaaactgtccacctctggagccattaagaaaaagaagaagaaatag

SEQ ID NO: 17622 - DNA, 471 bp, Artificial Sequence
  Description of Artificial Sequence: Synthetic coding sequence
atgtcatccgtgcaatcccaacaggagcagctctcacagagcgatccttctccaagtccgaactcctgctcaagctttgagctaatcgacatggatgccggctctctatatgaaccggtttccccccactggttttattgtaaaatcatcgatagcaaagagacctggattcctttcaacagcgaggatagccagcagctcgaggaggcttattcatccggtaaagggtgtaacggccgggtggtccctactgatggtggccgctacgatgttcacctaggggaaagaatgcggtatgcggtttattgggatgaacttgctagcgaagtaaggaggtgcacgtggttctataaaggggacaaagataacaaatatgtgccatacagtgagagtttttctcaggtactggaggaaacttatatgctggccgtcacattggacgagtggaaaaaaaagttagagagcccctag

SEQ ID NO: 17623 - DNA, 14262 bp, Artificial Sequence
  Description of Artificial Sequence: Synthetic coding sequence
atggtgcctgaagagcggagagtgggcctttcctccgacgagacctcctccgattccttaaagtcatggcattcaatctgcgtattggacagcaaggagcagccactggcctgtcaacagaagcagcgacagtttgtgaagcctgtgacggagtctgagcagccaaccgttctggagctacttctagccgaacttcgaacattgtttagcgccgttctgcaagacagctcccctgcagcctggaggtatttacatgctgtgctgggtttactacctccttacagggagctcctggttgggcatctggatttacttccttttctggaacagttgtactgctgggccccctgggtgcaaactcacctgcacttagacctgctgggcgctatcgttcaggccttccctccagactccagtctgctcgacagcgcttcacacgcagattgctgtcctcagaaaagacgattacaccatagacccccatgcccagcctgccccttcgtgcaagcccagtggtctcgccagcaggttaaagaggaactcgctacctggctcaggcccctaacattgccggaattgcaacgatgtctgggcatcgtgggggcacaggtcgccctcgaggaagccgtctggcttgacggacttagcttgctcccgcttgcgttggcggctgacatcccagttagatatgaaagctctgacactgataacgccgaagtggaacccgtaggccggaaggagactaggagccagctggactatgaagtgcccagagagaaggcattccaaaagtcctccaccggattctcacccgaaaccagctttcttgattctcaggtgatgacagccctcaagatggaacggtacctgaagaaaatccatttcctgtacctgaacgtcgctccctcccgttattttaggccctacagcctcatggtggtgccacctgacaaggttaaccccgaacactatatcttcagcccgttcggaattttgcacgtacatccagtcgaaggaagcgagactatgactctcggaacgtggcatcaccactgcgtgctgtggcagcagctgcagtttatcccattttttaagtactgcctgctgcgcaaaagtttcacttgctggaaaaagaatgtgcgcttgcagggcctgcaccgactccaaaagttcctggagaaccacctgctgcttgcagtgccccatttcggtgccgggctgctgcatataagtcgacttctgcaggaactccatagtgtgtcctggctgccacaggagctggaccggtgctatgaactgctggatctccaaactgccctcgccgaagagaagcacaaggcccttagactacttcacagatgcctgaatttatgcacctcaattctgaggctggtgcacgaagacacttaccatatgcaacagtgcttacaagaacgggtacagaactgtgaccgcatacgcactggacaggggagcatctacttgcaaagagtgcagcacaaacaactcgaacaaaagctcaagcaggcggaggcatggtggctccagctagggaagttcgccaggctcgttgattacatgatctgtcagtcacttataagcgtcttagaggaacagatcacgtctttcgtggcaaatattttacaggctccccgccagaaacctttcctgtccagtcagctcgtgttcgacgatcacggacagctgtcccacgtgccatgtgtggagaatatgattcagacgttgaccgggggtctgcaaagcgtcaaaacttcagctctacaggtcgtacagtccgcggacttgaaaacctcatcagattccctttattcagaggaggaggacgaggaagaggactccaaggatgagtttctgatgcccaaattccaaggtcaaccttcagacgcagtgtccatcttctgcggccctaatgttggactagtgtggccatggaagagccatcccatcgccggcattcttgaggtgagggggtgccgcctgagagggcaatacttcccacataactacaagcaattggaagaggacctggacaataatccgaagatccagcaggctctgaacatacagcaggtcttactggaaggggttctgtgcaaggtgcaggagttctgcagggagcaccactggatcaccggcatctatgaattcctccagtcctgggggccacaaaagctggaggatatgaggggcggtcctataaaaaactatgtgaccttggtgagtaggctgaacgtgtggcaggcaagagttagctccatgcccattgagttgctaacgaagggggggcttttgctgcttagctgtcatgatgtgcaggcggagatggagtccaagctcaattccattcggaaggacattctggcgcacgtgcaaaacgagtgctggaacctgagccaacagcttatgactgaattgaccgactttatgcatatcttcagaaccattaattcagatattcatgcaattgcacaatgtactcaaaaactaaatgaggctaatgagcagtacgtggaattagaggaacggatggagtacgtcagagctctgcacgagctgattaggaaccatttctccctgttcagcgcggaaaacgaagccctggacatctcagtgaggaggcagtttggcgaatctcccatccctccctgccccccacctcctcagcctcacctgcttcattgcccactgctggccccccaattgctcgacatgtgggaggccttccagtttgagaaatcacaggcatccgagtttcttctcagcaagcgacacgcaatcatgcctaagctgcagcagctgatggcggcagctctcgcggaattggaggggctactcgccaaggcactgagcgggccttttatggatcctacacaggatcagcgctccactgagcatcaactggtcagtctggagcgccagtttcaaaatactgtctccgacctgagcgaactccatcacgcttacgctatattcaccgaagacgagactccggtccctttgccgatttgcggaacccgcccaattgtccaacagcagaggatttggcacctctacagggtgatttccgaaaatatcagcgaatggaagtgtatggccttcgctaaattctcacccgccatggcccaagaaaagacagaaggatggctgacagaggctgctaggatgtctacaaccctagagttgcatagcccagttctacaacattgcatgcgaatccttggtgagttcagaagctatctgcctctgctgacaaagctcggctcccttcacccccagtcacttaattgtcagtgtttgttgagagctctgggcttgggatccctacagactatcgagctgttgaccctgggccaattgcttacataccctctcttggagttcgccgatcgaattaatcaagtgtggcagaatgagaatgagagaattcacgctcaggagactatccgcaggttgcagagatactgggaggctcgccagctccggctgctcaactttatcctccacgtcccctacgaacctcctgccagtgagcgtagtaaaagacaggttctgaggtcaccccagtgggaggtggtcgacaaagattctggcaccttcatcctatctgattactcaaacttgcaagactctattcaggagtccctccaggtcctcagcaagattctcgccatagagaaaagcggcgatctgaataagattgccctcgagtgggtggccatcatgcacgggttgggtgccctactggaagtgtggctgacattccagcaaaagtggatttttctgaataaggtactgcatgagatgaagatccagtttccaaatgccgacctgaacagtcgcttcaaagtgatggatgaccagtacaggaccctcatgcggatctctgtggccgaccctatggtgctctctctcgtggtccctagcgcagaaaggtcaccgtattttcaaggccaacagctgcagcaactgctgcaagcaggttctgtcgaactggagggtataattatgagtctggaatccgtgctctatggcgtgtgtgctcacttcccgcgcctgtttttcctcagcgactcagagcttgtcgctttgctggccgctagactggagagttgcgaagctcagttatgggttcggcgttgttttcctcacgtacatgctgtttccttccggtcttgcccaaccggcgagaagaacacagatgactgggagtccagcccaaatactcagacacaagtagaagctctcgcagtcctgggcgccggaggcgaagaagtcaagctgcaggggccattgccattgcatccggatctgcccaaatggctggctagccttgagaagtgccttcgcctcgccctggttcacatgctgcagggctgtgtggctgcccgcttggcccgtgggcccagtctcggggaagcccttaagcaactgcctaagcaaaacaagctgtacctccagttatacgtccaacactggattgatctggtacaagccttcccgtggcaatgcgtgttggttgctgaggaagtagtttggagggctgagatggaggaggctctcctggagtggggaaccctggcaatggtatcaatgcacatgaggaaactcgaggtcttagtaaactttatgcgtgcccaacgcgcttcccagggaggtcaatccctgcccagcgtgaggcaaacttccctgttgtctgccctgctggttatggctgttacccacagggacattgcccaactcctggaacagcaccaggtgagtgacttgaccgatttccactgggtcagacagctgaaatatcacctggggtcccctcatatcattccaaaatctcccctgcaaagccttaagacgatagcatcatctgagccctctctgtccccagccgcctgctggatagacgtactcgggagatctttcctgtacaactacgagtatctgggcccacgcctcggtccattgccatctttactccctgaaaggcccgctctggttctgctcctggccttagaggaagtagcctgtggaacagttctcggccccaacggtgttggcaaaagggccatcgtgaacagccttgcacaagctctggggcggcagctggttatgctgccctgctctcctcagattgaagcccagtgtctgtcaaattatctcaatggcgccctgcagggtggagcctggctccttctggaaaaggtgcaccagctaccacccgggctactgagtgcactgggccagagactcggtgagttgcaccacctgtatgctcctttgtatcaagaagcttcgcggaatacgtcaacaatcgaccctacccagccccaactactcggctctagtttcttcgaaaagcaccacgtgtccgtgcgtctgggctacggttgtctcctggtattgagagccctcagttcagctgtccccgccaacctgcatctgctgctgagaccagtggcactggcactccctgacctgcggcaggttgcggaacttacgctgctcggggccggcatgcgggacgcctttcaaatggcgactaggctgagcaaatttttctccctggagagagagttggtgtcaggcccgctcccctgcaggctgccgttgttgaaacaaatactcgaggacaccatcagaacactgaatgtcaccaaggaagaacccaagtgtcagaagccacgatctctcgcggctatagaggaggccgccttattgagaagtccccttttctcgatattgaacggactacacctccataacttgagggggcttctttgcgcccttttcccatctgctagtcaggtgctggccgagccaatgacctataagctgatgaaacccttggttgtggaggagctgcaacaagtcggactggatccatcccctgatattcttggatccctggagcagttatctcaggcactcagccgcgctagcggcatactgttgctgggccctgcgggttctgggaaaaccacctgctggcacagcttgtttaagattcagaatcgccttgcagcaatggaagacacaagcactcagggctgccagcctgtggaaattacgcatctctaccccagcggcctgtcaccccaggaattcctcggttggttggaggggtcctgctggcaccacggcatattccccaaagtcctgcgcgcagccgggcagtgtaataacatgggccagaagcgacaaaccgaggaatcaattggtattcagcactggatcatttgcgatggggcctccaatggagcgtggctggactcaatcacttgccttctatctgagctcccacaacttagtttgccctctgggcagcagattgctcgaccccctggcacctttctactcatggaggtggctgatacaaccggcatttcacccactgttgtcggctgttgcgcccttgtgtggtgcggaggcgagcaaacttggcagtgcatcctttctgctctgatggcatctctgccctacgagtatcggcttcagcataggacggtagctgagttaaatcacatggcagaagtattggttcctgcgacacttcgattcctgacctgtcaaggggttagctcactgctccaggtccatggtcagcaagcagtctgcgccggtgtggccgaggtaactagcatggctaggattctccactcactgctggatcttcacctgagactcaaagaagaaaaagcccccggcccagaggacctgagctatagcgaccctgtggcccagtcattccggtcctccaagagtagcttcttgaatcgaagtcaggtagattccgacgacgtacctgacaagtgtagagaacatctcctggccgtgtcttcttttttattcgctcttatctggggctttggggcacaccttccaagtcgcttttggccaatttttgacaccttcataagggactccattagcaggctctctaattaccctgagccacccccatctgcgctcgtgtttgaccttcacgtttctccagaggacggaacactggtgcccttcactggccagtacctcagcagccatataaaaggcactttggggacatttcatccatcaattcagaccgaaaggcttttatatgtcgtcgacttgcttctttccggcggccagcccgtcctcctcgctggcgaagcggcaaccggtaaatccgctttcgtggaagtgctggtagagccgcatcatccctatatttatagcccaattcatcccgctttttcgtcctcacacttgcgactcttgctttcgaggggtatccagggacagactcaagcgtccccccagcctggtcaccaccaagatagtaaacctagcctgttgtttcttctcgaagaccttcatctagccaccagcgacccagagaaatcctgccaaccagtgctcgagactttaaggcaggccatggatggaacagtgtacgcccactccactctagagctgcagaccctccagcccacggtgaatttcctcgccaccgtgaccgttccaggctattgtgaaagacccctgtgcccacgactcttccgcttgttcactgtgctggcactcgagagcatgacacaggccaccctcctagaacgccatgttcctataatccaggcctggctggagcggtttcccagtgtcgagcgagaacgcgcccttgccaggggattagtccgtgcctctgtcgaggcctgggaggcagtttgtaattgttttatgccatctcccctccatccacactatcactttagcctacactctgtctcacatctgctgtcatcactgcaactgctcccaaaccgaacaggaagtcgggggttcgtcgattacccgaaccatcaagagcatttacgcagagttagtggcctgcgaggcacctgtctgaccgtgatgatggccacacgcaacgtcgtgaggctgtggctgcatgaggcccagagaaccttttgcgatcggctcgacagccccagggaaagatcatactgcgcgaaattactgctggtcgtcgcacagtctgtattttgttgcgggcccggccctcagcacttgggcaaggaccatcaggagtcggaggaagaggaagaggaggagcgggtgccagaagtggaaagcgaaggagagcttgctcagtgggaggacttcagtaacagtaactccgaaaccgaggaagaggaggagccctacggcctgcaggtggccagggtctctaatagtcgggatcccagtcttacaccttctataggacccgtgagtaggggaatgaaggaaagtatttcgcacaagatcaggcaggaaaaagggacaagagcaagtaactataggctccaagtgaggcggagctttaaaacatggtggcagaagaagcctcaaatggatctgatcagccccctcctgttacccgttctgcttcttcacccccaggaaaagccgtccgatttggtcttttcacaggaactgattctgggcccgaactcagagactccaaatctctacctggaacgccagtgggagaaattggaagagcagctggctacaagcgcagcccagttaaagctgtctccccatttagcccgttgccattcaatggcgcagcatgtagctcggttagtgcgtgtcctcgctcggccgagacagcacgggctacttctgagcggtgccctgggaacaggtaggcatactgctataaccttggctagctccatctgtcaagcccattttttccacctgccctccgggtccgaagaggccatcctgcagtgcctgcgtgatgccagctggcatgccggcatgctcagccaacctgtcgcacttctagtaccatccggcgttgatctgaccacacttcaccgcttattagccttagcgactagcggctcattccccggtcagtacactgaggcagacttggaccgcatcggagagcacttgcccagagagaacctgggggtgaagcagaatatcaaaaaggaaatggtcctgcaacgttttcatcagcaggtgtgtagccatctacatctctttttcttgataggtgataaacaggcccataaacaattgccatccactctgttcctgaggctcctccagctggccaccgcatcaatcgatcgttatgagccctgggatcaagctgctctcgcgaaggttgcccagcatcacctggaaggtgcccaaagtgtacctctggacgatggaagctggaagtaccctgatttacaggcatccatacccagcgttgccaaggctatggctttgattcacttatccgctacacactaccacgaacacttgtgtccggcattgcccctggttacccctaagacattcctcgacttcctggacactttcttgatgctgcagcaacagacaatcctgaagatcaaaaataaagcacagcgggtacagaatgccctcgagaatctacgaatgctgatcaaggagcacggcactcacgccaatctgatcttcgaccttgaacaacaactgaaggactctggcaaatctctgagcatgtttcaacagcaattagagcagagcaaattgctgtataaacagcagctggaagagtgtcgtcatcaggaaaatttgatcgaaaatctagcccgtcagcgggacgctctgcaggctcagcgcgaagcatttctggagcagatgtctaaggcttttctcgaacccctgtcccagttacaggtggctgacttcgaggaaatccgctcctatcgggccccccctgaatctgtggtgcgggtcacagacgctatgtgcgacctgttccaccatgagactgggtgggcttctgctaagcagttactatgcaccgaggatttttaccaagaattagtgttcttccctaaagagaagatcaccgattccgaattgatcaagctgcacttgatcctgaaggcacccgggatggatgacgctgctctcagagcagtgagcagaccagcggcctcactggcagcatggctgtgggctgtgcttcattacggactggcccactgccgtggattgcctactgacctcctcttacagcaggtcgaagccactctgacccgagaacaagcccgtttagggtattatcaatttcaggcccaggagactttggagcataatcttgccttagcaaagatggtggaggatgcccaggcaagccacaattgcgtggcaaagacgctctcccaggcccagtgtgggcagtaccataaatggcccatgaaggctgcactgctgacacccatgagagcttggaccacacaactacagaagctcaagggcaggtgcatgaccgtctttggcgatactctcctgtgttcggccgctatcatttaccttgggccattcccccctcttcgcagacaggaactgctcgatgaatggctggctctctgtaggggcttccaggaggctctcgggccagacgacgttgctcaagctttgaaaagaaagcaaaaaagcgtctcaattcctccgaaaaaccctttgctggccacacattccccgttcagcatcctctcgctcctcagtagcgagtcagagcaataccagtgggacggaaacctaaaaccacaagctaaaagcgcacatctggcgggtctcctgctgcgtagcccaacacattatagttcctgcagatggccactacttcttgatccatctaatgaggcattgatttggctggatcccctccccctcgaggagaataggtccttcgctccagctctgaccgagggccgggggaaggggcttatgagaaaccagaagagggaatctaagactgacatgaaggaggaggatgatgagagtgaggaatctaacgaagccgaagatcagacgaaggaacagaaagccgaggaacggaaaaatgagcaagaaaaggaacaagaggaaaacgaagaaaaagaggaagaaaaaactgagagtcaaggctccaaacctgcctacgagacccagttgccgagtttgccatacctttcagttctttcgggtgccgaccccgaactgggttctcagttgcaggaggccgcagcgtgtgggctgccagtgctgctcactaacgtcgagctgggattgggctgtgaggaattgcaatggctcttgcaaagagagcagctcagccctcctcaagtccagcctgggttttgtctctatctgtctacaacactgagtctgtgcgccatggaaaaggtcctaggctgtgagcttcttaaggggctgaacgtgcttgacttaggcctgaacatggaaattctggaggagcagatgctccacgagattctgtgtcgggaatacccagagctcgagaccaggtggcaagatctgaagattcgggctctggacacttgtaaggcagtggaagcagccgaggaaaggctgttgaccatgctcctctttcagaaccctaagaggcaaaaacccgcaaagtttctccgcaatattgtgcgggcccagggtaagctgtgccaactgcgcgcccattgtgaggagctcgaaggtcagaaattacaggaaatggtgctctgggcaccgtaccggccagtggtgtggcatggcatggccatggtgaaagccctgtcccagctgcagaacctccttcccctgttttgtatgtccccggagaactggttggctgtcacaaagcaggctctcgacagtatgaagccgcgggagattaatcacggggaggacctcgctagtcatctcctccagctcagagcacatctgacgaggcagttactgggttccacagtgaccgcgctcgggcttacacaggtgccccttgtcggagcgctgggagctcttgcactactgcaagcaacagggaaggcctctgaactggagaggctggcactgtggcccggtctcgctgcaagtccaagcacagttcattccaaacctgtctccgacgtcgctagacccgcctggctgggtcccaaagcgtggcatgagtgcgagatgctggagctgttgcccccatttgttggtctgtgtgcaagcttggccggtcattcttccgcttggcaggcgtacctgagtctgtcctccactgtgctgggccccgctccaggcccaggtcccgagcctctctctctgctgcaaaagctgatactttggagggtattgaggcccgaatgtttagctggcgcattagcagactttactacaagccttcttggacgccctctggatgagaacacatatgcccccactatgcccttcaagcattcccaggctacgcagcccatgctgatcctgttgcctcccccaggccatcctagtgcgacactacatcccttgacggttattcagaagctcgccgccaaatatcagcagggccaaaagcagctgcaggttatcgcattgggtagtgaggcctgggaccctgtgtcggtggttgtgagtaccctttctcaagctatgtatgagggccactggctagtcctcgacaattgtcacctcatgcctcactggcctaaggagctgttgcaactactcctcgaactactcggacgggccaaagtcgttgccgacctggaatccgaacagctgctagatcaaccggagagccgtaatgtcagcactgttcacagggacttccgactctggctcattgtgcccgctgaatcaagtgcttcgcttcccgcagtcctgactcagcattcaatgcctgtcttctggaaccagtccttggagttgggtcacgtgctaatcgatagcgtagagctagcgcagcaggtgctctacatgcaacctcccacccaggcattaccactcctgctactccacggactgctgcttcaccgccagttatatggcaccaggctacaggcacatcgcggcaggtggtcacaagtcacacttacccaggtcctgcagactcaggaccagttatgggcttcactatctaaccccagagccgctatgcaggagttagctgccagcgtgttttacggaggaccactgggtgacactgaggatagagaggcgctgatatccctcactcaggcctgtctgagtccatcttccgggagttgggtccagcctcataccccgcagagcctgctggctacactaatgcctctgccagaactgagggagctggacgctatggctgagtgcaaggcacagatgcatctgctacctagtccacccgaaccccgtttgtgcggtctgtccgaggggccccaagcatggctgctgcggagacaatcgagagccctgttgtctgccctgcagcggtcttctccagtctgggttccagagtccaggaggggtgcccaactggcagagcgccggctcagacagcgcttggttcaggtcaacaggaggctggagtccctccaggacttgctaacccatgttatacggcaggatgagagtgatgcaccatggtcggtgctgggtcccaacgcccgccgccccctagaaggagtgctggagactgaggcgctggaactgtcacagctggtgggaaccttgcagagggatctggattgcttacttcagcaacttaagggggcccccccttgtcccagccgccgctgtgctgccgtggctcacgctctgtggacaggaaggctcccgctgccatggaggccccatgctccggcaggtccacagcccccatggcattggctcagacagcttagtagacggggtcagctgctcgtacggtacctgggcgtcggtgcagacgcaagtagcgacgtcccagaaagggtgtttcatctttcagcgttccgccatccccgccgtttactcctcgcactaaggggggaagccgccttagatcagaacgttcctagttccaactttccgggaagtcgagggtccgtgtcgtcacagctgcagtataagaggcttgagatgaattcaaatcctttacattttcgggtggagaacggtcccaatcctaccgtgccagagcgcggattgcttctgatcgggcttcaggtacttcacgcagagtgggatccaatcgctggtgctctgcaggatagtccatcctcacagccttccccactgccgcccgtgtctattagtacccaggctcccggaacatccgatctacctgcccccgccgacttgaccgtgtatagctgtccggtctacatggggggccctctgggcacagctaaactacagtccagaaacatcgtcatgcatttaccgcttcccaccaagctgacccccaatacctgcgtccagagaagagttcacgtctgctcgcctcctctgtcttag

SEQ ID NO: 17624 - DNA, 390 bp, Artificial Sequence
  Description of Artificial Sequence: Synthetic coding sequence
atggtggccatggctgaggcagaggcgggagtagccgtggaggtcaggggtcttcctcccgccgtgcccgatgagctcttgaccttatatttcgagaacaggagacggagcgggggcggaccagtgttaagttggcagaggctcggatgcgggggggtcttaacgtttcgggagcctgcggatgccgagcgcgtccttgcccaagcagatcatgaacttcatggcgctcagcttagcttgcggccagccccaccccgggctcccgcccgactgttactccagggccttcccccaggcacaaccccgcagaggttagagcagcacgtgcaggctctcctgcgtgcatcaggactgccggtccagccctgttgcgccctggcttctccttag

SEQ ID NO: 17625 - DNA, 867 bp, Artificial Sequence
  Description of Artificial Sequence: Synthetic coding sequence
atggagagggagcctagtgcctccgaagcggcacctgcagctgcagccctgttcgcttggggcgccaacagctacggacagctcggcctgggacacaaagaggacgtgctactgccccagcaactgaacgatttctgcaagcctcggtcagtacggcggataaccggcgggggaggccacagcgcagttgtcacggacggcggcgatctgttcgtgtgcggactgaataaggacggacagctcggtctaggacacaccgaggatataccgtattttaccccttgcaaatctctgttcggatgccccattcaacaggtagcttgcgggtgggattttacgatcatgctcaccgagaacggacaagttttatcctgcggatctaacagcttcggtcagctcggagtcccccacggaccccggaggtgtgtggtcccgcaggccatcgaacttcataaagagaaagttgtgtgtatagcggcaggactccggcacgccgtggcggccacggcgagtggcatcgtgtttcaatggggtaccggcctcgcctcctgcggaaggcgtctgtgcccgggacagacattgcctctgtttttcacagctaaggaacctagtcgggtcacgggcttagaaaattccaaagccatgtgtgtcctggcggggagtgatcactcagccagtctgactgatgcgggggaggtctatgtctggggctcaaacaaacatggacagcttgcaaacgaggcagcctttctacccgtcccccagaaaattgaggctcattgttttcagaacgaaaaggtcacagctatttggtctgggtggactcaccttgtggctcagacagggcttctctggctccgtgcctag

SEQ ID NO: 17626 - DNA, 372 bp, Artificial Sequence
  Description of Artificial Sequence: Synthetic coding sequence
atgaatcggcgccgtaagttcctgctggcttccgtcctggccttacaaaatagtagctttatttaccctagctgtcaaaaatgcttcagtcgcatcattctcgtgtccaaaagatcaaattgccctaagtgcggttctaccggtgagagcgggaacgcaaactatagatataagctgagtctgaaagtggccgagtcaaacaaacttttcgttattactgtattcggctcctgtctcgataccttctttgggcttaccgctacgggtctacaccgatacattcaggatcccaataaaatacctgagaccctggacaatgatactactcagaaccttcttaccaaggcggtcgaaacatgcttcgtcggctag

SEQ ID NO: 17627 - DNA, 324 bp, Artificial Sequence
  Description of Artificial Sequence: Synthetic coding sequence
atgctgcgcctatacccaggacccatggttaccgaggctgaggggaagggaggcccagaaatggcaagtctaagctcctccgtagtgcctgtttctttcattagcactctgagggaatccgttctggaccctggagtgggcggtgaaggagcctcagacaagcagaggagtaagctgtcattgtctcattcgatgattccagcagcaaagatccatactgaactgtgcctgccggctttcttttctcccgccggcacacagagacggtttcagcagccacagcaccacttaaccctttctattatccacactgcagctcggtag

SEQ ID NO: 17628 - DNA, 1653 bp, Artificial Sequence
  Description of Artificial Sequence: Synthetic coding sequence
atggaaacagatctgaacagtcaagatcgaaaggacttggacaaattcatcaagttttttgcactgaaaaccgtgcaggtcattgttcaggctcggctgggagaaaagatttgcactcgttctagtagttcccctactggaagtgattggttcaacctggctattaaggatatcccggaagtaacgcatgaagctaagaaagcattggctggccagctgcctgcggtaggcaggagcatgtgtgtcgaaatttccctcaaaacctctgaaggtgactcaatggagctcgaaatttggtgcctggaaatgaacgagaagtgtgacaaggaaatcaaagtctcttacacagtatacaataggctgagcctgttgttaaaatcattgctggccataacacgcgtgaccccagcttatagactctcgagaaaacagggccatgagtacgtcatattgtatcgcatctactttggcgaagtccaattgagtggcctgggggaaggtttccaaaccgtgcgtgtcggtacggtcggcactcctgttgggaccatcacactgtcctgtgcctaccgaattaacctggccttcatgtccacgcggcagttcgagagaacacctcccatcatgggcattatcatcgaccactttgtggaccgtccatatccatcttcatcaccaatgcatccgtgcaactacaggacggctggagaggatacaggggtcatttacccatctgtggaagattctcaggaggtgtgcacaacttcatttagcacatctccgcctagccaatgtgttttcacagtgaccaaggcccacttccagacacccacccccgtggtcactgatactctgcgcgtaccaatggcgggactggcctttagtcaccagctgtcaagtagtcgactcagctaccagcctgccgccctcggggtcggaagtgccgatcttgcatatcctgtggtgttcgctgcagggcttaatgcaacacatccccatcagcttatggttcccggtaaagaaggaggtgtgccgctggccccgaaccaacccgtgcatgggacccaagccgatcaagagcggctcgccacgtgtactccctcggaccgcactcactgcgccgcaaccccctcgtctagcgaagacacggagacagtgagtaactcttccgaggggagggcttctccacatgacgtgcttgaaactatttttgtccgcaaagtaggagcatttgtcaataaacccatcaaccaggtcactctcacgtcactggacatcccctttgcgatgtttgcccctaagaacctggagctggaggatacagatccaatggtcaacccgcccgattcaccagagactgaatcgccattgcaagggtctcttcattccgacggcagttctggtggaagttctggaaacacccacgacgattttgtcatgatcgacttcaagcccgctttcagtaaagatgacattctgcctatggatctgggaacattctatagagagtttcagaatccaccccaactgtcgtcccttagtatcgatatcggcgcccagtcaatggccgaggatctcgattccctccccgagaagctcgctgtacatgaaaagaatgttagggagtttgacgccttcgtcgagacactgcagtag

SEQ ID NO: 17629 - DNA, 4104 bp, Artificial Sequence
  Description of Artificial Sequence: Synthetic coding sequence
atgggaaacagtgactcacagtacacacttcaaggatctaaaaatcactctaacacaataacgggcgccaagcagattccatgctctctgaaaattagaggcatccatgcgaaggaggaaaaatctttgcacggctggggtcacggcagcaacggcgcagggtacaagagccgttccctcgcacgcagctgcctgtcccacttcaaatcaaaccagccttatgcttcccgcctgggaggccctacttgcaaggtatctagaggcgtcgcttactccacacatcggacaaacgccccaggcaaggactttcagggaatttccgctgctttcagcaccgaaaacggttttcattcagttgggcacgaactcgccgacaatcacatcacctctagggactgcaatggacacctcctgaactgctacggtagaaacgagtccattgcttccaccccccctggggaggatcggaaatctccgcgcgtgttaatcaagaccttaggtaagctcgatgggtgtctcagggtagagtttcacaacggcgggaacccttctaaggtgcctgccgaggattgttcggagccagtccaactgctccggtactcccctacactggcctcggaaacttcccctgtcccagaagcccggaggggcagtagcgcggactccctgccaagccaccggcctagtccaaccgattcccgcctgcgctccagcaagggatcttcactgtccagtgagagcagttggtacgactcaccttgggggaacgcaggtgagttaagcgaagccgaagggagctttctggcccctggtatgcctgatccgagcttgcacgccagttttcctccaggggatgccaagaagccgtttaatcagagctctagcctatcctcccttagggagttgtacaaagacgctaacctgggctccctgtccccatccggaattaggctgtcagatgagtacatgggcacccatgcctcactctcgaaccgcgtgagctttgcatccgacatcgacgtgcctagcagggtcgcccacggcgatccaatacagtactccagctttactttgccttgccgaaagcccaaggcatttgtggaagacactgctaaaaaggattctctgaaggcaagaatgcggcgaatctcggactggactggtagcctttcccgcaagaaacggaagctccaggaaccacgatccaaggaaggatccgactactttgatagccgctctgatgggctgaacacagatgtgcagggctcctctcaggcgtcagccttcctgtggtctggggggagtacacagatccttagtcagagatccgagagtactcacgcgattgggtcagacccactccggcaaaacatctacgagaatttcatgagagagctggagatgtcgcggaccaatactgagaatattgaaacatccacagaaacagcagagtctagttctgagagtctgtctagcctcgaacagttagatctcctcttcgagaaagaacagggtgtcgtcaggaaagcaggatggctatttttcaagcccctagtaactgtacagaaggaacggaagctggaactggtcgcacgacgcaaatggaaacaatactgggttacactgaagggctgcaccctactgttttacgagacgtatggcaagaattcaatggaccagtcgtccgctccccgttgcgctctcttcgcagaggactcaatcgtgcagtctgttccggagcaccctaagaaagagaacgttttctgcttatcgaatagctttggcgatgtttatctctttcaagctacatctcagaccgatttagagaactgggtcacggccgtgcattctgcctgcgcaagcttgttcgccaaaaagcatggcaaagaggacacactacggctcttgaagaaccagacaaaaaatctcttgcagaagatcgacatggacagcaagatgaaaaaaatggcagaactgcaactgtctgttgtctctgacccaaagaaccggaaagctatcgagaatcagatccagcagtgggagcagaatctggaaaagttccacatggacctatttcgaatgcgttgttatctggcctccttacagggcggcgagcttcccaatcccaagagtctactggccgcagcgtcgagaccaagcaaattggcactggggcggttgggaatactatctgtctcatcgttccatgcgctggtatgctctcgcgacgattccgcattaagaaaacgcactctgtccctcactcagcgtggccgaaataagaagggaatttttagtagcctgaaaggcctagacacactggcccggaaggggaaggaaaagcggccgtctatcacacaggttgacgagctgctgcatatttacgggtccaccgtggatggagtccctcgcgacaatgcgtgggaaatccaaacatacgtgcacttccaggacaaccatggtgtgactgtggggatcaagcctgaacaccgtgtggaagacatcttgaccctggcatgtaagatgcgacagctggagccttctcactacgggctccagcttaggaaactggttgatgataacgtggaatattgcatcccagccccttacgaatatatgcaacagcaggtgtacgacgagatcgaggtatttccactaaatgtgtacgatgtccagttgaccaaaactggatccgtttgtgactttggtttcgccgtgaccgcacaggtggacgagcgccaacatttgtccaggatcttcatctccgacgtgctccctgacggtctagcatatggtgaaggattgaggaaggggaacgagattatgacattgaacggcgaggcagtatccgatctagatctcaagcaaatggaggccctctttagcgaaaaatcggtggggctcacgttaatagccaggccgcctgacacaaaggcaactctttgtacaagctggagcgactcagacctgttttcgcgagaccagaagtcgcttctaccaccccccaatcaatctcaattactcgaggaatttctggataactttaagaagaatacagccaacgacttctctaatgtcccagacataactacaggtctcaaacgctctcagaccgatggtacacttgatcaagtgtctcacagagaaaaaatggaacagacctttcgttccgctgaacagatcaccgctctgtgtcgttctttcaacgactctcaggctaatggaatggaaggccccagggaaaaccaggatccaccccccagaagccttgctaggcacctgagcgacgctgataggctgcgaaaggttattcaggaactggtcgacacggagaaatcttacgtgaaagatctctcttgccttttcgagctctacctagagccccttcagaacgaaacatttcttacccaagacgagatggaatcactttttgggtctctgccagaaatgcttgaattccaaaaagttttcctcgagactcttgaagatggcatatccgctagctcagatttcaataccctcgagaccccttctcagttcagaaaactcctgttctctctaggaggctcgttcctgtattacgcagatcattttaagctgtattcagggttttgcgccaaccatatcaaggtacagaaggtgttggagcgggccaaaaccgataaggctttcaaggctttcctagacgctaggaatcctacgaagcagcacagctctaccctggagtcttatttgattaagccggttcaaagggtattgaagtaccccctccttttaaaggaactggtctccctgacggatcaggagtccgaggagcattatcatctgaccgaggcgttaaaggctatggagaaagtcgcctcacacatcaacgaaatgcagaagatatatgaggattatggcacagtgtttgaccagctggtcgctgaacagagcgggaccgagaaagaagtcaccgaactctccatgggtgaactactgatgcactcaacagtttcatggctcaacccttttctctccctgggaaaagcacggaaggatctggagttgaccgtgttcgtattcaagcgcgccgtaatcttggtgtacaaagagaactgctag

SEQ ID NO: 17630 - DNA, 45 bp, Artificial Sequence
  Description of Artificial Sequence: Synthetic coding sequence
atgaatgggacacttgaccaccctgaccagcccgacctcgactag

SEQ ID NO: 17631 - DNA, 519 bp, Artificial Sequence
  Description of Artificial Sequence: Synthetic coding sequence
atggtagctatggctgaagcggaagccggtgttgctgtggaggtcaggggcctgccccctgccgttccggatgaactgctgaccctctacttcgagaatagaaggagatctggagggggccctgtgctatcttggcagcggcttggctgcggcggcgtcctaaccttccgagagccagccgacgcagagcgagtgctggctcaggcagaccatgaactccatggggctcagctttcgttacggcctgccccgcctcgtgcccccgctaggctgctccttcagggacttcctcctggtacgacccctcagaggctggagcaacatgtacaagcactactccgggcaagtgggttgcctgtccagccttgttgcgcacttgcctccccacgcccagaccgggcccttgtccagctgcccaagccgctaagtgaggctgatgtccgggtgctggaggagcaagcccagaatctgggcttagagggaacactggtttctctggcccgggtgccgcaggcttag

SEQ ID NO: 17632 - DNA, 27 bp, Artificial Sequence
  Description of Artificial Sequence: Synthetic coding sequence
atgttttggaagtttgaccttcactag

SEQ ID NO: 17633 - DNA, 411 bp, Artificial Sequence
  Description of Artificial Sequence: Synthetic coding sequence
atggttgccatggccgaggccgaagccggcgttgccgtcgaggtgcgcgggctccctccagccgtccctgacgaactgctgaccctttactttgagaatagacggcgctccggggggggaccagtgttatcctggcagagactggggtgtggcggggtgctgacctttagggagccagctgacgctgagagggtcctggctcaggcagatcacgagctgcatggcgctcaactcagcttgagacctgccccaccgagagcaccagcacgcttgctgcttcagggtctgccccccgggaccaccccccagcggctcgaacagcacgtgcaggcacttctgcgggcatccggactccctgttcagccatgctgtgccttagcaagtcctcgccctgatcgtgcactcgtgtag

SEQ ID NO: 17634 - DNA, 5844 bp, Artificial Sequence
  Description of Artificial Sequence: Synthetic coding sequence
ggcaggcccatcgaccccagggaaggtccgggtaggccacccctggatggtagagatcattttggcagaccccctgtggacatacgcgagaatttagtaaggcctggtatcgaccacctgggtagaagagatcacttcggatttaatccagaaaagccatgggggcaccgcggggactttgatgagcgcgagcatcgcgtcctgccagtttatggcggccctaagggactgcacgaagagcggggcaggtttagatcgggcaattaccgctttgaccccagaagcgggccttggaatcggggattcgggcaggaggttcaccgcgactttgatgaccggagacgaccgtgggagcgccagcgggatagagatgaccgcgactttgacttttgtagagagatgaatggtaaccggctaggccgggacaggatccaaaatacctgggtgccccccccccacgcgagagtgttcgactatttcgagggcgcaacctctcagcgcaaaggcgataacgtgccacaggtcaatggggagaatacagagcggcacgctcagccacccccaataccggtgcagaacgacccagaactatacgaaaaactgacttcgtcgaacgagattaacaaggaaaagtccgatacggtcgctgatattgaatccgaaccggtggtggaatcaaccgagactgaaggtacaccactaacctccttgacggctgagaccagacgccaggtgaagatgggcaactcagattcgcagtacacactgcagggttccaagaaccacagcaatacaataacaggggccaagcagattccctgctcactcaagatacgcggtattcatgcaaaggaagaaaagtctctccatggctggggccacgggagcaacggagctggatataaatccagaagcctagcaagatcatgtctctcgcattttaaaagcaaccagccatacgcgtcacggctaggagggccaacctgtaaagtttctcggggagttgcctatagcacccaccgaactaatgccccaggcaaggacttccaggggatcagtgcagcgttcagtacagaaaacggatttcacagcgttggccatgaacttgcagataaccacatcaccagtagggattgtaatgggcacttgctcaattgttacggccgtaatgagtctatagcatctacccctccaggcgaggatcgcaagtctccacgggtgctcataaaaaccctgggtaaactggacggatgccttcgcgtcgaatttcacaacggcgggaacccctctaaggtccctgctgaggactgctccgagcctgtgcaactgttgcggtatagccccacgctggcctcagaaacgtccccagtgccggaggccaggcgggggtcatccgccgattctctcccatcacatcgtccatctcctacagatagcaggctgcggtctagcaaggggagctctctttccagcgagtcttcctggtatgactcaccctggggcaatgctggagagctttccgaggcagaagggagcttcctggccccgggcatgcctgatccgtccctccacgccagctttccccccggtgacgcaaaaaagcctttcaaccagagctctagcctgtcctccttgcgagaactgtacaaggatgctaacttaggcagcctttccccaagcggaattaggctatccgacgagtatatggggactcatgcttctttgtcgaatagggtctctttcgcttcggatatcgacgtccctagccgggtggcccacggggacccgattcagtattcatcattcactttgccatgccgcaagcctaaggccttcgtggaagatacagctaaaaaagattctcttaaggcccgcatgcgacgcatatctgattggacagggtccctctctcggaaaaaaaggaagctgcaggagccccgatcaaaggagggatcagattattttgactcaaggagtgatggactcaacacggatgttcaaggctcttcccaggcctcggccttcctctggagcgggggaagcactcaaatactctctcaacgcagcgaatctacacacgccatcgggtccgacccactgcgccagaatatatacgagaacttcatgcgtgaattagaaatgagccgcaccaataccgagaacattgagacatctactgagactgccgagtcctcctccgagtcactgagcagcttagaacagttagacctcttattcgagaaagaacagggcgtcgtgcggaaagccggctggctcttttttaaaccactcgtgacggtgcagaaagaaagaaagctagagttggttgcccgtcgaaagtggaagcaatactgggttacacttaagggctgtactctgctgttttatgaaacctatggcaagaatagtatggaccagagctcagccccaaggtgcgcactgtttgccgaagactccattgtccagtcggtgcctgagcatccgaagaaagagaatgtgttttgccttagtaacagctttggtgatgtgtacctgttccaagctacttctcaaactgacttagaaaactgggtgaccgcggtccattctgcctgcgccagtttattcgctaagaaacatggcaaagaggatacactaagacttctgaagaaccaaacaaagaacctcctgcagaaaattgatatggattctaagatgaaaaagatggcagaactgcagctgtctgtcgtgagtgaccctaagaataggaaagccatcgagaatcaaatccaacagtgggagcagaacctggagaagttccacatggacctctttagaatgcgctgttatttggctagcctccaggggggggaactgccaaatcccaagagcctattggcggctgcctcgcgcccctccaaattggcacttgggcggctaggcatactcagcgtcagttcctttcacgcgctagtatgctcgagggacgattctgccctgcgaaagcgaactttgtcgctcacgcagcgaggtcggaataaaaagggaatcttttcttccttgaaagggttagatacactcgcccggaagggtaaggaaaaaaggccgtccataactcaggtcgatgagctccttcacatttatggatctacagtggacggggtacctagagacaacgcttgggagatccaaacctacgtgcatttccaggacaatcatggcgttaccgtcggaatcaagccggagcacagggtcgaagacatccttacactggcctgcaaaatgcggcagctggaaccgtctcattacggactgcagctccgtaagcttgtcgacgataacgtggagtattgcattcccgccccctatgagtacatgcagcagcaggtctatgatgagatcgaagtgttccccctgaatgtgtacgacgtccagcttaccaaaacgggcagtgtgtgtgactttgggttcgcggtcacagcccaagtcgatgagaggcagcacctgtcgcgaatcttcatctcggacgtgctgcccgacggccttgcttatggcgaaggcctccgaaaaggcaacgagatcatgaccctgaatggcgaagcagtgtcagacctcgatttgaagcagatggaggcactgtttagcgagaagtctgtggggttgacacttatcgcgagacccccggacaccaaggcaactctgtgtactagttggtctgactcggatctgttttctcgggaccagaaatcccttctccctcctcccaaccagagccagctgctggaggagttcctggataattttaagaagaatacggctaacgacttctcgaacgttcctgatattaccacgggcttgaaacgcagtcagacagatgggaccctcgaccaggtcagccatagagaaaaaatggaacagaccttccgcagcgctgagcagattactgccctctgtcggtcgtttaatgactcacaggccaacggaatggaagggccccgtgagaatcaggaccctccgccacgctcattggcacgtcatttgtccgatgctgatagactgagaaaagtgatccaggaactggtcgataccgagaaatcctatgttaaggacctgtcatgcctgttcgagctgtacctcgagccactccagaacgaaacatttctgacacaggatgagatggagtcactgtttggcagtctccccgagatgctcgagttccagaaggtattcctcgagactctggaggacggaatctccgcctccagtgattttaatacactggagacgcccagtcagttccgtaagctcctattttccctggggggatccttcctgtactacgcagatcacttcaagctgtatagcggcttttgtgccaaccatatcaaagtgcagaaggtattggagcgggccaaaacagataaggcattcaaagcattcttggatgcaagaaatccgaccaagcaacacagctccactctggaatcctacctcattaaaccagttcagagagtgctgaagtatccactgctcttgaaggaactggtgagcctcaccgatcaggagtctgaggaacactatcatttgaccgaggccctgaaggctatggagaaggtggctagtcacatcaatgaaatgcagaagatctacgaagactacggaacggtgtttgaccaactcgtggccgagcagagcggtactgagaaggaggtgaccgagctatcaatgggcgaactgcttatgcacagcaccgtgagctggttaaaccccttcttatccttgggaaaggctcgaaaagatctggaactgactgtgttcgtgttcaaaagagctgtgattcttgtgtataaagagaattgcaagctgaaaaagaaacttccttctaattcacgccctgcacacaattctaccgacttggatccttttaaatttcgttggttaattcctatcagcgccctacaggtaaggctcggaaatcccgctggtacggaaaataattctatctgggagctgattcacacaaaaagcgaaattgagggccggccagagactattttccaattgtgctgcagcgatagcgagtcaaaaacgaatatcgtgaaggttattcggtcaatcctcagggagaactttagaagacatattaaatgtgagcttcctcttgagaaaacctgcaaggatcgcctcgtgccactaaagaaccgggtgcctgttagtgccaagctggccagctccagatccttgaaggtgctcaaaaattcgtcatccaacgagtggacgggcgagaccggaaagggcacccttttagacagcgacgagggatctctatcttcgggcacccagagctcaggttgtccgacggctgagggtaggcaggacagcaagagtacctcgcccggaaaatatcctcaccccgggctggctgacttcgcagataatctaattaaagagtcagacattctcagcgatgaggacgacgatcatcggcagacagtcaaacaggggagcccgacgaaggatatcgaaatacagttccagagactgaggatatctgaggatcccgatgtgcatccggaagccgagcaacagcccggacccgagagtggggaggggcagaagggcggagagcagccaaagcttgttaggggtcacttttgcccaattaagagaaaagccaatagcacgaaaagggacagaggaactctgcttaaggcgcagatccgacatcagtcactggacagccagtcagaaaacgccaccatcgacctcaactccgttctggaacgggaattttcggtccagtcactcacttctgtcgtttctgaagagtgtttttacgagaccgagtcccacgggaaatcctag

SEQ ID NO: 17635 - DNA, 294 bp, Artificial Sequence
  Description of Artificial Sequence: Synthetic coding sequence
atggaggctgccgacgcatccaggtccaatgggtcatccccggaggccagagacgctagatccccttcgggcccctcggggagcttagagaacgggaccaaagctgatggcaaagacgctaaaaccactaacgggcatggaggcgaggctgctgagggtaaatctcttgggagcgcccttaaacccggagaaggtaggtccgccttgtttgccggcaacgagtggagaaggccaatcatccagttcgttgaatctggtgatgacaaaaacagcaactacttctctatggattag

SEQ ID NO: 17636 - DNA, 117 bp, Artificial Sequence
  Description of Artificial Sequence: Synthetic coding sequence
atggaggcggcagatgcttctagatctaatgggagctcccctgaagccagagatgcgaggtccccgagcggtccatccggttcactggaaaacggcaccaaggcggatgggaagtag

SEQ ID NO: 17637 - DNA, 1455 bp, Artificial Sequence
  Description of Artificial Sequence: Synthetic coding sequence
atggccattgggaagcggttggccactctgcctacaaaagagcagaagacacaacgcctgatatccgagttaagtctacttaatcataagctaccagccagagtctggttgccaaccgctggattcgaccatcatgtggtgcgggtaccacacacccaggccgtcgtgttgaactccaaggacaaggccccctacttgatttacgtggaggtcctagagtgcgaaaatttcgacactactagcgtgccagcacggattcctgagaacaggatcagaagcactaggagcgtggagaatttaccggagtgtggtattactcacgagcaacgtgcgggaagtttcagtaccgtcccgaactacgacaatgatgacgaagcttggtctgtcgacgacattggcgaattacaggttgagctccccgaggtgcacaccaactcttgtgataatatctcccagttcagcgtcgatagtatcacatctcaggagtccaaggaacccgtgttcatagcagcgggggacatccgccggcgactctcagagcaactggcccataccccgaccgcgtttaagcgcgaccctgaagatcctagcgccgtcgcactgaaggaaccatggcaagagaaggtacggcgcatccgggagggctcaccttatggccacttgcctaattggcgactactgtctgtcatagtgaagtgcggggatgatctcagacaagagctcctggctttccaagtcctcaagcagttacaaagcatttgggaacaggagagggttcctctgtggataaagccctataaaatcctcgtgatttctgccgatagtgggatgatcgaacctgtggtcaatgccgtgagcatccaccaagtgaagaagcaatctcagctgagtctgttggactatttcctacaggagcacggtagctacacaactgaggccttcttatccgcccagcgtaactttgtccaatcttgtgccggatactgcctggtgtgctacctgctgcaggtgaaagataggcataacggaaacatcttattagacgccgagggccatataattcacatcgacttcggttttatcctatctagtagccctcggaacctgggttttgaaacatccgccttcaagctgaccactgagtttgtggacgttatgggcggactggatggggatatgttcaactattacaagatgctgatgctccagggcttaattgcagcaaggaagcatatggataaggttgtgcagattgtggagatcatgcaacagggatctcagctgccctgctttcacgggagttctaccatcaggaacctcaaagaacgattccacatgtctatgacggaggaacagcttcagctgctcgtggagcaaatggttgacgggagtatgcgttcaatcacaaccaaactctatgacgggttccagtatttgacaaatggcataatgtag

SEQ ID NO: 17638 - DNA, 228 bp, Artificial Sequence
  Description of Artificial Sequence: Synthetic coding sequence
atggccattcccatcaccgtgttagattgtgatctgttactgtatggccggggacatagaacactagacagattcaaattggacgacgtgacagacgaatacctcatgagcatgtacgggttcccccgccagttcatttattacttggtggaactccttggggctaatttgtcaaggcctactcagcggtctagggcaatttccccagagacccaggtcctagcttag

SEQ ID NO: 17639 - DNA, 2754 bp, Artificial Sequence
  Description of Artificial Sequence: Synthetic coding sequence
atggacggcgccgctggcccaggcgacgggccagctagagaagccctgcagagtctatctcagcgtttgcgtgtgcaggaacaggagatggagctagtgaaggcagccctggccgaggctctacgcctccttcgcctgcaggtgccacctagtagtctacaaggcagcggcacacctgccccgcctggagattctcttgccgcgccccccggcctgccccccacttgtacacccagcctggtgtccagaggtacacagacagagaccgaagtcgagttgaagtcatcacctggacccccgggactcagcaatgggcctcctgctccacagggcgcatccgaggagccttcaggcacccagtcagagggaggcgggtccagctcttctggagcaggatctcctggcccccctggtatcctgcggcctctgcaacctccgcaacgtgccgacacaccccggagaaactccagctcgagcagtagcccgtcagagagaccacgccaaaagctcagtagaaaagcaatcagctccgctaatctgctggtgagaagcggctcaaccgaaagccgtggtggtaaagatcctctttcttccccggggggacctggatccagaagatcaaattacaacctggaagggatctcagtcaaaatgtttctccgcggacgcccaattaccatgtacatcccttctggaattaggagcttggaagagctcccttcagggccgcccccggagaccttatccctcgactgggtctacggctaccgaggaagggattctaggagcaacttgttcgtcctgcggtcgggcgaggttgtctacttcatcgcctgtgtggtggttctttaccggcccggaggaggcccagggggtccggggggcgggggacagagacactatcggggccacactgactgcgttagatgcctagctgttcatccggatggcgtacgggtggcatccggccagactgccggcgtggataaagacggtaaacctctgcagcccgtagtgcatatttgggattcagaaactttattaaagctccaagagatcgggctcggagcgttcgaaagaggagttggcgctctggctttcagcgcggccgaccagggggctttcctctgtgtcgttgatgactctaacgagcacatgttgagcgtatgggactgctcccgtggcatgaagttagcagagattaagtccactaacgattcagtgctggcagtgggcttcaatcccagagacagctcctgcatcgttacgtctgggaaaagccatgttcacttttggaattggagcggtggcgtaggggtgccaggaaacggcaccctcacaagaaagcagggggtgttcggaaaatataagaaacccaagtttatcccctgctttgtttttctgcccgacggtgacattctcacaggggatagtgagggcaacatcttaacctggggacgatctccttcagattctaaaacaccgggacgcggcggcgcgaaggaaacctacggaattgttgcacaagcccatgctcatgagggctccatctttgcactttgcctgagacgcgacggcactgtgctttctggaggcgggcgagatagacgtctagtccaatggggccccggactcgtcgccctgcaggaagcagagatccctgagcatttcggcgcggttcgcgccatagctgagggtttaggcagcgagctgttggttggtaccacgaagaacgcactgctgaggggcgacttggcacaggggttctctcccgtcatacagggccatacagacgagctgtggggcctgtgtacgcaccctagccagaataggtttctgacctgtggacacgatcgccaactttgcctctgggacggcgaatcccacgcactggcctggtctattgacctgaaagaaacaggtctctgtgcggactttcacccgtcgggagcagtggtcgctgttgggttgaatactggacgctggcttgttctggacaccgagacgcgggagatcgtctctgacgtgattgatggaaatgagcagctgagcgtggtgcgatatagccccgacgggctttacctagcaatcggctcccacgataacgtgatctatatttatagcgtctcctccgatggagcgaaaagttcccgctttggtagatgcatggggcacagcagttttataacacatttggattggtccaaggacggtaacttcattatgagtaatagcggggactacgaaatcctgtactgggatgtggcaggcggatgcaagcagctcaagaacaggtatgaatccagggatcgtgagtgggcgacatatacatgcgtgctcggattccacgtttacgtacccgtacgctcttgccagggagcagaaccacacgtgagaggcccaagacagccccgggatcagaggcctatccatgcacgaagacttgctccacgcctcgctggtcggcagggccggcagcatctccccgtggccagtgccggccggtggggacggggagccggagccagacatgcactgagcaaccctcttcccgtgccccggctgctgcccaggcgcctgattgccgcctggcgagatcggctcgcaaggcgcaggggaccagcaccaccctgcccttccctggcccagtcgcctacaactagaggtcggctgtttcctgggctgacctcaaggcactcccgaagccgcatctttctagagggagcaaatggggcgcctgcccacaccgtatag

SEQ ID NO: 17640 - DNA, 321 bp, Artificial Sequence
  Description of Artificial Sequence: Synthetic coding sequence
atggtcgctatggctgaggccgaggccggcgtagctgtcgaggtcagaggcctgcctcctgcagtacccgacgaacttctaaccttatatttcgaaaatcggaggcggagcggcggaggtccagtgctctcctggcaacggctaggatgtggtggagtgctaaccttccgtgagcctgcggacgccgaaagggtactggcgcaggcagatcacgaacttcatggagcacagctctccctccgcccggcgcctcctcgcgcccccgcccgtctactactgcagggtcttccaccaggcactactcctcaacggcttgagtag

SEQ ID NO: 17641 - DNA, 228 bp, Artificial Sequence
  Description of Artificial Sequence: Synthetic coding sequence
atgttttggaagttcgatttgcattccagtagtcatatcgacactctgctggagcgcgaggatgtgacactgaaggagttgatggacgaggaggatgtgctacaagagtgcaaagcccaaaatcgcaagttaattgaattcctactaaaggctgagtgtctggaagatcttgtgagcttcatcatcgaggagcctccccaagacatggacgaaaaaattcggtattag

SEQ ID NO: 17642 - DNA, 1275 bp, Artificial Sequence
  Description of Artificial Sequence: Synthetic coding sequence
atggaccagcctagcggccgtagcttcatgcaagtgttgtgcgagaaatacagccctgaaaactttccatataggcgaggaccaggaatgggagtgcatgtgccagccacccctcaaggatctcctatgaaagatcgcctaaatctgcctagtgtccttgtgctgaatagctgcggcattacctgcgctggggacgagaaggagatcgcagccttttgtgctcatgtgtcagagctagatctgtccgacaataagctggaggattggcacgaagttagtaaaatagtgtctaacgtgccgcagctggagttcctgaatctctccagcaatccacttaacctgagtgtgttggaacggacgtgcgccggaagtttctctggtgtgcggaagcttgttttgaacaactccaaggcctcatgggaaaccgtgcatatgatcttacaggagctccccgacctcgaagaactttttctctgcctgaacgactacgagaccgtgagctgcccctccatctgttgtcactctcttaagctgctgcatatcaccgacaacaatctgcaagattggaccgaaattcggaaattgggcgtgatgttccccagtctcgataccctcgtgctagctaacaaccacctaaacgccatcgaggaaccagatgactctcttgccagactctttccaaatctgcgatccattagtctgcataaaagcggtctacagtcatgggaagatattgacaaactcaattcattccctaaactggaagaggtaaggcttctcggtatccctctgctgcagccttacacaacagaggaacggcgcaagctggtgattgcaagactccccagcgtgagcaaactgaacggcagtgtcgtcactgacggggagcgtgaagatagcgaacgctttttcatcagatattatgtagatgtaccccaggaggaggtccccttccgctaccatgagctgataacaaagtacggaaagttggagcctctggctgaggtggacctgcggccacagtctagcgctaaagtggaggttcatttcaatgaccaggtggaagaaatgtctattaggttagaccaaaccgtagccgagctgaagaaacagcttaagactttggtgcagctgccaacttcgaacatgcttctgtattatttcgatcatgaggctccatttggtcccgaggagatgaaatattcttccagagccctgcactcatttggaattcgagacggcgacaagatctacgttgaaagtaagactaagtag

SEQ ID NO: 17643 - DNA, 288 bp, Artificial Sequence
  Description of Artificial Sequence: Synthetic coding sequence
atggaagctgccgatgctagtcggagtaacggatcctctccagaagccagggacgctagaagcccttcaggccccagcgggagtttagagaatggaaccaaagccgacggaaaagatgcgaaaacaacaaacggccatggaggcgaagccgccgaaggaaagagcttaggatccgccctcaagcctggagagggaaggagcgctctttttgccggaaacgagtggcggcggcccatcattcagtttgtagaatctggcgatgacaagaacagcaactattttagttag

SEQ ID NO: 17644 - DNA, 3144 bp, Artificial Sequence
  Description of Artificial Sequence: Synthetic coding sequence
atggctcccaggcttcagctagaaaaggcagcctggaggtgggcagaaaccgtccggcctgaggaagtgagccaggagcacatcgaaacagcataccggatctggttggagccctgcataaggggggtgtgccgcaggaattgcaaaggcaacccaaactgcctggttgggataggagagcacatatggctgggtgagatcgacgaaaatagcttccacaacattgacgatcccaactgcgagaggcgcaagaaaaactcgttcgtcggcttaacaaacctgggagccacctgctatgtgaatacattcctgcaagtgtggtttctcaacctggaattgagacaagcattgtacctctgtcctagtacctgttccgattatatgcttggggacggaattcaggaggagaaagattacgaaccgcagacgatctgtgaacacctgcagtatctcttcgctctgctgcaaaattctaatcgcagatacatcgatccatcaggatttgttaaggccctgggcttggacacagggcagcaacaggatgcacaggagttcagcaagttgtttatgtccttgctagaagacacactctcgaaacagaagaaccctgatgtccgcaacattgttcagcagcagttttgtggcgaatatgcttatgtaaccgtatgcaatcaatgcgggcgcgaatctaaattacttagtaagttctatgagctcgagctgaacatacaagggcacaaacagctgaccgactgcatcagcgaattcctgaaagaagaaaaactcgaaggcgacaatcgctatttctgtgagaattgtcagtccaaacaaaacgcgactcgtaagatccgtctgctttctctaccttgcaccttaaacttgcagctgatgaggtttgtgttcgacagacagaccgggcacaaaaagaagcttaacacatatataggcttctctgagatcctggacatggagccttatgtcgaacacaagggcgggtcttatgtgtatgagctctctgccgttctcatacaccggggcgtgtccgcttattctggccattatatcgcccatgtaaaagatccacagtccggggaatggtacaagtttaatgatgaggatatcgaaaaaatggagggaaagaaactgcaactaggcattgaagaggacctcgagccatctaagagccagacccgcaagccaaagtgcggtaaagggacacactgttcccgcaatgcctatatgctcgtgtatcggcttcaaacccaggagaagcctaacacaaccgtgcaggttcccgccttcttacaggagttggtggatcgagataactctaaatttgaagagtggtgtatagagatggcagagatgcgcaaacagagtgtggacaagggaaaagccaaacacgaggaggtgaaggaactttatcaacgtctgcctgccggcgctgaaccttatgagttcgtgagcctggagtggctccagaaatggctggacgaatccacacctaccaaacctatcgataaccatgcatgcctgtgctcgcacgataagctccaccccgataagattagtataatgaagagaatctctgaatacgcagctgatattttctacagccgatacggtggaggcccccggctgacggtcaaggccctgtgcaaagagtgcgtcgttgagcggtgtcgcattctgcggctcaagaatcagctgaacgaggactataaaaccgtgaacaacctgcttaaggccgctgtgaagggatctgacgggttctgggtcggcaaatcgtcactcagaagctggcggcagctggctctggagcagctggatgagcaagacggcgacgctgaacagtcgaacggcaaaatgaacgggtcaacactgaataaagacgaaagtaaggaggaaaggaaggaggaggaagaattgaactttaacgaggatatcctttgcccacacgccgtgttcttcttttctaaatacattttcttgaattcaggagagctgtgtatctccgagaacgagaggcggctcgtgagcaaggaggcttggtctaagctgcagcaatattttcctaaagctcccgagttcccaagttacaaggagtgttgctctcagtgcaaaattcttgagagagaaggagaagaaaacgaggccctccataaaatgatcgctaacgagcagaaaaccagcctgcccaacctgttccaggataagaaccgaccctgtctttctaattggccggaggacactgatgttctgtacatcgtgagccaattctttgttgaagaatggagaaagttcgtaaggaagccgacacggtgcagcccggtcagctcagtgggaaactccgcgctcctctgcccccacggcggactgatgttcacttttgcttccatgaccaaagaggactccaagcttatagccctgatatggcctagtgaatggcagatgatccagaagcttttcgtcgtcgatcacgtaattaaaataacacggatcgaagtgggcgacgtgaaccctagcgagacccagtatatatcggagcccaaattatgcccggaatgcagagaggggctgctgtgccaacaacagcgagacctgcgcgagtatacgcaggcaacaatctatgttcacaaggtggtggataacaagaaggtaatgaaagacagcgccccagagctgaacgtttcaagttcagagaccgaggaggacaaagaggaggcgaagcccgacggagagaaagatcctgacttcaaccagtcaaacggcggcacgaagagacagaaaatcagccaccaaaattatatcgcctaccagaaacaggtaatccgcagatcaatgagacacagaaaagtaaggggtgagaaagcattgctggtatccgccaatcagacattaaaggaattgaagattcagatcatgcatgccttttccgtcgccccttttgaccagaatctgtctatcgatgggaaaatcctgagtgatgattgcgctactctagggacacttggagttattccagagtctgtgattctgttaaaagccgatgagcctattgccgattacgctgccatggacgacgttatgcaggtgtgcatgccagaggaggggtttaaggggacaggtctgcttgggcattag

SEQ ID NO: 17645 - DNA, 1443 bp, Artificial Sequence
  Description of Artificial Sequence: Synthetic coding sequence
atggagacagacctcaactcacaagaccgcaaagatctggacaaattcattaaatttttcgcactcaaaactgttcaggtcattgtgcaggcccggctgggcgagaagatatgtacgagatcctctagttcccctactggcagtgactggttcaacctggccatcaaagacattccagaggtaactcacgaagccaaaaaggctctagcaggacagttacctgccgtcgggcgatccatgtgcgtcgaaattagcctgaaaacctctgaaggggacagtatggagttggagatctggtgtctcgaaatgaacgaaaagtgtgataaggagattaaggtcagttataccgtctataatcgcctctccttactccttaagtcactcctggccattacaagagtcacgcctgcgtatcgtctctcccgcaagcagggccatgagtacgtgatcctatatcgtatatacttcggggaggtacagctcagtggtctaggcgaggggttccagactgtgcgggtcgggactgtgggaacgccagtgggcactatcactctcagctgcgcctatcgcatcaacctggccttcatgtccacccggcagttcgagcgtacgccacctatcatgggtataataatagaccactttgttgacagaccgtatccctcgtctagcccgatgcacccttgtaactacagaaccgcgggggaggatacaggcgtgatttacccgtccgtggaagacagccaggaagtgtgtaccacgtccttctccacgtcccctccaagccaattgatggtgcctggaaaagaggggggcgtcccattagctcccaaccagccagtgcatggcacgcaagctgatcaggaaaggctggctacttgcactccgagcgacagaacccactgtgccgcaacaccctctagctctgaggacaccgaaaccgtcagtaacagtagcgaggggcgagcctcacctcacgacgttctcgagaccatcttcgttcgcaaggtgggcgcgtttgtgaacaagcccattaatcaggtgaccctaacgagcttggacatcccatttgcgatgtttgctcccaagaatctcgagctggaggatactgaccccatggttaacccacccgatagcccagagacagagtctcccctccaaggttcactgcactctgatggcagctctggcggcagcagcggcaatacccacgatgacttcgttatgatcgactttaaaccagcattcagtaaagatgacattctcccgatggatttaggcacattttaccgcgagttccagaatccgcctcagctctcttcccttagcatcgacatcggtgcacaatcaatggctgaagacttagactctctaccagagaagctggccgtacacgagaaaaatgtcagagagttcgacgcctttgtggaaactttacagtag

SEQ ID NO: 17646 - DNA, 2376 bp, Artificial Sequence
  Description of Artificial Sequence: Synthetic coding sequence
atgttctggaagtttgatttacacagttcgtcccacatagataccctgcttgagagagaggacgtgactctgaaagagctgatggacgaggaggacgtgctgcaggaatgcaaggctcagaataggaaactgatagagttcctgctcaaggccgagtgtctggaggacctggtgagtttcatcatcgaggagccacctcaggatatggatgagaaaattagatacaagtatcctaatatttcatgcgagctcctgacctctgacgtgtcacagatgaatgatcggctgggggaagacgagagcctcctgatgaagctttattccttcttgctcaatgatagtccgcttaaccctctgctggcctcatttttctccaaggtgctcagtattctgatctcccgaaagcccgaacaaattgtagacttcttaaaaaaaaagcacgattttgttgatctcattatcaagcatattgggacaagcgctattatggatcttctgctgcgcctactgacgtgtattgagcctcctcagcctagacaggatgttttaaactggctaaacgaggagaagattatacagagattagtggagatagttcacccatctcaggaggaggaccgccacagtaacgcgtcgcagtccctatgtgagattgtcagactctctagagaccaaatgctccaaatccagaatagcacagagcccgatcccctgctagccactctcgaaaaacaggagataatagaacaattattaagcaatatattccacaaggagaaaaatgagagcgctattgtgtcagccatccagatcttactcacattactggaaaccagacgccctacatttgaaggccacattgagatctgtccccccgggatgagccacagtgcatgttctgttaacaaatcggtcctggaggcaattaggggccgattgggcagtttccacgagctgctactggagccgcctaagaatatgttcttcaaatatacttggaataacttcctccatacccaggtggagatttgcatcgccctgattttagcctcccccttcgaaaatactgagaatgcaacaattacagatcaggactccactggtgacaatcttctgttaaaacacctgttccagaaatgtcagctcattgaacgcatcttggaggcgtgggagatgaatgagaaaaagcaagctgaaggtgggcgccggcacgggtatatgggccatctgacccgaattgccaattgcatcgtacacagcaccgataaaggacctaacagcgccctggtgcagcaactgatcaaggatctgccagacgaggtgagggagcgttgggagaccttctgcacatcttctctgggggagactaataagagaaacactgtggacttggccttctccgattaccagatgcagcagatgaccagcaattttatagaccagttcggtttcaacgacgaaaagttcgcagaccaggacgatattgggaatgtctctttcgaccgggtttccgatatcaatttcactttgaatactaacgagtcagggaatatcgccctgtttgaggcctgctgcaaggaacgaatccagcaatttgacgacggaggtagtgacgaggaggatatttgggaagagaagcacatcgcattcactcctgaatcccagcgaaggagttccagcggctcgaccgactctgaagagagcacggactctgaggaagaggacggtgccaagcaggatctctttgaaccttcgtcggctaacaccgaagacaaaatggaggtggatctgtccgaaccgccaaattggagcgctaacttcgatgttccaatggagaccactcatggcgcccccctggacagcgtgggaagtgatgtttggagcacggaagaacccatgcccaccaaggaaacaggctgggcctcttttagtgaatttacttcctccttgtctactaaagacagcctgcggtcaaactcacctgttgagatggaaacctccactgagccaatggatcctctgactccatcagctgccgcgctggcagtgcaaccagaagccgccggcagcgtggcgatggaagcttcctctgacggcgaggaggatgcggagtcgacagacaaggtcaccgaaactgtcatgaacggggggatgaaagagactctcagtctcaccgttgacgccaagacggagacagccgtgttcaaaagcgaggagggcaaactcagcacatctcaggatgccgcttgcaaggacgccgaggagtgtcctgaaacagcagaagctaaatgtgccgctccacgtccacctagctcctccccggaacagtccggggtcgaaatcccagctttacccggccagtggtctcagcagtag

SEQ ID NO: 17647 - DNA, 1500 bp, Artificial Sequence
  Description of Artificial Sequence: Synthetic coding sequence
atgtttggagacgcttccacaagtcttgtggtgcccgagaaggtgaaaacacccatgaagtcctcaaaaacggatctccaagggagtgccagcccgagcaaagttgaaggcgtccatacaccacggcaaaaacgctccacccctctgaaagagcggcagcttagtaagcctctcagcgaaaggacaaattcaagtgattctgaacgttcaccagatcttggtcattcaacccagataccccgcaaggtagtgtatgatcaactgaatcagattctggtctccgacgcagccttacccgaaaatgtcattctagttaatactacggattggcaaggacagtacgtggcagagttgctacaagatcaacgtaagcccgtggtttgcacttgtagcaccgtggaggtacaggcggtcctcagcgccctcttgacacgcattcagcggtactgcaactgtaatagcagtatgccccgaccagtgaaagtagcagctgtgggcggtcagagctacctctcttctatactccgattctttgttaaatcactggccaacaaaacgagcgactggctgggctatatgaggttcctgattattcccctggggagccatcccgtcgctaagtacctggggtccgtggatagtaaatacagcagctcattcttagattccgggtggcgcgatcttttctcgcgttctgagcctccagtgtccgaacaactagatgtcgctgggagggtcatgcaatacgttaatggagccgctactacacaccaactgcctgtggccgaagccatgcttacctgcagacataaattcccggatgaagacagttaccagaaattcattccttttataggcgtggtgaaagtgggcctggtggaggatagtccgtcaaccgctggcgatggcgatgactctcccgtggtcagcctgacggtacctagtacaagcccgccctcaagctccggtctgtcccgagacgccaccgctactccccccagttcgccaagtatgtcctctgccctcgcaatcgtcgggagccccaacagtccctatggcgacgtgattggtctgcaagtggattactggctgggacatccaggagagcggagacgtgaaggcgacaagcgggatgcctcctctaagaacaccttaaagagcgtgtttcggagtgttcaagtgtctaggctgccgcattccggcgaggcgcagttgagtgggactatggctatgaccgtcgttacgaaagaaaagaacaaaaaggtgcccactatatttctgagtaagaagcctcgagaaaaggaggtcgattctaaatcccaagttattgaagggatttctagacttatctgctcagcaaagcaacagcagaccatgttgcgcgtctccattgacggcgtggaatggagtgacataaaatttttccagctggccgcacaatggcctactcacgtgaaacatttccctgtcgggctgttctctggctcaaaggcaacgtag

SEQ ID NO: 17648 - DNA, 435 bp, Artificial Sequence
  Description of Artificial Sequence: Synthetic coding sequence
atggtcgctatggccgaagccgaggccggagtggccgtcgaggtgagaggcctccctccagccgtcccagacgagttgctgaccctgtatttcgaaaataggaggcggtccggcggtggccccgtgctctcttggcagagactcggatgtggcggagtgctgaccttcagagaacccgccgatgctgagagggttttggcccaggctgatcacgagctgcacggggcccagctaagcctgcgtcctgcacccccccgcgctcccgctagactgctcctccagggcctaccccctggcactacgcctcaaaggttagaacagcatgtacaggcgctgctacgggcctccggtctaccggtgcaaccttgctgtgcattagcatctcctcggcctgaccgggccctggtgcaactccctaagcccctctctgagtag

SEQ ID NO: 17649 - DNA, 513 bp, Artificial Sequence
  Description of Artificial Sequence: Synthetic coding sequence
atggcctccgaagccgaaaaaacctttcatcgttttgctgcgttcggggagtcgtctagcagcggcactgaaatgaataacaagaacttctccaaactgtgtaaagactgtggaatcatggacggcaagactgtgacatctacagacgtggacattgttttttcgaaggtgaaggctaaaaacgcccggactattacatttcagcagtttaaggaggcagtgaaggaacttggtcagaaacgatttaaaggaaaatcacccgacgaggtcctggaaaatatttacgggctgatggaaggaaaagatcccgccactaccggcgctacaaaagctaccaccgtgggagctgtggataggctgacagatactagcaaatacacggggacccataaggaaagatttgacgagagcggcaagggtaagggaattgcgggtcgggaagagatgacagataacaccggatacgtatcgggctataagggaagcggcacctatgacaagaagacaaaatag

SEQ ID NO: 17650 - DNA, 270 bp, Artificial Sequence
  Description of Artificial Sequence: Synthetic coding sequence
atggtcgccatggccgaggctgaggctggggtggctgtcgaggtcagaggactccctcccgccgtacctgacgagttattgaccttatacttcgaaaataggcgccggagcgggggggggccagtacttagctggcaacgactcggatgcggaggtgtactgacttttcgcgaaccagccgatgcagagcgagtcctagcacaggcagatcacgaattacacggggcccagctttctctgaggccagcaccccctagagccccagcgtag

SEQ ID NO: 17651 - DNA, 1206 bp, Artificial Sequence
  Description of Artificial Sequence: Synthetic coding sequence
atgtgcgtggaaatcagcctcaagactagcgagggtgactctatggaactggagatttggtgtctcgagatgaacgagaaatgtgataaggaaatcaaggtcagctatacggtgtataaccgtctgagtctcctgctgaagagccttcttgccatcaccagagtcactcccgcttaccgtttgtcccggaagcagggacacgagtacgtgatcttgtacaggatctattttggggaggttcagctgtccggtctgggagagggctttcagactgtcagggtggggaccgttggaacaccagttgggacgataactttgagttgcgcctatcgaatcaacctcgcttttatgtctacaaggcagtttgaacggacaccccctattatgggcataataattgaccattttgtagatcgcccttatcccagctcaagcccgatgcacccttgtaactatcggacagccggtgaggacacgggagtcatttatccctctgtagaggacagccaagaggtctgtactactagcttcagtacaagcccaccatcacaactgatggttcccggtaaagagggaggcgtgccccttgctcctaatcagcccgtccatggtactcaggccgaccaggagcgactggccacctgtaccccgtccgacagaacccactgtgcggcgacacccagcagctcagaggacacagaaactgtgtccaactcaagcgaagggcgcgccagtcctcacgatgtcttagaaacaatctttgtccggaaagtcggagccttcgttaacaagcccatcaaccaggtaaccctgacttccctggatataccctttgccatgtttgctccaaaaaacctggagctggaggatactgatccaatggtgaacccgccagacagtcccgaaacagagagtccgctgcaaggaagccttcattcggatggctcttcgggcggatcgagtggaaacacacacgacgacttcgtgatgatagatttcaagcccgccttctcaaaggatgatatactgccaatggatcttggcactttttaccgggaatttcaaaacccaccacagctctcctccttgtcaatcgatatcggcgcccagtccatggctgaagacctcgactctctccccgagaagctggccgttcacgagaaaaatgtgagagaattcgacgcctttgtggaaaccctgcaatag

SEQ ID NO: 17652 - DNA, 2148 bp, Artificial Sequence
  Description of Artificial Sequence: Synthetic coding sequence
atgagtcaatcaggcgccgttagctgttgccctggggcaaccaatggctctctgggtcggagcgatggcgtggcaaagatgtcccccaaagacctgtttgagcagagaaaaaaatattctaactctaatgtcataatgcacgaaacgagccagtaccacgtgcagcacctcgccaccttcattatggacaagtccgaggctattacctcagtcgacgacgctattagaaagttggttcagttgtcaagcaaggaaaaaatctggacgcaagaaatgctcctccaagtgaacgatcagtctctgcgtctgttagatattgaatctcaggaagaacttgaggatttccctctgccaacggtgcagcgcagccaaaccgttctgaatcagctaagatatccaagtgtcctgctgctggtgtgccaggattccgagcaaagcaagccagatgtgcacttcttccactgcgatgaggtcgaggcggaacttgtgcacgaggacattgaatcagctctggccgactgtagacttggaaaaaaaatgcggccgcagactctgaaaggacatcaggagaagatccgacagaggcagagcatcttgccaccgcctcagggtccagctccaatcccattccagcatcgcgggggagactctccagaggctaaaaacagggttggtccccaggtgccactgtcagagcccgggtttaggcgccgcgagagccaggaagaacccagagccgtccttgcacaaaaaatcgaaaaagagacccaaattctcaactgcgcactggatgacatagagtggttcgttgcacggctccaaaaggctgcggaggcgttcaagcagctcaaccagcggaagaaaggcaagaaaaaaggcaaaaaagctccagccgagggggtattaaccctgagagctcggcccccatcggaaggagagttcatcgattgcttccagaagataaaattagccatcaatctcttggcaaagttgcagaaacacatccagaacccctccgccgcagaactggtacattttctatttggccccctggatctgatcgtcaatacctgtagtgggccggacatcgctagatcagtctcctgccctctgctcagtagagatgccgtggactttcttcggggccacttggtcccaaaagagatgtccctgtgggagtctttgggcgaaagttggatgcgccccagatccgaatggcctagggagccccaggtgccgctgtacgtgcctaagtttcattctggctgggagcccccggtcgatgttctgcaagaggccccatgggaggttgagggactggcttcagctcccattgaagaagtgagccctgtaagtaggcagtctataaggaactcccagaaacacagcccaacttcagagcctaccccacccggagatgccctgccccccgtatcctctccacacacccatcggggttatcagcctaccccagctatggcgaaatacgttaaaatcttatatgactttaccgcaagaaacgctaatgagctctcagtgctgaaggacgaggtcctggaagtgctggaggatggcaggcagtggtggaagctaagatctcgctccggccaggctggatatgtgccctgcaatattctgggagaagcccgaccagaagatgcaggggccccttttgaacaggccggtcagaagtactggggaccagccagccccacgcacaagctcccaccctcttttcccgggaataaggatgaactgatgcagcacatggatgaagttaatgatgagctcattcgcaaaatcagtaatattagggcacagcctcagcgtcattttcgcgtggagcgaagccagcctgtcagtcagcctcttacttacgaatcaggccctgatgaggtccgcgcgtggctggaggccaaggctttttccccccgcatagtggaaaatttagggatcctcactggtccgcagctctttagtctgaacaaagaagaactcaaaaaggtttgtggggaggaaggcgtgagagtgtactcccagctaactatgcagaaggcgtttttggaaaaacagcaaagtggtagtgagctcgaggaacttatgaataaatttcactcaatgaatcaaaggagaggagaggattcgtag

SEQ ID NO: 17653 - DNA, 336 bp, Artificial Sequence
  Description of Artificial Sequence: Synthetic coding sequence
atgaccggctccaacagccacattaccattttaaccctaaaggtattgccacatttcgagtccctcggtaagcaggagaagatccccaataagatgtcagcctttcgaaatcactgccctcatctggactccgtgggtgaaatcacaaaagaagatttaatccaaaagtctctggggacgtgccaggactgtaaggtgcagggccccaatctctgggcctgtctggagaacagatgcagctacgtgggctgcggcgagtcacaggtggatcattccaccattcattctcaggagacaaaacactacctcacggtgaatctgaccaccctgagatag

SEQ ID NO: 17654 - DNA, 228 bp, Artificial Sequence
  Description of Artificial Sequence: Synthetic coding sequence
atggctgggcaagaggaccctgtgcagagagaaattcatcaggactgggcaaacagagagtatatagaaattatcaccagttccatcaagaagattgctgactttttgaatagctttgacatgtcctgcagatcacgtttggctactctgaacgaaaaactaacagccctcgagagaagaatagagtatatcgaagcgcgggtgacaaaaggagaaacgctcacttag

SEQ ID NO: 17655 - DNA, 348 bp, Artificial Sequence
  Description of Artificial Sequence: Synthetic coding sequence
atgcggtacgttgcttcatacctactggccgccctgggcggcaactccagtccctctgcaaaagatatcaagaagattctcgacagcgtgggcatcgaggcggacgatgaccgcctcaacaaggtgatatccgagttgaacggaaaaaacatcgaagatgtcatagcgcaaggcatagggaagctcgccagcgtacctgcggggggcgctgtggccgtgagcgcagctcctggttccgctgcacctgccgcgggatccgcccccgccgcagccgaagagaaaaaagatgagaaaaaggaagaatccgaggaatccgatgacgacatgggctttggtctgtttgactag

SEQ ID NO: 17656 - DNA, 1077 bp, Artificial Sequence
  Description of Artificial Sequence: Synthetic coding sequence
atgcctggatgcgaactcccagtgggaacatgcccggatatgtgcccagcagcggagcgagcccaacgggagagggagcacaggttacataggctcgaagtggtccccggctgcaggcaggaccctcccagggccgaccctcagcgcgcagtgaaggagtatagcaggccagccgccgggaagcccagaccaccgccatctcagctgcgaccccccagtgtgttgctggctactgtgagatatctcgccggggaagtggccgagtccgctgacatcgctcgggccgaggtggccagctttgttgctgaccgcctgagggccgtgttgctggaccttgccctccagggggcgggcgacgccgaggcagctgtagtgctggaggctgcccttgccaccctgctgacagtcgttgcaagactcggcccagatgccgcacgcggccctgctgaccccgttctcctgcaagcccaggtgcaggaaggctttggctctctgaggcgatgctatgcccggggggctggcccacatcctaggcagccagcctttcagggtctttttcttctgtataacctgggcagtgtggaggcccttcatgaggtgctgcaacttccggctgcactgcgcgcctgccccccactccggaaggcgttggcggttgacgcggcctttcgggaaggtaatgcggcccggctttttcggctccttcagactcttccctacctcccaagttgtgccgtgcagtgtcatgtgggccatgcccggcgcgaagcgctggctagatttgcccgcgctttctcaacgcccaaaggtcagacgctgccactgggatttatggtgaacctgttggcattggacggcctcagggaggctcgggacctttgtcaggcccacggcctgccgttggatggtgaggagcgggtggtgttcctgagaggaagatatgtggaggagggtctgcctcccgctagtacgtgcaaagtgctggtggagtccaagcttcggggtcgcaccttagaggaagtagtaatggccgaggaagaggacgaaggaactgacagaccaggcagccccgcgtag

SEQ ID NO: 17657 - DNA, 4047 bp, Artificial Sequence
  Description of Artificial Sequence: Synthetic coding sequence
atggctgacaccgacctttttatggaatgcgaagaagaagaactggaaccatggcagaagatctcagacgttatcgaggacagcgttgtagaggactataatagcgtcgataaaacgacaactgcaggcaatcccctggtgcagcagggtgggcaacccctaatcctgacccaaaatccggctcccggactcgggacaatggtcactcagccggtccttagaccagtacaggtgatgcagaacgccaatcatgttacctcttcgccggttgccagccagccaattttcataacaacccagggtttccctgtgagaaatgtgcggcctgttcaaaatgctatgaatcaggtcggcatcgtgctcaatgtacagcagggccaaacagtgcgccctatcactcttgtcccagccccaggcacgcagtttgtcaagccaacagtgggtgtgcctcaggtgttctcccagatgaccccagtgcgtcccggctcgaccatgcctgtaagacctaccacgaacaccttcaccacggtgatacccgccaccttgactatccgatccaccgtgcctcagtctcagtctcagcaaaccaagtcgaccccctcgacctctacaacaccaacagcaactcagccaacaagcctgggacagctcgccgtgcagtccccaggccaaagcaaccagactactaatcccaaactggtgtccattgcttctttcgtgactgtaaagcgccccggcgtgactggtgagaactccaatgaggtggccaagctggtgaatacactcaacacaattccttccctgggccagtcaccgggcccagtggtcgtatccaataatagtagcgctcacggtagtcagcggacgagcggtcctgagagcagcatgaaagtgacctcatcgatccccgtttttgatctccaagacggggggcgcaagatatgcccgcgctgtaacgcccagttccgggtaaccgaggctctcagagggcatatgtgttattgctgtcccgaaatggttgagtaccagaagaagggaaagagcctagatagtgaacctagtgtcccttctgctgctaaacctccgagtcctgaaaaaacagcgcctgtcgcgtcaacgcccagcagtacaccaatcccagctttaagcccaccgaccaaagttccagaaccaaatgagaatgtgggagacgccgtacagaccaaacttatcatgctggtcgatgatttctattacggcagagacgggggaaaagttgcacagctcacgaattttcctaaagtcgccacatcctttcggtgcccccactgtaccaaacgcctcaagaacaatattcggttcatgaatcatatgaaacaccacgtggagttagatcaacaaaatggggaagtggacggtcacaccatatgccagcactgctacaggcaattttcaactcccttccagttacagtgtcatctcgagaacgttcactccccatacgaatcaaccactaagtgtaagatttgcgagtgggccttcgagtctgaaccactttttctgcagcatatgaaggacacccacaagccgggggaaatgccatacgtatgccaggtgtgtcagtacaggtcctctctctatagtgaagtcgatgtgcactttagaatgattcatgaagacacacgtcatctgctatgcccttattgcctcaaggtatttaaaaatgggaatgcatttcaacagcactatatgaggcaccagaaaagaaatgtctaccactgcaacaaatgtagattgcaattcctgtttgctaaagataaaatagaacacaaactgcaacaccacaagaccttccgcaagccgaaacaactagaaggcctgaagccaggcaccaaagtgacaattcgcgcatcacgcggccagccccgaaccgttcccgtgagcagcaatgacacccctccgtctgctctgcaggaggccgctcccctgacttccagcatggacccgctcccggtgttcctttatcctcctgtgcaaaggtctatccagaagcgtgccgtgagaaagatgtcagtgatggggagacagacatgcctggaatgcagttttgaaatccctgatttccctaatcatttcccaacctacgttcactgcagcctatgcagatattccacctgttgcagcagagcttacgcaaaccacatgatcaacaaccacgtgccaagaaagtcccctaagtatttggccctgttcaaaaatagcgtgtcgggcataaaactagcttgcacctcctgtacttttgtgacgtccgtgggggacgcaatggcgaagcatttggtttttaatccctctcaccggagtagctccatcttgccccggggattgacatggatcgcccacagccgccacgggcagaccagggatcgcgtgcacgaccggaacgttaagaacatgtacccgccaccttcttttcccaccaacaaggctgccactgtgaagtcagcaggtgctacgccagctgagcccgaggagcttctcacgccgctggctcctgcattacccagccccgcctcaacagccacccccccaccaacacccacccatccccaggctctcgccctgccacccctcgccacagagggtgccgaatgccttaatgtcgatgatcaggacgagggatctccagtaacccaagaaccagaacttgcatctggggggggtggctccggaggggtagggaagaaggagcagctgagcgtgaagaagcttagggtggtcctgttcgctctttgttgcaataccgagcaggccgcagagcatttcagaaatccccagagacgtatcagacgctggttaaggagattccaggcatcccagggggaaaatctggaaggtaaatatctctccttcgaggcagaagagaagttggcagaatgggtgctgacgcagagggagcagcaattgcccgtgaacgaggaaacactgtttcagaaagccactaagattggaaggtcactcgagggaggctttaagatcagctacgaatgggccgtgcgatttatgctgagacaccatctcacccctcacgccagaagggcagtagcccacacgcttcctaaagatgtagcagagaacgctggtctctttattgacttcgtgcaaaggcagatccataatcaagatctgcccctgtctatgattgtcgctattgacgagatcagtctgttcctggatactgaagtgttgagttccgatgaccgaaaggagaatgcactgcagaccgtcgggactggcgagccctggtgcgacgtggtgctggccattctcgcggacgggactgtgcttcccacactggtgttttaccggggtcaaatggaccagccagctaacatgcctgactcgattctgcttgaagcgaaagagagcgggtattctgacgatgagattatggaactttggtcaacgcgggtttggcagaagcacactgcatgccagcggagtaaaggcatgcttgtcatggattgtcaccggacacacctcagtgaggaggtgctggcaatgctatcagcaagctccacactgcctgcggtggttcctgccggctgttctagcaaaatacaacctcttgacgtgtgtatcaaacggactgtgaaaaatttcttacacaaaaaatggaaggagcaggccagggaaatggccgataccgcgtgtgactctgatgtcctgctgcagttagttctagtctggcttggagaagtcctaggagtgatcggggactgcccagaactcgtccagagaagcttcctcgtcgccagtgtgctgcccggccccgacggaaacatcaactcccctacaagaaacgccgacatgcaggaagagctcatagccagtctggaagagcagctgaaactttctggggagcattccgagtccagcacacctcggccgaggtcctctccagaagagacaatcgagcccgaaagtctccaccaactctttgagggggagagtgagacagaatccttctacggtttcgaagaggccgatttggatctcatggaaatttag

SEQ ID NO: 17658 - DNA, 561 bp, Artificial Sequence
  Description of Artificial Sequence: Synthetic coding sequence
atgttttggaaattcgatctacattcctctagccacattgacaccctgctcgagcgggaagacgtcacattgaaggagcttatggatgaggaagacgtactgcaggaatgcaaggcacagaatcgaaagctgattgaattcctgttgaaggcagaatgcttagaagatctagtctcttttatcatagaggagccccctcaggacatggatgagaaaatacggtataaataccctaatatttcttgcgagcttctcacgtcggacgtctcgcaaatgaacgacagactgggcgaagatgagtccctgctgatgaagctctattcattcttgctgaatgactctccgctgaatcccctgctggccagcttcttttccaaagtgctctctatcctgatttcccggaaaccagagcagattgtggacttcttgaagaagaaacacgactttgtggacctgatcattaagcacatcgggacaagtgcaatcatggacctcctgctgagactactgacgtgcatcgaaccaccgcagcctcgccaggatgttctgaattggctctag

SEQ ID NO: 17659 - DNA, 288 bp, Artificial Sequence
  Description of Artificial Sequence: Synthetic coding sequence
atgagtcagtccggggcggtttcttgctgtccaggggcgactaatggcagcctcggaagaagcgatggggtggctaagatgagccccaaagacctgtttgagcagagaaagaagtatagtaactcaaacgtgatcatgcacgagaccagtcaatatcacgtgcaacatctggccacctttatcatggataagagcgaggcaattacatcagtggacgacgctattcggaagctcgttcaactctcgtcgaaggaaaagatctggacacaagaaatgttgctccaatag

SEQ ID NO: 17660 - DNA, 1740 bp, Artificial Sequence
  Description of Artificial Sequence: Synthetic coding sequence
atggacgatagcaagcaggagagcactacatctaaagaagaggagacaaacattatctcgtcgatagttccttccacacaggacatttatcagcgtcagaacagttcagacgtgcataaaagtctgctgcccgcagtggatgagacaacctgtggtcatacacacttccaacagatgatcgacaaatatattaatgaggcaaatcttatacccgagaaaacagatctgcaggaacttgagcacatttttcccaatttacaccatcagctgtttaagcctttggagccccatcccgatttcgatctcagcagcagttctagcggtattagtcctgataaccgggatttttaccaacggtccgattcttcgtctgaatcgcactgtgccactggcttgtccaagtccacagtgtattttacagcactgcgccggactagtatgcactcttcgctgaacaccagccccaatcagcaacccgataccaaccttgcacacgtgggcgcacactcgtttgctaccgagaacattatcgggggctcggaacaatgctttgaacagcttcagccagagtatagtagccaggaggagagtcagcacgcggatctgccctcaattttttcgatcgaggcgagggacagctcacagggcatgaagaatcagaactatccgagtgaagagcacaccgagattctacagaacaaaaagaagatcgttcattttcagttaagtatcggaaatctctctagtgtgtattctagttccgacgaggccaatgtgtttgatcagctaaatgtgcagcatagcactccttgcggctccaacagcagtgagtgtagtactaagcatcagctggagtcccgcaaggagagtatgggctttgaggagctgtcaaaacgcggagtggtgaccatgctgcagtcacagggcctgatcgaagacaacaaaaacgagacatgcagggttctcgatattaaccctcaggtggaagaaaccgattctagactttgcgtccgcaccgtggaaatggggacctcaatacaagcgccatattctctgaccactcaaaatgagaaatattttgagaacagcgctgagactgatatccccaaaataacaaagaaactgagtcaactgggagagtctgagttattcgctagcagcggctcgttttcactgcagtcatcaattcccgtttgggagacggaaacaggacatggcatcatggaggagccagaactaacactcattagcacaacagataccagtatagcagagatggatttcgctaacctcactctagaggagaaatcggagaacgaggctaagtgcttttttcaggtgagcgagttcctgccgctggtgtctgccaccgaagctagcgattaccctgccgtcagtgagctcagtatcgaaaagccacgcaccgcctcgacagctgagacaccgcggcgccttaccccagtcccaggctcccttcaggaagccttcatcaaacgaaaaaagagctttatggaacgctctcatcagcgacagaaggagatcaggaacaagattcacgtgtccgagaattcccaaatcaagacagttaaagagaagccctctatctctagctccgtgtccagactgaaaggggtgaataaagtgcgcgcgtcatttccagaagataggaagactacccaggccctgaggcaccagcgcggtttgagactatacaatcagctggcggaagtgaagcaatag

SEQ ID NO: 17661 - DNA, 435 bp, Artificial Sequence
  Description of Artificial Sequence: Synthetic coding sequence
atggttgcaatggccgaggccgaggcaggtgtcgctgttgaggtaagggggctgccaccagctgtgcccgatgagctgttgaccttatattttgagaaccgtaggagaagcggcgggggccccgtgttgtcttggcaacgtctcggttgtgggggggtacttacattccgggaaccagccgacgctgagagagtgttggcccaagccgaccacgagctccatggcgcccagctaagcctcaggcccgcaccaccgcgtgcacctgcccggctcctccttcaggggcttccgccaggcactacaccccagcgattagagcaacatgtccaggcactcctcagagcttcaggcttacccgtacagccatgctgtgcgctggcgtcaccacgacccgaccgcgcactggtccagctccctaaaccactgtcagaatag

SEQ ID NO: 17662 - DNA, 246 bp, Artificial Sequence
  Description of Artificial Sequence: Synthetic coding sequence
atggtagccatggccgaggccgaggccggcgtggcagtggaggtgcgaggactgccaccagctgtcccagacgagctcctgacgctctattttgaaaacaggcggagaagcggcggagggcccgtgctaagctggcagcggctgggttgcgggggggtccttacttttcgggagccagctgacgctgagcgagtacttgcccaggctgatcatgaacttcacggagcccaactgagcctgaggtag

SEQ ID NO: 17663 - DNA, 1539 bp, Artificial Sequence
  Description of Artificial Sequence: Synthetic coding sequence
atggccgctttcaagttggatttcctaccagagatgatggtcgatcactgctctttaaattcatccccagtgagcaagaagatgaatgggaccctagaccacccagaccagcccgacctcgacgccattaagatgtttgtgggacaagtacctaggacatggagtgagaaggatctgcgagagctgtttgagcagtatggcgcggtgtacgaaatcaatgtactacgggatcgttcccagaatccaccgcagtccaaaggctgctgtttcgtcaccttttacacccgaaaggccgctcttgaagctcaaaacgccttgcacaacatgaaggttctgcccggcatgcatcacccaatccagatgaagcccgcggacagcgagaaaaacaatgtcgaagatcgaaaattgtttataggcatgatcagtaagaagtgtactgagaatgacatccgagtcatgttctcttcatttggccaaattgaagaatgtagaattctgcggggacctgatgggctcagtcggggctgcgcttttgtgacattcactactcgggccatggcccagacggccatcaaagcaatgcaccaagcacagaccatggaagggtgctcatcacccatggtcgtgaaatttgccgatacacagaaggataaggaacaaaagagaatggcccagcagctccagcagcagatgcaacagattagcgctgcctcggtgtgggggaatcttgccgggctgaatacactcggaccgcagtatctggcactgtacctccaactgcttcaacaaacagcctccagtggcaatctcaatactcttagttcgctgcaccccatgggcggtctgaacgctatgcaattacaaaaccttgccgccctggcagcagcagcttccgcagcccagaacactccttctggcactaatgcactgaccacgtcctcatcaccgctctcagtgctgacaagctctgggagtagcccttcttcttcaagttcaaatagcgttaatccgatcgcctcccttggcgctctgcaaaccctcgctggcgccacagccggcttaaatgtgggatcactagcagggatggcagctctgaacggtggcctcggatcctctggtctgtctaatgggaccgggtcgacaatggaggcactcacacaggcttattccggcatccagcaatatgctgctgctgccctgcccacactttataaccagaacctgctgacccaacagagtattggagccgccggatctcagaaggagggcccagaaggagcaaacttgtttatctaccacctgcctcaggagttcggcgatcaggatctgctgcagatgtttatgcctttcggcaacgtcgtcagtgcaaaggtcttcattgataagcagaccaatctgtctaagtgctttgggttcgtctcttatgacaaccccgtgtctgctcaagccgctatacaaagcatgaacggctttcagataggaatgaagagactgaaggtgcaactcaagaggtccaaaaacgatagtaaaccttactag

SEQ ID NO: 17664 - DNA, 1131 bp, Artificial Sequence
  Description of Artificial Sequence: Synthetic coding sequence
atgaaggacgtgcccggcttcctccagcagtcccagaactccgggcctgggcagcccgctgtctggcatcgtctcgaggaactgtatacgaagaagctgtggcatcagcttaccttgcaggtgctggacttcgtccaggatccctgcttcgcacaaggagacggcttgattaaattgtatgaaaactttattagcgaattcgagcaccgcgttaatcctctttctcttgtggagataatcctgcacgtggtgagacagatgacagacccaaacgttgccctgacatttctggagaaaacacgcgagaaggtgaagtcgtctgatgaagctgtgatcctctgcaagacggctatcggtgccttgaagttaaacatcggcgacctccaagtaacaaaggagaccatagaggacgtggaagaaatgctcaacaacctgccaggtgtgacttcagtgcatagccggttttatgatctctcatccaaatattatcagactatagggaatcacgcttcatattataaagatgctctgcggttcttgggctgtgttgacatcaaggatctgcctgtaagcgaacaacaggaaagggcattcacgctcggcctggctggcttgcttggtgaaggagtatttaactttggcgagctgcttatgcatccagtgctggaatcactgcgtaataccgaccgccagtggctcattgacacgctgtatgcatttaacagcgggaacgtggaacggttccaaacattgaaaacagcctggggacagcagcccgatcttgccgcaaatgaggcccaactgctccggaagatccagctcttatgtctgatggagatgacattcacccgcccggcaaaccaccgccagctcaccttcgaagaaatcgccaagagtgcaaagatcaccgtgaatgaagtagaactgcttgttatgaaggctctgtcagtggggctggttaaagggagtatcgatgaagtggacaagcgggtccacatgacctgggtgcagcctcgtgtgctcgatctccaacagataaaggggatgaaggaccggctggaattttggtgtacagatgttaaaagtatggagatgcttgtcgagcatcaggcccatgacatcctgacttag

SEQ ID NO: 17665 - DNA, 489 bp, Artificial Sequence
  Description of Artificial Sequence: Synthetic coding sequence
atgacttcaaagaaacttgtgaactccgtggccggatgcgccgacgatgcgttggcagggttggtggcatgcaacccaaatttgcaactgctgcagggacatagagtggctcttcgctcagacctggattcactcaagggcagagtcgccctgttgtcaggtggcgggtctggccatgaacctgctcacgccggcttcatcgggaagggaatgctgaccggagtgatcgcgggcgcagtctttaccagtcccgctgttgggtccattctggccgcaatacgagcagtcgcacaggctgggacagtagggactctgctgatagtgaagaactacactggcgaccgcctcaattttggcctggcccgtgaacaggctcgggcagagggtataccggtggagatggtggtgatcggcgatgattcagcttttactgtgctgaagaaagccggccgcaggggtctctgcggcactgtcctgattcacaagtag

SEQ ID NO: 17666 - DNA, 7854 bp, Artificial Sequence
  Description of Artificial Sequence: Synthetic coding sequence
atgttgaccgactccggaggaggcggcacttcattcgaggaggatctggactccgtggctccacgtagcgctccagccggtgccagcgagccaccccctcctggtggtgtggggctggggatccgaacagtgcggctgtttggcgaggcagggcctgcttccggtgtggggtctagtggaggaggtggaagcggttccgggaccggcggaggagatgcagctcttgactttaagttagcagctgctgttttgagaacaggtggcgggggcggagcttccggctctgatgaggacgaggtatccgaagtcgaatcattcatccttgaccaagaggacttggataatccagttctgaagacgacaagtgaaatcttcctctctagcaccgccgagggtgccgacctacgaaccgttgatcccgaaacacaggcacggttggaggctctgttggaggcagccggcattggtaaattaagcacagcagatgggaaagccttcgccgaccccgaggtgctgcggcggctgacgtcgtcagtaagctgtgccttggacgaagccgctgctgcccttacacggatgaaggcagagaactcccataacgccgggcaggtagatacacgcagcctggctgaagcctgctccgatggcgacgtcaatgccgtccgcaagctgttggatgaaggccggagcgtgaatgaacacactgaggagggtgagtctctgctgtgtctagcctgttctgcgggctactatgaactcgcccaggtgctgcttgctatgcacgccaatgtagaagaccgtgggaataaaggtgatatcaccccgctgatggccgccagttcaggcggttacctggacattgtgaagctcttgctgctccacgatgcggacgtgaactcccagtctgccaccggcaacacagctctgacctatgcctgtgccgggggcttcgtggatatcgtgaaagtactcctgaacgaaggagccaatatcgaagatcataacgagaacggtcacacaccgctgatggaggctgcctcagcgggccacgtcgaggtcgcacgggtgctcctggaccatggggcggggattaacacccactccaatgaatttaaggagtcagccttgaccctcgcctgttataaaggtcatctcgacatggtacgttttctgctggaggcgggtgccgatcaggagcataaaaccgacgagatgcatacggcccttatggaagcatgcatggacggacatgtggaagtagcacgcttactgctcgactctggcgcacaagtgaatatgccggcagacagtttcgagtctccccttacacttgccgcgtgcggaggccatgtggagttggccgcgttgctgatcgagagaggagcgaatcttgaggaagtaaatgacgagggctatacaccattgatggaagccgccagggagggccacgaggaaatggtggccctgctcctggcgcagggcgccaatataaatgctcagacagaagagacccaggagacagctctcaccctggcttgttgcggggggtttagtgaggtggcagacttcctgatcaaagctggagctgacatcgagttggggtgctccacaccattaatggaagcaagccaagagggccatctggaactggtgaaatatcttctggcatccggcgcaaatgtgcacgctacaacagctacgggggacacagccttgacgtatgcgtgcgagaatggccatactgatgtggctgatgttctcctgcaggcgggagctgatttagaacatgaatcagaagggggaagaactccgttgatgaaagccgcgcgggccggtcacctgtgcacagtgcagttcctgataagtaaaggtgctaatgtgaacagagccaccgctaacaacgaccacacagtggtgtcacttgcctgcgcagggggacacttggctgtcgtagagttgcttctggctcacggtgcagaccctacacaccgcctgaaagatggatccactatgttgatcgaggccgcaaaggggggtcatacaaacgtggtgtcgtacctcctagattaccccaataatgttctgtcggtcccaacaactgacgtttctcagctcccccccccatcccaggaccaatcccaggttcctagggtgccaactcatacactggccatggtcgttcctcctcaagagcccgaccggacaagtcaggaaaacagccctgctcttctcggggtccaaaaaggcacctccaagcagaaatccagtagcctacaagtggctgaccaggacctgctgcccagttttcacccataccaaccgctggagtgcattgttgaagagacagaaggcaagctaaatgaactgggacagaggatctctgctatagagaaggctcaattaaagagcctggagcttatccaaggcgaacccctaaataaggataagatcgaggagctgaagaagaatcgcgaagagcaggtacagaaaaaaaaaaagatcctaaaggagctgcagaaagtggagcggcaattgcagatgaagacccaacagcagttcacgaaagagtatctagagactaaaggtcagaaggacacggtttctctgcatcagcaatgttcccaccgcggagtgtttcctgagggggagggagatgggagcctgccagaagaccatttttcagagctgccacaggtcgataccattttatttaaggacaacgatgtggatgacgagcagcagagcccccctagcgctgagcagatcgatttcgtgcccgtgcagcccctatcctccccacagtgcaacttcagctcagatctggggtcaaatggaactaatagcctggagttacagaaagtcagtggaaaccagcagatagttggacagcctcagatcgctataacgggtcacgatcagggcctgctagttcaggagccagacggcctgatggtggctaccccagctcagaccctaaccgacactctggatgacttgatcgccgctgtgagcacgcgggttccaaccggcagcaattcatcatcacagaccacggagtgcttaactccggagagttgcagccaaactaccagtaacgtggcgtctcagtctatgccccccgtctacccttccgtcgatattgacgcccacacggagagtaatcacgatacagccctgactttagcctgcgccggagggcatgaggagttggtgtccgttctcatagccagagacgctaagatcgagcacagggacaagaaaggctttacccctctcattcttgccgctactgctgggcatgtgggtgtcgtagagatactccttgataaggggggggatattgaagctcagtccgagaggaccaaagacacacctctgtctctggcctgttcaggaggaagacaggaagtggtagacttgctgctggcccgaggagctaacaaagagcataggaacgtatctgattatactccattatctctggctgcgtcaggtgggtatgtgaacataattaagattctgttgaacgccggcgctgagatcaattccagaacgggatctaagcttgggattagcccactgatgctggccgcaatgaacggtcatgtgccagccgtcaagctgctcttggatatgggaagcgatattaacgcgcaaatcgagaccaaccgaaacacggcgcttacactggcttgttttcagggacgggcagaagtcgtgagcctcctcctggaccggaaagcgaacgtcgaacaccgcgctaagacgggtctgacccctctgatggaagcagcttcaggaggatacgccgaggtgggccgggtcttactcgacaaaggcgccgatgtgaatgccccaccggtccctagttctcgcgacacggcccttaccatagcggcggataagggtcactacaaattttgtgaacttctgatccatagaggggcacatattgatgtgcgaaacaagaagggcaataccccactctggctggccagcaacggaggccatttcgatgtcgtacagttactggtgcaagctggcgcagatgtcgacgccgctgataaccggaagattacacctctgatgagtgcctttcgaaaaggacacgttaaggttgtgcaatacctggtgaaggaagtcaaccagttcccctctgatattgagtgcatgaggtacatcgccaccatcaccgacaaggagcttttgaagaagtgccatcaatgtgtcgagaccattgtcaaagcaaaagaccagcaggcagccgaggccaataaaaacgcttctattctgctcaaagaactggacctggagaaatcacgtgaagagagccgaaagcaggcactggctgctaagagggagaagaggaaagaaaagcgcaaaaagaaaaaagaagaacagaaaagaaaacaggaagaggatgaggaaaacaaacccaaagagaattctgagctgccggaggacgaggacgaggaagagaacgatgaggatgtagagcaagaagtgccaatagagcctccatctgctacaacaaccaccaccattggtatcagtgcaacttctgcaacctttacaaacgtgttcggaaaaaagagagcaaacgttgtgaccactccttcaaccaaccgaaagaataaaaagaataaaaccaaggaaaccccacctactgcccatttaatccttcctgagcagcatatgagtcttgctcagcagaaggctgacaagaacaaaataaatggagaaccaagaggcgggggtgcaggcggaaattccgacagcgacaatctagattctaccgattgtaattccgagagttcctcaggtggtaaatctcaggaattaaattttgtcatggatgtaaacagctcgaaatatccaagcctgctgcttcattcccaggaggagaagactagcacagcaacctcaaaaacacaaactagacttgagggcgaagtcacgcccaattcgctctctaccagttataaaactgtcagcctgcctctgagttctcctaatattaagcttaacctgacgtctcctaagaggggccagaaacgtgaggaaggatggaaagaagtcgtgagaaggtctaaaaagctctctgtcccagcctccgtggtctcccggatcatggggaggggcggctgtaacatcacagccatccaagatgtgacgggtgcccacattgatgttgacaagcagaaggataaaaatggagaaaggatgatcacgattcgcggaggtacggagtccacaaggtatgcagtacagttaataaatgccttaatacaggacccagctaaagaactggaggacttgatccccaaaaatcatatccggacccccgcctcaacaaagtctatccacgcaaatttttcctccggggtgggcaccacggctgcttcaagcaaaaatgccttccctctcggggcaccaacattggtgacttcccaggcaacaacactgagtacctttcagccagccaacaaacttaacaagaacgttcctacaaacgtccgatcttctttcccggtgtctctcccactggcctacccgcacccccactttgcgcttctcgcagcacagacgatgcagcaaatcagacatcctcggttgccgatggctcagttcggcggaaccttttccccgagcccaaacacctggggcccctttcccgtgaggccggtgaacccagggaataccaatagctctcccaagcacaataatacgagtagactgccgaatcaaaatggtaccgttcttccaagcgaaagcgccggcctagccactgcttcctgtccaattactgtgtctagcgtggtggctgcctctcagcaactatgtgttacgaatacccggaccccttcctctgttaggaagcagctttttgcatgcgttcccaaaacatctccaccagctacggtcatctcttcagtgacttcgacttgctccagtcttccctcagtctcatccgcgcctatcacgtccggacaggctcccactacctttctgccagcctccacgtcccaggctcagttgtcatcccagaaaatggagtctttctcagccgtgccaccaaccaaagagaaggtttccacacaggatcagccaatggccaatttgtgtacgccatcttctacagcaaattcatgctcttcaagcgcgtccaatacacccggcgccccagaaacgcatcccagtagtagtcccacaccgacctcatctaatactcaggaggaggcccaacccagttccgtcagcgacctgtctcctatgtcaatgccctttgcttcaaatagtgagccggcgcctctcacgcttaccagtccacggatggtggccgctgacaatcaggatacctctaatcttcctcaactggctgtaccagccccacgggtgagtcacaggatgcagcctagagggtcattctattcaatggtgccaaatgccactattcaccaggatccccagagcatatttgtcaccaatccagtgacactcaccccacctcagggtcctcctgccgcagtgcaattaagttccgcagtgaatataatgaacggttcgcaaatgcatatcaaccctgcaaataaatctctcccccccacattcggccctgcgacactttttaaccacttctcctctctattcgattccagtcaggtcccagcgaatcaggggtggggggatgggcccctgtcttcccgggtcgctacagatgcgagtttcaccgttcaatcagcctttctcggaaattctgtcctgggccacctcgagaatatgcatcccgacaatagcaaggccccgggcttcaggcctccctctcagcgcgtctcaacatctcccgttggcctcccctcgatcgacccttctggctcctctccttcgagttccagtgctccactagcctctttctcaggtatcccgggcaccagggtgttccttcagggccccgctccagtcggcacaccttcttttaaccgtcaacatttttccccccatccttggactagcgcttcgaactcttccactagcgctcccccaactttaggacaacctaaaggagtgagcgccagccaggacagaaaaattccgccaccgatcggcacggagagactggctagaatccgccaggggggatctgttgcacaggccccagcgggaacctcctttgttgcgccggttggccatagtggaatttggtcttttggcgtgaacgctgtgtccgaaggcctgtctgggtggagccagtccgtcatgggtaaccaccccatgcaccagcagttgtcagatccatctaccttttctcaacatcagccaatggagcgagacgattcaggtatggtggctccttcgaatattttccatcagccaatggccagcggcttcgtggacttctctaagggcttacctatcagtatgtatggcggcacgatcatcccctctcacccccaactagccgacgttcctggggggccactatttaatgggttgcacaaccctgaccctgcgtggaatcccatgattaaggtgatccagaactccaccgagtgcacagatgcccaacaggcaagtctgctcccctcagtcccggccctgaaaggcgaaatcccctcccctcaacttaccaggccaaagaagcggatcgggagaccaatggtcgcaagccccaaccagcggcatcaagatcacctacgccccaaagtgcctgctggggttcaggaactgacgcactgcccagatactccactcctacccccatcagactcccgcgggcataactcaagtaatagcccctctctgcaagccggtggagccgaaggcgctggagaccggggtagggatacccggtag

SEQ ID NO: 17667 - DNA, 753 bp, Artificial Sequence
  Description of Artificial Sequence: Synthetic coding sequence
atgggagatatccccgccgtgggtctgtctagctggaaagcctcccctggcaaagtcaccgaagctgtgaaggaggcgattgacgccggttacaggcatttcgattgtgcgtacttttatcataatgagcgagaggtgggcgcggggatccgatgcaaaataaaagagggcgccgtccggcgcgaagacctattcatcgctacaaaattgtggtgtacctgccacaagaaatctctcgtcgagactgcgtgtagaaagtccctgaaagctctcaagctcaactacctagatctttacctcatacattggcctatgggatttaagcctccccatcccgagtggatcatgagttgctccgagctctctttttgcctgagccacccgcgagtccaggacttgccactggacgagagcaatatggtaattccttccgacaccgatttcctcgacacctgggaggctatggaggacttagtgatcaccgggttagttaaaaacatcggagttagtaacttcaatcacgagcagctcgaaaggcttctgaacaagcctggcttgcggtttaagcctttgaccaaccagattctaataaggttccaaatccaaaggaatgtgatcgttattcccggaagcatcaccccaagccacataaaagagaatatacaagtctttgactttgaactaacgcagcacgatatggacaacatcctttcactcaacagaaacctcagactcgctatgttcccgatgtag

SEQ ID NO: 17668 - DNA, 525 bp, Artificial Sequence
  Description of Artificial Sequence: Synthetic coding sequence
atgcttaccgaaaacggacaggtattgagctgcgggagtaattcttttggacagctgggcgtgccacacggaccacgcaggtgcgtggtgccccaggctatcgagctgcacaaagagaaggtcgtttgcattgctgcagggcttcgccatgccgtcgctgcaacagcctcgggtatcgttttccaatggggcacaggattggcaagttgcggtaggagactttgtccagggcagacacttccgttgttttttactgctaaagaaccaagtcgtgttaccggtctagagaactcaaaagccatgtgtgtactagcaggctctgaccactctgcatccctgaccgacgcaggggaagtttacgtgtggggcagcaataagcacggccagcttgcaaacgaggcagcctttttaccggttccccagaaaattgaagctcattgcttccaaaatgaaaaagtcactgctatttggtccggctggacccacctcgtcgcacagaccgggctgttgtggttgcgagcatag

SEQ ID NO: 17669 - DNA, 228 bp, Artificial Sequence
  Description of Artificial Sequence: Synthetic coding sequence
atgaaccgcaggcgtaaattcctgttggctagcgtgctggccctccagaactcatcatttatttaccccagctgccaaaagtgctttagtaggattattctcgtgagcaagcgttcaaactgccccaagtgcggaagtacaggagaatcgggaaatgctaattacaggtataagctcagcctaaaggtcgccgaatctaacaagttattcgtgatcacagtgttctag

SEQ ID NO: 17670 - DNA, 252 bp, Artificial Sequence
  Description of Artificial Sequence: Synthetic coding sequence
atggtggcaatggccgaagcagaggctggagtggccgttgaggtgcgcggacttcctccagccgttcccgatgagctgttgaccctctactttgagaataggcggcgcagcggcggagggcccgtgctgagctggcagagactgggctgtggcggggttttaactttccgtgagcctgccgatgccgagcgcgtgctcgcccaggccgatcatgaactgcacggggcgcaactttctttgagacccgcctag

SEQ ID NO: 17671 - DNA, 528 bp, Artificial Sequence
  Description of Artificial Sequence: Synthetic coding sequence
atgctgagcgaggaagagaaagaagaattgaaagcggagctggtccaactggaggacgagataacaactctgagacaggtgctttccgccaaggaacggcatctggtcgagataaaacagaaactgggcatgaatctgatgaatgagttgaagcaaaatttcagcaagagctggcacgacatgcagactacaactgcctataaaaagacccatgaaactctgtcgcacgcaggtcaaaaagctactgctgcattttcaaatgtgggtactgccatcagcaagaagttcggtgacatgtcctattccatacgacactccataagcatgcctgctatgaggaactcccccacgttcaaatctttcgaagagcgggtcgagaccacagtaacatccctcaagacgaaggtaggtgggacaaatcctaacggaggatcattcgaagaagtgcttagttctaccgctcacgctagcgcccagagtctagcaggaggtagtcggcgcacaaaggaggaagaactgcaatgttag

SEQ ID NO: 17672 - DNA, 231 bp, Artificial Sequence
  Description of Artificial Sequence: Synthetic coding sequence
atgaaccgaagaagaaagttcctgctggcatcggtccttgcccttcagaacagctccttcatttatcccagttgtcagaaatgcttcagccgcataatcctggtttcaaaaagaagtaactgcccgaagtgtggttctacgggcgagtcgggaaatgcaaattatcggtacaagctgtctctgaaagtggcggagtccaataagttattcgtgataacagttttcgggtag

SEQ ID NO: 17673 - DNA, 456 bp, Artificial Sequence
  Description of Artificial Sequence: Synthetic coding sequence
atgtcgataccatttagcaatacccactaccgcatccctcagggatttggcaacttgctcgaaggcctcacaagggaaatcctgagggagcagcccgacaacattcctgcctttgccgctgcttactttgaatcacttctcgagaaaagggagaaaaccaatttcgacccggccgaatggggttcaaaagtggaggaccgattctataacaaccatgcattcgaagagcaggagccaccagaaaagagcgatcctaagcaggaagaatcacagataagtgggaaagaggaagagacaagcgtcaccattcttgatagcagcgaggaggacaaggaaaaagaggaagtagccgcggtgaaaatccaggctgcatttagaggccatattgcccgcgaggaggcaaaaaagatgaaaacaaatagccttcagaatgaagaaaaagaagagaacaagtag

SEQ ID NO: 17674 - DNA, 270 bp, Artificial Sequence
  Description of Artificial Sequence: Synthetic coding sequence
atggaggcggccgacgcttctaggagtaacggctcttcccccgaggcccgcgatgctcgctccccttctgggccatccggatctctggaaaatggtactaaagctgacggcaaagacgctaagacaacaaacggacatggcggggaggccgccgaaggtaaatctctggggagcgccctcaaaccgggcgagggcagaagcgccctgtttgccggaaatgagtggcgccggccgattattcagtttgttgagagtggtgatgacaagtag

SEQ ID NO: 17675 - DNA, 1542 bp, Artificial Sequence
  Description of Artificial Sequence: Synthetic coding sequence
atggaagtcgggatcacgatacagcacgcctatgaaaagcagcacccctggatagatctgacatctattggcttctcatacgtcatagattttaataccatgggccagattaaccgtcaaacccagcgtcagcgcagagttaggcggaggctcgatttgatttatcccatggttactggcactttgcctaaggcccaatcatggccagtgtcaccaggccctgccacctccccgcctatgagcccatgtagttgcccccagtgtgtactggtgatgtctgtgaaagcggcagtggtaaacggaagcaccgggccgctgcagttacccgtgactcgaaaaaatatgcctccccccggggtagttaagctgcctcctctgcccggtagcggagccaaacctctggattcaacaggaactatacgcgggccactgaagaccgcaccctcacaggtgatcagacgccaggcctcttcaatgccaacgggtaccaccatgggaagccccgcctcccccccagggccaaatagtaagacaggacgcgttgccctggcgacgctgaacaggactaacctgcagcgtttggcgatcgcccagtctagagtcttgatcgcttcaggcgttcctacggtgccagtgaagaatctgaacgggtcctcgcccgtaaacccagctctggcaggtataactggcatactgatgagcgccgcaggcctacccgtgtgtttaacgcggccacccaagttagtcctgcaccctccaccggtgtccaagtccgagattaaatccatacccggtgtgtctaacacttctcggaagacgaccaagaaacaggccaaaaagggtaaaacgccagaggaagtgctcaaaaaatatttgcagaaggtcagacaccctccagatgaagactgcacaatttgtatggagagattaacagccccctcaggatataaagggcctcagccaactgtaaagcccgatctggtgggcaagctctcccgctgtggccatgtgtaccatatttattgcctggtagctatgtacaataacggaaataaagatggctcgctacaatgcccgacatgcaagacaatctatggcgtcaagacaggcacacagccaccaggtaagatggagtaccacttaataccccattccctgccaggccaccccgattgtaagacaattcgaattatctattccattcctccggggatccagggaccagagcatccaaatccaggtaagtcattcagcgctcgggggtttcctcggcactgctaccttcccgacagtgaaaaagggcgcaaggtgttgaagctgttacttgtcgcctgggataggcgtctcatcttcgccataggtacttcctcaactaccggcgagtcggatacggtgatctggaacgaggtgcaccataagaccgaattcggatctaacctgacgggacacggatatccagatgctaattacttagataatgtgctggctgaattagccgcccaggggatcagcgaggacagcaccgcccaagagaaagactag

SEQ ID NO: 17676 - DNA, 414 bp, Artificial Sequence
  Description of Artificial Sequence: Synthetic coding sequence
atgagctcagttcagagccaacaggagcagctctctcagagcgacccctcgcctagcccgaacagttgctcttcttttgagctaattgatatggacgccggctccctgtatgaaccagtgtccccacattggttctactgcaagatcatcgatagcaaagagacgtggattccctttaatagtgaggacagccagcagctcgaagaagcatattcatcagggaaagggtgcaatggaagagtggtacctaccgacggcggccggtacgatgtgcatctcggggagagaatgcgctatgcagtgtactgggacgaattggcgagcgaggtaagacgttgcacatggttctacaagggtgataaggataataaatatgtgccctattcagaaagtttttcacaggtgttggaatag

SEQ ID NO: 17677 - DNA, 120 bp, Artificial Sequence
  Description of Artificial Sequence: Synthetic coding sequence
atgttctggaagttcgatctgcattcctccagccatatcgataccctcttggaacgtgaagatgtcacacttaaagaactgatggatgaggaagatgtattacaggagtgcaaagcctag

SEQ ID NO: 17678 - DNA, 2157 bp, Artificial Sequence
  Description of Artificial Sequence: Synthetic coding sequence
atgctgatgacgctagagatgacagaattgacagacccgcatcacaccatgggtgattacaaagtcgcacacccccaggatccacatcatcctagcgagaaacctgtcatccactgtcacaaatgcggcgaaccttgcaagggcgaggtgctgcgcgtgcagactaaacacttccatatcaaatgttttacatgcaaggtttgcgggtgcgacttggcccagggaggattctttatcaagaacggtgaatacctttgcacgctggactatcagcgtatgtatgggacgcgttgccacggctgcggggagtttgtggagggggaggtcgtgaccgccctggggaagacctaccacccaaactgtttcgcgtgcacaatttgcaagcgaccttttcctcctggggacagagtgacatttaatggcagggactgcctgtgccagctgtgtgcacagcctatgagcagctcaccaaaggaaaccaccttttccagcaattgtgctggatgcgggagagacatcaaaaacggccaggctttattggccctggacaagcagtggcatttgggatgttttaagtgtaaatcgtgtggtaaggtcttgaccggtgaatacattagcaaggacggggcaccttattgtgagaaggactaccaaggcttattcggcgttaaatgcgaggcttgtcatcaattcatcacggggaaggtgttggaagctggggacaagcattatcatccaagctgtgctagatgttcacggtgtaaccagatgttcacggaaggggaggagatgtacttgcagggtagtaccgtatggcatcctgactgcaagcagagtacaaaaaccgaagaaaagctgcgtccaacccggacctcatccgaaagcatctactctaggcctggtagctccatccccgggtcacccggccataccatatacgcaaaggtggataatgagattctggactataaagatttagcagctatccctaaggttaaggctatttatgatattgagcgacctgatctgatcacttacgaacctttttatacctccgggtacgatgataaacaagagcgccagtctctcggcgagtcgccaagaactctgagtcctacccctagcgctgaggggtaccaggatgtcagggatcgtatgatccaccggtccactagccagggctccattaactcacccgtttactcacggcactcatatacacctacaacaagcaggtccccccagcatttccacaggccagggaacgagccttcctccggccgcaatagccccctgccctaccgacccgatagcagacccctcacccctacttatgcccaagcaccaaagcatttccacgtccctgaccaggggattaatatctaccgcaagccaccaatttataagcaacatgccgctttggcagcccagtcaaagtcttcggaagacattattaagtttagcaagtttcctgcagcccaggctccagatccttctgagacaccaaaaatcgagacggatcactggccaggacctccttcttttgccgttgtgggacccgacatgaagcggaggtcatccgggagggaggaggacgatgaagaactcctgaggagacgccagctgcaggaggagcagctgatgaagcttaacagcggcctgggccagctgatccttaaggaggaaatggagaaggaaagccgggaaagatcctcgctcttggcctcacgctacgacagtcccatcaactctgccagccatatccctagttctaagacggcctccctcccgggctatggccgcaacggtctgcataggccagtgtctacagactttgcccagtacaactcgtatggcgatgtaagtgggggggttagagactttcagactctccctgatgggcacatgccagccatgcgaatggacagaggcgtgtccatgcccaacatgttggagccaaaaatctttccctatgaaatgctgatggtcacaaatagaggccgaaacaagatacttcgcgaagttgatagaaccagactggaacgccacttggcccccgaagtgttccgcgaaattttcgggatgtccatccaggagtttgaccgactgccgctgtggcgccgaaacgatatgaagaagaaggccaagctcttctag

SEQ ID NO: 17679 - DNA, 2148 bp, Artificial Sequence
  Description of Artificial Sequence: Synthetic coding sequence
atgagtcagtcgggtgcggtgtcgtgctgcccaggggctacaaacggctctctaggacggagcgatggtgtcgcaaaaatgtcacccaaggatctgttcgagcagaggaaaaaatatagtaactcaaatgtgattatgcacgagacatctcaatatcatgtgcagcacctcgcaaccttcattatggataaaagcgaagctatcacttctgttgacgatgctatcaggaaactggtacagctcagctcaaaggagaagatttggacacaagagatgctcctccaggtcaacgaccagagcctgaggctgctagatatagagagtcaggaggagctagaggattttcctctcccaaccgtacagcggagccaaacggtcttgaaccagctcaggtatcccagcgtcctgctacttgtgtgtcaggattccgagcagtctaaacctgacgtgcacttctttcattgtgacgaggtggaagctgagctggtgcacgaggacatcgaaagtgctctagctgattgtaggctcggcaagaagatgcgaccacaaaccctcaaaggacaccaggagaagatccggcaaaggcaatctattcttccaccgccccagggtccagcacctattcctttccagcatagaggaggagattcccctgaggctaaaaatcgagtagggccccaggtgccgctcagcgaacctggctttcgcaggagggagagccaagaggaacccagagctgtgttggcgcagaaaattgagaaggaaactcagatactgaactgcgcactggacgacatagagtggttcgtggcaagactgcagaaggccgccgaggcattcaagcagcttaaccagcgcaagaagggaaagaagaagggaaaaaaagccccagcagagggagtgctgactctcagggcccggcctccatctgaaggcgagttcattgactgctttcaaaagatcaaactggcgatcaacctcctcgctaaactccagaaacatatacagaatccttctgccgccgagctggtgcactttctcttcggaccactggatctgatcgtgaacacttgctctggtcctgacatagctcgatctgtgtcttgtcctctgctgagccgcgacgcggtggatttcttacgcgggcatttggtccccaaggagatgtctctctgggagtctctgggcgagagttggatgcgcccccgttccgagtggcctcgcgagccccaggtgcccctctacgttccaaagtttcactcagggtgggaacctccagtcgatgtgctccaggaagcgccctgggaagtcgaaggtttagccagcgcaccaattgaggaggtatctcccgtgagtcgccaatccattcggaacagtcagaaacactcacctacttccgagccaaccccgccgggcgatgccctgccacccgtgtcaagcccacacacccatcggggctaccagccaactccagccatggctaaatacgtaaagattttgtacgacttcaccgcccgcaacgcgaacgagttgtctgttcttaaggatgaggtactggaagtactggaagacggccggcagtggtggaagctcaggagtcggtctggccaggctgggtacgtaccgtgcaatattttgggcgaggcccgcccagaagatgctggggctccttttgagcaggctggccagaaatactggggtcctgccagccccacacacaagcttccgccaagtttccctggcaataaagatgagcttatgcaacacatggacgaggtgaacgacgagctcatccgaaagatatcgaacattagagctcagcctcagcgccacttccgggtggaaagatcccagcccgtaagtcagcccctcacctatgaatcgggccccgatgaggtacgagcttggctggaggctaaagcattctctccccgcattgtcgagaatctgggcatactgaccggtccgcagctctttagtctgaataaggaggaattgaagaaagtctgcggggaggagggagtacgcgtctatagccagttaacaatgcagaaagccttcctcgaaaaacaacagagcgggtccgagctggaggaacttatgaataagttccatagtatgaaccaacgtcggggcgaggactcctag

SEQ ID NO: 17680 - DNA, 360 bp, Artificial Sequence
  Description of Artificial Sequence: Synthetic coding sequence
atggagaccgacctgaacagtcaggaccggaaggacctagataagtttattaaatttttcgccctgaagacagtccaagtgattgtgcaggcgcggctcggagaaaaaatttgtaccaggtctagttcatcacctaccggttcagactggtttaatcttgcaattaaagacattcctgaggtaactcatgaagctaaaaaggcgctggctggacaattgccggcagtaggtaggagcatgtgtgtggaaatctcactgaaaacctctgagggggattccatggagctggaaatctggtgcttagaaatgaatgagaaatgcgacaaggagattaaagtgagctatacggtatacaattag

SEQ ID NO: 17681 - DNA, 420 bp, Artificial Sequence
  Description of Artificial Sequence: Synthetic coding sequence
atggcggacacagatctgtttatggaatgtgaggaagaggaattagagccttggcagaagatcagcgatgttattgaggattccgtcgtggaagactacaacagcgtcgataagactactacagtgtcagtatcacaacagcccgtgtcagcacctgtgccgattgccgctcacgcctccgtcgctggacacctttctacgagcacaaccgttagttctagcggggcccagaattcagactctactaagaagaccctcgtgacacttatcgcaaacaataatgccgggaaccccctcgtccaacagggcggacaacctcttatcctgacccaaaaccccgcacctggcctcgggactatggtcacccagcccgttttgaggcccgtgcaggtaatgcagaacgccaaccatgtgacatag

SEQ ID NO: 17682 - DNA, 492 bp, Artificial Sequence
  Description of Artificial Sequence: Synthetic coding sequence
atgcatgataagggcattaccaccgccgccgtgtgcgtgtatccggcgagggtatgtgatgccgttaaagctctgaaagccgcagggtgtaatattccagttgctagtgtggcagccgggttccctgcgggtcagacccatttaaagaccaggctggaagagatacggctcgctgtcgaggatggagcaacggaaatagacgtcgtgatcaaccggtccttggtgctgactggccaatgggaagcactgtatgacgagatacgccaattccggaaagcctgcggtgaggcccatctgaagaccatactggctactggcgaactggggacactgacaaatgtgtacaaagcttctatgattgccatgatggcaggttctgacttcattaagacatccactgggaaagaaaccgtgaacgctacctttccagtcgctattgtgatgctgagagcgataagagatttcttttggaagaccggtaataaggtttag

SEQ ID NO: 17683 - DNA, 456 bp, Artificial Sequence
  Description of Artificial Sequence: Synthetic coding sequence
atggctgacacagacctgttcatggaatgtgaggaagaagagctggagccgtggcagaagattagcgacgtgattgaagatagtgtggtggaggattacaattctgtcgataagaccacaaccgtgagcgttagtcagcaacctgtgtcagcccctgtgccaattgccgctcatgccagtgtggccgggcacctatccacatcaactaccgtctccagcagcggtgcgcagaactcagacagcacaaagaaaacccttgtgaccctgattgccaacaacaatgccgggaatcccctggtccagcagggtggacaacctctaatcctcacccaaaatcctgcgcccggcttaggtaccatggttacccaacctgtgttaaggcccgtgcaggtgatgcagaacgcgaatcacgtgacttcatcaccagtggcatctcagcccatattcatcacgtag

SEQ ID NO: 17684 - DNA, 252 bp, Artificial Sequence
  Description of Artificial Sequence: Synthetic coding sequence
atgagccagtccggggccgttagctgctgcccaggtgccaccaacgggagtcttgggagatccgacggtgtcgctaagatgtctcctaaagatttgtttgagcaacgaaaaaagtattccaattccaatgtgatcatgcacgagacaagccagtaccatgtgcagcacctggccacttttattatggacaaaagcgaggcaattacttctgtggacgacgcaattagaaagctggtccagctgagttcctag

SEQ ID NO: 17685 - DNA, 366 bp, Artificial Sequence
  Description of Artificial Sequence: Synthetic coding sequence
atggccgggagacctttgcgcatcggcgaccagctcgtgctggaagaggactatgatgaaacatacattcctagtgaacaggagatcctggaattcgcgcgggaaatagggatcgatccaattaaagaacccgagcttatgtggcttgctagagaggggatagttgcccccttacctggcgaatggaagccatgccaggacattaccggcgatatctactactttaatttcgccaatgggcagtccatgtgggatcacccttgcgatgagcattatagaagtctcgtaattcaagagcgcgctaagctgtctacttccggagcaataaaaaagaagaaaaagaagaaggagaagaaggataagtag

SEQ ID NO: 17686 - DNA, 2997 bp, Artificial Sequence
  Description of Artificial Sequence: Synthetic coding sequence
atgaacaggcgcagaaaatttctgctcgccagtgtgctggccttgcagaactcgagttttatttacccttcatgtcaaaagtgctttagcaggatcatcctggtgtcaaagcggtccaattgccccaaatgcggcagcacaggcgagtccggcaatgccaattatcgatacaaacttagtctgaaggtggccgagagtaacaaactttttgtgattactgtgttcggatcttgcctcgacacctttttcggccttaccgctacaggtctgcacaggtacatccaggaccccaacaaaatcccagaaaccctcgataacgatacaacccagaacctcctgactaaagctgtggagacctgctttgtgggacagtccttcattttcggcgtgacaaattttgaaaaccagccgggacagggatccgacgcctctaacttcctccagcagtgctccgaccacaagagaaaggccaaagcactggtggcttgccagatcgtccttccagatcctgggatcgctgggtttacggtgattgactattttcaccaacttctccaaactttcaacttccggaaactgcaatgcgattcccaggcccctaacaaccatctgctcgccttagatcactccaattctgatttgagtagcatctatacgagtgattcaactagtgatttcttcaagtcttgctcaaaagacacgttcagtaagttctggcagccatcactggagtttacatgcatcgtatcacagctcactgacaatgatgacttctcggccagcgagcagagcaaggccttcgggaccctccagcagaatcgtaaatccatttccatcgcagaagcaaccggatcatcttcgtgccacgatcccattcaggactcatggtcactggtctcctacatggataagaaatcgactgccgagaaactggggaaagagctgggcctgcaggccaaggagctttcagccgtgcattcctcccaccacgaaattggcgtgaatgacagtaatcttttctctcttgaaatgagggaacccctcgaatctagcaatacaaaaagtttccactctgctgttgagatcaagaatagatcacagcatgaactgccatgcttccagcaccacggtatcgacacaccaacctctctgcagaaacgatccgcatgttgtcccccctcactgttgaggctggaggaaaccgccagctccagccaagatggagacccgcagatctgggacgatctgcctttctccgaaagcctgaacaaatttctcgccgttcttgagtccgaaatcgctgtcactcaggccgatgtcagctctcggaagcaccatgtggacaacgacatcgacaaatttcacgcagatcatagtagactgagtgttactccccagagaaccactggcgccctgcacactccacctatagcgctccgctccagtcaggtgatcgtgaaggccaactgttcaaaagatgactttctttttaattgtaaaggcaatctcagcccaagtgtcgaaaaggagagtcaacccgataacaaggtggaagccgtttccgtcaatcataatggacgggatatgtccgagtatttcctgcctaacccttacctaagtgctctgtcttcttcatccaaagacctggagacaatcgtgacactgaagaagaccatccgaatttctccccaccgtgagtctgatcattctagtttgaacaataaatacctgaatggctgcggtgaaatctcagtgtctgagatgaatgagaaactgaccacattatgctacagaaaatacaatgatgtgagcgatctgtgtaaactggagaataagcagtattgccggtggtccaagaaccaggacgattcatttacgatttgcagaaagctgacttaccccctggaaactttgtgcaatagccccaacagatcaacaaacacgttaaaggagatgccttggggacacattaacaacaatgttacccagtcctacagcattggttatgaagggagctacgatgctagtgctgacctgtttgatgatatcgccaaagagatggatattgctactgaaatcactaagaaatcccaggacattctgctcaaatggggaactagcctggccgagagtcacccttccgagagcgacttttccttaaggtccctgtctgaggacttcattcagccaagccagaaactgtctcttcagagcctctctgatagtaggcatagccggacatgtagcccgactccccattttcagtcagattctgagtataactttgaaaactctcaggatttcgtaccatgttctcagagtactcccatttcaggcttccaccagacaaggatccatggcattaaccgagctttcaagaaacccgtcttttactcagatttggatggaaactatgaaaagatacgcatctttcccgaaaatgataagcagcaggcttcaccaagctgcccaaagaatatcaagactccgtctcaaaagattcgctcccccattgtgagtggcgtctcccagccagacgtgttcaatcattacccattcgcagagtgtcatgagacagatagcgacgagtgggtgcctccaacaacccaaaaaattttccccagcgatatgctgggcttccagggcataggactggggaagtgcttggctgcataccactttcctgaccagcaggagctgccaaggaagaagctcaaacacatcaggcagggcacaaacaagggccttatcaagaaaaaacttaagaatatgctggctgctgtcgtgacaaagaaaaaaacccataagtataattgcaagagcagcggctggatatctaagtgtccagacatccaggtgttagcagcacctcagttacaccctatcttagggcccgactcatgctctgaagtgaaatgttgtttgcctttttccgagaagggccccccatcagtttgcgagacccgctcagcctggagcccagaactattttcgtag

SEQ ID NO: 17687 - DNA, 504 bp, Artificial Sequence
  Description of Artificial Sequence: Synthetic coding sequence
atgggcactaccgcgcccggtccaattcacctgctcgagttatgcgatcagaagctgatggagtttctctgcaacatggataacaaggacctcgtatggctggaggagatccaggaggaggctgaaaggatgttcacacgtgagttcagtaaggagccagaattgatgccaaagaccccaagccagaagaacaggcgaaagaagagaaggatttcctacgtccaggacgaaaacagagatccaatcagacgcagattgagcaggaggaagagtaggagctcacagttaagcagcaggaggctgcggtctaaggacagtgtcgaaaagcttgctactgtggtgggagaaaatggaagcgttctcagacgggtaactagggccgctgccgcggccgccgctgctaccatggccctcgccgcgccaagttcccctacccctgagtcacccaccatgctgaccaaaaaacctgaagacaatcatacccagtgtcaactcgtgccctag

SEQ ID NO: 17688 - DNA, 615 bp, Artificial Sequence
  Description of Artificial Sequence: Synthetic coding sequence
atggaagcccaggcccaggggctactggagactgaaccgctgcaaggcactgacgaagacgccgttgcttctgccgatttcagctcaatgctttccgaggaagagaaggaggaacttaaagctgagctcgtgcagctcgaagatgaaataaccactctacggcaagtgctcagcgctaaagagaggcacctggtcgagatcaagcagaagctgggcatgaacctcatgaatgagctgaagcagaatttctcaaaaagctggcacgacatgcaaacaacaacagcctacaagaaaacccatgaaacgctctcccacgctggacagaaagccacggccgctttctccaatgtgggcaccgcgatcagcaaaaagtttggcgacatgagctatagcattcggcattccatctctatgcccgcaatgaggaattcacctaccttcaagtcatttgaagagcgagtcgagacgaccgtgaccagcttgaagaccaaggtcggaggcactaatccaaacggtggatccttcgaggaggtgctgtctagtaccgcccacgccagtgcacaatccctagccggcggttctcgtagaacaaaggaagaagagttgcagtgttag

SEQ ID NO: 17689 - DNA, 1023 bp, Artificial Sequence
  Description of Artificial Sequence: Synthetic coding sequence
atggccgcggctagagatcctcccgaagtgagccttagggaggcaacacagcggaagcttcggcgattttctgagctccgcggaaagttagttgctcgaggggagttttgggatatagtcgccataactgctgctgacgagaagcaggagctcgcttacaatcagcagctttcagagaagctcaagaggaaagagcttcccctgggtgtccagtatcacgttttcgtcgacccggcgggggcaaaaataggaaacggtggatcaaccttgtgtgctctgcagtgtctcgaaaagttatatggggataagtggaacagctttactatcctactcatacactcgggcggctacagtcaacgtctcccgaacgcctcagccctcgggaaaatctttactgctctccctctagacattcctgagtgcagtggcaaaacatcttgcataattcagtctatcctagactcgcgatgcagtgtcgcccctgggtccgtcgtggaatattctaggcttggccccgatgtatcagtgggtgagaactgcatcatcagcggctcctacatcctgacaaaagccgccctgcccgctcactcatttgtttgctcactgagcttgaaaatgaataggtgtctgaagtacgctactatggcattcggagtgcaggataatctgaagaagtcggtcaagactctgagtgacattaagctgctgcagttttttggggtttgctttctgtcctgtctcgacgtctggaacctgaaggtaacggaggagttgttctctgggaataaaacatgtctcagcctgtggactgctaggatcttccctgtctgctcctctctctcagattcggtgataacatcgctcaaaatgttgaacgcagtgaagaataaatccgccttcagccttaacagctacaaacttctgagcatagaggaaatgctcatttacaaagatgtagaggacatgataacatacagggaacagatctttcttgagatctccctgaaatccagcctgatgtag

SEQ ID NO: 17690 - DNA, 873 bp, Artificial Sequence
  Description of Artificial Sequence: Synthetic coding sequence
atggcagagcttacggctcttgagtcattgattgaaatggggttcccacgcggacgggcggagaaggcattggctctgaccggcaatcaaggcattgaagccgccatggactggttgatggagcacgaggatgatccagatgttgacgagcccttggaaacacccctggggcatattctgggtcgggagcctacctcttccgagcaaggtggcctcgagggcagtgggagcgccgccggagagggaaagcccgcattatccgaggaggaacggcaagaacaaaccaagagaatgcttgagctggtagctcaaaaacaaagggagagggaagagagagaggaaagagaggcactcgaacgtgaaaggcagagaagaagacagggacaagagcttagcgccgcgaggcagaggctacaggaggatgagatgaggcgggccgccgaagagcggcgcagagaaaaagccgaggagctggcggcccgacagcgcgtgcgggagaagatcgagagggacaaggcggaaagggcaaaaaaatatggtggctctgtcggctctcaacctcctcctgtggcccccgaacccgggccagtaccgtcctctcctagtcaggagcctccaaccaaacgcgagtacgaccagtgtcgcattcaggttcggttacccgatgggacatccctcacacagaccttccgggcccgcgaacagttggctgccgtccggctgtacgtggagctccatcggggagaagaactcggtggaggccaggatccagtacagctcctgtctggttttcctcggcgagctttttcagaggcagacatggaacgtcctctacaggaactgggcctggttccttccgcggtcctgatctag

SEQ ID NO: 17691 - DNA, 309 bp, Artificial Sequence
  Description of Artificial Sequence: Synthetic coding sequence
atgctgtctgaagaagaaaaagaggagctaaaagcagaactggttcagctggaggacgagatcactacgctgagacaggtgttgagcgcaaaagaacgccaccttgtagaaatcaagcagaagctggggatgaacttgatgaatgaactgaaacagaatttctcgaagagctggcacgacatgcagactacaaccgcatacaagaagacccatgaaactctgtcacacgccggacagaaagcaacagccgccttttctaatgtcggcactgctatttccaagaaattcggcgacatgaggaggaaatag

SEQ ID NO: 17692 - DNA, 279 bp, Artificial Sequence
  Description of Artificial Sequence: Synthetic coding sequence
atgttgagtgaggaggagaaggaagaactcaaagccgagctcgtgcagcttgaggatgaaatcactactctccgtcaggtcctcagcgccaaagagaggcatcttgtggagataaagcagaaactcggaatgaacctgatgaacgagttgaagcagaatttctcgaaaagctggcacgatatgcaaacaactaccgcttacaagaaaacacatgagactctttcacacgctgggcaaaaggccacagcagccttctccaacgtgggcacagcgatttag

SEQ ID NO: 17693 - DNA, 3735 bp, Artificial Sequence
  Description of Artificial Sequence: Synthetic coding sequence
atgctgatcaaagagtaccacatcctactgccaatgtctcttgatgaataccaggtggctcagctgtacatgatccaaaaaaagagccgagaggaatcgagcggtgaagggagcggcgtagagatcctcgcaaaccgtccctatacagacggccccggtgggagcggacaatacacccacaaggtatatcacgtgggaagccatattcccggttggtttagagcacttctgcccaaggctgctttgcaggtggaggaagagtcttggaatgcctacccttacactaggacacgatatacgtgcccctttgtcgagaaattcagcattgagatagagacttactacctccctgacggcgggcaacagcctaatgtgtttaatctatccggggctgaacgcagacaacggattctggacactatcgacattgttcgagatgccgtggcacccggggagtataaggctgaagaagacccaaggctgtatcactctgtcaagacgggccgtggacccctctcggacgattgggctaggactgccgcgcagaccggtcctctcatgtgcgcttacaagctctgcaaagtggagttcaggtattggggaatgcaggcaaagattgagcaatttatccatgatgtgggactgaggagagtaatgttgagggcgcataggcaggcatggtgttggcaggacgagtggacagagctgtcaatggccgacatccgggctttagaagaggaaaccgccaggatgctcgcgcagcgtatggcaaagtgcaataccggctctgaggggtcagaggcccagcccccagggaagccttccacagaggcacgctccgccgcgagtaatacggggacccccgacggaccggaagctccacccggcccagacgcgtccccagatgccagttttggaaaacagtggtcgtcaagtagcaggtctagctatagctcccagcacggaggggctgtgagcccacaatccttatccgagtggcggatgcagaacattgctagggatagcgagaactcgtccgaggaagagttcttcgacgcccatgaaggctttagcgatagtgaggaggtgtttcccaaggagatgacaaaatggaactcaaacgatttcatcgatgcctttgctagccctgtagaagccgagggtacaccagagcctggcgctgaggccgccaaaggtatagaggacggcgcccaggccccacgcgatagtgagggactggatggagccggggaacttggggccgaagcctgtgccgtacatgccctgttccttatcctccactccggaaatatcctagactcgggccccggagatgctaactcaaagcaggcagatgtgcagaccctgagcagcgcttttgaagctgttacacgtatccatttcccagaagcgcttggccacgtggcactcaggctcgtgccttgccctcctatttgtgctgcggcctacgctctggtctcaaacctatccccttatagccatgatggagactcgttatctaggagccaggaccatatcccattagcggccctgcctctcctggctacctctagctccagataccaaggggccgtagcgacagtcatcgctcgcacaaaccaggcctacagcgcctttctgagatcccctgagggcgctggcttttgcggccaagtcgcactcattggggatggggtgggggggattctggggtttgatgcactctgtcactccgccaacgctgggacgggaagcagaggcagcagtaggcgtgggtccatgaataacgagttactgtccccagaatttggacctgtgcgcgatcctctggcagatggggtggagggcctgggtcgggggtctccagagccaagcgctctccctcctcaacggatcccttcagacatggcaagccccgagccggagggctcacagaactccttacaagccgcaccagccactacgagtagctgggagcctcgtcgcgcgtcaacagctttctgccctccagccgcttcatcagaggccccagacggtccttcctctaccgctagactcgacttcaaggtatccggattcttcctcttcggcagtccactcggcctggtgctggctctgcggaaaactgtcatgcccgcactcgaggccgctcagatgagacctgcctgcgagcaaatctacaacttgtttcacgctgccgatccctgcgccagccggctggagcccttgctggctcccaagtttcaggcgatcgcgcctctgacggttcccaggtatcagaaatttccacttggtgacggctcttccttgcttctggctgatacactccagactcattcgagcctgttcttggaggaattggaaatgttggtcccctccacccccactagcacttcaggagcgttctggaagggttccgaactggccactgacccccctgcccagccggcggctccgtccaccacttccgaagtggttaagattttggagcgctggtggggcacaaagcgaattgactattcactgtattgcccagaggccctgaccgctttcccaactgtgactcttccacacctgttccatgcatcgtactgggaatcggcagacgtagtggctttcatacttcgccaggtcatagagaaggaaagaccacaactagcagagtgcgaagaacccagcatttactcacccgcattcccgagggaaaagtggcagaggaaacggacccaggtaaagatccggaatgtaacctctaaccaccgggctagcgatactgtcgtgtgcgaggggaggccccaggtccttagcggcaggtttatgtacggtcctctggatgtggtaacactgactggagaaaaggtcgacgtttatatcatgacacagcctctctctggcaaatggatccactttggtaccgaagtcactaacagctccgggcgactgacttttccggtgccccccgaacgggctctcggaatcggagtgtaccctgtgcgtatggtcgtgcggggcgatcatacatatgctgagtgctgcctgacagtggtggcacgcggcacagaagcagtcgttttcagcatcgacgggagttttactgcatctgtttccataatgggcagcgatccaaaggttcgagcaggggccgttgacgtcgtgagacactggcaggacagtggctacctgattgtgtatgtgacgggcagacctgatatgcagaagcaccgcgtagtggcttggctaagccaacataatttccctcatggcgtggttagcttctgcgacgggcttacgcacgatcccctgaggcaaaaagccatgttcctccagtccctggttcaggaggttgaactgaatattgtggcaggctatggctcaccaaaggatgtggctgtatacgcagcactgggtctgtctccgtctcagacctacattgtcgggcgggccgtgaggaaactgcaggcccagtgtcagttcctgtcagacgggtacgtggctcatctgggccagctggaagccgggtctcatagccacgccagttctggcccaccgagggcggcactaggcaagtcgagttacggagtggccgcacccgtggactttctcaggaaacagagccaactgctcagatctcggggtccttcccaggctgaaagagaaggacccggaactccacctacaacgctggctcgcggcaaggcaagatcaatctccctgaagctggatagtgaggaatag

SEQ ID NO: 17694 - DNA, 2676 bp, Artificial Sequence
  Description of Artificial Sequence: Synthetic coding sequence
atggatcagccagaagcaccttgctcatccactggccctaggctggctgttgcccgggagctgctcctggcagcgttagaagaactttcccaagagcagctgaagcggttccgacacaagctcagggacgtgggaccagatgggcgctccattccgtggggaaggctggagcgcgcagatgcagttgacctggctgagcagctcgcccagttttatgggcctgagcccgccctcgaagtggcacgtaagacacttaagcgagccgatgcgcgagatgtggcagctcagctgcaggaaaggagactgcagagactcggtctaggaagcggaacgctgttatctgtgagcgaatataaaaagaaataccgggaacatgtgctgcagttacatgcaagggtgaaggagagaaatgctcgctcagtaaagatcaccaagcggttcactaagcttctcatcgcccccgagtccgcagctccagaggaagctatgggcccagccgaagaacccgagcccggacgggccagaaggagcgacacgcacacattcaatagactgtttagaagggacgaggagggacggaggccgctgacagtggtcctgcagggtccagccgggattgggaaaactatggccgccaaaaagatcctgtacgattgggctgcggggaaattatatcaggggcaggtcgattttgctttcttcatgccctgcggggaactcctggagcgaccaggaacaaggagtctggccgatctgatcttggatcaatgccctgaccgaggggcaccagtgcctcaaatgctagctcaaccccagcggttgctgttcatcctcgacggggccgacgaacttccggccctaggtgggcccgaggccgcaccatgtaccgatcccttcgaagctgccagcggggccagggtacttggggggctactgagtaaggctctcctgccaaccgccttactgctggtaaccacgcgggccgcagctcccggccgcctgcaaggcaggctgtgttcgccacagtgcgccgaggttaggggattcagcgataaagacaagaaaaagtatttctacaagtacttcagagacgagcgccgcgctgaacgggcctatcggttcgtcaaggagaatgagaccttgttcgccctgtgtttcgtaccatttgtgtgttggatcgtgtgtaccgtgctgagacagcaacttgagttgggacgtgatctgtcccggacctccaagactacgactagtgtgtatcttctcttcattacgtcggtgctctcatccgctcccgtggcagatggaccgaggcttcagggcgatctgcgcaacctgtgtagactggcgagagagggcgttctagggcgacgggctcagtttgccgagaaggagctggagcagctcgaacttagaggttccaaggtgcaaactctttttttgtccaagaaggaattgccgggcgtgttggaaacagaggtcacctatcagttcatagatcagtcctttcaagagttcctggccgccctttcttatctgcttgaggatgggggggtgccacgcactgcggcaggcggcgtgggcacgctcctgagaggcgacgctcaacctcacagccacctggtgcttaccactcgctttctgttcggtctcctgagcgctgagcgaatgcgggacatagaacgtcactttggctgcatggtgtccgaaagggtcaagcaagaggccctgaggtgggtgcaggggcagggtcagggctgtccgggagtcgcacccgaggtgaccgaaggagcaaagggactggaagataccgaggagccagaggaagaggaggagggcgaagaaccaaactatccgctggagctgctctactgcctctacgagacccaggaagacgcattcgttcgccaggccttgtgtcgattccccgaactcgccttacaacgcgtgagattctgtcgcatggacgtcgccgtgctgagctattgtgtcaggtgttgtccggccggccaagctctcaggctgatttcctgccggctcgtggctgcccaggagaaaaaaaagaagtccctcggcaagcggctgcaggcgagtctgggaggtggatctagtcagggaacgaccaaacagctccctgcctcactcttgcatcctctgtttcaagcaatgaccgatcctctttgtcacctctcctctcttacattatcccactgcaagctgccggacgccgtgtgcagggacctcagtgaggctctgagggccgcgcccgcactgaccgaactcggattactgcacaaccggctcagtgaagctggtctcagaatgctaagtgagggcctggcttggccacagtgtcgtgtccagaccgtccgggtgcagttgcccgatccccagcggggcctgcagtacctggtcggcatgctgaggcagagtccagctctgaccacgttggatttgtccggctgtcagttaccagccccgatggtgacttatctgtgcgctgtgctacagcaccagggttgtggcttacagactctgtccctggcaagcgtggagctctcggagcagagcttacaggagctccaagcagtgaagagggctaagcccgacctcgtcatcacccaccccgctctcgacggacatcctcagccgcctaaggagttgatttccaccttctag

SEQ ID NO: 17695 - DNA, 240 bp, Artificial Sequence
  Description of Artificial Sequence: Synthetic coding sequence
atgtctcagtccggcgctgttagctgctgtcccggcgccactaatggaagcttggggcggtcagatggggtcgcgaagatgtctcctaaggatctctttgagcaaaggaagaaatactcaaacagcaacgtgataatgcacgagacttctcagtatcatgtgcaacacctagccacattcataatggataaaagtgaggctatcacctcagtggacgacgccattcgaaagttagtgtag

SEQ ID NO: 17696 - DNA, 543 bp, Artificial Sequence
  Description of Artificial Sequence: Synthetic coding sequence
atgggagacaagaagtcacccacccggccaaagcgacagcctaaacccagttctgatgaaggatactgggactgttctgtgtgtacctttcgtaattccgctgaggccttcaagtgcatgatgtgcgacgttcgaaagggaacctctacccggaagcctagacccgtgagccaactcgttgcgcaacaggtaacgcagcagttcgtccccccgacccagtccaaaaaagaaaagaaggacaaagttgaaaaggagaaatccgagaaagagactacgagcaagaagaattcacacaagaaaactcggcctcgactcaagaatgtggaccgatcttcagcccaacacctggaggtgaccgtcggcgatctgactgtgataattacggatttcaaagagaaaaccaaatcgcctcctgcaagctccgcagcatccgccgaccagcattcccaatcagggtctagctcagataatactgagaggggcatgagtagaagcagctccccaaggggcgaagcttcctctctcaacggcgagtcccactag

SEQ ID NO: 17697 - DNA, 2196 bp, Artificial Sequence
  Description of Artificial Sequence: Synthetic coding sequence
atgggttctggcgaagagcctggccagtccggggcttctctccgtacgggccctatggtgcagggaagggggatcatgacaactggcagcgggcaggaacccgggcaatctggcacctcacttcggactggccctatggggtctttgggacaggcggagcaggtaagttctatgcctatgggctctctagagcacgagggcctggtgagtctgaggccagtcggactgcaagagcaggaaggcccaatgagcttaggcccagtcggttcggccgggccagtggaaactagtaaaggacttctgggccaggagggtctcgtagagattgctatggactctcccgagcaggaggggctggtgggccctatggagattacgatggggagtttagagaaagcagggcccgtgagtcccggctgcgtgaagttagcaggtcaggagggcctggtggagatggtacttctcatggaacccggcgcaatgagatttctgcagctgtatcatgaagacttgctggcggggctgggggacgtcgctctgctgcccctcgaaggtcccgatatgactgggtttagactgtgcggggcccaggccagttgccaggccgccgaggagttcctacgcagcttgctaggatccatatcctgccacgtgctatgcttagaacatcctgggtctgccaggtttcttttgggtccagagggtcagcacttgctccagggcctggaagcacagttccagtgtgttttcggaaccgagcggctggccactgccacccttgacactggactggaggaagtcgacccaacggaggctctgcctgtgttgcccggaaacgcgcacacgctgtggacaccagattctacaggaggagaccaggaggacgtgtcgctggaagaagtgcgggagttgctggccactttggaagggctcgatttggacggcgaggactggcttcccagagagcttgaagaagaagggcctcaggaacagccggaggaggaggtcacaccggggcacgaggaggaagaacccgtagcgccctccactgttgcccctaggtggcttgaagaggaggccgccctccagttagccttgcacaggagccttgagcctcagggacaggttgcagagcaggaggaggccgccgctttgaggcaggccctcaccttatccctactcgaacagccgcccctcgaggccgaagagcctcctgacggcgggactgatggcaaagcccaactggttgtacacagtgcttttgagcaagatgttgaggaactggatcgtgctctccgggctgctctggaagtacatgtccaagaggaaacagttgggccctggcgccgcacactacctgccgaactaagagccagactggagaggtgccacggagtgtccgtcgccttaaggggggactgcactatacttcgcggtttcggggcacatcctgccagagccgcgcgacatctcgtagctctgctcgccggaccttgggaccagtctctggcattccctttggccgcaagcggccctacactggccggtcagaccctcaagggcccttggaacaacctggagcgtctggcagagaatacaggggaattccaagaggtagtgagggcattttatgataccctggacgcggctcgctcttctatcagggttgtaagagttgagagagtcagtcaccctctgcttcagcagcagtatgaactctacagagagcgcctcctgcagcgttgcgagcggaggccggtggaacaagtgctctaccacggaactaccgctccagctgtgccagacatttgtgcacacggctttaaccgctctttctgtggacgtaacgcgaccgtgtatggcaagggagtgtactttgctaggagagcctctctcagtgtgcaggacaggtactctccgccaaacgcggatggacataaggctgtgttcgtagccagagttttgaccggcgactacggccaaggccgccggggtctgcgggcaccgccactcaggggtcctggacacgtccttttacgatacgactctgccgtggactgcatctgccagcccagcattttcgtaattttccacgatactcaggcccttcccactcacctgatcacctgtgaacacgtgcccagagcatcacctgacgatcctagcgggctcccgggccgatcacccgatacttag

SEQ ID NO: 17698 - DNA, 1083 bp, Artificial Sequence
  Description of Artificial Sequence: Synthetic coding sequence
atgcaagtatatgaaggactggatatcatcaccaataaggtgtcagctcaggaacagagaatttgcaggcaccacatgataagctttgtcgatccacttgtgacaaattacactgtggttgactttcgcaacagggcaaccgccctgatctatcttcccgagacgaaattcctgttgttgtgggaagagccaataatcactctgaatctgtgcagcggcaaatttctgtctatcccaagatcacttcaggtgttcgaggagacaggaattagtcattcagaattcctgcatcgacagcacactgaagaagggggaggccccttgggaggccctctaaagttcagtaacccatgcattctctggctacatgccgatcaggctgtgctcgatgagagactggataaacgtgtagacgatatgctcgctgcagggctgttggaagaactacgcgatttccaccgcagatataatcaaaagaacgtttctgaaaacagccaggattaccagcatgggatcttccagtcaatcggattcaaggaatttcatgagtatctgattaccgaaggaaaatgtactctggagacatctaaccagcttcttaagaagggcattgaagccctaaaacaggtcacaaagagatatgcgcggaagcagaatagatgggtgaaaaacaggttcctcagtaggcccggcccgatcgtgccacccgtatatgggctggaagtaagcgacgtcagcaagtgggaggagtcggtcctagagccagctttggagatagtccagtcatttatccaagggcacaaacctacagccactccgatcaaaatgccgtataacgaggctgagaacaagcgctcctaccacctgtgtgatctctgtgaccgtattattattggggaccgagagtgggccgctcacatcaagtccaagtcccaccttaaccagttgaagaaacggcgtcggctggactccgacgcggtgaataccattgagtcccagagtgtgtcccccgatcataataaagagcccaaggagaagggcagccccgggcagaatgatcaagagctgaaatgtagcgtgtag

SEQ ID NO: 17699 - DNA, 828 bp, Artificial Sequence
  Description of Artificial Sequence: Synthetic coding sequence
atgtctgccgaggtgaaagtgaccggtcagaatcaggagcaattcctactccttgcgaaatctgcaaaaggggcagcattagcaactctgatccatcaagtgctcgaggcacccggtgtctatgtgttcggagagctactggatatgcccaatgtgcgggaactggccgagtccgattttgcctcgactttccgcctgctgaccgtgtttgcgtatgggacgtatgctgactacttagctgaggcccggaacctgcctccacttacggaggcacagaagaataaactgagacaccttagcgtggtcaccctcgctgccaaggtgaagtgcattccgtatgccgtcttgctggaggccctcgctctgagaaacgtgagacagttagaggatcttgtgattgaggccgtttacgccgatgtgttgcgcgggagcctcgaccagaggaaccagagactcgaggtcgactattccatcggcagggacatccagagacaggacctgagtgccatagcacggacgctccaagaatggtgtgtcggatgtgaagtcgtactttcagggatagaggagcaagtaagcagggccaaccagcataaggagcagcaattgggcctcaagcagcaaatcgaatcggaggtcgccaatctgaaaaagaccatcaaagttaccactgccgcagctgcagccgcaacctctcaggatcctgagcagcatctgaccgagctgcgcgagccggcccccggaaccaatcagaggcagccgtcgaagaaggcaagtaagggcaaaggactgagaggaagcgccaagatttggtccaagtcaaactag

SEQ ID NO: 17700 - DNA, 1692 bp, Artificial Sequence
  Description of Artificial Sequence: Synthetic coding sequence
atggagacggctaaacagaaagcgttggaggtcgctaaccgactgtaccaaaaagaccttcgagcgcctgatgtggttatcggggccgataccatcgtgaccgtaggggggctgatcctggaaaagcctgtggacaaacaagacgcttatagaatgctctctagactgtcaggaagggaacattcggtctttacaggggtggccatcgttcattgctcctccaaggaccatcagcttgacacacgagtcagcgaattttacgaggaaactaaggtgaagttttccgagttatcagaggaactgttatgggaatacgttcactccggggaacccatggacaaagccggtggttacgggattcaggctctgggcgggatgctggtagaaagcgtgcacggagacttcttgaatgtggtgggctttcctctgaaccatttctgtaagcaactagtcaaactgtactacccccctagacccgaagacctgcggcgctctgttaagcacgacagcattccggctgctgacacattcgaggacctttccgacgtcgagggaggaggtagcgaaccaacgcaacgagacgctgggtcacgcgacgaaaaggcagaagccggggaagcaggccaggcaacagccgaggcggaatgccacagaacgcgcgagactctccctccttttcccaccaggcttttggaacttatcgagggcttcatgttgtctaagggcctcctgactgcttgtaagctgaaagtgttcgacctcctaaaggatgaggcaccccaaaaggctgcagatattgcttctaaggtggatgcttccgcgtgcggaatggagagactcctcgatatatgcgccgccatgggtttactggagaaaacagaacagggatactctaacacagaaaccgcaaacgtgtacctagctagtgatggggaatattccctgcacggcttcatcatgcataataacgatctaacctggaacctgttcacttacttggagtttgcaattcgagaaggcacaaatcagcaccaccgtgctttagggaaaaaagccgaggatctattccaggatgcctattaccagagtcccgagactcgacttcgcttcatgcgagccatgcatgggatgaccaaactgacagcctgtcaggtggcgacagcctttaatctgtctcgattcagtagcgcttgcgatgtggggggctgcaccggtgccctggcaagagaacttgcccgtgagtatcccagaatgcaagtaacggtgtttgacttgcccgatatcattgagctcgccgctcatttccagccccctggtccacaggctgtacagatccatttcgccgccggtgacttttttagagaccctctgccttctgcagagctttatgtcttatgcaggatccttcacgattggccagatgacaaggttcataaactcctgtctcgcgtcgctgagtcttgtaaaccaggggccgggttactcctggtcgaaaccctccttgacgaggaaaagcgcgtggcacaacgggcactaatgcaatctttgaacatgctggtccaaacggaaggaaaagagcgatctctgggggagtaccaatgtttgcttgagttacacggctttcaccaggtacaggtggtgcatctgggcggagtactggacgctattctggcaaccaaagtggcgccctag

SEQ ID NO: 17701 - DNA, 828 bp, Artificial Sequence
  Description of Artificial Sequence: Synthetic coding sequence
atgtcagcagaggtcaaagttaccggacagaatcaggaacagtttttgctccttgccaagagcgcgaaaggtgccgccctggctacactcattcaccaggtccttgaggctcccggagtgtatgtgtttggggaacttctggatatgcccaacgtgcgcgaacttgccgagtcagacttcgcgtccacctttagactgcttacagtgtttgcctacggaacttacgccgactatttagccgaggctagaaatcttccccccctaacagaggcacagaagaacaagctgcgtcacctgagcgtggtgacgctggccgcaaaggtgaagtgcataccatacgcagtcctgctcgaggctctggctctccgcaatgtcagacaactagaggatctcgttatcgaggctgtgtatgctgatgtgctcagagggtcattggatcagcggaatcagagattggaagtggattactcaataggccgagacattcagcggcaagacctgagtgcaatagccaggactctccaggagtggtgcgtggggtgcgaggtggtgctgagtggcatcgaggaacaggtaagtagggcaaaccagcataaagagcagcagttggggctcaagcaacaaatagaaagcgaagtcgcgaaccttaaaaagacaattaaggttactactgcagcagccgcggccgccactagtcaggacccagagcagcatctcaccgaactccgggagccagctcccgggaccaatcagagacagccgtcaaagaaagcttctaagggaaagggcctcaggggctctgcaaaaatttggagtaagtccaactag

SEQ ID NO: 17702 - DNA, 999 bp, Artificial Sequence
  Description of Artificial Sequence: Synthetic coding sequence
atggaatatctggggggggggtcagctctggacctgctgaaaccagggccacttgaagagacctatatagccactatcctcagagagattttgaagggtttggactacttacattctgaacgcaaaatacatcgagatatcaaagccgccaatgtgctgctgagcgaacagggtgacgtcaagctcgccgattttggcgtggctgggcagctgaccgacacccagatcaagcgcaacaccttcgtgggaacacctttttggatggccccagaagtgatcaagcaatctgcctacgacttcaaagcagacatttggtcactaggtatcactgccattgagctggcgaagggagagccgccaaattcggacctccatcctatgcgcgtgttgttcctaataccaaagaactccccgcccaccttggaaggacagcattccaagccatttaaagaattcgtggaagcctgtctgaataaggatcctaggttcagacctacggccaaggagctgcttaagcataaattcatcacgagatacacaaaaaaaacatctttcctgactgagctgatcgaccggtacaaaaggtggaagtccgaaggccacggcgaagagagcagttcagaggacagcgacattgacggggaggctgaagacggtgagcaggggcccatctggacattccctccaacaatccgtccaagtccccacagtaaattacataagggcactgccctgcactctagccaaaagccagccgaacctgtcaaacgccagccaaggagccagtgtttaagcaccctggtgcgcccagtctttggcgagcttaaagagaaacataaacaatctggcggttcagtcggcgcgcttgaagagctcgaaaacgccttttccctggctgaggaatcctgcccaggcatttctgataagcttatggtgcacctggtcgaaagggtgcaaaggtttagtcataaccgcaatcacctcacaagtaccagatag

SEQ ID NO: 17703 - DNA, 279 bp, Artificial Sequence
  Description of Artificial Sequence: Synthetic coding sequence
atgaatttcactcctacacacacccccgtctgccgtaagcggacggtagtctcgaagcgaggcgttgcggtcagtggacctacaaaacgaaggggtatggcagacagcctggagagtacgcccttgcctagtccagaagataggcttgcaaagctgcacccttcaaaggagctcctggagtattaccagaaaaagatggctgaatgtgaggctgaaaatgaggacctgttgaagaaattggagctgtataaagaggcctgtgaaggacagcataagtag

SEQ ID NO: 17704 - DNA, 429 bp, Artificial Sequence
  Description of Artificial Sequence: Synthetic coding sequence
atggcccagaaggaaaattcatatccctggccttatggtcggcagaccgcgccctcgggcttgtctaccctgccccagagggttcttcgcaaagaacctgttacaccgtccgccttagtgctgatgagtagatccaatgtgcagcccacagcagcgcctggccagaaggtaatggaaaacagtagcgggacaccagatattctgacacgaaggcattttacgatcgatgacttcgagattggacgacctctggggaagggcaagttcggcaacgtctaccttgcaagggaaaaaaaaagtcacttcattgtggccctgaaggttctctttaaaagtcaaatcgagaaggaaggcgttgaacatcagttgcgcagagagatcgagattcaggcgcacctgcaatcgtggaggagctggcagatgctgtag

SEQ ID NO: 17705 - DNA, 501 bp, Artificial Sequence
  Description of Artificial Sequence: Synthetic coding sequence
atggatcaggaggattccgaaagtaaaaccgtctctgagcacggtgagagggactggatgaccgcgaagaaattttggaagcccggagattccctcgcccctcctgaagtagattttgaccgcctgctggcttcacttcaggacctgagcgagctggtcgtcgagggagatacccaagtcacccccgtgcccggcggagctcgactccgaaccctagagccaatccccctgaaactctacaggaatggaataatgatgtttgacgggcccttccaacccttttacgacccctcgacacaaaggtgcctgcgggatattctcgacgggtttttcccatccgagcttcagcgtttatacccaaatggtgtgccattcaaggtgattagttgtagtagtaaccatacctttggggactttgagggatccggcgatacgcagcccccccagaccccccctattctaaggggaagcagatgcactccctggggcacccccgtctag

SEQ ID NO: 17706 - DNA, 1473 bp, Artificial Sequence
  Description of Artificial Sequence: Synthetic coding sequence
atgcagtccctggacgacgccactaagcagttagatttcaccaggaaaactctcgccgaaaaaaagcaggagttggacaagttgcggaatgagtgggcttcccacacagctgcgctgacaaacaagcacagccaagagctcacgaacgagaaagaaaaggcgctccaagctcaggttcaataccagcaacaacatgagcaacaaaaaaaggacctggagattctgcatcaacagaacatacaccagcttcagaaccggctgtctgaactggaagccgccaataaagatctcacagagagaaagtataagggagattctactattagagaactcaaggcgaaactcagcggagtcgaggaagaactgcaacgaacaaaacaggaggtgctgtcgctgagaagagagaatagcactctcgacgtggagtgccacgaaaaggagaagcatgtcaatcagctacaaaccaaggtggcagtactggagcaggagatcaaggacaaagatcagctggtacttaggacgaaggaagcatttgatacaatccaggagcagaaggtagttctggaggagaatggggaaaagaaccaggttcagctcggaaaactcgaagcgaccattaaatcgctgagcgccgagttattgaaggctaacgaaataatcaaaaagctgcagggagacttaaagaccctcatgggaaaactgaagctcaaaaacaccgtcacaatccagcaggaaaaactgctcgcagagaaggaggagaagctccagaaggaacaaaaagaacttcaggacgtcggccagagtctgaggatcaaagaacaagaagtgtgtaaactgcaggagcaactggaggcaacagtcaagaagcttgaggaatccaagcagttgttgaaaaacaatgagaagctcattacatggctgaataaggagctgaacgaaaatcagctggtcagaaagcaggacgtgctaggccctagtacgacccctccagcccattcaagcagtaatactattcgctccggcattagccctaatctgaatgtcgtggacgggaggctgacctacccaacatgcgggatcgggtacccggtttcctcagcttttgccttccaaaacactttccctcattccatctccgccaagaacacgagccaccctggatccggcactaaggttcagttcaatttacagtttactaagccgaatgcatcgctcggtgatgtgcagtctggagccactatttctatgccatgtagcacggataaagaaaatggagagaacgtcgggcttgagagcaaatatctgaaaaagagagaagactcaatcccattgcgtggcctgtcacaaaaccttttcagcaacagcgaccaccagagggacggcacgctgggagcactgcacacaagctccaagcccacagcgctcccaagcgcttctagcgcctacttccctgggcagcttccaaactcctag

SEQ ID NO: 17707 - DNA, 3015 bp, Artificial Sequence
  Description of Artificial Sequence: Synthetic coding sequence
atgctgcgtaccgcagggcgcgacggtctgtgtcgcctgagcacttacctggaggagttagaagcagtggaactcaaaaagtttaagctctatctgggcaccgccaccgaactgggagagggaaaaatcccttggggatccatggagaaggctggccccttagaaatggctcagctgctgatcacccactttggcccggaggaagcgtggcgactggccttatccaccttcgagcggattaatcggaaagatctctgggaacgtggacagcgggaggatctggttagagacaccccccctggcggcccgagctcgctgggcaaccagtcaacatgcctgctagaggtgtctttggtcacgcctagaaaggaccctcaagaaacctatcgcgactacgtgcgccgaaagtttcggcttatggaagatagaaatgctaggctcggagagtgcgtcaacttgtcacaccgatacacacgactcctgctggtcaaggagcattctaatcccatgcaggtgcagcagcagttgctcgacactggtcggggccacgccagaaccgtcggacaccaggcttctcccattaagatcgaaactcttttcgagcccgatgaagagcgacccgagcccccccgcaccgttgtcatgcaaggcgccgcaggaattggcaagtccatgctggctcataaagttatgctggactgggccgatggcaagctgtttcagggcaggtttgactatctgttctatattaactgcagagaaatgaaccagtccgctaccgaatgttccatgcaggatctgatattctcctgttggcccgagccaagtgcccctctgcaagagttgatcagggtgcccgagagacttctgtttatcattgacggcttcgatgagttaaaaccttcatttcatgacccgcagggcccgtggtgtctctgctgggaggagaaacgtcctacggaacttctcttaaattccctaatcagaaagaaactacttcccgagcttagtctccttattaccacccgtcctaccgccctggagaaactgcaccgcttactggagcacccgagacacgtagaaatcctggggttcagtgaggccgaaaggaaggagtacttttacaagtactttcataacgcagaacaggccggtcaggttttcaactatgtccgagacaatgagcccctcttcacgatgtgctttgttccactcgtgtgctgggtggtatgtacttgcctgcagcagcagcttgaaggtggggggctgctaaggcaaaccagccggaccactacagccgtctacatgctgtacctgttgagtctgatgcagccgaagcctggagcccctcgcctccagcctcctccgaaccagaggggactctgcagccttgccgcagacggactgtggaaccagaagatactcttcgaggaacaagacctacgaaagcacggtcttgacggagaggatgtgagcgcattccttaacatgaacattttccagaaagatataaattgcgaacggtattactctttcatacatttatccttccaggagttttttgccgctatgtactatattctggatgagggggaaggcggagctgggcccgaccaggacgtgacccgtttactgactgagtacgcctttagtgagagatctttcctggcgctcacatctcgctttctgtttggtttactgaacgaggaaacaaggtcccatttagagaagagtttatgctggaaagtttctccccacatcaaaatggatcttttgcagtggattcagtccaaggcgcaatccgatgggtccaccctccaacaggggtcactggagttcttcagttgtttatacgagattcaggaagaagagtttatccagcaggcccttagccacttccaagtgatcgtcgtgagcaacatcgccagcaagatggaacatatggtgtcatctttttgtctgaagaggtgtcgctccgcccaggtcttgcacctatatggcgccacctatagcgcagacggagaggatcgtgctcgctgttcagcgggggcccacaccctcttggtacagcttcccgagcggactgtcttactggatgcctatagtgaacatttggccgctgccctttgtactaaccccaacttgattgaactgtcactgtacaggaatgctttaggctctaggggcgtgaagctgctctgccaagggctacgtcaccctaattgcaagctgcaaaacctgaggcttaagaggtgtaggatcagctcttctgcctgcgaggacctgagcgccgcattgatagccaataagaatctcactcggatggacctgtccggcaacggagtgggattcccaggtatgatgctgctgtgcgaaggccttcggcatccccaatgccgcctccaaatgattcaactaagaaaatgccaattggaatcaggcgcgtgccaggaaatggctagtgtgcttggcacaaaccctcaccttgtagagcttgacctaactggaaacgccctcgaggatctggggctccggctgttatgccaggggctcagacaccccgtgtgcagactgcgaaccctgtggctgaagatctgtcgactgaccgcagcagcatgtgacgagcttgcaagcacactgtctgtcaatcagtctcttagagaacttgacctttcactaaacgagctcggggacttgggggtgctgttgctgtgtgagggacttcggcaccctacttgtaagttacaaaccctgcgactgggcatctgccgtctgggctcagccgcatgcgaagggttatctgtggttctgcaggccaaccataacctgcgcgagctggatttgtcattcaatgacttaggtgactggggtctttggttgctggctgagggtctgcagcacccggcctgcaggctgcaaaaactttggctcttcggaatggacctcaacaagatgacacacagccgactcgcggctttgcgggtgaccaagccttatctggatatcggctgttag

SEQ ID NO: 17708 - DNA, 2517 bp, Artificial Sequence
  Description of Artificial Sequence: Synthetic coding sequence
atgaccggagccgagatcgagcctagtgcacaggctaagcccgaaaagaaagcaggagaagaggtcattgccgggccagagagggagaatgatgtcccactcgtcgtgcggccaaaagttcgaacacaggccacgaccggggccaggcctaagacagaaaccaaatcagtgcctgcagcacgtcctaagactgaggctcaagccatgtccggagccaggccgaaaacagaagttcaggtcatgggcggcgctcggccaaaaactgaggctcaggggattacgggggctcgccctaaaaccgacgcccgtgctgttgggggagctcggtcaaagaccgatgcaaaggcaataccgggagcacggcctaaggacgaggcacaggcatgggctcagtctgaatttggtaccgaagccgtgagccaggccgaaggtgtgtcccagaccaatgccgttgcgtggcctctcgccaccgccgaatcgggatccgtgaccaaaagtaaggggttgagcatggaccgcgagcttgtgaatgtagacgcagaaaccttcccaggtacgcagggtcaaaaaggaatccagccttggttcgggcctggagaggagactaacatgggttcatggtgctacagccgacccagggctcgcgaggaagcctctaacgagtcgggcttttggtccgccgacgagacatcaacagcttccagtttctggaccggggaagagacatccgtgagaagctggcccagagaggaaagcaacacccggtccagacaccgcgccaagcaccagacaaacccacgctcccggccccgttccaaacaggaggcctatgtggacagctggagtggctcagaagatgaggccagtaatccctttagcttttgggtgggcgagaatacaaataatctctttcgccccagggtgcgagaagaggcaaatattcggtctaagctaagaactaacagagaagactgctttgaaagcgagtccgaagatgagttttacaagcagtcttgggttctgccaggagaggaggctaacagcagattccgccaccgcgacaaggaggacccaaacactgccttgaaactccgcgctcagaaggacgtcgattctgatcgtgtgaaacaggagccacggtttgaagaggaggtgatcattggatcctggttctgggctgagaaggaggcctcactagagggtggtgcatctgccatttgcgagagtgaacccggcacagaagagggtgccattgggggcagtgcctattgggctgaggagaaatctagcctcggggccgtggcccgggaagaggccaaacctgagagcgaggaggaagctatcttcggaagttggttttgggatagagacgaggcctgcttcgacctcaacccgtgccctgtgtataaagtgtctgacaggtttcgggacgcggctgaggaattgaatgcgtcgagtaggcctcaaacttgggacgaagtgaccgttgagtttaagccaggcttattccatggagtggggtttaggagtacatctccattcggcataccagaagaggcaagcgaaatgctggaggctaaaccaaagaacctagagctgtcacctgaaggagaggagcaagaaagtctcctgcagccagatcagccttctcccgagttcacttttcagtatgatccatcgtaccgctctgttagggagattcgggagcatctgagagctcgggagagcgcggagtctgagagctggagttgctcttgcatccaatgcgagctgaagataggctccgaggagtttgaagagttccttcttctgatggacaagatcagggatccattcatacacgaaatcagtaagatagccatgggaatgcggagcgcatctcagtttactagagacttcatccgcgactccggggtggtgagcttgattgaaactttgctcaattacccctcatcacgagtaagaacctctttcctggaaaacatgattcatatggctcccccataccccaatctgaacatgatcgaaaccttcatctgccaagtctgcgaagagacactggctcacagtgtggattcactggaacagctgaccgggatccggatgctgaggcatcttacaatgactatcgactaccataccctgattgccaattacatgtccgggtttttgtctcttctgaccaccgctaacgcgaggactaagttccacgtgctcaaaatgctgctcaatctgtcagagaaccccgccgtggcgaaaaagctattcagcgccaaggcattgagcattttcgttggactttttaacattgaggaaactaatgataacatccagatcgtaattaagatgtttcagaacatcagtaacattattaaaagcggcaagatgagcctgatagatgatgattttagtctggagccactgataagtgccttccgcgagttcgaggagcttgccaagcagttgcaggctcagattgacaatcagaatgacccagaagtgggacagcagtcctag

SEQ ID NO: 17709 - DNA, 165 bp, Artificial Sequence
  Description of Artificial Sequence: Synthetic coding sequence
atgggaaactcagacagccagtatactctgcaaggctccaaaaatcattctaataccattaccggggcgaaacagatcccctgttcacttaaaattaggggtattcacgcaaaagaggaaaaaagcctgcacgggtgggggcatggatccaatggcgctgggtag

SEQ ID NO: 17710 - DNA, 1269 bp, Artificial Sequence
  Description of Artificial Sequence: Synthetic coding sequence
atggcttcactcagcagggccttaagggttgccgcagcccacccccgccaatcacctacacgcggtatgggcccctgcaacctgagcagcgctgcaggccccaccgccgagaagtctgtgccctaccagagaactctgaaagagggacagggcacctctgtggttgcacagggcccaagtagaccactgccttcaactgccaacgttgttgtcatcggcggtggcagcctggggtgtcagacactttaccacctggccaaattgggcatgtctggtgccgtactgctcgaacgcgagcggctcacctctggcacaacatggcacacggcaggcctgctttggcagctgagaccatcagatgtagaggtggaactgcttgctcatactcgacgagtcgtaagtagggagctggaggaagagaccgggttacataccggctggatacagaatggtggactgtttattgcttccaataggcaacggctcgacgagtataagcgtcttatgtcgttaggaaaggcgtacggagtggagagtcacgtactgagtccagctgaaaccaagaccttgtaccctctaatgaatgtggatgatctgtacggcactctgtacgtccctcacgacggcactatggatcccgctggaacctgcacaactcttgctcgcgctgcatccgcaaggggagcccaggtgattgagaattgcccggtaactggcattcgtgtatggacggacgacttcggagtacgccgggtggccggggtggagacccagcacggcagtattcaaacgccttgcgttgtgaattgtgctggcgtttgggccagcgccgtaggacgtatggctggtgtcaaggtccctctggtggcaatgcaccatgcctacgtggttactgagaggattgagggcattcaaaacatgcctaacgtgcgcgaccacgacgccagcgtgtatttgcggctacagggagatgccctgtccgtgggaggctacgaggcgaacccgatcttctgggaagaagtaagtgacaagttcgcgttcggcctcttcgacctggactgggaggttttcacccagcatatcgaaggtgctataaatcgtgtccccgtgctggagaagaccggcatcaagtcgactgtttgtggccctgagagttttacccctgaccataagccactgatgggtgaagccccagagctgcgagggttcttcctgggttgtggctttaactccgccggtgagtctgggcaggcactacttgccccatag

SEQ ID NO: 17711 - DNA, 327 bp, Artificial Sequence
  Description of Artificial Sequence: Synthetic coding sequence
atgtcaatgttgaaaccatcgggactgaaggcacccacaaaaatactgaaacccggtagcaccgccctcaagacccctaccgctgtcgtcgcccccgttgaaaaaacaatcagtagtgaaaaggcttccagcacaccatcgtccgagacccaagaggaattcgtggatgacttcagagtgggagaaagggtgtgggttaacggcaacaagcccggcttcatccagtttctgggagagactcagttcgccccgggtcagtgggcgggaattgtgctggatgaacccatcggcaaaaacgatggctctgtggcaggcgtcaggtattag

SEQ ID NO: 17712 - DNA, 2148 bp, Artificial Sequence
  Description of Artificial Sequence: Synthetic coding sequence
atgaaacgcggccggctgcctagctcatcagaagacagcgacgataatggcagtctttccacaacgtggtcccaaaatagccgtagtcagcatcgcagaagctcgtgttccaggcatgaggaccggaaaccgtctgaggtttttcggacggatctgattacagccatgaagctgcatgacagctatcagttaaaccctgacgaatattatgtgctcgccgacccttggcggcaggagtgggagaagggtgtgcaagtgcctgtttcgcccgggactataccccagccggtcgcccgagtggtatctgaggagaagagccttatgttcatacgccctaaaaaatatatcgtttcttccggttccgaaccaccggagctggggtacgtagatattaggacactagctgacagtgtctgtagatatgacctcaacgacatggatgcggcttggctcgaactgaccaacgaggagtttaaggaaatgggcatgccagagttagacgaatataccatggagcgggttctggaggaattcgagcagagatgttatgacaacatgaatcatgcgatcgaaaccgaagaggggctcggtatagagtacgatgaagacgtggtgtgcgacgtatgccagtctcccgacggggaagacggaaatgaaatggtgttttgcgataagtgcaatatttgcgtgcaccaagcatgttatggcatcctgaaggtgcccgaggggagttggttgtgcagaacctgcgctctgggcgtgcaacctaaatgtctgctgtgtcccaagaaaggaggggccatgaaacccactcgatccgggaccaagtgggttcacgtgagctgtgccttgtggattccagaggtatcaataggcagcccagagaaaatggagccgatcactaaggtgagtcatataccctccagcaggtgggccctggtctgtagcctgtgcaatgagaagtttggcgcctcaatccagtgttcggttaagaattgtaggactgccttccatgtgacctgcgctttcgatagggggttggagatgaagacaattcttgctgagaatgacgaagtcaagttcaaatcctactgtccaaagcactcaagccatcggaaaccagaggagtcactgggcaagggcgctgcccaggagaacggcgcccctgaatgtagccctcgaaaccctctggagcctttcgcaagtctcgagcagaatagggaagaagcccaccgcgtgtccgttaggaagcagaagttgcaacaattagaggacgaattttacactttcgttaacctcctggatgtcgccagggccctgcgcttgccggaggaggttgtcgatttcttgtatcagtattggaagctcaagcgcaaggtcaacttcaataaacccctgatcacccccaaaaaggatgaggaggacaacctggccaagcgagagcaggatgtgttattcagaaggctgcagctgtttacacaccttaggcaggacctagagagagtgaggaatctgacctatatggtgactcggcgtgagaaaatcaagcgtagtgtttgtaaagtgcaggaacaaattttcaatctctacaccaaacttctggaacaggaacgggtgagtggcgttccatcgtcatgctcttcgtcgtccttagagaatatgctgctctttaattctccatccgtgggaccagacgcccctaaaattgaggatctgaagtggcattccgcctttttcagaaagcaaatggggacctccctggtccactcactgaagaagccacacaagcgcgatcccctgcagaattctcctgggagcgagggaaaaaccttactgaagcagcccgatctatgtgggagacgtgagggcatggtggtgcctgaaagcttccttgggcttgagaaaaccttcgcggaagcccgtctgatcagcgcccaacagaaaaacggggtggtgatgccagatcatggtaagcggcgggacaacagatttcattgcgaccttattaagggggacctgaaagataagtcatttaagcagagccacaagccactccgatctactgacgtgtcacaacgccacttagacaacactcgggcggccgcgatttggcggttccgcgtcatctggcaaggaccagccgcctag

SEQ ID NO: 17713 - DNA, 162 bp, Artificial Sequence
  Description of Artificial Sequence: Synthetic coding sequence
atgggacgacgcagcaccagtagtaccaagtctggaaaatttatgaatccgaccgatcaggcccgcaaggaagcgcgcaagagagagctcaagaaaaacaagaaacagaggatgatggtcagggccgcggttctgaagatgaaagatcccaagcagatttag

SEQ ID NO: 17714 - DNA, 1035 bp, Artificial Sequence
  Description of Artificial Sequence: Synthetic coding sequence
atgaccacgagaagtgtgctggatgtggaaacttttgtggccgatatcctgaagggtgagaatctgtccaaaaaagccaaggagaagcgcgagtccctgatcaagaagattaaagatgtgaaatcgatttacctgcaggagtttcaggacaaaggcgatgccgaggatggagaggagtacgacgatcccttcgccgggccgcccgataccatctctctggcctcggagagatacgacaaagacgacgaggcccccagcgacggggcccaattcccaccgatcgccgcccaggaccttccctttgtactcaaagctggatacctggagaagcggagaaaagatcatagcttcctgggatttgagtggcaaaaaaggtggtgcgccctgtccaaaacggtgttctattattatggatcggacaaggacaagcagcagaaaggcgaatttgctatcgacgggtattccgtcagaatgaacaacaccctgcggaaagacggaaagaaagactgctgctttgagattagcgctccagacaagagaatataccaattcaccgccgcctcgcccaaagatgccgaggaatgggtgcagcaactcaaattcgtgctgcaggatatggagtccgacatcatacccgaggactacgacgagagaggagagctctacgacgatgtagaccatcctctgccaatctcaaacccgttgacttcatcacaaccaatcgacgacgagatctatgaagagctgcctgaggaggaagaggacagcgctcccgttaaggtagaggaacagcgtaagatgagtcaggattctgtgcaccacacgtcgggtgacaagagtacagattacgcgaatttttaccagggtttatgggactgtactggagcctttagcgatgagttgtcatttaagcgaggcgatgtgatttacatccttagtaaggagtataatcggtacggttggtgggtgggcgagatgaaaggcgctattggactcgtgccgaaagcatatataatggagatgtatgacatctag

SEQ ID NO: 17715 - DNA, 2868 bp, Artificial Sequence
  Description of Artificial Sequence: Synthetic coding sequence
atggaagtggggagtgaggaggaaaagtgggagaaacttgacgcagaatttgatcactttgttgtagacatgaagcccttcgtgctgaagctccctcaccggacggagcgccagcgatgtgccctctggattcggaagctctgcgagcctagtggaaccggggctggcattatggggaggaaaaatcgaaatttatacgctaagctgttgttacatatgctcaagaggggcgcattggagggtccattcacccatagacctgagccaggcacacttaagatacttccaagttacatgtcaatctactttgatgagcccaaccccgccagagccaaaggatcttctcctgagggcctgcccgcctgggtgttgggcgaattggagaccagcgaacataagttgaatgaaagttggaagctctccagtggcgaggataacactctggttcagagcccaaccgacgtgtatagtcgtgaacaatatactggaaagctgagagttcggagccactcgctctcacctacacaccgcgaagatggacagaacattacccccaagatctgcgaggtttattccaaaaaatccccggtgagcttggacgacagcgatattgaggcgagactgaactcgtggaatctgggaatcgagaaccctcggtacctgcgccagaaacctattcccgtatccctcatgactccgaaattttctcttcgcaaaagtagctctttccatgatgaccattttctctccagaatccgagagaaagagttggacatgaaaactaagatgatggaggcaaagttccacgaagagaagctcaagttgcaacagaaacatgacgccgacgttcagaaaatcctggaacggaagaataatgagattgaggagctgaaaacgctgtatcgcagcaaacaacacgagactgaagaaactatcagaaaactggagaagaaagtgcagaccctgataagagattgccaagtgatacgggagacaaaagaagaccagatcgctgaactcaagaagatctgcgaacaaagtactgagtctctaaacaatgactgggaaaaaaagctacacaacgccgtggccgagatggagcaagaaaaatttgacctacaaaaacagcacacggaaaacatccaggagctgttggaggacactaacgtacgcctgaacaagatggagtccgaatatatggcccagactcagagcactaaccatatgatcaaggagctggaggcacgagtgcagcagctaaccggagaagctgagaatagtaaccttcaacggcagaaactgatccaggaaaaagcggaattagagaggtgctatcaaatcacttgttctgagttgcaggaagtgaaggcacgccgtaatactctgcataaggaaaaagaccatcttgtgaacgattacgaacagaacatgaaactcctgcagacaaagtacgacgccgatattaaccttctcaagcaagagcacgccctgagcgcaagcaaggcatcatcgatgattgaagagttggaacagaatgtctgccagcttaagcagcagctgcaggaatcggaactccagcggaagcagcaactccgtgaccaggagaataaattccagatggaaaaaagccacctgaagcatatctacgagaaaaaggctcacgatctccagagtgaactggataaggggaaggaggatacccagaaaaagattcacaaattcgaggaggccttgaaagaaaaggaggagcagttgacgcgcgtcaccgaagtacagcgattacaggcccagcaggccgacgcggcactcgaggaattcaagcgacaggtggaactcaactccgagaaggtttatgcagaaatgaaagagcaaatggaaaaagtggaagcagatttaacccgctcaaagagcctcagggagaagcagagcaaagaatttctatggcaacttgaggacattcgccagcgctatgaacagcaaattgtcgagttaaagctcgagcacgagcaagagaagacccacctattgcaacaacacaacgctgaaaaggactcattagtacgggatcatgagcgcgagatagagaatctcgagaagcaactgagagcggcaaatatggagcatgaaaaccagattcaggaattcaagaagagggatgcccaggtcatcgctgacatggaagcccaggtgcataagctccgggaagagttgataaatgtaaattcacaaaggaaacagcagcttgtcgaactggggttactccgggaggaagagaaacagagagccacacgcgagcacgaaatcgtcgtgaataaactcaaggcagagtcagagaaaatgaagatcgaactgaagaagacgcacgcagctgagacggagatgacattggagaaggctaattcaaagctgaagcagatcgaaaaagaatacacacagaagctggccaagtccagccagataatcgccgaactgcaaacaacaatctcaagcctgaaggaagaaaattcgcaacagcagcttgcagcagagcgcaggttacaggatgtaaggcagaaattcgaagacgagaagaagcagctgatccgcgacaatgatcaggctatcaaggtcctccaggatgaattggagaacagaagtaatcaagtgagatgcgccgaaaaaaaactgcagcataaagaactcgaatctcaggaacaaatcacctatatcaggcaggaatatgaaaccaagctgaaaggattgatgcctgcatctcttcgccaggagctagaagacaccatttccagtctcaaatctcaggttaatttcctccagaaacgggctagcatactgcaagaggagctgactacttaccaggggagacggtag

SEQ ID NO: 17716 - DNA, 834 bp, Artificial Sequence
  Description of Artificial Sequence: Synthetic coding sequence
atgctctctcaaaaggaagtggccgttgccgacgccaaaaaaagtctggaactgaatccaaacaactccacggccatgctaaggaaggggatttgcgaataccacgagaaaaactatgcggcagcattagaaacttttaccgaaggtcagaaactcgacagcgccgacgccaatttcagtgtgtggattaaaagatgtcaagaggcccagaacggttccgagagtgaggtgtggacccaccagtccaagattaagtacgactggtaccagactgagagccaagtggtgataaccctgatgataaaaaacgtgcagaagaacgacgtgaacgtggaattctccgaaaaagagctgagcgcgctggtcaagttgccttccggtgaggactacaacttgaagctggaactgctgcaccctatcatacccgagcagtccacttttaaggtgctgtcaaccaagatcgagattaagttgaaaaagcctgaggcagtgcgatgggaaaaattggagggtcagggggacgtgcccacccccaagcagttcgtagcagacgtgaagaacctttaccctagcagttcaccttatactagaaattgggataaacttgtaggagaaatcaaggaagaagagaagaatgagaagcttgaaggcgatgcagccttgaatcgcctgtttcagcagatctacagcgatggaagcgatgaggtgaagagagccatgaataagtctttcatggaatctggagggactgtgttatcaaccaactggtctgacgtcggtaaaagaaaggtggagatcaaccctccagacgatatggagtggaagaaatattag

SEQ ID NO: 17717 - DNA, 807 bp, Artificial Sequence
  Description of Artificial Sequence: Synthetic coding sequence
atgggatccgcaaaatcagtccctgtaactccagctcgaccacctcctcacaataagcatctggctcgggtggccgacccgagaagtccgagcgccgggattttgcgcactcccatacaggtggagtcgtctccccagcccggactgccagctggcgaacagctagagggactgaagcacgcccaggacagtgatccacgctcccccactctaggtatcgcccgaacacctatgaagacctcttcgggagatccccccagcccactagtaaaacagctttccgaggtttttgagacagaagacagtaagtccaacctcccccccgaacctgtgcttcctccggaggccccgctgtcttccgagttagacctgcccctcgggacacagttatccgtggaggagcagatgccaccctggaaccagacggagttcccaagtaagcaggttttctctaaggaagaggcccgccagcctaccgagactcccgtcgcgtcccagagctcggataaaccaagccgcgaccccgaaacaccccgtagctcaggatccatgcgcaatcgttggaaacctaattcctccaaggtcttgggacgcagtccacttaccattctgcaagatgacaattcacctggaaccctaaccctccgacagggcaagagaccttcccctctgtcagaaaacgtgtccgagctgaaagagggcgcgattctcggcactggccggctcctgaaaactggcggccgcgcatgggagcagggtcaggatcacgacaaagagaatcaacatttcccacttgttgaatcctag

SEQ ID NO: 17718 - DNA, 1140 bp, Artificial Sequence
  Description of Artificial Sequence: Synthetic coding sequence
atggtgtttaagctgaagaccaaagaggagcagcatagcatgctaggcagtgggttcaaagctgagagactgagggtcaatctgcgcctcgtgattaatcggcttaaactcttggaaaagaaaaagacagagttagctcagaaagctcgcaaggagatcgcagattatctcgcagcaggaaaggatgagcgagcacgaatcagggtggaacacatcatacgggaggactatcttgttgaggcaatggagattctggagctctactgcgatctgctgctggctcgctttggactcatacaatcaatgaaagagctggattctggattagccgagagcgtgtcaacgcttatctgggccgccccacgattacaaagcgaggtggccgagctgaagatagtggctgaccagctatgcgcaaagtatagtaaggaatatggaaaactctgccgcacaaaccagataggtaccgtgaatgaccgactcatgcataaactcagcgtggaagcccctcccaaaattctggtggaacgatatctcattgagatcgctaaaaactacaatgtcccatacgaaccggactccgtggtcatggccgaggccccacccggtgttgagaccgatctgattgacgttgggtttaccgacgatgtcaagaagggaggaccaggccggggcggttcgggaggctttaccgctccggtcggagggcctgatggtactgtgcctatgccaatgcccatgcccatgcctatgccgagtgccaacacgcccttcagctatccgctgcctaaggggccctcagatttcaacggactgccaatgggcacgtaccaggcatttcccaatatccacccacctcagatcccagccactccccctagctatgagagcgttgacgacatcaatgctgataagaatatatccagcgctcagatcgtgggacctggcccgaaaccggaggcttctgctaaacttccttcaagaccagctgataactacgataactttgtcctgcccgaactgcccagcgtgcctgacaccctgcccacagcgagcgcgggcgcttccaccagtgcaagcgaggacatcgactttgacgacctgtccagaagatttgaggaactcaaaaagaagacgtag

SEQ ID NO: 17719 - DNA, 903 bp, Artificial Sequence
  Description of Artificial Sequence: Synthetic coding sequence
atggccagaccactgagcacgcctagtagttcccagatgcaagcgcgcaagaagcataggggtatcattgaaaaaaggcgtagggatagaatcaattcctctctgtcagagctgcggaggctggtgcctaccgccttcgagaaacaggggagcagtaagctcgaaaaagctgaagtgctgcagatgacagtagaccatcttaaaatgctgcacgctacaggaggcaccggctttttcgatgcccgggcgttagccgtcgattttcggtcaatagggttccgtgagtgtctgaccgaggtgatccggtaccttggcgttctcgaaggaccttcctctcgcgccgacccagtccgtattcggctgctgagtcatcttaattcatatgccgcggaaatggagccttcccctacacccacaggaccactggccttccccgcctggccttggagtttcttccattcatgccctgggctcccagcccttagcaatcagctcgcgatccttggccgagtcccttctccagttctccctggtgtttcctcacctgcctaccccattcccgcgctgcggaccgcccccctgaggcgggccaccggcatcatcctcccggccagaaggaatgtacttccgtctcggggagcgagcagcacccgccgcgcccgaccactagagcgacctgcaacccccgtgcccgtggcccctagcagccgggctgcgcgcagctcccacattgcccccctccttcagagtagttcacccaccccacccggcccgactggctcagctgcctacgtcgccgttccaacccctaactcatcatctcctggacctgcaggtagacccgccggggccatgctgtatcactcctgggtgtccgaaattaccgagatcggggcattctag

SEQ ID NO: 17720 - DNA, 318 bp, Artificial Sequence
  Description of Artificial Sequence: Synthetic coding sequence
atgagtgtggtgccgcctaatcgaagccagactggctggccaaggggagtgactcaattcgggaacaagtatatccagcagaccaagcccctgaccctggagagaacaatcaatttatacccattgaccaattatacattcgggaccaaagaaccgctgtatgagaaggactccagtgtcgccgccagatttcaaaggatgcgggaggaatttgacaagatcggcatgaggaggacggtggaaggcgtgttgatcgttcacgaacatcggcttcctcacgtgctgttacttagccggtttaacttcatttacaactag

SEQ ID NO: 17721 - DNA, 588 bp, Artificial Sequence
  Description of Artificial Sequence: Synthetic coding sequence
atggggaactccgactcacagtataccctgcaaggcagcaagaaccactccaatacgatcaccggggctaagcagattccatgtagcttaaagattcgggggatccacgctaaggaagaaaagagcttacacgggtggggacacggctctaacggagcgggttataagagtcggagtctggccaggagttgcctgtcccacttcaagagcaaccagccctatgcctctagactcggtgggcccacttgcaaagtaagcagaggcgttgcttactctacccatagaacgaatgctcctgggaaagacttccaggggatctccgcagccttttccacagaaaatggttttcattcagtggggcacgaactagccgacaatcatataacatccagagattgcaatggacatctcctaaattgttacggtaggaatgagtcaatagcaagtaccccccccggtgaggataggaagtcaccccgcgtactgatcaagaccttaggcaagctggatgggtgccttagagttgaatttcacaatggcgggaaccctagcaaggtgccagctgaagattgcagcgaacctgtctag

SEQ ID NO: 17722 - DNA, 1581 bp, Artificial Sequence
  Description of Artificial Sequence: Synthetic coding sequence
atggttcccggcgaggagaatcaactggtcccaaaggaagacgtcttttggcgatgccggcagaacattttcgacgaaatgaaaaagaagtttctgcagattgaaaacgccgcagaggaaccacgtgttctctgcatcatacaggacaccacaaactctaagacggtcaatgagcggattaccttaaatcttcctgcatcaacgcccgtgagaaaactctttgaggatgtggctaacaaggtcggatatataaacggaacctttgaccttgtgtggggtaacggaataaatactgctgatatggcacccctcgaccacacgagcgacaagtccctgttggacgcgaactttgagcctggaaagaaaaatttcctccacttaacagataaggacggcgaacagcctcagatattgttagaggattcttctgccggcgaagattctgttcatgaccgctttattggtccgttaccccgggaaggatccggtggtagcacatctgactacgtgagccagtcatactcgtactccagcatcctgaacaaatccgaaaccggatatgtaggacttgtcaaccaggcaatgacgtgttacctgaactccctactgcagactctcttcatgactcctgagttcaggaatgcactttacaagtgggaattcgaggagtcggaagaggatccggttaccagtattccataccaactccagaggttgtttgttttgcttcaaaccagcaagaaaagagcaattgaaactaccgacgtaactagatcctttggttgggacagtagtgaagcttggcagcaacatgatgtgcaagaactttgcagagtcatgtttgacgcgctcgagcagaaatggaaacagacagaacaagctgatctgatcaatgagctatatcaggggaaattgaaggactacgtgcgttgcttggaatgtggttacgagggatggcggatagatacctaccttgatatcccactcgtaatcaggccctacggatcttcgcaagcatttgcctctgtagaggaggccctacatgcttttatccagcccgagatcctggacgggcccaatcaatatttttgtgagaggtgtaaaaaaaaatgcgatgcgagaaaaggtctgaggtttctgcatttcccctacttgctgacgttacagcttaagcgattcgattttgactacaccacaatgcaccgcatcaaattaaatgaccgaatgacatttccagaagagcttgatatgagtacctttattgacgttgaggatgagaagtccccccagactgagtcgtgtacggactcaggcgcggagaacgagggaagctgccacagcgaccagatgagtaatgacttttctaatgacgatggcgtggacgaggggatctgcctggagacaaacagcggtacggagaagatttccaagtctggcctggaaaagaactcgctaatttacgaacttttctccgtgatggtgcactcagggagtgccgccgggggccattactatgcgtgcatcaagtcatctgtgatgtcctctgggactgcttcaatgatcaatatgagtgcagggtag

SEQ ID NO: 17723 - DNA, 963 bp, Artificial Sequence
  Description of Artificial Sequence: Synthetic coding sequence
atggggaaagagcaggaattgctggaagccgctcggacagggcatttgccggccgtcgagaagttgctgagcggcaaaagattgagcagcggattcggcgggggcggtggtggagggtccggcggcggcgggggggggagcgggggcgggggcgggggactagggtcctcttcacaccctttgtcatccctgctaagcatgtggagaggcccaaatgtcaactgtgtggatagtaccggatataccccactccatcacgctgctctcaatggacacaaggacgtggtggaggtcttgctccgtaacgacgcactgacaaatgtagcagatagcaaggggtgttatccactacacctggcagcttggaaaggcgatgctcagatcgtccgactcctgatccaccaggggcctagccatacaagagtgaatgagcagaacaatgataatgagacagcccttcattgtgcggcacagtacggtcacaccgaggtggtcaaggtgctgcttgaagagctgaccgacccaacaatgcgcaataataagtttgaaacaccgttggatctggcggctctgtacggaaggttggaggtggtgaagatgctgctgaatgctcatccaaacctgctaagctgcaatacgaaaaaacatacacccctgcatcttgcggcccggaatggccacaaagctgttgtccaggtgcttttggacgcagggatggatagcaactatcagaccgaaatgggtagcgcattacacgaggctgcacttttcggcaaaacagatgttgtccagattctcttggcggccggcacagatgtcaacatcaaggacaatcacgggctcactgccctagacacagtccgcgagctaccaagtcagaaatcccagcaaattgctgcactgatcgaggacctggatacccttcagttctatttcattagctgccccttccagggactctag

SEQ ID NO: 17724 - DNA, 660 bp, Artificial Sequence
  Description of Artificial Sequence: Synthetic coding sequence
atggtgattcacaagaaccctccggatactcctactgaaagccagtttacgaggttcctgtgtagttcacctttagaagccgagacccctcctaatggtcccgattgcggctatggctcatttcatcagcagtactggctcgatggcaagatcatcgcggtgggcgttattgacattctgccaaactgtgtgtcaagtgtgtatctgtactacgaccctgattatagctttttgagcttgggcgtctactccgcactgcgcgaaatcgccttcactagacagctccacgaaaagacctcacaattgtcatattattacatgggattttatattcactcctgccccaaaatgaaatataaagggcagtaccggcccagcgacctgctctgcccagaaacttatgtgtgggtgcctatagaacagtgcctgccttctctggagaactccaagtattgcaggtttaatcaggaccctgaggccgtggatgaggatcgaagtacagaaccagacagactgcaagtgttccataaacgggctattatgccttatggggtttataagaagcagcagaaagacccctcagaagaggctgctgtacttcagtatgcgtcacttgtgggccaaaagtgtagtgagcggatgctcctcttcaggaattag

SEQ ID NO: 17725 - DNA, 1791 bp, Artificial Sequence
  Description of Artificial Sequence: Synthetic coding sequence
atgcagcagaaggagctcggcactttcgcgcagtcatccatcgcattacatcaccagtataatcctaagttccagacactgttccaaccctgcaatctgatgggtgcaatgcagcttatcgaggacttttcaactcacgtctctatagactgtagtccccacaaaacagtgaagaaaactgcaaacgagttcccctgcctgccaaagcaggtcgcttggatcttggcaacatctaaagtttttatgtacccagaacttctgcccgtgtgttcactcaaagccaaaaatccacaggacaaaatactgtttacaaaggctgaagataacaaatatctgctgacatgcaagaccgcccgccagctaactgtccggattaaaaacctgaacatgaaccgggcacccgacaacataattaaattctacaagaagaccaaacagctgcccgtgctgggtaagtgttgcgaagagatccagccccatcaatggaagcctcctattgaaagagaggaacatcgcctcccattttggctcaaggccagcttaccatctatacaggaggagttgcgccacatggcagacggtgccagggaagtagggaacatgaccggaaccactgagatcaactcggaccaaggactggagaaagacaactctgaactggggtctgagacgcgctacccactgttactgcccaagggagtggtacttaagcttaagcctgtggccgatagattccctaaaaaagcatggcgacaaaagcgctcatccgtccttaaaccattgctgatccagccctcaccatctctccagccatcctttaatcccggcaaaaccccagctcaaagcactcactcggaagccccccctagtaagatggttctccggatcccccacccaatccagcccgccaccgtcctgcagacagtcccaggagtgccacctctcggggtcagcggaggggagtcttttgaaagcccagccgcattaccggctatgccccccgaagccagaaccagttttcccctttcggaatcccagaccctgctgagctcagccccagtccctaaagtgatgatgccctcgcccgcctcatctatgttccgaaagccttatgtgaggaggcgtccttccaagcggagaggagctcgggctttccggtgcattaagccggcccccgtgatccaccctgcgtccgtgatttttactgttcctgctacaacggtcaagattgtttctctgggaggcgggtgcaacatgatccaacccgtgaatgccgccgtggcccagtccccccaaaccatccctatcgctaccttactcgtgaatccgaccagcttcccctgcccattgaaccagccgctggtggcctcttccgtcagccccctaatcgttagcggcaactctgttaacctgccaataccatccacccccgaagataaagcacatatgaacgttgatatcgcctgcgctgtggctgacggagagaacgcctttcagggccttgagccaaaattggagccacaggaactttccccgttaagtgcgaccgtgttccctaaagtggagcatagtccaggaccaccccccgtggacaagcagtgtcaggaagggcttagtgagaattcagcatacaggtggacagtcgtgaaaaccgaggagggccgtcaagctctggaacccctcccacagggtattcaggaatccttaaacaatagcagccccggagatctcgaggaggtggtgaagatggagccagaggatgcaactgaggaaatcagcggattcctctag

SEQ ID NO: 17726 - DNA, 912 bp, Artificial Sequence
  Description of Artificial Sequence: Synthetic coding sequence
atggccgacaagagcaagtttatcgagtacattgatgaggcgttggaaaagtctaaagagactgctctgtctcacctattcttcacctatcagggcatcccgtaccccattaccatgtgtacctccgagacgttccaggctctggacactttcgaagcgcggcatgacgatattgtcctcgcgagctaccctaagtgcgggtctaactggatactgcacatcgtgtctgagctcatatatgccgtgtccaaaaaaaagtataagtatccagagtttcctgtactcgagtgtggggatagtgagaagtaccaaagaatgaaaggcttcccatctcccagaatactggccacccatctgcattacgacaagctccccgggagcatttttgaaaataaggccaagattctcgtgatcttcaggaatcccaaggacactgcagtgtcttttctgcactttcataacgacgtgcctgatataccgtcttacggctcctgggacgagttttttcggcaattcatgaagggtcaggtgtcctggggcaggtacttcgatttcgctatcaactggaacaagcatctggatggtgacaatgtgaaattcatcctgtacgaggatctcaaggaaaatcttgccgctggaatcaagcagatcgccgagtttcttgggttctttcttacaggagaacagattcagaccatatcggttcaatctactttccaggcgatgcgggcgaaatcccaggatactcatggcgctgtgggaccctttctctttagaaaaggagaagtgggcgactggaagaacctgttcagtgagatccaaaaccaggagatggatgaaaaatttaaagaatgcttagctggtacatcgctcggcgccaagctgaagtatgaaagctactgccaaggctag

SEQ ID NO: 17727 - DNA, 366 bp, Artificial Sequence
  Description of Artificial Sequence: Synthetic coding sequence
atgggtgtgcctgaaattcccggggaaaagttggtcactgaacgtaataaaaaaaggctggagaaggagaagcatgagaaaggggcccagaagaccgactgccagaagaatttgggaacagtgggggcagttgcccttgattgcaagggtaatgtcgcatatgccacaagcacagggggaattgtgaacaagatggtcgggcgggttggagactctccttgcctggggagaacaaaggggtgccttctgcccctaccccttttcagccgacctcaagctttcctcaccttatacagcctccccctgagcgtgtcttgctgtgtgccattcctccttttagtacagttacaggacgtctgggagtag

SEQ ID NO: 17728 - DNA, 579 bp, Artificial Sequence
  Description of Artificial Sequence: Synthetic coding sequence
atgaccttggggagcaagtcgcagcagccccccgaggatattaaagccctctcgtggaacagacaggcccaacacatattgtcaagcgcacatccgtcaggcaaggccgtcgtctgggatctcagaaagaacgaacctatcatcaaagtgtcggaccattccaaccgcatgcattgctccggattagcctggcatccggacattgccacacagctcgtcctatgctccgaggatgatagactccccgttatccagctctgggacctcagatttgcctcgagcccgttaaaggtgctcgaatcccactcgcgcggaatcttatcagtctcctggtctcaggctgacgccgagctgctcctgactagtgccaaggactctcaaatcctttgccggaacctcggctccagtgaagtcgtctataagctccccacccagtcttcttggtgttttgacgtccagtggtgccctagagacccgagcgtcttcagcgccgcgagcttcaatggatggatcagtctgtattccgtcatgggaagatcgtgggaagtgcaacatatgcgccaagccgataaggtctag

SEQ ID NO: 17729 - DNA, 621 bp, Artificial Sequence
  Description of Artificial Sequence: Synthetic coding sequence
atgaaggatgttgataacctgaaaagtatcaaagaagagtgggtgtgtgagactggttctgataatcagcccctgggcaacaaccaacagtccaattgtgagtactttgtggactccctcttcgaggaggctcagaaggtctcgagtaagtgcgtaagccctgctgagcagaaaaaacaggttgacgtcaacattaaactgtggaagaacggcttcacagtgaacgacgattttcggtcctacagcgacggcgcttctcaacagtttctgaacagcatcaagaagggcgaactcccaagtgagttgcagggcattttcgacaaagaagaagtggacgtcaaggtggaggacaaaaaaaacgagatctgtctttctactaagcccgttttccagccgttcagcggccagggccatagattagggcgcgttagccatattaaggatttcattgagaaataccaagggtcgcaaagatctccgcccttctcactggctacagctctgcctgttctaagattactcgacgaaaccctgacacttgaggaggccgacctgcaaaacgccgtgatcatccagagactgcagaagactgcgagtttcagagaactgtccgaacactag

SEQ ID NO: 17730 - DNA, 1359 bp, Artificial Sequence
  Description of Artificial Sequence: Synthetic coding sequence
atgaggggatgtagttatggactgtgcagacgcggactgctcttttgtgtgatcttggacgaccagtccgggaagaaatctgtgaacgataagaatttgaagaaaaccgtcgaagacgaagaccaggactctgaggaggagaaggacaatgatagttacatcaaggaaagaagcgatataccgtctgggacatccaagcacctccagaagaaagcgaaaaaacaagctaagaaacaagctaagaatcagcgccggcagcagaaaattcaggggaaggtcctacacctgaacgatatctgcacgatcgaccatcccgaagacagcgaatatgaggctgagatgtcgctgcagggggaagtgaacattaagagcaaccacattagtcaggaaggggtgatgcacaaggagtactgcgtcaatcagaaggatctgaatggacaggcgaaaatgattgaatctgtcaccgacaaccaaaaaagcactgaagaggtggatatgaagaacatcaatatggacaacgatttagaggttctaacatccagtcccaccagaaatctcaacggagcctacctgacggagggctctaatggcgaggtggatatctccaatggttttaaaaatctgaatctgaacgctgccctccacccagacgagatcaatatagaaatcttgaatgacagccatacaccaggcacaaaagtgtacgaagtcgtgaacgaggacccggagactgccttctgcaccctggctaaccgggaagtatttaacactgacgaatgctcgatccaacattgcttgtatcagtttactagaaatgagaaactgagggatgcaaacaagttgctttgtgaggtttgtaccagacgtcagtgcaatggacctaaagccaatattaaaggagaaaggaaacacgtttacaccaatgctaaaaagcagatgttaatttcactagctcccccagttcttactttacacctgaagagattccagcaggcaggattcaatcttcgcaaggtcaataagcatatcaagtttcccgaaatacttgatctggccccattttgcaccctcaagtgcaaaaacgtggccgaggagaacaccagagtcctgtatagcctctatggagtcgtcgagcactccggaacaatgaggtctggtcactataccgcctacgccaaagcacgcaccgccaattcccacctatctaatctggtgttacacggcgatatccctcaggactttgaaatggagagcaaagggcagtggtttcatatctctgacactcacgtgcaggctgtgccaacgacaaaggtgttgaattctcaggcatatctcctgttttacgaacgtatcctgtag

SEQ ID NO: 17731 - DNA, 450 bp, Artificial Sequence
  Description of Artificial Sequence: Synthetic coding sequence
atggaaaggatcgaaggcgccagtgtcggaaggtgcgcagcaagcccctatctgagaccccttaccctgcattatagacaaaatggggcacagaaatcttgggacttcatgaagacgcacgatagcgtaaccgttctcctgttcaatagttcgagaaggtctctggtgctggtgaaacagttcagacccgcagtatacgccggcgaagtggagagaaggtttccaggctccctggccgcagtcgaccaggatggccctcgggagctccagcccgccttacccggctcagccggagttacggtggaactgtgcgcaggtctcgtcgaccagcctggcctctcactcgaggaggtggcatgcaaagaagcttgggaagaatgcggatatcatctggctccttctgatttacgcagagtcgctacatattgggacgcgactatgggctcatag

SEQ ID NO: 17732 - DNA, 489 bp, Artificial Sequence
  Description of Artificial Sequence: Synthetic coding sequence
atgaactccaatgcctcagagcataccgggatgttgagaacttgttggtcacacagccattgggacccattctcttccgggtcagtgaccgcaatgtgggcgacccacagtccaactagtaaagcttgggccgggatacaaggcagagggaggtgggccctcggatttccgtggagaggacaaggtgttttacacgtgatagccagtcagaaagcggcagtcaccgaggcggttgatttacgcaccggggcagcctctcaggcgatgtccgaggcatttgtgcgcagcggaatgttttaccttaggccggctttcgtgttgttatgctataaatggggtaagttgagacacagcgaggtgtctaacctcctcggagtggcctggccagtgagcgaagaagcatgtatgggaacctggggatccctggcagtggccgtcaccttgccggctcagggcttgggaacttgggggagagatgagggcgaatag

SEQ ID NO: 17733 - DNA, 1320 bp, Artificial Sequence
  Description of Artificial Sequence: Synthetic coding sequence
atggtgccttcaagagaggccttactgggtcccggaacgacagccatccgatgccccaaaaagctgcagaaccagaattataaggggcacggccttagcaaaggcaaggagcgcgagcaacgggcatctatacggttcaaaactaccctaatgaatacgttgatggatgttctcagacatcgccctggatgggtggaggttaaggacgagggcgagtgggatttctattggtgcgatgtttcatggttgcgagagaattttgaccatacatatatggacgagcacgtacgcatcagccactttcgcaatcactatgagctgacaaggaagaactatatggtgaaaaacttaaagcgttttcgcaagcagctggaacgcgaggccggaaagctagaagccgcaaaatgtgacttctttcctaaaacatttgagatgccttgcgagtaccatctttttgtggaggagtttcggaaaaatcccggaattacatggattatgaagcccgtggcaagatcccaaggaaagggcatttttctctttagaaggctgaaagatattgtggactggaggaaggacacacgatcgtccgatgaccagaaagacgacattcccgttgaaaactacgtcgcccagcgatatattgaaaacccttatctcatcggagggagaaaattcgatctgcgagtttacgtgttggttatgtccgtgtttgccgaatgtctgctgtggtcaggccacaggcggcaggacgttcaccttaccaatgttgcagtgcagaaaacctctccagattaccaccctaaaaaaggttgcaaatggaccctgcagcgcttcagacagtacctggcctccaagcatggccccgaagccgtagaaactctctttagggacatcgataatatattcgtgaaatcattgcaatctgtgcagaaagtcatcatcagcgacaagcattgcttcgagctctacgggtacgacatactgattgaccaagatctgaaaccatggttgctggaggttaatgccagtcccagcttgaccgccagttcacaggaggattatgaattgaagacctgcctattggaggacacactgcatgttgtggacatggaagcgcggctgaccggccgcgaaaaaagagtgggaggctttgatctcatgtggaatgatggccccgtaagccgggaagagggggcacccgacctgagcgggatgggtaacttcgtgactaatacgcatcttgggtgtgtgaacgatagaaaaaaacagttaagacagctcttctgctcactccaggtccagaaaaaggcttccagctag

SEQ ID NO: 17734 - DNA, 867 bp, Artificial Sequence
  Description of Artificial Sequence: Synthetic coding sequence
atggccaaatggggcgaaggagatcctaggtggattgttgaggaaagagcagatgccacaaacgtgaacaactggcactggaccgaacgcgacgcttcaaattggagcaccgacaagctgaaaacattgttcctcgctgtacaagttcagaacgaagaggggaaatgtgaagtaaccgaggtcagcaagctcgatggcgaggcctctatcaacaacaggaagggcaagctgatcttcttttatgagtggagcgtgaaactcaactggacggggacaagtaagagcggggtgcagtacaagggtcatgtggagatccctaacttaagtgatgaaaacagcgttgatgaggtggaaatttcagtcagtctagcaaaggatgaacccgataccaatcttgtcgcactaatgaaggaagaaggcgtgaagttactgagggaggcaatgggcatctatatcagcacactgaaaaccgagttcacacagggcatgatcctgcccacaatgaacggagagagcgtggaccccgtaggccagcccgcactgaagaccgaagaacgaaaggcaaagccagcaccatccaagactcaggctcgaccggtcggggtcaagattcctacatgtaaaattactttgaaggagactttcctgacgagccccgaggaactgtaccgcgttttcaccactcaggagctggtacaagcctttacccatgccccagccacactcgaggccgacaggggaggcaagttccacatggtagacgggaatgttagtggcgagttcacagatcttgttccagagaaacacattgtgatgaagtggagatttaagtcctggcccgaaggatcacattgtcatagcggatag

SEQ ID NO: 17735 - DNA, 1053 bp, Artificial Sequence
  Description of Artificial Sequence: Synthetic coding sequence
atgcctagctttatccggcatggcccaacaattccccgacgcacagacatctgcctccctgacagttctcctaacgctttcagtaccagtggcgacgttgtctcccgtaatcagagcttcctaagaacccctatacaaagaacgcctcacgagatcatgcgccgggaatccaacagactcagcgccccctcctacttggcccgttcattagctgatgtcccacgcgaatacggcagttctcaatcattcgtgaccgaggtttccttcgctgtcgagaatggtgattctggaagtcggtattattattccgataactttttcgatgggcagcgaaagcgacccctgggtgacagagcccacgaggactatcggtactacgagtacaatcacgacttgttccaacgcatgccacagaaccaggggcgtcatgcctccggaatcggaagggtggccgcaactagcctcgggaacttgactaatcatgggtccgaagatctcccccttcctcccggctggtccgtggattggaccatgcggggccgcaagtattatattgatcacaacaccaacaccactcactggagccatccacttgagcgggagggcctccctcctggttgggaaagagtagaaagctctgagtttggcacctattacgtggaccacacaaacaagaaggctcagtaccgccacccttgcgcccctagtgtgcctaggtacgaccagccgcccccggtaacttaccaacctcagcaaacggaacgcaaccagtcactgctggtgcccgctaacccgtatcacaccgcagaaatccccgactggctgcaggtgtatgcccgagctcccgttaagtacgatcatatcctgaagtgggaactttttcaactggctgaccttgacacctaccagggcatgctcaaactgctcttcatgaaagagctggagcagattgtgaaaatgtatgaggcctatcgccaggcactgttaacagaactagaaaacaggaagcagcgacagcaatggtacgcacagcaacacggaaagaacttctag

SEQ ID NO: 17736 - DNA, 537 bp, Artificial Sequence
  Description of Artificial Sequence: Synthetic coding sequence
atgaccttccgcgaagggcaccagtgggaaaaaatcccgttgtctggctctaatcaggagatcagacggcagaaggagcggattacagaacaacctctgaaggaggaggaagatgaagaccgcaagaataaaggtcaccaggccgctgagattgaatggctggggttcagaaaaccttcccaagctgacatgctccatagcaagcacgatgaggaacagaaggtttgggatgaggaaatcgatgacgacgatgatgataattgtaacaatgacgaagacgaggttcgagtaatcgagttcaagaaaaagcacgaggaagtcagtcagttcaaagaggaaggggacgcctcggaagactcacctctgtctagtgcttccagccaagccgtgacccccgatgagcagcctacgcttggcaagaagagtgatatcagcagaaatgcctactctcggtataatacaatctcttacaggaagatccgtaagggcaacactaagcagagaattgatgagttcgagtccatgatgcatttatag

SEQ ID NO: 17737 - DNA, 312 bp, Artificial Sequence
  Description of Artificial Sequence: Synthetic coding sequence
atggctgcctttaagctcgacttcctgcctgaaatgatggtggatcactgcagcttaaactcatcaccggtgagtaagaagatgaatggaaccttagatcaccctgatcagcccgacctggacgcaatcaaaatgtttgtcggtcaggtgcctcgcacctggtcagagaaggacctcagagaactgttcgaacagtacggggcggtctatgaaattaatgtcctgcgcgaccgctcccagaatcccccccagagtaaagggtgttgttttgtcactttctacaccaggaaggccgcactggaagcccagtag

SEQ ID NO: 17738 - DNA, 1917 bp, Artificial Sequence
  Description of Artificial Sequence: Synthetic coding sequence
atgccacccattaacttgcaggagaaacaggttatttgtttaagtggagatgatagctccacctgcataggcatattggctaaggaagtggaaatcgtggccagcagcgattcttctatatcgtctaaggctaggggctcaaacaaggtgaagatacagcctgtcgccaagtatgactgggaacagaagtactactacggtaatttaatcgctgtgagtaactcattccttgcctacgccattcgcgcggccaacaatgggtctgctatggtgcgagtgattagtgtctctacatccgagcgaacacttctcaaagggtttacagggtcggtggccgacttggctttcgctcacctgaatagccctcagctcgcttgtctggacgaagcgggaaatttattcgtctggcgacttgccctagttaatggcaaaatccaagaggagattctcgtacatattcgacaacctgaaggaacaccactgaatcattttcggagaataatctggtgccccttcataccggaggaatctgaagattgttgtgaagagtcatcacctacagtcgcgttacttcatgaggatcgggccgaggtgtgggacctggacatgctacgcagtagtcattccacctggccggtggacgttagtcaaatcaagcaggggtttattgtagtgaaggggcatagtacctgtctgagcgagggcgccttaagccccgacggaacagtcttagctactgcttcacatgatggctatgtgaaattttggcagatttacattgaaggacaggatgaaccacggtgcctccacgagtggaaacctcacgatggtcggcccctatcttgcttattattctgtgacaaccacaagaagcaggaccccgatgtgcccttctggcggttcctcatcacaggcgccgatcaaaatcgcgagctaaaaatgtggtgcacagtctcttggacatgtctgcagactattaggttttctccagacatattctctagcgtcagcgtccctccgtctctcaaggtgtgtctcgaccttagcgccgagtacctgatcttgagcgatgtgcagcgcaaggtcctgtacgtgatggagctgctacagaatcaggaggagggccatgcttgctttagttctatctctgagttcttactgactcatcccgtgttatctttcggtattcaggtggtgtcacggtgccggctgcgccacactgaggtgctgcccgccgaggaagagaatgactccctaggagcagacggcacgcacggggctggcgccatggaaagcgcggccggcgtcttgatcaagctgttttgcgtacacaccaaagcactacaggacgttcagatccgcttccagccacagctgaatcccgatgtcgtcgcccctctgcctacgcataccgcgcacgaagactttacattcggtgagagccgccccgagctcggctctgaaggcttggggagcgccgcgcatggctcacaaccagaccttaggcgaattgtagagttgcccgccccagccgacttcctgagtctgagtagcgaaactaagcctaaactgatgaccccggacgccttcatgacacccagtgcttctcttcagcagattacggcctctccttcatcaagcagctccggatcgtcctcttcgtcctctagtagttctagctctctgactgccgtttcggccatgtcctctacatcagccgtcgaccccagcctgacaaggccgcccgaagagctgacgctatcccccaaactgcagctagatggatcgcttacaatgtccagtagcggatccttacaggcaagccccagggggttacttccaggcctcctgcccgcacctgcagacaaacttacaccaaagggccctggccaggtgtgtgactgggtatgcgtttag

SEQ ID NO: 17739 - DNA, 495 bp, Artificial Sequence
  Description of Artificial Sequence: Synthetic coding sequence
atgcgcatcttgattcttggattggatggggcaggaaagaccaccattctatatcgacttcaggtaggggaagtcgttaccacgattcccacaatcggcttcaacgttgagactgtaacctataaaaatcttaaattccaagtttgggaccttggaggacagacatcaattagaccctactggcggtgttattactcaaataccgacgcggtgatctacgtggtggactcttgcgaccgggaccgcatcggtatatccaagagtgagctagttgccatgctagaagaggaggaactcagaaaagctatcctagtggtgttcgcaaacaagcaggatatggaacaggccatgacttctagcgaaatggcgaatagcctcggactgccagccctgaaagataggaaatggcaaatattcaaaacctctgccaccaaaggcactgggctggatgaagctatggagtggctcgttgaaaccctgaagagcaggcagtag

SEQ ID NO: 17740 - DNA, 1944 bp, Artificial Sequence
  Description of Artificial Sequence: Synthetic coding sequence
atggcccaagggtccgtttctttcaatgatgtgactgtagatttcactcaggaagagtggcagcacctcgatcacgcccaaaaaaccctttatatggacgtgatgctggagaattactgccaccttatttctgttggttgtcatatgactaagcccgatgtgatcctcaagctggagcggggcgaagaaccttggaccagttttgctgggcatacctgtctggaggaaaactggaaggccgaggacttcctggtcaagttcaaggagcaccaggagaaatactccaggagtgttgtatctatcaatcacaagaagttggtcaaagaaaagtccaagatttacgaaaagacgttcactctcggaaagaaccctgtgaacagtaaaaatttgccaccagagtacgatacgcatggaaggatattaaagaacgtgtctgagttaattatatcaaacctgaatccagcacgaaagcgtcttagtgaatataatgggtacggcaagtccctgctcagcactaagcaggagactactcacccagaggtgaaaagtcataaccaatccgcgagagcattttctcataacgaagtcttgatgcagtaccagaagaccgagacccctgcccagagcttcggttacaacgactgcgagaaaagcttcttgcagcgtggcgggctgatcacgcactccagaccatataagggagagaacccatctgtgtacaataagaagcgccgagcaacaaacattgagaagaaacacacttgtaatgaatgtggcaagagcttctgtcgtaaatctgttttgatcttgcatcaggggatccattcagaagaaaagccctaccagtgtcaccagtgtgggaatgcatttcgtcgaaaaagctacctaatcgaccatcaaagaacgcacaccggagaaaaacctttcgtgtgcaatgaatgcggcaagtctttcagactgaaaactgccctgaccgaccaccagagaacgcatacaggagagaaatcttatgagtgccttcagtgtaggaatgcctttcgtttgaagtctcacctcattaggcaccagagaacccacactggtgagaagccctatgagtgtaacgattgcggtaagtcctttcggcagaaaacgaccctctctttgcatcaacgcatacatacaggggagaaaccgtacatatgtaaggaatgcgggaagtcgttccaccaaaaggccaatctgaccgttcatcagcggacccatacaggcgagaaaccctatatttgcaatgaatgtggcaagtcctttagccagaaaacaacccttgctttgcacgaaaaaacgcataacgaggagaaaccctacatctgtagcgagtgtggcaaatctttcagacagaagaccaccctggtagcccatcagcgcacacatacaggggaaaagtcatatgagtgccctcactgtggcaaagctttccgtatgaagtcctacctgatagaccaccacagaactcacaccggggaaaaaccctacgagtgcaacgagtgtgggaaaagttttagtcaaaaaacaaacctgaacttacaccagcgcatccacaccggcgagaagccatatgtgtgtaacgagtgtggcaagagttttcgccagaaagccacacttactgtgcaccagaagatccacacagggcagaaaagctatgagtgccctcagtgtggcaaggccttctccagaaagtcctatttgatccatcatcagcggacccataccggggagaagccatacaagtgctcagagtgcggaaaatgttttaggcaaaagacaaacctgatcgtccatcaacggacccatacgggcgaaaagccttacgtgtgtaacgagtgcgggaaatcttttagctacaaacggaatttgatcgtgcaccagaggactcataagggtgagaacatcgagatgcaatag

SEQ ID NO: 17741 - DNA, 3570 bp, Artificial Sequence
  Description of Artificial Sequence: Synthetic coding sequence
atgaagctggagtgtattcccgcccctataactccttccaccgtgccgtctttccccccaactccacccactccccccgccagtccccctcatacccccgtcatcgtgcccgccgctgcgacaaccgtgtcatctccctctgctgctataacagtccagagggtcctggaggaagacgagtccatcaggacatgtctgagtgaagacgccaaggaaattcagaacaagatagaggtggaggccgatggccagacagaggagatcctggacagtcaaaacctgaacagccgaaggtctcctgtaccagcgcagatagctataaccgtccccaagacatggaagaagcctaaagatcgcacccggaccactgaagaaatgctggaagctgagcttgagctgaaggctgaggaagagctcagcatcgacaaggttctagaatccgaacaggataagatgagccagggctttcatccagaaagggacccctccgacctcaagaaggtgaaggccgtggaagagaacggcgaagaagctgagcccgtgcggaatggggcagaaagcgtcagcgagggagaagggattgacgccaacagcgggtcaacagactcatcaggtgatggcgtaaccttccctttcaagcctgagagttggaagcctactgataccgaggggaagaaacaatacgaccgagagttcttgctggacttccagtttatgccggcatgtatacaaaagcctgaggggctgccccccatcagtgacgtggtgctggataaaattaaccagccgaaacttccgatgcgcaccttagatcctagaatcctgcccagggggccagactttacaccagcctttgctgactttggccggcagacccctggcggtaggggtgtcccgctcctaaacgtcggatcacggcggtctcagccgggtcaaaggcgagaaccccgcaagatcatcactgtgtctgtgaaggaagatgtgcatctcaagaaagccgagaacgcttggaagccttctcagaaacgagacagccaggctgatgacccagagaatatcaagacccaggaattgttcaggaaagtgagatctattctaaacaaactcacaccccagatgtttaaccagctcatgaaacaagtgagcgggctcacagtagatacagaggagcgattaaaaggagtgattgatctggtgtttgagaaggcaattgatgaaccaagcttttcagtggcttacgccaatatgtgccggtgcttggtcacactgaaggtcccaatggcagataaacctggtaacacagtaaacttcagaaagctgctgctcaacagatgccagaaagagttcgagaaggacaaggcggacgacgacgttttcgagaagaagcagaaggaactggaggccgcttcggctcctgaagagcgcactcgcctgcacgatgaattggaggaggcaaaagataaagctagaagacggagcattgggaacatcaagttcataggagaactctttaaattgaaaatgttaacagaggccatcatgcacgattgcgtagtcaagctgctgaagaaccatgacgaagagtctctagaatgcctctgtaggttattaactaccattgggaaagatctggattttgagaaggcgaaacctcgcatggaccagtactttaatcagatggaaaagatcgtgaaagagagaaaaactagctcgaggattcggttcatgctccaggatgttattgacctgcgcctctgcaattgggtgagcagacgcgcagaccagggtcctaaaactatcgagcaaatacacaaggaagccaagatcgaggagcaggaagaacaacgcaaagttcagcagctaatgacaaaagaaaagcgccgacccggtgttcagagagtggacgaaggaggttggaataccgtgcagggggcgaagaattccagagttctcgatcccagcaaattccttaagattactaagccgacaatcgatgaaaagattcagcttgtacctaaagcacagctaggtagctgggggaaaggctcatccggaggagccaaagcttccgagactgacgccctcagatcttcagcaagttccctgaaccggtttagcgctctccagccccctgccccctcgggatccacccctagtacacctgtagaattcgactctcgccgaaccttaaccagtagaggcagcatggggcgggaaaagaacgataagccccttccttccgcaactgctcgacctaatacctttatgagaggagggtcaagcaaggatctcttggataatcaatcgcaggaagagcaacgcagagagatgctcgagaccgtgaaacagctaacaggcggcgtcgacgtagaaaggaacagtactgaagcggagcgaaataagactcgggaatctgctaagcccgaaattagcgcaatgtctgctcacgacaaagccgctctgagtgaggaggaactggaacgcaaatccaaaagtataattgacgaatttttacatattaatgactttaaagaggccatgcagtgcgtggaggagctgaatgcccaggggttactacacgtattcgtgcgcgtaggcgttgaaagcaccctggagcggagtcagatcacacgtgatcacatgggccagctgctgtaccaattggtacagtccgagaaactgtccaagcaagattttttcaagggattcagcgaaacacttgagctggccgatgatatggctattgacatcccccacatttggttatacctagcagaactggtcactccaatgctgaaggaaggtggaatctctatgcgggagctcaccattgagtttagtaagccattgctgccagtcggccgggcaggtgtgctcctgtccgaaattttgcatctgctgtgtaaacaaatgagtcacaagaaagttggggctctgtggagagaagccgacctctcctggaaagacttcctgcccgagggagaggacgtgcacaacttcctgctggaacaaaagttagactttatcgaatcagactctccgtgcagctctgaagctctgtcaaaaaaggaactcagcgctgaggagttatataaacgtttagaaaagttaatcatcgaagacaaggcaaatgacgaacagatattcgattgggtggaggctaatcttgacgagatccagatgtcgtctccgacctttctgcgtgctctcatgactgccgtatgcaaggcagctattattgctgacagcagtacctttcgagtcgacaccgctgtaatcaaacagagggtgcctatcctcttaaaatacctggattccgatacggaaaaggagctgcaggccctgtatgcgctccaagccagcatcgtgaagcttgatcagccagcaaacctgctgagaatgtttttcgattgcctttacgatgaagaagttatctcagaagatgccttctacaagtgggagtccagcaaggatcccgcggagcagaatggaaaaggggtggccctgaagagcgtgacagctttctttacctggcttcgggaggccgaagaggaaagtgaggataactag

SEQ ID NO: 17742 - DNA, 591 bp, Artificial Sequence
  Description of Artificial Sequence: Synthetic coding sequence
atgtggtcagttttgcaggacggtcccattagtcgggttattgtattttctcttagcgccgccaaagaaaccaaagatcggccacttcaagatgaatattccgtcctggtggctagcatgctcgaacccgccgtcgtgtatcgcgacctgctgaatcgggggctggaggatcagctgcttctaccagggtcggatcagttcgactcggtgctctgctcattggtgaccgacgtggatttagacgggcgacccgaagtgctggtagctacctacggacaggagcttttatgttataagtaccggggccccgagtccggactgcccgaggctcaacatggctttcacctactgtggcagagatccttttcctctccgctactggccatggctcacgtcgacctcaccggagatggactccaggagctagcagtagtgagtttgaaaggcgtgcacatcctgcagcatagccttatccaagcatcagaattggtgctgacaaggctgcgacaccaggtagagcaaagacgcaggagattgcaggggctcgaagacggggcaggagctgggccggctgaaaatgccgcctcatag

SEQ ID NO: 17743 - DNA, 1056 bp, Artificial Sequence
  Description of Artificial Sequence: Synthetic coding sequence
atggtttcgcatacgtttcatatgagaaccgaagagtctgacgcgagccaggagggcgacgatttacctaagagcagcgcaaacactagccatccgaagcaagatgactctcccaaaagcagtgaggaaaccatccagcccaaagaaggagacatccctaaggctcccgaggagaccatccagtctaaaaaggaggacttacctaagtcaagcgaaaaggccatacaaccgaaggagagcaatatacctaagagtagcgcgaaacccatacagcccaaattagggaatattcccaaaacatcagtgaagccgtcacagcctaaagaaagtgacatcccaaagtccccggaggaagccatccagccaaaggaaggcgacatcccaaagtcattggaagaagctattcaaccaaaagagggcgacatccccaagtctccagaggaaacgattcaaccaaagaaaggggacataccaaagtctcccgaagaggctatacagcccaaggagggcgatattcctaagtcccccaaacaggcaatccagccaaaggagggggacattccaaaaagcttagaggaagccattcccccaaaggagatcgatatccctaaaagcccagaggagactatccagcctaaggaagacgatagccccaagagcctggaggaggccacgccatccaaagagggggatatcttgaaaccagaggaggagacaatggagtttcctgagggagacaaggtgaaggtgatactttcaaaggaggatttcgaggccagcctaaaagaggcaggcgagcgcttggtagccgtggatttttcagctacttggtgcggtccctgtagaacaatccggccattttttcatgccctatcggttaaacatgaagacgtggtcttccttgaggtcgacgctgataattgcgaagaagtagtcagggagtgcgccattatgtgcgtccctactttccaattttataagaaggaagagaaggtcgatgaactgtgtggggcactgaaagagaagctagaagcggtcattgcagagcttaagtag

SEQ ID NO: 17744 - DNA, 1473 bp, Artificial Sequence
  Description of Artificial Sequence: Synthetic coding sequence
atgcccgacggaaagattcagaagcttatcattaccgaggagacggcgaagatacgcccattcgcagtggctgcagttttaaggaacatcaaatttaccaaagatcgctatgacagttttatagagctccaggaaaagctacaccagaatatatgtagaaagcgggccctggttgccatcggtacacatgacctggatactttaagtggcccttttacttatacggctaagcgcccctcggacattaagtttaaaccactgaacaagaccaaagagtacaccgcctgcgagttgatgaatatttataaaaccgacaatcacctgaagcattacttgcacattatagagaacaaaccgctgtacccagtcatctacgattctaatggggtggtgctttccatgccgcccattattaacggcgatcactcgagaataacagttaatacgcggaacatctttattgagtgcacaggcacagatttcaccaaagcaaaaatagtgctcgacattatcgtgaccatgttctcagagtattgtgaaaatcaatttaccgtggaggccgccgaggtggtgtttccaaatggcaaaagccataccttccctgagctcgcttatcgtaaagaaatggttcgtgcggacctcatcaacaagaaggtgggaataagagaaacaccggaaaaccttgcaaagctcctgaccagaatgtatctgaagtctgaggtgatcggagacggaaaccagattgagatcgagatacctccaacaagagctgatattatccatgcttgcgacattgttgaagacgcggctatagcctacggatacaacaatatccagatgaccctaccgaagacctataccatagctaaccaatttccgctcaacaagttgactgaattgctgagacacgacatggctgctgccggcttcaccgaggcactgacgtttgccttgtgctctcaggaagacattgccgacaaactgggagtggacatctccgccactaaggctgtgcacatctctaaccccaagacagctgaattccaggtcgctcgcaccaccctgctcccggggctgctgaagaccatcgccgctaacaggaagatgccacttccactcaagctctttgagatatctgacatcgtcatcaaggactcgaacacagatgtcggtgccaagaactaccgacatctttgcgcagtatactataacaaaaatcccgggttcgagatcattcacggactcctggacaggatcatgcagttactcgatgtgcctcccggagaggacaagggaggttacgttataaaggcctctgaggggcccgcatttttccctggacggtgtgccgagatctttgctagaggccagtccgtgggcaaactgggtgtgctgcaccccgacgtcataaccaagtttgaacttacgatgccttgctctagcctggagattaacgtcgggcctttcctttag

SEQ ID NO: 17745 - DNA, 1458 bp, Artificial Sequence
  Description of Artificial Sequence: Synthetic coding sequence
atggccgctgaactatatgcacctgccagcgcagctgcagcagatttagcaaattccaacgcaggcgctgccgtgggacggaaagcagggcccaggtctccccccagcgcgcctgcacctgctcctccccctcctgcgccagctcctcctacccttggcaataatcatcaggagtccccaggctggcgatgctgccgaccaacactgagggagcgcaatgccttaatgttcaacaatgaacttatggcggatgtccactttgttgtggggccccccggcgctaccaggaccgtgcccgcacacaagtacgtgctcgccgttggtagttcagtgttctatgcaatgttctacggtgacctggctgaggtcaaatcagagattcacatacccgacgtggagcccgccgcctttctcattctcctgaagtacatgtactctgacgaaattgacctggaggccgatactgtcctggctaccctctacgccgccaagaaatacattgtgccagcgctggctaaggcctgtgttaactttctcgaaacctccctggaagccaagaatgcctgtgtgctgctaagtcagagtcggctcttcgaggagccggagctgacccagcgttgctgggaggttatagatgctcaggctgaaatggctctgcggtccgaggggttttgtgaaatagaccgccagacgctggagattattgtaacgcgagaggcgctaaacacaaaagaggccgttgtcttcgaagcagtattgaattgggccgaagccgaatgcaagcgacaggggctcccaattacaccaagaaacaagcgccacgtcctcggccgtgccctgtacttggtccgcatccctaccatgaccctggaagagtttgcaaacggtgcggcgcagagtgacatcctgacactcgaagagactcattccattttcctgtggtacacagctaccaacaaaccgaggctggacttcccactcaccaaacggaagggccttgccccccaacggtgtcacaggttccaatcctcagcctaccgtagcaatcaatggagatacaggggaaggtgcgattcgatccaatttgcagtggataggcgggtgttcatcgccggtctagggctgtacgggtcaagctctgggaaggctgaatactcagtgaagattgaactcaaacgcctgggcgtggttcttgcacaaaacctgacgaagttcatgtccgatgggtcttcaaacacattccctgtgtggttcgagcatcccgtgcaggtggagcaggatacgttctataccgcttctgcagtgctcgatggcagcgagctgtcatactttggccaggaaggcatgaccgaagtacagtgcggaaaagtcgcattccaattccagtgctcctcagactccactaacgggacaggcgtgcagggagggcagatacccgagctgatcttctatgcgtag

SEQ ID NO: 17746 - DNA, 204 bp, Artificial Sequence
  Description of Artificial Sequence: Synthetic coding sequence
atggctctgctggctgagcacctgctgaaaccactgccagctgacaaacaaattgaaaccgggccctttctggaggccgtgagtcatctgcctccattcttcgactgcctcggtagccccgtgttcaccccgataaaagctgatattagtggcaacatcaccatgaggaagttaaggctgcggggcgtcgagggactagcatag

SEQ ID NO: 17747 - DNA, 816 bp, Artificial Sequence
  Description of Artificial Sequence: Synthetic coding sequence
atctgtgagcgcattcgaagcacggtggacgagaaagagcaaaagcagctgctgatggatttagatgtagtgatgcgatcctctgattgcccgtatatcgtccagttttacggggctctgttcagagagggggactgttggatctgcatggagctgatgtccaccagcttcgacaagttctataagtacgtgtacagtgttctcgacgatgttatccctgaggagatcttaggaaaaatcacactggccaccgtaaaggcactaaaccatcttaaggaaaatctcaagatcatccaccgcgatattaaacctagcaatatcttgctggaccggtctgggaacatcaagttgtgcgactttgggatctctgggcagctggtggactcaatcgcaaaaacccgtgacgcaggctgcaggccttacatggcccctgaacgcatcgacccctcagcatccaggcaaggatatgatgtgagatcagacgtgtggagcctcggaataaccttatatgagctcgctaccggtaggtttccgtatcccaaatggaattctgtattcgatcagctgactcaggtagtgaaaggagatcccccccaattaagtaactccgaggaacgggaattttccccatcctttatcaacttcgtgaatttgtgtttaacaaaggatgagtcaaagcgccccaaatacaaggagctattaaaacacccctttattctgatgtatgaagaaagggccgtagaggtggcttgttatgtctgtaagatcctagatcagatgccagcaactcccagtagcccgatgtatgtcgactag

SEQ ID NO: 17748 - DNA, 291 bp, Artificial Sequence
  Description of Artificial Sequence: Synthetic coding sequence
atgagcgaaaaggtggactggctgcaaagtcagaacggagtttgtaaagtcgacgtctacagccctggagataaccaggcccaggactggaaaatggacactagcactgatccagtgcgggtattatcttggttgaggcgggatctcgagaagtcgacagcagagttccaggatgtcagatttaagcccggcgagagcttcggtggggaaacgagcaactctggtgatccccacaaggggttcagcgtggactattataacacaaccactaaaggaacacccgagcgatag

SEQ ID NO: 17749 - DNA, 792 bp, Artificial Sequence
  Description of Artificial Sequence: Synthetic coding sequence
atgctcagctctaagggattaacagtggtggatgtctatcagggatggtgtggcccgtgcaaaccggtcgtgtcactctttcaaaaaatgcgaatcgaggtgggcctggacctactccacttcgctctagcagaggcagacagactcgacgtgctcgagaaatacagaggaaagtgcgaacccacattcctgttttacgccatcaaagacgaagcgctcagtgacgaagatgaatgcgtctcccacggaaagaataatggcgaggacgaggacatggtgtcttccgagagaacatgtacacttgccattattaagccagatgctgtcgcacacgggaagacagatgaaatcattatgaagattcaggaggccgggtttgaaattctgaccaacgaagagaggactatgacagaagccgaggtgaggcttttctaccagcacaaggccggtgaagaagctttcgagaaactcgtccaccatatgtgctccggcccaagccatctgctgatattaacgcggacggagggcttcgaggacgtggtgaccacctggaggaccgtgatggggcctagggaccccaacgttgcacgaagagaacagcccgagtctctgcgggcccaatacggcaccgagatgcccttcaatgccgtccacggaagtcgggacagagaggacgccgacagagaactagcactcctgtttccctcacttaaatttagtgacaaagacacagaggcgcctcagggcgaatctagcacacaaccccggctgaagatcaccgacctggactag

SEQ ID NO: 17750 - DNA, 867 bp, Artificial Sequence
  Description of Artificial Sequence: Synthetic coding sequence
atgtcttccagcatgtggtacattatgcagtctattcaatcaaaatactctctgtccgaacgccttatacgcactatagctgccattcgcagtttccctcacgataacgtggaagacctcatccggggcggagcggacgtcaattgcacccacggaaccctcaagccgctccattgcgcctgcatggtgtccgacgccgactgtgtggagctgctcctcgaaaaaggcgccgaggtgaacgccctggacgggtacaatcgcaccgccctgcattacgccgccgagaaggatgaagcctgcgtcgaggtcctgttggagtacggcgcaaatccaaatgccttagacgggaatcgggatacaccgcttcactgggccgctttcaagaacaacgccgagtgcgtgagggccctgctcgagagcggagcctcagtcaatgcacttgactacaacaacgacactccactgtcatgggccgcgatgaaaggtaatttggaaagtgtatccatcctgctagactatggcgcagaagtgagggttattaatcttataggtcaaaccccaatcagtcgtcttgtcgctctgctagtacgcgggctgggcacagagaaggaagattcatgttttgaactgttgcaccgggcagtcggccacttcgaactgcggaaaaatggtacaatgcctcgggaagtcgctcgcgacccgcagttgtgtgagaaactgacagttctgtgcagcgcgcccgggaccctgaagacgcttgctcggtatgccgtgcgcaggagcctgggcctgcaatacctgcccgatgccgttaagggcctgcctctcccagcctccctgaaagaatatctgctcctgctggagtag

SEQ ID NO: 17751 - DNA, 549 bp, Artificial Sequence
  Description of Artificial Sequence: Synthetic coding sequence
atgcccatcccaccaccccccccaccccccccgggacccccacccccccccacctttcaccaggccaatacagagcagcctaagttatccagggacgagcagcgaggaagaggggccctgttacaggacatctgtaagggcaccaaactgaagaaggttaccaatattaacgatagatccgcccccattctggagacacctccaccacccccgcccgtgatccgtaatggagctcgcgacgcgcccccccctccgcctccctacagaatgcacggctcggagcccccatctagaggcaagccaccacccccccccagccggaccccagctggacccccaccacccccaccaccccccctgcgcaacggacatagagactccatcaccaccgttcgctcattcctggacgactttgagagcaaatacagcttccacccagtggaggacttccccgcacctgaggaatacaaacattttcagcggatttacccaagcaagaccaaccgcgccgcccggggggcccctcctctaccccctatactgcgctag

SEQ ID NO: 17752 - DNA, 999 bp, Artificial Sequence
  Description of Artificial Sequence: Synthetic coding sequence
atggaccaaccagctggccttcaggtagactatgtattccgaggggtagagcacgcagtgcgcgtgatggtgagcggacaggttttggagctggaagtggaggacaggatgacggcagaccagtggcgcggcgaattcgatgcaggcttcattgaggacctgacccacaagaccggaaatttcaaacagtttaatattttctgtcacatgctggaatctgcccttacccagagttcggaaagcgtgacacttgatctgcttacatacaccgatctggaatccctcaggaaccgtaaaatgggtgggcgtcccggcagtctcgctcctcgatctgcacagctcaatagtaagcgttacctaattctcatctactcagtggaatttgatcggattcattatcccctgcctctgccgtatcagggtaaacctgacccagtcgtgctgcagggcattatcaggtccctgaaagaggaactcggaagactccagggcctcgacggccaaaacacgcgagatacacgcgagaacgaaatatggcatctgagagaacagcagcaacaacggaatcgtctcggaagcggcgggagtggagatgggccctccgtttcttggtctagacaaacgcagccacccgccgcgctgacaggcagaggcgacgcccccaatcgatcaagaaaccgcagctctagcgttgatagcttcaggtcacggtgctcaagcgcctcttcctgctcagacctggaagatttctctgaatcattgtctcgtggggggcacagacggcgtggcaagccgccttctcctactccttggagtggcagcaatatgaaaagccctcctgtggaaaggagtcatcatcaaaagtcgcttgctaacagtgggggctgggtgccgattaaggaatactcaagcgaacaccaggcggctgacatggctgagatcgacgcacgcctcaaagccctccaggagtacatgaacagactggatatgaggtcatag

SEQ ID NO: 17753 - DNA, 516 bp, Artificial Sequence
  Description of Artificial Sequence: Synthetic coding sequence
atgtcctcaaagaggacaaaaaccaagactaagaaacgcccacagcgcgccacttcaaacgttttcgccatgtttgaccagtcccaaattcaggagtttaaagaggcatttaacatgattgatcagaaccgggacggatttatcgacaaggaagacttgcatgacatgcttgccagcctaggcaagaatccaaccgacgagtaccttgatgcgatgatgaatgaagcacctgggcccatcaactttaccatgttccttaccatgtttggggagaaattgaacggcaccgatcctgaggacgttattaggaatgcatttgcctgcttcgatgaggaggccactgggacgatccaggaggactatctccgtgaactgcttacaactatgggagaccggttcaccgacgaagaggttgacgagctttatagggaagcccctattgacaagaaaggaaatttcaattatattgagttcacacgcatcctgaaacatggtgccaaggataaagacgactag

SEQ ID NO: 17754 - DNA, 2391 bp, Artificial Sequence
  Description of Artificial Sequence: Synthetic coding sequence
atgagcctggatgacaacttgagcggcactagcgggatggaagtcgatgacagagtgtcggctctcgagcagagactgcaactgcaggaggatgaactggccgtcctcaaagcagcactagccgatgcactgaggcgtttgagggcctgcgaagagcagggagccgcgctgcgggcgcgcggcacacccaagggaagagcaccccctcggctcggcaccactgccagcgtttgccaattgcttaaaggcctccccacaaggacccccctgaacggaagtggccctcccagacgggttggcggttatgccacatcaccaagctccccgaaaaaggaggcaacctcgggcagatcctcggtcagaaggtacctgtcacctgagagactggcaagcgtgcggcgagaggacccaagaagccgcacgaccagtagtagttctaactgctctgcaaagaaagaaggtaaaaccaaagaggttatcttcagtgtggaggacgggtctgtcaaaatgtttttgcggggtcggcccgtgccaatgatgattccagacgaactcgcaccaacttatagcctggacaccagatcagagctccctagttgtagactgaagctcgagtgggtgtatggatatcgcggacgagactgcagggccaacctctaccttctgcccacgggcgaaatagtctatttcgtcgccagcgtggccgtgctgtactcagtggaggagcaacggcaaagacattatcttgggcataacgatgacattaagtgcctggccattcatccagatatggtgacgattgcaacagggcaggttgcaggcactacaaaagaggggaaaccactgcccccacacgtacggatctgggatagtgtcagtctcagcacccttcatgttctaggacttggagtcttcgacagggcagtgtgctgcgtggggttttcgaagagcaatggaggcaaccttttatgcgccgtggacgaaagtaatgaccacatgctgtccgtatgggactgggctaaagaaactaaagtcgtggacgtcaaatgttcaaacgaggccgtcctcgtggctacatttcaccctacggacccaaccgttctgataacgtgcggtaagagccacatctacttctggactttggaaggcggctccctctctaaacgacagggactattcgagaaacacgaaaaaccaaaatatgtcctgtgtgtgactttcctggagggcggtgacgttgtgaccggtgattccggcgggaacctctatgtttgggggaaggggggcaaccgtatcacccaagccgttctcggggctcatgatggcggggtgttcgggttatgtgcgctgagggatggtacactggtaagtggggggggcagagacaggcgagtcgtgctctggggaagcgattacagtaaattgcaggaagttgaggtgcccgaagactttgggccagtccgcacagtagccgagggccacggtgatacgctgtacgtcggaactacgcgtaattctatcctgcaggggtccgttcatactggcttttcgctattagtgcaaggacacgttgaagaactctgggggctggctacccacccttccagggctcaatttgtcacttgtggtcaggacaagctcgttcatttgtggagctccgacagccaccaacctctctggagtcggattatcgaggaccctgctcgctccgcaggcttccatccttctggatcagtcctggccgttgggactgtcacaggaaggtggctgttgctggataccgagacacacgacctcgtggctattcacactgatggcaacgagcagatctcagttgtgagctttagccctgacggggcttatctggctgtaggaagccacgataaccttgtctacgtgtacacagtggatcagggaggccgtaaggtttcgaggctgggcaagtgttcgggacacagctcatttatcactcatctcgactgggcccaggatagttcttgtttcgtcaccaattctggggattacgagattctgtactgggatcctgcaacgtgtaagcaaatcacatcagccgacgctgtgcggaacatggagtgggctacagccacctgcgtcctcggcttcggcgtgttcggcatttggagtgagggggctgacggaaccgatattaacgccgtagctagaagccacgacggcaagctgctggcaagtgctgacgattttgggaaggtgcatctgtttagctacccatgttgtcagccccgggccctcagccacaaatacggcggtcattcgagtcacgtgacaaacgtcgctttcctctgggatgatagtatggccctgaccaccggggggaaagatacttcggtcctgcaatggcgggtggtttag

SEQ ID NO: 17755 - DNA, 1059 bp, Artificial Sequence
  Description of Artificial Sequence: Synthetic coding sequence
atggctctcctgggacaagctttaaagtggcagcagcatcagggtctcctgccaccaggaatgacgatcgacctgttccggggcaaggcagcagtcaaggacgtggaagaggagaagtttcctacacaactctcccgccatatcaagttcggacaaaagagtcacgttgaatgcgctaggtttagtccggatggccaatacctggtgacggggtccgtggacggtttcatagaagtgtggaatttcactaccgggaaaatccgcaaggacctgaaatatcaagcacaggataacttcatgatgatggacgacgcggtactgtgtatgtgtttcagtcgggacaccgagatgctggccaccggggcccaagatgggaaaatcaaagtctggaaaattcagagcggccagtgtctcaggcgatttgaacgcgctcacagtaagggggtcacctgtctgtcattctctaaagactcttcccagattctgtctgccagctttgaccagaccattcggatccacggtcttaagagcggcaaaactttaaaagagttccgggggcactcctcatttgtaaatgaagcaacctttacccaggacggccactacatcatctcagctagctctgacggcaccgtgaagatctggaatatgaaaacaaccgagtgttcaaatacattcaagtcacttggcagtactgccggaacagacatcacagtgaattcagtgattctactccctaagaatcctgagcactttgtggtctgcaaccgtagtaacactgtggtgatcatgaacatgcagggccagatcgtccggagttttagcagcggcaagagagagggtggagactttgtgtgttgtgcgctctcaccccgtggagaatggatttattgtgttggtgaggattttgtcctctactgtttctccacagtaaccggcaaactagagcggacactgactgttcacgagaaggacgtgattggtatcgcccaccacccgcaccaaaacctgattgcgacttacagcgaggatggcctgctcaagctgtggaaaccatag

SEQ ID NO: 17756 - DNA, 951 bp, Artificial Sequence
  Description of Artificial Sequence: Synthetic coding sequence
atgcagagttgggtcttaatcagcaaagagcttatttccctgttgcatctctcgctgttacacttggaagaggacaaaaccacagtcagtcaggagtcacgccgggctgagacactggtctgctgctgcttcgacctgctcaagaagctacgagccaaactgcaatccctaaaggctgagcgcgaagaggcccggcatagagaggaaatggccctaagagggaaagatgcagctgaaattgtgctcgaggctttctgtgcccacgccagccagcgaatttcccaattagagcaagatctcgcctccatgcgagagttcaggggtctcctcaaggatgcccaaacacagcttgtcggcctccatgcaaagcaggaagaactggtccagcagaccgtgtctcttacctccacactgcagcaagattggagatccatgcaacttgactatactacgtggaccgctctgctgtcccgatctcggcagctgacggagaaactgaccgtaaaatcccaacaggcgctgcaggagcgggatgttgcaatcgaagagaaacaagaagtgagcagagttctcgagcaagtaagtgcccagttagaagagtgcaaaggccagaccgaacagctggaactcgaaaactccagattggccacagatttacgagctcagctccagattttggccaatatggatagccaattgaaggaactccagtcccagcatacacactgcgcgcaagacctcgctatgaaagacgaacttttatgtcagctgacccagtccaatgaagaacaagccgctcaatggcagaaggaggagatggccttaaaacacatgcaggcagagctgcagcaacagcaggccgtacttgccaaggaggtgagagatttgaaggaaactcttgagttcgctgatcaggaaaaccaggttgcccaccttgaactagcctggtag

SEQ ID NO: 17757 - DNA, 597 bp, Artificial Sequence
  Description of Artificial Sequence: Synthetic coding sequence
atgacactgcgttgcctcgagcccagtggcaatggcggggagggtacccgatcccagtggggtaccgccggctcagcagaagagccttctccccaggccgcgagacttgctaaggctctccgagagctgggtcagacaggctggtactggggttcaatgacagttaacgaggctaaagagaagttaaaagaagctcctgagggaacgtttttaatcagagacagttcacactcggattatctgttaacgattagcgtgaagacttctgccggaccaacaaatctgagaatcgagtaccaagatgggaagttccgtcttgatagtattatttgtgtgaaatccaagctgaagcagtttgactccgtggttcatctgattgactactatgtgcagatgtgcaaggacaagcgaacaggccccgaagccccccgtaatggtacggtccacttgtatttgaccaagccactctatacctccgctccatcattacagcacctgtgtcggctcacgatcaataagtgcacgggggctatttggggccttccattgcctactcgactgaaagactacctcgaagagtacaagtttcaggtctag

SEQ ID NO: 17758 - DNA, 591 bp, Artificial Sequence
  Description of Artificial Sequence: Synthetic coding sequence
atggtccccagaccctggtcaggttctccagggcctggtgaatgccttcactccctactgagcgaaaggctctggatttgtcgagacatatctgctcagcggcggtccgcccctggaagtccacgcccgtcagattgccagcaactgagttttctacccggcaaccagccaacattcctctgtctgcaggctctggccgccctcgttcccggagtcacacaggtggacaacaagagtggatttctgcagaaaaggccacaccggcagcaccccggtattctcaagctgccccatgtgcggcttccgcaggccctggctaatggggctcagttgcttctcctgggatccgccggccctacgatggaaaaccaggtgcagacactgacatcgtacctttggtcccggcacctccccgtggagccggaggaacttcagagacgtgcccgtcaccttgagaagaaatttctcgagaaccccgggcccgattttcagagccttttttctcctcagacctaccttaggcagcgccgtaacttcgtggaacagtgctatacacactacgtgaagttaccaacaattggcaagaattag

SEQ ID NO: 17759 - DNA, 1131 bp, Artificial Sequence
  Description of Artificial Sequence: Synthetic coding sequence
atgccggacgtggtgcaaactcgtcaacaggcttatcgcgacaaactggcccagcagcaggctgcagccgcggctgctgccgccgccgccgcttcgcaacaaggttctgccaaaaatggcgaaaacaccgctaatggggaggaaaatggagcccacaccatagctcggatatggaatctgtcagagaatagtacctctggttccacacagcttgtgctgcgccactgtatccgggagggtggtcaggatgtccctagtaataaggatgtaacgagcctggattggaatagcgaaggcacacttcttgcgactggcagctatgatggattcgcccggatttggaccaaggatggaaacctcgcatctaccttgggacagcacaaggggccgatcttcgcgttgaaatggaataagaaaggtaacttcatcctgtcagccggtgtggataagaccactatcatctgggatgcccacactggagaggccaagcaacagttcccattccatagcgcacctgcgctggatgtggactggcagagcaataacacctttgcctcctgcagcaccgacatgtgcattcacgtgtgcaagctcggccaggaccgccctatcaaaacattccagggccacacaaacgaggtaaacgcaatcaagtgggatcccacaggtaacctgctggcttcctgcagcgatgatatgaccctgaagatctggtctatgaaacaggacaattgtgtccacgacctccaggcacacaataaagagatttatactattaaatggtctccaaccggcccaggcactaataatcccaatgctaatctgatgctagcatctgcctcgtttgactctactgtcaggttatgggacgtggaccggggcatttgcatccacacactcacaaaacaccaggaaccagtgtattcggtagccttttccccagatggaaggtacctggcgtccgggtctttcgataaatgcgtgcacatctggaacacacagacaggtgctctggtgcacagctaccggggcaccggtggcatcttcgaagtctgctggaatgcagctggcgacaaggtgggggcctccgcctccgacgggtctgtttgcgttctggatttacgcaaatag

SEQ ID NO: 17760 - DNA, 1116 bp, Artificial Sequence
  Description of Artificial Sequence: Synthetic coding sequence
atgcacattaaatcaatcatccttgagggctttaagtcctatgctcaaaggacagaggtgaatggtttcgatcccctctttaatgccatcaccggactgaacgggagtgggaagtccaatatcctggatagtatttgcttcctgctaggtatcagcaacctatctcaggttagggctagcaatttacaggacctggtctacaagaacggccaggcagggataacaaaagccagcgtttcaatcacctttgataactccgacaaaaaacaatcccccctggggtttgaagtgcatgatgagatcactgtgactagacaggtggtgatcggcgggcgcaataaatatctcatcaacggggttaacgctaacaacacccgtgtgcaggacctcttttgttcagtggggctgaatgtgaacaacccgcactttctgatcatgcagggtcgaatcacaaaggtattgaacatgaaaccccccgagattctcagcatgattgaagaagccgccggcactcgaatgtatgagtataagaagattgctgctcaaaagaccatcgagaaaaaggaagccaagctgaaggaaatcaaaacaattctggaggaggaaatcaccccgaccatccagaaactgaaagaagaaagatctagctatttggagtaccagaaagtgatgcgggaaatcgaacatctgagcagactgtacattgcctaccaattcctgctggcagaggatactaaggtaagatctgccgaagagcttaaggagatgcaagacaaagttataaaactgcaggaggagttgagcgagaatgataaaaagatcaaagctctaaatcacgagatcgaagagcttgagaagagaaaggataaagagacaggaggaatcctccgcagtcttgaagacgcgctggctgaagcacaacgcgtgaataccaagagccagtctgccttcgatctgaaaaagaaaaatctggcctgtgaagagagcaagcgtaaagagttggagaagaatatggtcgaggacagtaagactcttgctgctaaagaaaaagagaagattaagagaaaggccttttggaagtccgccggaagctgtctagttattctagttgattag

SEQ ID NO: 17761 - DNA, 507 bp, Artificial Sequence
  Description of Artificial Sequence: Synthetic coding sequence
cacaagcttcagtcgggtatcggtcggcttattctgaaagaggaaatgaaagcaaggagctcttcctacgcagacccttggacacctccaaggagctccacatcctcaagagaggccctgcacacagctgggtacgagatgtcacttaatggaagcccgcgctcccattacctggccgacagtgatccactcatctctaaatcagcttcactgccagcttatcgacgcaatggactccacaggactcccagcgccgacctcttccactacgatagcatgaatgctgtaaactgggggatgagagaatacaaaatttatccctatgaacttttgctggtcaccacgcgggggaggaatcgtcttcctaaagacgttgaccgcacgagactcgaacgacacctgagccaggaagagttctatcaggtctttggcatgacaataagtgaattcgataggctggccctctggaagcgaaatgaacttaagaaacaggctcggctcttctag

SEQ ID NO: 17762 - DNA, 1770 bp, Artificial Sequence
  Description of Artificial Sequence: Synthetic coding sequence
atgagcgtgtccgttcatgagacccgcaagtcaagaagtagcacgggatcaatgaatgtgacactattccacaaagcctcgcaccctgattgcgtgctggcccacctgaatacattgcgaaaacattgcatgtttaccgacgtgaccctgtgggctggggatcgagctttcccctgccatcgggcagtacttgcagctagtagcaggtacttcgaagcgatgttctcccatggcttgcgggagagccgcgacgatactgtgaacttccaggacaacctgcaccccgaagttctggaactcttactcgatttcgcttactcgtctcgaatcgcaataaatgaggagaatgccgaatcccttctggaggcaggggacatgctccaatttcacgacgtgcgcgatgctgcagccgagtttctggagaagaacctattcccttcaaactgcctggggatgatgcttctctccgatgcccatcagtgccggcgactttacgagttttcctggagaatgtgtttggtgcatttcgagacagtccgacagtccgaggactttaatagtctctccaaggacaccctcttggacctgatatcatcagatgagttggagacagaggacgaacgcgtggttttcgaggcaattttacaatgggttaagcatgacttggagccccgcaaggtacacctgccggaactcctgcggagcgtgcggctggccctcttgccctctgactgcttacaggaagccgtgtcttctgaagcccttctgatggccgacgagcgtaccaaactgataatggacgaagccttacgatgcaagacccggatccttcaaaatgacggcgtcgtaacctcaccttgtgcccgcccgaggaaagccggtcacaccctgctcatcctcgggggtcagaccttcatgtgtgacaagatatatcaggtcgaccacaaggccaaagagatcattcccaaagctgacctcccaagcccgagaaaggagttctccgcatcagctataggatgcaaagtttatgtaaccggaggacgggggtccgagaatggcgtctcaaaagacgtgtgggtatacgataccgtgcatgaagagtggtccaaagctgctcctatgttaattgcccggtttggtcatggcagcgcggaactcgagaattgcctttatgtggtgggagggcacacttctctggctggggtgtttcctgctagcccatcagtgagccttaaacaagtggagaaatacgacccgggcgcaaataagtggatgatggtagccccactccgcgacggagtatccaatgctgctgtggtctcagccaagctgaagctgttcgtgttcggagggacatccatacatcgggatatggttagtaaagttcagtgctatgatccctctgagaaccgatggactataaaagcagagtgtccgcaaccctggagatacacagccgcggcggtcctgggaagccagatctttatcatgggcggcgatacggagtttacagcagccagcgcctaccgatttgattgcgaaacgaaccaatggacaagaatcggtgatatgactgccaagcggatgtcatgccacgcactggcatccgggaacaagctgtacgtggtcggtggctattttggaacccagcgctgcaaaactttggactgttacgatccaactagcgacacctggaattgtattacaacagtaccatacagcctaatacccactgctttcgtgtctacatggaagcacttgcctgcctag

SEQ ID NO: 17763 - DNA, 1287 bp, Artificial Sequence
  Description of Artificial Sequence: Synthetic coding sequence
atgtccatgttgaaacccagtggacttaaggctcccacaaagatcctgaagccagggtcgacggccctgaagaccccgaccgctgttgtcgcacctgtcgagaaaacaatcagttccgaaaaggcttcgagtacacctagtagtgagacccaagaggagtttgtggatgatttcagggtcggagagagggtgtgggtcaatggaaacaagcccggtttcatccaattcttaggagagacgcagtttgctccaggtcagtgggcagggatcgtgttagacgaacctattggaaagaatgacgggagtgttgccggcgtgagatatttccagtgcgaacctctgaaagggatattcacccgcccttctaagctgaccagaaaggtgcaggccgaggatgaggccaatggcttgcagaccacccccgcgagtcgggccacgtcccccctgtgcacaagcacagcatctatggtgagttcttcccccagtacccctagtaatattccgcaaaagccttcccagccggcagcaaaggagccatcagcaacgccccctatcagtaacttaacaaaaacggcatccgagtccatcagcaacctctctgaagctggatcaataaaaaagggcgaaagagagctgaaaattggggaccgcgtgctcgtggggggcaccaaagccggcgtggtaaggtttcttggagagactgacttcgccaaaggcgaatggtgtggggtggaacttgatgagccattgggcaagaatgatggagcagtggctggtacgcggtactttcagtgccaacctaagtatggattattcgctcctgtgcacaaggtgaccaaaataggatttcctagcacaacacccgccaaggcgaaggccaacgcagtgaggagggtcatggctaccacttccgcttccctcaagaggtccccctcagcctccagcttatcctcgatgtcaagcgtcgcgtcatcagtcagctccaggccaagccgaaccgggcttcacgtgcttgagctggaagccaagatggaccagctgaggaccatggtggaggctgcagatcgcgaaaaggtcgagctccttaatcagctcgaggaagagaagcggaaagtggaggatcttcagttcagggtggaggaggagagcattacgaaaggagatttggaacagaaatcccagatttctgaggaccctgagaacgtgcgcgggcacctgactgtctggatatttcctctgttgaccaagatagatcacagattgaagtgtctgctgatctatagctag

SEQ ID NO: 17764 - DNA, 3483 bp, Artificial Sequence
  Description of Artificial Sequence: Synthetic coding sequence
atggttgtgacccttggtcctgggcccgactgcctgatcctcgaggccagtcgccagccccagctggtgcccaaacccgagcgaatggcatccgatggggccagcgccctgccaggacctgatatgtctatgaaaccgagcgcagcacccagcccatcacctgcactgccgtttctgcccccaacttcagatccaccagatcatccacccagagagccacctcctcaacccataatgccttccgttttcagccctgacaaccctctgatgctgtctgccttccctagttcactattggtcacaggtgatggcggaccttgcttatccggtgccggcgctggcaaagtgattgtgaaggtgaagaccgagggggggagcgcagagccctcgcagacccagaacttcatactcactcaaactgcgctgaattccaccgcacccggaacaccctgtggcggtctcgagggacccgcacctccgtttgttactgcaagcaacgtgaaaaccatcttgccttccaaggcggtaggcgtgtcacaggagggccccccgggtctgccaccacaaccaccccctcctgttgctcaacttgttccaatcgtgccacttgaaaaggcatggcccggccctcatggtaccacaggagaaggaggccccgtcgcaacactgtccaagcctagtctcggtgatcgctccaagatttccaaagacgtttatgaaaatttcagacagtggcagcgctataaggctctcgcacgcaggcacctgtcccagagtccagataccgaagcactgtcgtgtttcctgatcccagtactgcggtcactcgcccggcttaagcctaccatgaccctagaagaaggtctccccctggccgtgcaggagtgggaacatacttcgaactttgatcgcatgattttctacgagatggctgagcggtttatggaattcgaagctgaggaaatgcagattcagaatacacagctaatgaacgggtctcaggggctgagcccagccactccactcaagttagatccgctagggcctctagcctccgaagtgtgccagcaaccggtgtatatccctaaaaaagctgcgtccaagactcgagcaccccgtcgccggcagcggaaggcccagcgcccacccgcccctgaagcaccgaaagagatccccccggaggccgtgaaggagtatgtggacattatggagtggttggtcggaacccacctggcaacaggcgaaagcgatggcaaacaggaagaggagggacaacagcaggaggaggaaggtatgtaccctgaccccggcctgctatcttacattaacgagctgtgttcacaaaaagtgttcgtgagcaaggttgaagcagtgattcaccctcagttcctagcagacttgttgagccccgagaagcaaagggatccattagcactgatcgaggagctcgaacaggaggagggactgacccttgcgcagttggtgcagaagcgactgatggccctagaggaggaggaggacgcagaggccccaccatccttcagtggtgctcagctggatagctcacccagcgggtctgttgaagatgaggacggggatggcaggcttagacccagtccggggctgcagggggctggtggggctgcctgcttaggcaaagtctccagctctggaaaaagagcaagggaagtgcatggaggccaggagcaggcactggatagtccccggggcatgcaccgagatggaaacacactcccatcacctagttcctgggacctgcagcctgagctggccgcaccccagggtacaccagggcccctaggggttgagaggagagggagtgggaaggtcataaaccaggtgtctctgcaccaggacggacatctgggaggcgctggacccccaggtcactgtttggtcgccgatcgtacatctgaagcccttccgctttgctggcaaggcggtttccaacccgagtccacccccagtctggacgccggcctggctgagctggcccccttgcaggggcaaggtcttgagaagcaggtattgggattacaaaagggacagcagaccggagggcgcggagtgctcccccaaggcaaagaaccactcgcagtgccttgggaagggagctccggtgcaatgtggggcgacgatcgggggacaccgatggcccagtcatatgaccagaatcccagtccacgggctgctggtgaaagggatgatgtgtgcttgtccccaggagtgtggctgtcttcagagatggatgctgtcggcctcgagctacccgtccagatagaggaggttatcgaaagtttccaggtcgagaaatgtgtgaccgaataccaggaaggttgccagggtctcggatctagaggaaacatctccttggggcccggggaaacccttgtgcctggtgacactgaaagttctgtgataccttgcgggggaacggtggcagctgcagcactcgagaaacgtaactactgctcgcttcccggtccactcagagctaactcaccacccttacgctcaaaagagaaccaggagcagtcatgtgagaccgttggccacccaagcgatctgtgggctgaaggctgctttcctctcctggaaagcggagactcaacactgggctcctccaaagagacactgccgcccacttgccaggggaacttgttgatcatggggaccgaggatgcttccagtctgccagaagcgtcccaggaagcagggtcccggggcaactcattctctcctctcctggagactatagagccagttaatattttggatgtgaaggacgattgcggactgcaacttcgcgtgtccgaagatacctgcccactgaacgtgcactcttacgatccgcagggggagggcagagtcgacccagatctctctaagccaaagaacttggctccactgcaagaatcgcaagagagctatacaaccggcactcctaaggctacctccagccaccagggcctcggaagtaccttgcctaggcgcggcacgcggaacgccatcgtcccccgcgagacttccgtgtccaaaacccatagatctgccgatagggcgaaaggcaaagagaagaagaaaaaggaggccgaggaagaagatgaggagctgtccaactttgcctatctgctggcctccaaacttagtctttctccccgggagcaccccttatccccgcaccacgcatcaggaggacaaggctcccagcgagccagccacctgttaccggcgggcgctaaggggcctagtaagctgccatacccggttgccaagtcaggcaaacgggcattagccgggggacccgcacccacagagaagaccccccactccggggctcagctgggggttccccgggaaaaacccttagcccttggggtggtcagacccagtcagccccggaagcggagatgcgattcctttgtgacaggccgccggaaaaaacgaagaaggtcccagtag

SEQ ID NO: 17765 - DNA, 1548 bp, Artificial Sequence
  Description of Artificial Sequence: Synthetic coding sequence
ctaaactcacaatgtcgcaataaaaaccctttcgccgccgggccccggcctccgcaccatcaattttttcagagacctcagattcaaccgccacgagcaacaataccaaatagctccccctcaatccgtccaggtgcccaaactcctacagccgtgtaccaagccaatcagcatatcatgatggtgaatcacctacctatgccctaccctgtaccacaaggacctcaatattgtatccctcagtatagacattccggtcctccttatgtcggtcccccccaacagtatcctgtgcagccacctggcccaggcccattttatcccggacccggacccggggatttccctaacgcctacggcaccccattctatccttcgcaaccggtttatcagtcagcccccattattgtgccaacccagcaacagcccccacccgccaaaagggagaaaaaaactattcggatccgggaccccaatcagggaggaaaagatataaccgaagaaatcatgtccggaggcgggtccagaaacccgacgccacctatcgggcggcctacctcaaccccaactccgccacagcagctgccctcccaggtcccagagcactcacctgttgtctatggcaccgttgaaagtgcccatctagccgctagtacacctgtgacggccgcgagcgatcagaagcaggaggaaaaaccaaagccggatcctgtcctcaaaagccccagcccagttctcagattggtgctgtcaggagagaagaaagagcaggagggccagactagtgagactacagccatcgtttctatcgcggaactgcccctgcccccaagtcccactacggtgtcgtctgtcgccagaagcacgatcgctgctccaacctctagtgctttgtcaagccagccaatctttacgacggcgattgatgacaggtgcgaattatcaagccccagagaagacaccataccaataccgtcgctgacatcatgtacggaaacgtcggatccactaccaaccaacgagaatgacgatgacatctgtaagaaaccctgcagtgtggcccctaatgatattcccctggtgtcttccacaaacctgatcaatgaaatcaacggcgtgtccgagaagttaagcgccactgaaagtatcgtggagatagtgaaacaggaagtcctgcctctgacactggaattggaaattctggagaatccgcccgaggagatgaagctggagtgcatcccagccccaataactccatccacagtccctagtttcccgccaacgccacctactccacccgcatcacccccacacacacccgtgattgtgcccgcggctgctacaaccgtctctagtccttcagcagccatcaccgtacagagagtacttgaagaggatgaaagcatacggacatgcctgtctgaggacgctaaggaaattcagaacaaaattgaagttgaagccgacgggcagacagaggaaatcctggattctcagaatttgaactcacggcgtagccctgtcccagaaacatcaaatgaatgttag

SEQ ID NO: 17766 - DNA, 204 bp, Artificial Sequence
  Description of Artificial Sequence: Synthetic coding sequence
atggccctgctggcagagcacctcctcaagcctcttcccgctgataaacagatcgagaccggacccttcctggaagccgtcagccatcttccaccctttttcgattgcttgggaagcccagtgttcacccccattaaggccgacatctcaggtaacatcaccatgcggaagttacgtctacggggagtggaaggcctggcctag

SEQ ID NO: 17767 - DNA, 2418 bp, Artificial Sequence
  Description of Artificial Sequence: Synthetic coding sequence
atgatgcagaatgttcacctggctcccgaaactgacgaggacgatctttacagtggctacaacgattataatccaatttatgacatcgaggagctggagaatgatgctgccttccagcaggcagtcagaactagccatggccgccggccaccctccaagacctccctcgcttcttctataggcaggccaatgactggagcaatacaggatggtgtgacccgacccatgacagctgtccgcgccgctggcttcaccaaggccgccctcaggggtagcgctttcgacccactgagccagtcgcgaggtccagcctctcctctggaagcaaagaagaaggactccccagaagaaaagatcaagcagctggagaaggaggtgaacgagcttgtggaggagtcttgcatcgcaaacagttgcggcgacctaaagctagcactggaaaaggcaaaggatgcaggtcggaaagagcgagtgcttgtcaggcagcgggagcaggtaaccacccccgagaatattaatctggacctgacgtattcggtcctatttaacctggctagccagtatagcgtgaacgaaatgtacgcggaggccctgaacacatatcaagttattgtcaagaacaagatgttcagcaatgcagggattttaaagatgaatatgggcaacatttatctgaagcagcggaattactccaaagctatcaaattttatagaatggcacttgatcaggttccgagcgttaacaaacaaatgcgcatcaaaataatgcagaacattggcgtcactttcattcaggcaggccagtacagtgacgccattaattcatacgagcacatcatgtcaatggcccccaatctgaaagcgggttataatttgacaatttgttacttcgccattggcgaccgggaaaagatgaagaaggcttttcagaagctaatcacggtcccgctggaaatcgacgaggataagtacatctctccatctgacgatccccacaccaacttggtgaccgaggctatcaaaaacgatcacttgcggcagatggaacgtgagcggaaagcgatggccgagaagtacatcatgaccagtgcaaagttaatcgctcccgttatcgaaaccagttttgcggctgggtatgactggtgtgtggaagtggttaaagcttcccaatacgttgagctggctaacgacttggaaattaataaagccgtgacatacctgaggcagaaagattataaccaggcagttgaaatcctgaaggtccttgagaaaaaggattcgcgggtgaagagtgcagccgctacaaacctctctgcattgtactatatgggaaaggatttcgcgcaggcatctagttatgcggacatcgccgttaacagcgacaggtacaaccccgcagcgctgaccaataagggaaacactgtcttcgctaatggagattacgaaaaggctgccgaattctataaggaagcccttcggaatgactcttcttgcacagaggccttatacaacatcggtctgacttatgaaaaacttaatcgcctggacgaggcgctggactgctttctgaaactccacgctatcctgcgaaacagcgccgaggtgctgtatcaaattgcgaatatctacgaactgatggaaaatcccagccaagcaatcgagtggctgatgcaggtggtatctgttatccctacagatccgcaggtactaagtaagcttggggaactatacgatcgggagggagataaaagccaagcatttcagtactactatgaatcctacaggtatttcccatgtaatatcgaggtgattgagtggctcggggcctactacattgacacacagttctgggagaaagccatccagtacttcgaacgggctagcctaatccagccaacacaagtgaagtggcagctaatggtggcctcatgcttccgccggagtggcaattaccaaaaagcgctggacacatacaaagatacccacagaaaatttccggagaatgttgagtgcctgcgctttctggtgcgcctatgtactgatctcggcttaaaggatgcccaggaatatgccagaaagctgaagaggctggaaaaaatgaaagaaatccgagaacaaaggattaaatctgggcgggatggatccgggggaagtaggggcaagagagagggaagcgcatcaggagacagtgggcagaactatagcgccagttccaaaggtgaacgactgtcagctagactccgtgctttgccaggtaccaacgagccctatgaatcgtccagcaacaaggaaatcgacgcttcctacgtcgatcccttgggaccacagatcgagcgccccaagactgcggcaaaaaaaagaatcgatgaagacgattttgccgatgaagaattgggcgatgatctcctgccagagtag

SEQ ID NO: 17768 - DNA, 765 bp, Artificial Sequence
  Description of Artificial Sequence: Synthetic coding sequence
atggcccctggctccttcgctgagtacactgttgtgcccgcctccattgcgacacctgtcccctcagttaagccagagtatctcacattgcttgtctctgggacaactgcatacatctcactcaaagaactcggcgggttgtctgaaggcaaaaaggtcttggtaactgctgcagccggcggtacgggccagttcgcaatgcagctgtcaaaaaaagccaagtgtcacgtgatcggcacctgctcatctgacgaaaagagcgcattcctcaaaagtttagggtgcgatcggccgataaactacaagactgagcctgtgggaaccgtcttgaaacaggaataccccgaaggagtcgacgtggtctacgagagtgtcggtggtgcgatgtttgatctggcagtggatgccctggcaacgaagggccggctgattgttataggatttatctccggataccaaactccgactggcctgtccccagtgaaggccggaacactgccagccaagttgctgaaaaaatctgcctcagtccagggctttttcctcaatcactatttgagcaagtaccaggccgcaatgagtcacctcctcgaaatgtgtgtcagcggcgacctcgtctgtgaggtcgacttgggcgacctaagcccagaagggagattcaccgggctggaatccatatttagggctgtgaactacatgtatatgggaaaaaacacagggaagatcgtagtggaattgcctcattctgtgaatagcaagctgtag

SEQ ID NO: 17769 - DNA, 1212 bp, Artificial Sequence
  Description of Artificial Sequence: Synthetic coding sequence
atgcaccatccgatccagatgaaacccgcggacagtgagaaatccaacgcagtagaggaccgcaagctgtttatcgggatggtgtctaagaagtgtaacgaaaacgatataagggtgatgttttccccatttgggcagatagaggagtgtcgcatcctcaggggaccggatggactgtcccggggttgcgctttcgtgacgttcagcacccgggctatggctcaaaatgccattaaggccatgcatcaatcccagaccatggaggggtgctcatcacctatcgtggtcaaattcgccgacacccagaaggataaggagcaaaggaggctgcagcaacaactcgcccagcaaatgcagcagctgaatactgctacctgggggaatctgactggtctcggcggcttaaccccgcaatacctcgccctccttcagcaggcaacaagcagcagtaatctcggtgcattttccgggatccaacagatggcgggtatgaatgctcttcagctgcagaacctggccactttggcggctgccgccgcggcagctcaaacatccgccacctcgacgaacgctaacccgctctctacaactagctccgcccttggggctttgacttcccctgtcgccgcaagcaccccgaatagcaccgctggcgccgccatgaacagtctgacctccttggggacgctccagggattggccggggcaacagttggtttaaataacattaatgccctggccgtggcacaaatgctatccggcatggccgccctcaatggaggactgggagcgacaggcctgaccaatgggactgccggaaccatggacgccctcacgcaggcttacagtgggattcagcagtatgccgccgctgccttacctactttatactcccagtcactgctgcaacagcagtctgcggctggatctcaaaaggaggggccagaaggagcaaacctgttcatctaccatctgccccaggagttcggggatcaggacatcttacagatgttcatgcctttcgggaatgtgatttcagcaaaggtattcattgacaagcagactaatctttctaaatgcttcggctttgtgagctatgacaaccctgtctctgcccaggcggccattcaggcaatgaatggatttcagatcgggatgaagagactaaaggtacagctgaaacgttcaaagaatgatagtaaaccatattag

SEQ ID NO: 17770 - DNA, 1332 bp, Artificial Sequence
  Description of Artificial Sequence: Synthetic coding sequence
atggcagagtttttaaaacaagttaagccttatgtcgaagagggtctccatccacagataatcattcgcgcctttcggacagccacccaacttgctgttaataagattaaagagatcgcagtgactgtgaagaaagccgacaaggtggagcagcgtaagctgcttgaaaagtgcgctatgactgcactttccagcaaactaataagccagcagaaggcattcttcgccaaaatggtcgtcgacgcggtcatgatgcttgacgacctactgcagctgaaaatgattggtattaagaaggtgcagggtggtgccctggaggatagtcagctggtggcaggtgtcgcgttcaaaaaaaccttcagttacgcgggcttcgagatgcagccgaagaaataccataatccaaaaatagctcttttaaatgtcgagttggagctcaaggccgaaaaggacaacgctgagatcagagtacatacggtggaggattatcaggccattgtcgacgccgagtggaatattctgtacgataaactggagaagattcaccactcgggagcaaaggtcgtgctaagtaagcttccaataggcgatgtagcaacccagtattttgccgatagggatatgttctgtgcaggccgagtccctgaagaagaccttaaaaggaccatgatggcctgcggcgggtccatacagacatccgtcaacgcactgagtgctgatgtgctgggcagatgtcaggtgttcgaggagacacagatcggcggggaacggtacaatttctttaccggttgtccaaaagccaagacctgtacgtttatcctgagggggggagccgagcaatttatggaggagaccgaacgctccctacatgatgccataatgatcgtgcgccgcgctatcaagaacgacagcgtggtagcgggcgggggcgcaatcgaaatggaactgtccaagtacctgagggattacagcaggaccatccccggcaagcagcagttgctgatcggtgcctatgctaaagccttggaaattattccccgacagctatgcgacaacgccggctttgacgcaaccaatatcctcaacaagctcagggccaggcatgcccagggcgggacatggtacggagtcgacataaataatgaggatatcgcagataacttcgaggccttcgtctgggaacctgcaatggttaggattaacgccctgactgccgcgagcgaagccgcttgcctgattgtgtcggtcgacgaaaccatcaagaacccacgtagtacagtcgacgccccgactgctgctgggcggggaagagggagggggaggccacactag

SEQ ID NO: 17771 - DNA, 2193 bp, Artificial Sequence
  Description of Artificial Sequence: Synthetic coding sequence
atgcagcttttcgagcagccctgtcccggagaggatccacgcccgggcggacagattggagaagttgagcttagttcatatacgcctcccgccggcgtgccgggcaagcccgccgctccccattttctgccggtactgtgctcggtatcgccaagtgggtcgcgcgtgccacacgacttactgggtggaagcggcggttttaccctggaggatgctctgtttggcttacttttcggtgctgatgctacactgctgcaatcgccagtggtcctgtgcgggttgcccgacggccagctttgctgcgtgattcttaaagctctcgtgacttcccggtcagcacccggagacccaaacgccctggttaagatccttcatcatctggaggagcctgtgatatttattggcgcactgaagacggaaccacaggcggcggaagcggcagagaattttcttcccgacgaggatgttcattgcgattgcctcgttgcctttgggcatcatggcaggatgctagcgataaaagccagttgggatgaaagtggcaaactggtgccagagctgcgagagtattgcctacctgggccggtgctctgtgcagcatgcggcggcgggggacgcgtgtaccatagcaccccttctgatctatgtgttgttgacctgagcaggggctcgacacctctggggccagagcagcctgaagaaggccccggcggcttgccgcctatgttgtgtccggccagcctgaatatttgtagtgtcgtgagtctgagcgccagtcccaggacccatgaaggaggaactaagctgttagctctcagcgcaaaaggaagacttatgacatgctctctggatttggactccgaaatgcctggtcccgcccgaatgactaccgagagcgcgggtcagaaaattaaggaacttctttcagggattggaaacatctccgagcgggtctccttccttaaaaaagcagtggatcagagaaataaagcccttacctctctcaatgaggcgatgaacgtcagttgcgcattgctgtccagcgggacaggcccacggccaatcagctgtaccacttccactacgtggtcgcgcttacagacacaggatgtgttaatggcaacttgtgtactggagaattcaagtagtttctcactggaccagggatggaccctctgtatccaggtgctaacatctagttgtgctctggatttggactcagcatgttctgccatcacatacaccatcccggtggatcaactaggccctggagccagaagggaagtcacactgcctctgggccccggcgagaatgggggtctggacctgcccgtgacagtgtcttgtaccttgttttatagtctccgggaggtggtcggtggtgctttagctccctccgattctgaagacccgtttctcgatgagtgcccctcagacgtcctccctgagcaggaaggcgtctgccttcccctaagtaggcatactgtcgatatgctccagtgcttgagattccctggcctggctcctccccatactagggctcctagccccctgggacctacaagggaccccgtcgctacgttcctagagacttgtagagagcctggctcacagcccgccgggccagcatccctgcgcgcagagtacttgccaccatccgtcgcctcaatcaaagtcagcgcggaattgcttcgggccgccctaaaggatggtcacagcggagttcctctgtgttgtgccacgctccagtggctgctggctgaaaacgctgccgtggacgtggtgagggcacgggctctgtcttccatccagggcgttgcgccagatggtgctaatgttcacctaattgttcgggaggtggccatgactgacctgtgtcctgcaggcccaatccaggctgtggaaattcaggtcgagtcttcttcattggctgacatctgccgggcccaccacgccgtggtgggaagaatgcaaactatggtgaccgagcaagcaacgcagggatcatcagccccagatctgagggtgcagtatctacgccagatccacgctaatcacgagaccttgctcagggaggtgcagacactacgcgatcgactgtgtaccgaagatgaggcttcgagttgcgccacagcccaacgacttttacaggtgtaccgacagctgaggcacccttccttgatcttactgtag

SEQ ID NO: 17772 - DNA, 4179 bp, Artificial Sequence
  Description of Artificial Sequence: Synthetic coding sequence
atgtctatgctgaaaccaagtggtcttaaggctccgactaagattctcaagcccgggtccaccgctcttaaaacaccaaccgcagtggttgcccctgtcgagaaaactatttcgagtgagaaagcttctagtactcctagttctgaaacacaggaagagtttgtggatgatttccgcgtgggggagcgagtctgggttaatggcaataagccggggttcattcagtttctcggcgagacacagtttgcacctggtcagtgggctggaatcgtcctcgatgaacctatcgggaagaacgacggtagcgtggcgggtgttcgctactttcagtgtgaaccacttaagggtatattcacaagaccttccaaacttacacgtaaagtccaggcggaggatgaggccaacggcctccagaccaccccagcctcaagggccacaagtccgttatgtacctctaccgctagtatggtgtcctctagcccctctacaccctcaaacattccccagaaacctagccaacctgcggcaaaagagcctagtgcaaccccccctatttccaatctgactaagaccgcctccgagtcaattagtaaccttagcgaggctgggagcattaagaagggcgaacgggaattgaaaatcggagatcgagtgcttgtaggaggaacgaaggcgggagtcgtacgctttttgggagagactgacttcgccaaaggtgagtggtgtggcgtcgagctggacgaaccgctgggaaagaacgatggggcagtcgctggaactaggtatttccagtgtcagccaaaatacggcctgtttgccccagtgcataaggtgacaaagatcgggttcccatctacaacccctgccaaggcaaaggccaatgccgttcgacgcgtcatggccacaaccagcgcgagccttaaacggagccccagcgcctcttccttaagcagcatgtcctcagtggcttcctcagtgagcagccggcccagtcgtacgggcttgctgacagaaacatccagccggtacgcgaggaaaatttccggcacaaccgccctgcaggaagcgctgaaagagaaacagcaacacatagagcagctcctcgccgagagggatcttgagagggccgaagtggccaaggcaacttcgcatgtgggtgagatagagcaggaactggccctcgcacgagacggacacgaccagcacgtcctggagctggaggctaagatggaccaattgcgcactatggtcgaggcagcagatcgggagaaggtcgaactcctgaaccagctggaagaagaaaagcggaaagtggaggacttgcagttcagagtcgaggaagagtcaattacaaaaggagatctggaggtggccactgtttcggagaagtcgagaatcatggaactcgaaaaagatctggccttgcgagtacaggaggtcgcagagctcagacgaagactggaaagcaacaagcctgctggcgacgttgatatgagtctatcactgctgcaggaaatctctagcctgcaggaaaaactagaggtaacacgaaccgaccatcagcgggaaattacctctttaaaagagcactttggggcacgggaagagacccaccagaaagagatcaaagctttgtatacagctacagagaagctcagcaaagagaacgagtctttaaaaagtaagcttgaacacgccaataaggagaattccgacgttattgctctgtggaaatcgaagctggagaccgcgatagcttcccaccagcaagcaatggaggagcttaaggtgtcattttcaaagggcttgggaacagaaactgctgagtttgccgagctcaagacccagatcgagaagatgagattggactaccaacatgaaatagagaacttacagaaccagcaggacagtgagagagcagcacacgccaaggagatggaagccctcagggccaaactgatgaaggtgataaaggagaaagagaattctctcgaggccatcaggtccaagctcgataaagctgaggaccagcacctggtagagatggaagacacactgaataagctccaggaagctgagatcaaggtcaaggaacttgaagtgttacaggcaaaatgcaacgagcagacaaaggtgattgataacttcaccagccagttaaaggccaccgaagagaagctgcttgatctggatgcactgaggaaggcctcctcggaaggtaagagtgaaatgaagaagctgaggcaacagctggaggcggctgaaaaacagatcaagcatctcgagatcgagaagaatgcagaatcttcaaaggcctccagcatcactcgggaactacaggggagagagttgaagctgacaaatctccaggaaaatctcagtgaggtgagtcaagtcaaggagacgctggagaaagagctacagatactgaaggagaagtttgctgaagcatctgaggaggctgtctcagtgcagagatcgatgcaggagacagttaacaagctgcaccagaaggaggaacagttcaacatgctgtctagcgatttggaaaaattacgagagaacttggccgatatggaagcgaagttccgggaaaaggacgaaagagaagagcagctgatcaaggccaaggagaagttggaaaatgacatcgcagagattatgaagatgtcgggggataactccagtcagttgaccaagatgaatgatgagctgcgcctcaaggaaagagatgtggaggaactgcaactgaaactgacgaaagccaatgaaaacgcatcatttctacaaaaaagcatcgaggatatgactgtgaaggctgaacagtcacaacaagaggctgctaagaagcacgaagaagagaaaaaagagctcgagcgaaaactcagcgatctggagaagaagatggagacttcgcataatcagtgtcaggaactgaaggctagatacgagagagcaacaagcgaaactaaaacaaagcacgaagagattctccagaacttgcaaaagactcttctggatactgaagataagctgaaaggcgcaagggaggaaaacagtggtcttctccaagagctggaagagcttcggaagcaggcagataaagccaaagccgcgcagaccgcagaggacgccatgcagattatggagcagatgaccaaagaaaaaacggagacactggctagcctcgaagacaccaaacagacgaatgcaaagctgcagaacgagctagatactctcaaggaaaacaacttaaaaaacgtggaggagctgaataagagtaaggaattgctgaccgttgagaaccagaagatggaggagtttagaaaggaaatcgaaactttgaagcaggctgccgctcagaaatcacagcaactatcagccctacaagaagagaacgtaaagttggccgaagagctaggtcgcagcagggatgaggtgacatctcatcaaaagctagaagaggagcgctccgtgctgaacaaccagctcctggagatgaagaagcgcgaatcaaagttcatcaaagatgccgatgaggagaaggcgtctctgcaaaagtcgattagcattacctccgcattgctgacggaaaaggatgcggaactggaaaagttgcggaacgaggttaccgtgctgagaggcgagaacgcaagcgctaagtcgcttcacagcgtggttcagactctggaatcagacaaagtgaaacttgagctcaaggtaaaaaatctagaactccagctcaaggagaacaagaggcaactctccagttcaagtggcaataccgacacgcaagccgacgaagatgaaagagcccaagaatcccagatcgattttctcaatagcgtcattgtggacctccaaaggaagaaccaggatctcaagatgaaagtcgaaatgatgtctgaagctgccctgaatggaaacggggacgacctcaataactacgacagtgatgatcaggagaaacagtctaaaaaaaagcctagattgttttgcgatatttgcgattgctttgacctccacgatacagaggactgtccgactcaagctcaaatgtccgaggaccctcctcactcaactcaccacgggtcgcggggcgaggaacgcccatactgtgagatatgtgaaatgttcggccactgggcaactaactgcaacgacgacgaaacattctag

SEQ ID NO: 17773 - DNA, 492 bp, Artificial Sequence
  Description of Artificial Sequence: Synthetic coding sequence
atgttccgaaagatcggcatcgaggccctcaaacaggtgactaaacgatacgcaagaaaacagaacaggtgggtcaagaatcgttttctcagtcggcccggcccaatcgtacctccagtctatggcctggaagtctccgacgtgtcaaagtgggaggagagcgtgttggaaccagctcttgagattgtgcagtcttttatacaaggacacaagccaacagccactcctatcaagatgccttacaatgaagccgagaacaagaggtcttaccatttgtgcgatttgtgtgaccgaatcatcatcggtgaccgcgaatgggccgcacacatcaagtcgaaaagtcatctcaaccaactaaagaagcgccggcggctagattccgacgctgttaatactattgaaagccagtcagtctcccctgaccataataaggaacctaaggagaagggctcgcccggacagaatgaccaagaactgaaatgcagcgtctag

SEQ ID NO: 17774 - DNA, 1602 bp, Artificial Sequence
  Description of Artificial Sequence: Synthetic coding sequence
atggcatcacctggcaaggacaattatagaatgaaatcatacaagaacaatgcactcaatcctgaggaaatgcgcagacgcagagaggaagaggggatccagctgcgaaagcagaagcgtgagcaacagctattcaaaaggagaaatgttgaactcatcaacgaggaggctgccatgtttgattcactgcttatggatagctacgtgtcttccacaaccggcgaatcagtgataaccagagagatggtcgaaatgttgttctcagatgactccgaccttcaattagcaaccacccagaagtttcggaaattactgagcaaggagccatcacctccaatcgacgaggtcatcaacactcctagggtagtggaccgcttcgtagagtttctcaagaggaatgagaattgcaccttacaatttgaggctgcctgggcgttaaccaatattgctagcggaacatctcagcagactaagattgtaatcgaggctggggccgttcccatcttcatcgagttattaaacagcgattttgaagacgtacaggagcaagccgtttgggccctaggcaatattgcaggcgactccagtgtgtgccgggactatgtgcttaactgtagcatcctcaatcctttgctgacccttcttaccaaatccacacgactgaccatgacaaggaacgccgtgtgggccctgtccaatctgtgccgagggaaaaatcctccccccgagttcgccaaggtgagcccctgtctgcccgtcctgagccggctattgttttcttccgatagcgatcttctcgctgatgcctgctgggctcttagttacttgagcgacggacctaatgaaaaaattcaggctgtgatagactcaggagtgtgccgacgcttggtcgagctcctgatgcataatgattacaaagtggcctctcctgctctgcgagccgtgggcaacatagtcactggggacgatatccagacgcaggtaatcctgaactgctcggcactgccatgcctgctgcatctcctgtcaagccctaaagaaagtattagaaaggaggcctgctggactattagcaacattacagccgggaaccgggcccaaattcaggccgtcatcgacgctaacatcttcccagtgttgatagagatcctgcagaaggcagaatttcgcacccgaaaagaggccgcatgggccattacgaacgcaacgagcggcgggacccccgaacagatccgatacctggtgtccttaggttgtatcaagcctctgtgtgatctgctgactgtcatggattccaagatagtccaggttgcattaaatggactcgagaatattcttcggctcggagaacaggagggcaagcgttccggaagcggcgtcaacccatattgcggacttattgaagaggcttatggcctcgataagatcgagttccttcagtcccatgaaaatcaggagatataccagaaagcgtttgatttgatcgaacattactttggcgtggaagacgacgactcaagtctggcaccccaagtggatgagacccagcaacagtttatatttcaacagcccgaagcgccaatggaaggctttcagctgtag

SEQ ID NO: 17775 - DNA, 993 bp, Artificial Sequence
  Description of Artificial Sequence: Synthetic coding sequence
atggaacggttcatggaacaggtggtgtttaaatacttacgcgcagagcccgaagaccactattttctgatgactgaaccccctcttaacacacctgagaatagagagtatctggctgagataatgttcgagagcttcaatgtgcccgggctgtacatagccgtccaggctgtcctcgctttggctgcatcatggacatccagacaagtgggggagcggacactcacaggaatcgtgatcgattctggtgacggcgtgacacacgtgattcccgtggccgagggctatgtgataggctcttgcatcaagcacatacccatcgctgggcgggacataacttacttcattcagcagctgctgcgggagagagaggtcggaatcccacccgaacaatctcttgaaactgcgaaggctatcaaggagaagtactgttatatttgtcccgacatcgtgaaagagtttgctaagtacgacgtggaccctcgcaaatggattaaacagtacaccggtatcaacgctataaatcagaaaaaatttgtgattgacgtggggtacgagagattcctcggcccagaaattttctttcatccagagttcgcaaatccagacttcatggaatccatttccgacgtggtcgatgaggttatccagaactgtcctatcgacgtgcgtagacccctttacaagaacgtggttctcagtggcggcagtaccatgttccgtgactttgggcgccgacttcaaagggacctgaagagagtggtggatgccaggctccgcctgtctgaagaactcagcggcggccggatcaagccaaagccagtggaagtacaggtagtgactcatcacatgcagaggtacgccgtttggttcggcgggtcaatgttggcatccactcctgagttctttcaagtgtgtcacacaaagaaagactatgaggaatatggtccctcaatatgtagacataaccctgtttttggcgttatgtcatag

SEQ ID NO: 17776 - DNA, 576 bp, Artificial Sequence
  Description of Artificial Sequence: Synthetic coding sequence
atgtccagagagcgcggatcaagaagcgaggagcccggtgccgggaatagagagtctggctcacgcgaaccggggctcgccgccgcagctatgagcaccgttgacctggctagagtcggggcatgtattctgaaacatgctgtgactggagaggccgtggagttaagaagcctgtggcgggaacatgcctgcgtggtggccggtctgagaaggttcggatgcgtggtttgccgctggattgcccaggatctgtcgagcctggctggcctgctggaccagcacggtgttaggcttgtgggcgttggcccagaagctctgggactccaggagtttctggacggagactactttgctggggagctgtacctcgacgagtcaaaacagctctataaagaacttggattcaagcgttacaatagcctcagtattctacctgccgcactgggcaagcctgtcagggacgtggctgccaagtcaccgggtgattacgtgcccaaagagcatatcctgcaggtgcttggaatctcagccgaggtatgcgcatcagacccgccccagtgtgacagggaagtgtag

SEQ ID NO: 17777 - DNA, 1050 bp, Artificial Sequence
  Description of Artificial Sequence: Synthetic coding sequence
aatacaatacacgatgtgctcgacgtggaagcagcggttgttaaccttgataacagtgtggtagatctggaaaccctacaggctctgtacgaaaacagggctcagtcggatgagctggagaaaatcgagaagcacggtcggagtagcaaggacaaggagaacgccaaatccctggataaacctgagcaatttttgtatgaacttagtctaatccccaatttttcggagcgcgtcttctgtatacttttccagtcaactttttcagagtctatttgctcgattcgtcggaagctcgagcttctccaaaaactctgcgagacactcaagaacggacctggagtaatgcaggtgctggggctggtgctcgcatttggcaactacatgaatggggggaacaaaacaaggggccaggctgatggcttcgggttggacattctgcctaagctaaaggacgttaagagcagcgataattcacgcagtctcctgtcttatatcgtgtcatattatttgaggaatttcgatgaggacgcaggtaaagaacagtgtctgttccctctccccgaacctcaggacctctttcaagcctcacaaatgaaatttgaagacttccagaaggacctccgaaaactcaaaaaggacctcaaggcctgcgaggttgaggccgggaaggtctatcaggtgagctcaaaggaacacatgcagccctttaaggaaaacatggagcagtttattatccaggcaaaaatcgatcaggaagccgaggagaattcgctcactgaaacccataagtgtttcctggagactacagcttacttctttatgaagcccaagttaggagaaaaagaagtaagtcccaatgctttcttttccatctggcatgaattcagctctgacttcaaagacttctggaaaaaggagaacaaactgctgttgcaggagcgggtaaaggaagccgaggaggtgtgtaggcagaaaaaaggcaagtctctctacaagatcaaacccaggcatgacagtggcattaagaacaataactccatgcatacatag

SEQ ID NO: 17778 - DNA, 570 bp, Artificial Sequence
  Description of Artificial Sequence: Synthetic coding sequence
atgactgcatccgctagttctttttcaagtagccagggggtgcagcaaccaagtatctactccttttcccaaatcaccagaagcctttttctgtccaacggtgttgctgccaatgacaagctccttttgtcctctaacaggattaccgccatcgttaatgcctccgtggaaggtcagaggattctcagggggatacagtacatcaaggtaccagttaccgacgcaagagattctcggctgtatgacttctttgacccaattgcggatctcatccacacaattgatatgagacaaggtcgcacattactacactgcatggccggagtttcccgctccgctagcctgtgtctcgcttaccttatgaagtaccactccatgtcactgctggacgcccatacatggaccaaaagcagaagacccatcatccgccctaacaacggattttgggagcagctgattaactacgaattcaagctgtttaacaacaacactgtgagaatgataaattcacctgtgggtaatatccccgacatttacgaaaaggatctgagaatgatgatcagcatgtag

SEQ ID NO: 17779 - DNA, 549 bp, Artificial Sequence
  Description of Artificial Sequence: Synthetic coding sequence
atgtcgggacgatccgttccacatgcccaccccgccaccgcggagtatgagttcgcaaacccgtcccggctgggagagcagcggttcggtgaagggctcctacctgaagaaattctgactccgaccctgtaccatggctattacgttagacccagggcagctcccgcgggagagggatcgcgggcaggggcctccgagctacggctgagcgagggcaaatttcaagcctttttggacgtgagccacttcacacccgatgaggtgacagtgcgaacagtagataatcttctggaagtgtccgctagacatccacagagacttgaccggcacggattcgtctcacgcgagttctgccgaacttacgttcttccagccgacgtcgatccttggcgcgtgagggctgctctctcacacgatggaatcctcaacctcgaagctccccgtggtggacggcacctggataccgaggtcaacgaggtatacatctctctgctgcccgcccctcccgatccggaggaagaagaggaggccgccatcgttgaaccttag

SEQ ID NO: 17780 - DNA, 387 bp, Artificial Sequence
  Description of Artificial Sequence: Synthetic coding sequence
atggtgttccggaggttcgtggaggtggggcgtgtggcctacgtctctttcggccctcatgcagggaagctggtggccatagtggatgtgatcgaccaaaatcgcgctctggttgacgggccttgtacacaagtccgccgccaggcaatgccatttaagtgtatgcagctgactgactttatcctcaaattcccgcattcagcccaccagaaatacgtgcggcaggcctggcagaaggccgatattaacaccaaatgggctgcaactagatgggccaagaagatagaggcaagggaacggaaggctaaaatgaccgacttcgatcggtttaaggtcatgaaagcaaagaagatgcgaaaccggattatcaagaatgacacccgatag

SEQ ID NO: 17781 - DNA, 492 bp, Artificial Sequence
  Description of Artificial Sequence: Synthetic coding sequence
atgttccgcaaaatcggaatcgaggcactgaaacaagttaccaaaagatatgcccgcaagcaaaatagatgggtcaagaaccgattcctttctcgaccaggtccgattgtgccacctgtgtacggcctcgaggtttctgacgtgagcaaatgggaagaatctgtgttggagccagcactggagattgttcagtcgttcatacaggggcacaaacctacagcgacgccgatcaagatgccatacaacgaggctgaaaacaagcgttcctatcatctctgtgatctctgtgacaggatcatcatcggggatcgcgaatgggctgctcatatcaaatcaaagagccatcttaatcagttgaagaagagaaggaggttagattcagacgccgttaatacaattgaaagtcagtctgtttccccagaccacaacaaagaacctaaggagaagggctctcccggccaaaatgaccaagagcttaagtgctcagtgtag

SEQ ID NO: 17782 - DNA, 1224 bp, Artificial Sequence
  Description of Artificial Sequence: Synthetic coding sequence
atggcagctgagctgtacgccccagccagcgccgccgcggcagacctcgcgaactccaacgccggggccgcagtcggtagaaaggccgggccgagatcccctccatcagcccccgcaccagcacctccaccgccggcccctgcgccacctacgctcggcaacaatcatcaggaatcccctggatggaggtgctgccggcccacactgcgggaacggaacgcgctgatgttcaacaacgagctgatggcagacgtgcatttcgtggtgggcccccctggagctacacggacggttcctgctcacaagtacgtgctggccgtcggtagttccgtgttttacgcaatgttctacggcgatctggccgaagtcaagagcgaaatccacatcccagatgtggagcccgcagccttcctcattctgctaaaatacatgtatagtgatgagattgatctcgaggctgacaccgtgctggctacgctgtatgctgcgaagaagtatatcgtgcctgctctggcaaaggcctgcgtgaatttcctggaaactagcctcgaggctaagaatgcgtgcgtgctgcttagccagtccaggcttttcgaggagccagagctgacacagagatgctgggaagtcatcgacgcacaggcagagatggccctgagatccgaaggtttctgcgaaatagacaggcaaacgctggaaattattgtgactcgagaggcccttaatacaaaggaagcagtagtgtttgaagctgtgctcaattgggccgaggcggaatgcaaacgccaaggccttccaattacccctaggaataagcggcacgtcctcggccgggctctataccttgtgcgcatccccaccatgacacttgaggagtttgctaatggggcagcccagtctgatatcctgaccctcgaggagactcacagcatatttttgtggtacactgcaaccaataagcccagactggatttccccctgactaagcggaagggactggccccccagaggtgccaccgctttcagagctctgcctaccgtagcaatcagtggcggtatagaggccgatgcgattctatccagtttgcagttgacagacgagttttcatcgctggcttaggcctttacggttcctcctccggcaaagccgagtacagcgtgaagatcgaattaaagcgcctgggcgtagtgctggcccagaacctgaccaaattcatgagctag

SEQ ID NO: 17783 - DNA, 603 bp, Artificial Sequence
  Description of Artificial Sequence: Synthetic coding sequence
atgctggaactggtggctcaaaagcaacgggaaagagaggaacgagaggagagagaggcattagagagagagcgccagcggagaagacagggacaggagctgagtgccgcgcgacagcgactgcaggaggacgagatgagacgcgcggcggaagagcggcgacgtgagaaggccgaagagctggctgcaagacagagggtacgggagaagatagagcgggacaaggctgaaagggcaaaaaagtacggcgggtccgtcggctcccagcctccccctgtcgccccagaaccgggacctgtgccaagctctccctcacaggagccacctactaaaagagagtacgaccagtgcagaatccaggttaggctacccgacgggacatccctcacccaaaccttcagggcaagagaacagctggccgcggtgcgcttgtacgtcgaattgcaccgaggggaggaactggggggaggacaggatcctgtgcagcttctgagtgggttcccgagacgggcgttctcagaggcggacatggagagacctctgcaggagcttggcctcgtgccaagtgcagtactgattgtagccaagaagtgtccaagctag

SEQ ID NO: 17784 - DNA, 885 bp, Artificial Sequence
  Description of Artificial Sequence: Synthetic coding sequence
atgggacttgcaagctggtcccaactggcttccactccacgcgccccagggagcagagacgctagatgggaacggcgcgagcccgcactgcgtggggcgaaagaccgactcacaattggcaagcacctggacatgggatcccctcagctcagaacccgggacaggggctggccatcacctaggccggagcgcgagaaacgaacgtctcagagcgccaggaggcctacttgtacggagtcccgttggaagtctgaagaagaggtcgagagtgatgatgagtacctcgctctgcccgcccggctcacccaagtcagtagtctcgtgtcctacctgggatccatttccactctggtgacgctgcccacaggcgacattaaggggcaaagccctctggaagtatccgattcggacgggcctgcaagcttcccaagcagcagttcgcagagccagctaccccccggcgccgcattgcaagggtccggagacccagagggccagaacccatgttttctgaggagcttcgtgcgggcccacgatagcgcaggcgaagggagccttggctccagtcaggcgctcggcgttagttctgggctgctcaagaccagacccagcttgcctgcccgcctggaccgatggccattttcagatccggacgtagaggggcagctgcctcggaaaggaggtgaacagggaaaggagtcactggtgcagtgtgttaaagtcatgactttaaacgtgaggaagctttgtgtgcaggtgtcctgcctgttccctcagagcaccaacattatcattaaacatgtgcatgtggatcaagctctgtttatgtgccaggccctctgttgcactctctcgtacagtgttctcaccactttcactagatag

SEQ ID NO: 17785 - DNA, 354 bp, Artificial Sequence
  Description of Artificial Sequence: Synthetic coding sequence
atggttagaaaaattaccctagtatccgccgctcccgggaaagtgatatgcgaaatgaaagtcgaagaggaacacactaatgcaattggcactttgcacggcggtctcacagccactttagtagacaacatatcaacaatggctctcttgtgtaccgagagaggcgctcctggcgtctcggttgacatgaacattacctatatgagccctgcaaagctgggcgaagacatcgtgataacagcccacgttttgaagcagggaaaaacattggcgttcacaagcgtggatctgaccaataaggccacaggcaaactcattgctcagggaaggcacaccaagcatctgggcaattag

SEQ ID NO: 17786 - DNA, 840 bp, Artificial Sequence
  Description of Artificial Sequence: Synthetic coding sequence
atgacaagcggcaaaatcaagaagtttattcaagagaatatcttcggaatttgtccgcatatgacagaggataacaaggatctcatccagggaaaggatctgctgattgcttattatgacgttgactacgaaaagaatgccaagggctctaactattggcgaaatcgagtgatgatggtggcaaagaagtttttggacgctggacacaagttaaacttcgccgtcgcgagccgtaaaactttctcccatgagctgtccgattttggtcttgagtcaactgctggggaaatccccgtcgtggccatccggacggccaagggggagaagtttgtgatgcaggaagagtttagcagagatggcaaagcccttgagagattcctacaagactactttgacggcaacctgaaacgctacctgaagtctgagcccattcccgagtctaatgatggtccggtgaaagtcgtcgtggccgaaaatttcgacgaaattgtaaataacgaaaataaagacgtcctcattgagttctacgccccatggtgtggacactgcaaaaaccttgaacccaaatacaaggagctgggtgaaaagttgtcgaaagaccctaatatagtcatcgccaaaatggacgctaccgcgaatgacgtgcccagtccctacgaagtgcgaggatttcccaccatttatttctccccagccaacaagaaattgaaccccaagaagtatgaggggggccgagagctgagcgacttcatcagctatctgcagcgggaagcgacaaatcctccagtgattcaggaggagaagcctaaaaagaagaaaaaagcacaggaagatctttag

SEQ ID NO: 17787 - DNA, 3228 bp, Artificial Sequence
  Description of Artificial Sequence: Synthetic coding sequence
atgagccaggggttccacccagaacgcgatcccagcgacttgaaaaaagtgaaagcagtagaagaaaacggcgaggaagcagagcctgtccgcaatggcgccgaaagcgttagtgaaggggaggggattgatgctaattcaggcagcacagactcctctggggatggtgtgaccttcccatttaaacccgagtcttggaagcctaccgacaccgaggggaagaagcagtatgatagggaattcctgcttgatttccagtttatgccggcttgtattcagaagcccgagggtttgcctccaataagcgacgtcgtgctagataaaataaatcaaccaaagctgccaatgcgcaccctggacccccgcatcttgccccgtggtccagacttcacccccgcgttcgcggatttcggcaggcagacaccaggaggcaggggcgtgccaatctgtaaggtgcagagccgccatgggctcccgatattagagcagtctaaagcccccacatgccctcccctagtgatgtctcatccgcccatgaaatcactgccgctaggcctgcttaatgtgggaagccgcaggtcccagccaggccaaaggcgcgagcccagaaagatcattaccgtctctgtgaaagaagatgttcacctcaagaaagctgagaatgcctggaaacccagtcagaagcgagattcccaagcagatgaccccgagaacatcaagacccaggagctattccgaaaggttcggagcatccttaacaaattaacaccccagatgttcaaccagctgatgaagcaggtgtcaggcctgacagttgatacagaagagaggctgaagggggtgattgatctcgtgttcgaaaaggccatcgatgagccttctttctctgttgcctatgccaatatgtgccgctgcctggtgaccttgaaggttccgatggccgataaacccggtaatacagtcaacttcaggaagctgcttcttaatcggtgccagaaggagtttgagaaggataaggccgacgacgacgtgttcgaaaagaaacagaaggaattggaagccgcttcagcccccgaagaacgtactaggctgcacgatgagttggaagaggccaaagataaggccagacgccgatctatcgggaatataaagtttattggggagcttttcaaactgaagatgttaactgaggctatcatgcacgactgtgtcgtgaagctgctgaagaaccatgatgaagagtctctggagtgcctctgccgcctcttgacgacaatcggcaaggacctggactttgaaaaggctaagccccgtatggaccaatatttcaatcaaatggagaagatagtgaaggaacgaaagacgtcttcgcggatccgattcatgctccaggatgtaattgatctcaggctctgtaattgggtctccaggcgagcagatcagggccctaagactatcgagcagattcataaggaagccaaaatcgaggaacaggaagaacaacgaaaagtgcagcagctgatgactaaggagaaacgacgcccgggcgtgcagagggtggacgaggggggctggaacaccgtgcagggagctaaaaacagcagagtgctggacccaagtaagttcctcaaaatcacgaaaccaaccatcgacgagaagattcagctcgtgcccaaagcacaacttgggagttggggcaagggatcttccggcggtgctaaggcatcagagacggacgcgcttagatcatcggcatcgtcactgaatcggtttagcgctctgcagccccccgctccaagcggaagcaccccctcaactcctgttgaattcgactcacgcagaaccttaacttctagaggatcaatgggccgggaaaagaacgacaagccgctgccaagcgcgactgctcgcccaaacacatttatgagggggggctcctccaaagacctgctggacaaccagtcccaggaggaacaaagacgcgagatgttggagactgttaagcaattgacagggggcgtggatgtcgaaagaaatagcactgaagcagagcgcaacaagacccgggagagtgccaagcccgagatatccgcgatgtcagctcacgacaaagccgccctgtccgaggaggaactggagaggaagtcaaaaagtatcattgatgagttcctgcatatcaatgattttaaagaagcaatgcagtgtgtggaagaattgaacgcccaggggctcttacacgttttcgttcgcgtgggagttgagtctaccctcgaaagaagtcagataaccagggaccacatgggccagttgttgtaccaattagtgcaaagtgagaaactctcaaaacaagacttcttcaagggattttccgagactctggaattggcagatgatatggccatcgacattccacacatatggttgtatctggccgaattagtgactcccatgcttaaagagggcggcatttccatgagggagcttaccattgagttttcaaaaccactgctgccagtgggcagggccggcgtgctgctgagcgagatccttcacctcctttgtaaacagatgtcacacaagaaggtgggggccctgtggagggaggccgacctgagttggaaagacttcctgccagagggcgaagacgtgcacaacttccttcttgagcagaagctagacttcatagagagcgactcaccttgttcatctgaagctctgtctaaaaaagaattgtccgctgaagaactgtacaaaaggcttgagaagttgattatcgaggataaggccaatgacgaacagatctttgattgggtggaagcgaacctcgatgaaattcagatgagctcccctaccttcttgcgtgccttgatgacagccgtctgtaaagccgcgatcattgccgactcaagtaccttccgcgttgacaccgctgtgattaaacagcgcgttcctatcctgctcaagtatcttgacagtgacactgaaaaggagcttcaagctttgtacgcactacaggccagtattgtgaagctggatcagcccgctaatctgctgaggatgtttttcgactgtttatatgacgaagaagtcatatcagaagatgccttctataagtgggaaagctccaaggaccccgccgaacagaacggcaagggggtcgctctgaagagtgtgacggcgtttttcacttggcttcgggaggcggaggaagagagcgaggacaactag

SEQ ID NO: 17788 - DNA, 474 bp, Artificial Sequence
  Description of Artificial Sequence: Synthetic coding sequence
atgaaatgcatcccatacagtgtcctgctcaaggatctcgaaatgcgcaacctcagagaactggaagacctcatcatcgaggccgtttacaccgacatcatccaggggaaactggaccagagaaatcaactgctggaagtagatttctgcatcggaagagatataagaaagaaagacattaataatatagtgaaaactttgcacgagtggtgcgacggatgtgaggccgttctcctgggtatcgaacagcaagtcctacgcgccaaccagtacaaagagaaccataatcgcacgcagcaacaggtcgaggctgaagttaccaatatcaaaaaaacacttaaagctactgcaagctcatctgcccaagaaatggagcagcaattagctgagcgtgagtgcccgccccacgccgaacagcgccagcctactaagaaaatgagcaaggtgaagggtctagtatcaagtcgacactag

SEQ ID NO: 17789 - DNA, 837 bp, Artificial Sequence
  Description of Artificial Sequence: Synthetic coding sequence
atggattgtagagaaatggacctttacgaagattaccagtcaccattcgacttcgatgccggcgtcaataagagctacctctatctctcgccttctggcaactctagcccgccagggagtccaacactccaaaaatttggtctactccgaactgaccctgtccctgaagaaggggaagatgtggcggcaactatctctgcgactgagactttgtccgaagaagaacaggaagagctcagaagagagctggccaaggtggaggaggaaatccagaccctgtctcaggttctggctgcaaaggagaagcacctcgcggagattaagcgcaagctcggcataaactctctgcaggaattgaaacaaaatatcgccaaaggatggcaggacgtcaccgcaacttccgcctataaaaagacgtcagagaccctttcccaggccggtcaaaaggccagcgcggctttcagctcagttggaagtgtgatcaccaaaaagctggaagatgtgaagaactccccaacatttaaaagttttgaggagaaagttgagaacttgaaggggagcccaaaaaatgttgagtcttttgcctccatgctcagacattctccactcacacaaatgggtcctgctaaggacaagttggtcatcgggcgcattttccacatagtggagaacgacctgtatatagactttggtggcaagttccattgcgtgtgcaggcggcctgaggtagatggcgagtcccccatttcttggtatgccgtgtggcgtagattctcacaggtgatgattacctgtttttcctctaactctgattttgggaagcatcggaaacggtag

SEQ ID NO: 17790 - DNA, 3123 bp, Artificial Sequence
  Description of Artificial Sequence: Synthetic coding sequence
atggttagcagtgcacagatgggctttaacctgcaagctttgctggaacagctgtcccaagacgaattgtccaaattcaagtacctgataacaactttttcgctggctcatgaactgcagaagatcccacacaaagaggtggataaagccgacggtaagcagttggtcgaaatattaactacacattgtgatagctattgggtagagatggcctccttacaagtgttcgaaaagatgcaccgaatggatttaagtgagcgcgctaaggacgaagtgagggaggccgctctgaagtcctttaacaaaagaaaacctcttagcttgggcatcacacggaaagaacgcccccctcttgacgtggacgaaatgttagagaggtttaagacagaggcacaagacaaagataatagatgtagatacatactgaagaccaagtttcgagagatgtggaaatcatggcctggggactccaaagaagtgcaggtcatggcagagagatacaagatgctgattccctttagtaacccacgggttctccctggaccctttagctatacagtggtcctgtacggtcctgctggcctgggtaagacgactttagcacagaagctcatgctggactgggcggaagacaaccttatccataagttcaagtatgcattttacctaagctgtagagagctatcccggctaggcccctgttctttcgccgaactggtcttcagggactggcccgagcttcaagatgatatacctcatatcctggcccaggcccgcaagatcctgtttgtgatcgacgggttcgacgaactcggggcagcaccaggcgcgctgatagaggacatatgtggggattgggagaagaagaagccagtaccagtgttgctgggttcactattgaatagggtgatgctgcctaaagctgcccttttggtgacaactcggccacgagctctgagagacttgcgtatccttgcagaggaacccatttatatccgcgtggagggcttcctcgaagaggaccgaagggcttacttcctgaggcactttggcgacgaagatcaagcgatgagggcgttcgagctgatgcgctctaacgcagccctgttccagctgggttcagcccccgccgtgtgttggattgtctgcacaacactgaaactgcagatggaaaaaggggaagaccccgtacccacatgtctgactcgtactggtctgtttctgcgcttcctgtgttcgagatttcctcagggcgctcagctgcgcggcgccctccgaactctgtctttactcgcagctcaggggctgtgggcccagaccagtgttctgcatagagaagatcttgaaaggctgggtgtccaagaatcagatttacggcttttcttggatggagacattctgcggcaggacagggtgagtaagggttgttactccttcatccatctcagtttccagcaatttcttacagcattgttctacacactcgaaaaggaggaagaagaagatcgcgatggacatacctgggacattggtgacgttcagaagctgctgtctggcgtcgagcggttgagaaatcccgacctaatccaggcaggctactactcctttggccttgccaatgagaagagagcgaaggagcttgaggccacgttcggctgtagaatgagtcccgacatcaaacaagagttgctgaggtgcgatatttcgtgcaaggggggccatagtaccgtgaccgacctgcaggaattgttaggatgtctttacgaaagtcaggaagaggaactagtcaaggaagtgatggcacagttcaaagagatctccctgcacctgaacgccgtagatgtggtgccatcttccttttgtgttaagcactgtcgaaacctgcagaagatgtccctgcaggtgataaaggaaaatttgccggaaaacgtgacagcatctgagtcagacgctgaagtagaaagaagccaggatgatcagcatatgctgccgttttggacagacctttgtagtatttttggttctaacaaagaccttatgggtctggcaatcaacgactcctttctgtccgcttccctagtgaggatcctgtgcgagcagatcgcttcagatacttgccaccttcaacgcgtcgtgtttaaaaacatcagcccagccgatgcccataggaacctctgcctggccttacgtggtcataaaactgtcacatacctcactctccagggcaatgaccaagatgacatgtttcctgccttatgcgaggtgctcaggcatcctgaatgcaatttgaggtacttgggccttgtgtcttgttccgccactacccagcagtgggcagatctgagtttggcactcgaagtcaatcagtcccttacctgcgtgaacctgagcgacaacgagctcctggacgagggagccaagctgctgtatacaactctgcgccacccaaaatgctttctgcagagacttagtttggaaaactgccacctgacggaagccaattgcaaagatctggctgcagtcctggtggtgtcccgagaactaacacatctgtgtttggctaaaaaccccatcggcaatactggggtgaaattcttgtgcgaggggcttagatatcctgagtgcaagctgcaaaccttagtcctttggaattgcgacatcacttccgatggatgctgcgatcttacgaaattgctgcaggagaagagctctctgctgtgcctcgacctgggcctcaatcacataggggtgaaagggatgaaattcctgtgcgaggctctcaggaagccactttgtaacctgcgttgtctgtggctgtggggctgttcaatccctccattctcctgcgaagatctttgctctgccttgtcttgtaaccagtcactggtgacgttggatctgggccaaaatccccttggctcctcgggcgttaagatgctgttcgaaacactgacgtgctcctctggaacattgaggactttgcgattgaaaattgatgatttcaatgacgagctcaataagctgctcgaggaaatagaggaaaagaaccctcagctgatcattgacacagaaaagcatcatccgtgggccgagcgcccgtcgtcacacgattttatgatttag

SEQ ID NO: 17791 - DNA, 1809 bp, Artificial Sequence
  Description of Artificial Sequence: Synthetic coding sequence
atgtccgacaaatccgacttgaaggccgaattggaaaggaaaaaacagagactggcccaaattcgtgaggagaaaaagcggaaagaagaggagagaaagaaaaaagaggctgatatgcagcaaaaaaaagagccggtgcaggacgattcggatctggacaggaagcgacgtgaaactgaagccctgcttcaaagcatcggcatcagtccagaacctcccctcgttcctactcccatgtccccctctagtaaatccgtttcaacccccagcgaagcgggtagccaggactctggcgatttgggcccgcttacaaggagaagattacacaagctcggcgtttccaaagtcacccaggtcgacttcctgccgcgagaagtggtttcctactccaaggagacacagactcctttggcaactcaccaatcagaggaagatgaagaagacgaagagatggttgaatccaaggtgggccaagatagtgagctggagaatcaagataagaaacaggaggtaaaagaggccccgcctcgcgagctcacagaagaggagaagcagcagatcctacactccgaagagttcttgatcttctttgacagaaccattcgagtcatcgagagggctctggcagaggactctgacatcttcttcgattacagcgggagagagcttgaggagaaggacggagacgtacaggcgggtgctaaccttagcttcaacaggcagttctacgacgagcactggtccaagcatagggttgtaacctgtatggactggagcttacagtacccggagttgatggtggcgagctacaataataatgaggacgccccccatgagcccgatggagtcgcactcgtatggaacatgaagtttaagaaaaccacgcccgagtacgtgttccactgccaaagtagcgttatgtccgtttgctttgctcgcttccaccccaacctggtcgtgggtggaacctactctggccagattgtgctctgggacaaccgctctcataggcgcactccagtgcagcgcactcctctcagcgccgctgctcacactcacccagtctactgcgtgaatgtcgtggggacacagaacgcccacaacctgatcaccgtgagcaccgatggaaagatgtgtagctggtcactagacatgctgtcaaccccccaggagtccatggaactggtctataataagtcaaaacctgtggctgtgactggcatggccttccccaccggggatgtcaacaactttgttgttggctctgaggaggggacagtgtacactgcttgccggcatgggtccaaggccgggattggtgaagtctttgagggacatcagggacctgtaacaggcatcaactgtcatatggcggtcggaccaatcgatttttcccacctgtttgtgacttcctcattcgactggactgttaagctgtggaccacaaagcacaacaaaccgctttatagttttgaggacaacgccgactacgtgtatgatgttatgtggagcccagtgcacccagcccttttcgcatgtgtcgacggtatgggcagactggacctgtggaacttgaacaacgacacggaggtgccaactgcctcggtggccatagagggagcctccgctctaaacagggtgcgttgggctcaggcgggcaaggaagtggccgttggcgacagtgaagggcgcatttgggtgtatgacgtaggtgagggtctggccatgcttccagggtggtcacagaatagttggacccaggcaattctgttgtgttggccccctaaggtgctcggcttacagacctag

SEQ ID NO: 17792 - DNA, 2847 bp, Artificial Sequence
  Description of Artificial Sequence: Synthetic coding sequence
atgtacggctccgccaggtcggtggggaaggttgagccttcgtcccagagccccggtaggtcccctagactccctagaagccctagactcggtcatcgtagaaccaattccaccgggggttcgagtgggagctccgttggcggagggtcaggtaagacactatccatggagaacatacaatcacttaatgcggcctacgctacaagcggcccgatgtacctctccgaccacgaaaatgtgggatccgagactcccaaaagtacaatgactttaggcagatccggcggtcggctgccttatggcgtccgaatgaccgcaatgggctcatctcccaacatagccagttccggcgtggcgtctgatacaatagcattcggagagcaccacctaccaccggtttcaatggcttccacagtcccacattccctgcggcaggcgcgcgacaacacaatcatggatttgcagacacagctgaaggaggtgttaagagaaaacgatttgttacggaaggatgtggaagtgaaagaaagtaagttgtccagctctatgaattcaattaagaccttttggagcccagaattgaagaaggagcgcgcactgagaaaggacgaagcatccaagattacaatctggaaagagcaatatcgagttgtccaggaggagaatcagcacatgcagatgaccattcaagccctccaggacgagctgaggatacagcgcgatctgaaccagctctttcagcaggatagctcctctagaacaggggaaccttgcgtagccgaactgacggaagaaaattttcagagactccacgccgagcacgagcgacaggcaaaggagctctttctacttcggaagacactggaagagatggagttgcgcattgaaactcagaagcagacactgaacgcccgggatgagtctattaagaagttgcttgaaatgctacagtcaaagggactttccgccaaggcaactgaagaagatcacgaaaggactagaagacttgccgaggcagaaatgcatgtgcatcatctcgagtcacttcttgagcagaaggagaaagagaactctatgctgagagaagagatgcaccgccgcttcgagaacgcgcccgactctgccaagacgaaagcactgcagacagttatcgaaatgaaagactcaaagatttctagtatggaaagagggcttagggatctggaagaggaaatacaaatgcttaaaagcaacggtgccctctcgacggaggagcgcgaagaggagatgaagcaaatggaggtgtataggtcccactccaagtttatgaagaataaaattggacaagtgaaacaggaattatctagaaaggatactgaactcctggccctgcagacaaaactagagacactgaccaaccagtttagcgatagcaagcagcatatcgaggtgctcaaggaatccctgacagctaaagagcagagagctgctatcctccagacggaagtggatgccctaagactccggctggaggagaaggagaccatgcttaataaaaagactaagcagatccaggatatggccgaggaaaagggaacacaggctggcgagattcacgacttaaaagacatgctcgacgtgaaggagagaaaagtgaacgttctccagaaaaagatcgaaaacctccaagaacagctccgagacaaggagaaacaaatgagcagcttaaaagaaagagtgaagtctctgcaagcagatacgaccaacaccgacacggcattaactaccctcgaagaggccctggctgaaaaggagaggaccatcgagagactgaaggagcagcgggaccgagatgaacgggagaagcaagaagaaatagacaactacaaaaaggacctgaaggacttgaaggagaaggtgtctctgctccagggggaccttagtgaaaaggaggctagtttgcttgatttgaaggagcacgctagtagtttagcttcctctggcttgaagaaggattctaggctgaagaccctggaaatcgcacttgaacagaaaaaggaggagtgtctgaagatggaaagccagctcaagaaagcccacgaggccgcactagaggcccgcgcatcgcccgaaatgtcggaccggatccaacacctcgagagggagatcaccagatacaaagacgaatcctcaaaggctcaggccgaagttgacagactgctagagatcctgaaggaagtagagaatgagaagaatgacaaggacaaaaaaatcgccgagctggaatcgctattcagccgccaggtgaaagatcagaacaaaaaggtagccaatctcaaacataaggagcaggtggaaaaaaagaagtctgcgcagatgctagaggaagcacgaaggcgtgaagacaatttgaacgactcatcgcagcagctgcaggttgaagaactactgatggccatggagaaggttaagcaggaactggaaagcatgaaggcaaagctgagctccacccagcaatcattggctgagaaggagactcatttaaccaatctgcgcgcagagagaagaaagcacttggaggaagtgttggagatgaagcaggaggcactccttgctgccatatccgagaaagacgccaatattgctcttctggagctgagttcatctaagaaaaaaacccaggaagaggttgctgctttgaagcgagaaaaggaccgcctggtacagcagcttaaacaacaaacacaaaatagaatgaaactcatggcggacaattacgaggacgaccacttcaagagttcacacagcaaccagactaatcacaaaccctccccagaccaggacgaggaggaggggatttgggcatag

SEQ ID NO: 17793 - DNA, 2742 bp, Artificial Sequence
  Description of Artificial Sequence: Synthetic coding sequence
atggaggtgggtagtgaggaagagaaatgggagaaactcgatgcagaattcgatcacttcgtcgtggatatgaaacccttcgtgctgaaactgcctcataggacggagcgacaaagatgtgccctgtggattaggaaactctgtgagccaagtggtactggggccggtataatggggcgaaaaaatagaaacctgtacgctaagctcttgctgcacatgctcaagaggggagcccttgaggggccttttacacacagaccggaaccagggacattaaaaatcttgcctagctacatgagcatctattttgacgaacctaatccggctcgagctaagggatcgtcccccgaaggcttgccggcttgggtcctgggggagctggagacatcagagcacaaactaaacgagtcgtggaagctgtccagcggagaggacaacaccctggttcaatcccccacggacgtatattcacgtgagcagtacactggcaagctgcgggtcaggagccacagcttatccccaactcatcgcgaagatgggcagaacattacccccaagatttgtgaagtctactcgaagaagtcacccgtgagccttgatgattctgatatcgaggctcggctgaattcttggaatctgggcttagacatgaagacgaaaatgatggaggccaagtttcacgaggaaaagttgaagctgcaacagaagcatgatgcggatgtgcaaaagattctcgaaaggaagaacaatgagatagaggaactcaagactctctatcggtctaagcagcacgaaacggaggaaaccatccgaaagttggaaaaaaaggttcagacgctaatacgtgattgtcaggttatccgtgaaactaaagaggaccagattgcagagctgaagaaaatctgcgaacagtctacagagtcgctgaacaatgactgggagaagaaactgcacaatgctgtggcagagatggagcaggaaaaattcgatttacagaagcagcacactgagaatatccaagagttattggaggacacaaatgttcgccttaataaaatggagtcggagtacatggcgcagacacaaagtactaatcacatgattaaagagttagaggcgagagtgcagcaacttacgggggaagctgaaaactctaatctgcaacggcagaagcttattcaagaaaaggcagagctggagcggtgctaccagattacctgtagcgaactccaggaagtgaaagccagacggaatacgctgcacaaggagaaggaccatttagtcaacgactacgaacaaaatatgaagttgctgcagaccaagtatgacgccgacataaatcttctgaaacaggagcatgcactaagtgcttctaaagcttcctcaatgatcgaggagctggaacagaatgtgtgccaactgaagcagcaactccaggaatcagaactgcagcgcaaacagcaactgagggatcaggagaacaaattccaaatggaaaaaagtcaccttaagcacatctacgagaaaaaagcccatgatcttcagtctgagttggacaaaggtaaggaggatacccagaaaaagatccataaatttgaggaggcccttaaagagaaggaagaacagcttactagggtgaccgaagtgcagcggctccaagctcagcaggccgacgccgcacttgaagagttcaagcgccaggtcgagctgaattccgaaaaggtctatgctgagatgaaggaacagatggagaaggtagaggccgacctgacaaggagcaaatctttaagggagaaacagagcaaggaattcttatggcagctggaagacattcggcaacggtacgagcagcagatagtggagctgaagttagagcacgagcaggaaaagacacatttgcttcagcagcacaatgctgagaaagacagccttgttagggaccatgagcgcgagatcgagaaccttgaaaaacagttgagggccgctaatatggagcacgaaaatcagatccaggagtttaagaaacgagacgctcaggtaattgccgatatggaggcccaggtacacaagctgcgcgaggagctgataaatgtcaactcgcagcgtaagcaacaactagtggagctgggcctgcttcgagaagaggagaagcagcgcgcgacgcgggagcatgagatcgtggttaacaaactcaaagccgagagcgaaaagatgaagatcgagctgaagaaaacacacgcagctgaaaccgaaatgacattggagaaggccaactccaagctgaagcagatcgaaaaggaatacacccaaaaactcgccaagagcagccagattatcgccgagctgcagacaaccatctcctcacttaaggaggagaattcgcagcaacagctggccgcggagagacgactacaggatgttaggcagaaatttgaggatgaaaaaaaacagctcatcagagacaacgaccaggccatcaaggtcctgcaggacgagctggaaaatagaagtaaccaggttcgttgtgccgaaaaaaaactgcaacacaaggaactcgagtcccaagaacagattacatacatacggcaggaatatgagactaagctgaagggcctgatgccagcctcactgagacaggagcttgaagacaccatctcaagcctaaaaagtcaggtcaactttctgcaaaaacgcgctagcatcctccaggaggaactgactacgtaccagggacgccgctag

SEQ ID NO: 17794 - DNA, 825 bp, Artificial Sequence
  Description of Artificial Sequence: Synthetic coding sequence
atgcaggatgaaaagctaagagacgaaacggagcagcctgtatcgaaagtgattgagcggaatcgtctccgcactgtattaaagaacttgtccttgttgaagctgctgaaatcgtctaataggaggatacaggagcttcacaagttggccaagaggtgctggcactccttactgtcagtgcccaagattttgaggatcagctccggcgagaatagcgcttgcaataaaaccaagcagaataacgaagagtttcaggagatcggctgctctgaaaaggagttgaaaagcaagaaactggaaagcaccggcgatcccaagaaaaaggagtataaagagtggaagtcacaggtccagagtggcatgcgaaacaaggagaaaacttctcttgctgctatgccaaggaaggaaaagcacatcgagccagaggtgcccagaacgtcaagggatgattcccttaaccccggagttcagggaagacaacccctaactgaaggtccaagagttatctttatcaagccttataggaatcgcactccaatgggccatatgaagcaattggatgttgctgaccaatggatttggtttgaaggtctcccaactaggatacaccttcctgcccctagagtgatgtgtcgctccagcacccttcgctgggttaagaggcgttgcacacggttctgtagtgcctcacttgaaatgccaatgtggcatccctacaaagtggacgttacatggacaagagctcggggtgctagccgcgggtggcggtccagacatcagctgaagggtcgcaacggctggcggaacagccgcgtgtataagtag

SEQ ID NO: 17795 - DNA, 156 bp, Artificial Sequence
  Description of Artificial Sequence: Synthetic coding sequence
atgcagctgcgccacattggggataacattgatcaccgaatggttagggaggatctgcagcaggatggccgggacgccctggatcactttgtgttttttttttttcgtcgggttcaagtactgctacattttttctggaacaaccaccttctgtag

SEQ ID NO: 17796 - DNA, 444 bp, Artificial Sequence
  Description of Artificial Sequence: Synthetic coding sequence
atggctggtggagccagagaagttttaacattgcaactggggcatttcgctggcttcgttggggctcactggtggaatcagcaggacgccgctctaggacgtgcgacagacagcaaagagccccccggcgaactgtgtccagatgtattatataggacagggcgcacactacatggtcaggagacctacactccacggttgatcctcatggatctgaaaggctctctgagctcattaaaggaagagggcgggctctaccgagataagcagctggatgccgccatcgcctggcaaggaaagcttaccacacacaaggaggagctttatccaaagaatccttacctgcaggactttctgagcgcggaggtgagggcctccgttctcaacttcctgactcgctgccacaacttgcgggtgtcgataggagctgggtcggcggaatag

SEQ ID NO: 17797 - DNA, 1677 bp, Artificial Sequence
  Description of Artificial Sequence: Synthetic coding sequence
atgagtgtatctgttcacgagacacggaaaagccgctcctcaaccggaagtatgaatgtgacgctttttcataaagcctcccacccagactgcgtgctcgccgctagcagtcggtactttgaagcgatgttctcccacggactgagagagtcgcgggacgatacagtgaatttccaggataacttacacccagaagtcctggagctgttgctggacttcgcatactcgtccaggattgccattaacgaggagaatgcagaatcgctgctggaggctggagacatgctgcaatttcacgacgtgcgcgatgccgcagccgagttcctggaaaaaaacctctttccttcaaattgtcttgggatgatgctgctgagcgacgcccatcagtgcaggcgtttgtacgaattttcctggagaatgtgcttggtccacttcgagaccgtgcgccagtctgaggactttaactcattgtccaaagacactctgctcgatcttatctcgtccgatgagttagagacagaagacgaacgggtggttttcgaggcgatactgcagtgggtaaagcacgatttggagcccaggaaggtgcatctcccagagctactgcgcagcgttcgactcgccctcctccctagtgactgcttacaggaagctgtctcaagtgaagcgctgctcatggctgacgaacgaactaaactgatcatggatgaggctttgcgatgtaagaccaggatcctgcagaacgacggggtggtaacaagcccctgcgctcggcctaggaaggctgggcatactctcctgattcttggggggcaaacatttatgtgcgataagatttaccaggtagatcacaaggccaaagagataattccgaaggcggatctgccctcacctcgaaaagagttctcagcctccgcgatcggatgtaaggtgtacgttaccggcggaaggggctctgaaaatggtgtcagcaaggacgtgtgggtgtacgacactgtacatgaggagtggtccaaagcagctcctatgctgattgcacgattcgggcatggctccgcggagttagagaactgcctttacgtcgtgggcggacacacctccctggcgggtgtgttcccggcctcccccagcgtatctctcaaacaggtggagaagtatgatcccggggccaacaagtggatgatggtggccccgttaagggacggagtctctaatgccgccgtcgtgagtgcaaaactgaaactcttcgtattcggcggtacttccatccacagagatatggttagcaaggtccaatgttatgatccttcagaaaacaggtggactatcaaagcggaatgtccacagccctggcggtataccgccgccgccgtgctaggctcacagatcttcattatgggaggcgatacagagttcaccgctgcgtccgcttaccggttcgattgtgagacaaatcagtggactcgtatcggagatatgaccgctaaacggatgagttgtcacgccttggcatcaggaaataagctttacgtcgtcggaggttacttcgggacccagcggtgcaagacgttggactgctacgatccaacgtccgacacctggaattgtattactacagtaccctatagcttgattcctaccgccttcgttagcacttggaagcacttgcccgcttag

SEQ ID NO: 17798 - DNA, 2916 bp, Artificial Sequence
  Description of Artificial Sequence: Synthetic coding sequence
atgaacttcctgcgcggtgtcatgggggggcagtcagcagggccacagcacactgaggcagaaacagttcggggcgctgctggcctgggcttgggtaaaggaagtggacagggccgagggcgaagcacacgcaggcctgaagaatgcggcctcaagtttcgacactctttccgcctcgtcaagcacattctctatcacgtgacaatcaacgtgtccgactcagagatcattggatatgcccttgatacgctgtacaatattatctccaacgaggaggaagaagaggtcggcggttcacaggaggagaactcaactagacagtccgaagatctcggcagccagttcacagaaatatttattaaacagcaggaaaacgttaccctgctcctgtcccttctggaggagttcgacttccacgtgcgatggccaggcgtcaaacttttgacgagtttgttgaaacagctgggtccccaagtgcagcagataatcctggtgagtccaatgggagtgagccgcctgatggatctactggccgattcccgcgaggtcattcgcaatgacggagtgttgctgctgcaggccctcactagatctaacggcgcaatacagaagatcgtggccttcgaaaatgcttttgaaagacttctcgatatcatatcagaagaagggaattccgatgggggtattgtggtggaggattgcctaatcctgctgcagaacctcctcaagaacaataatagtaatcagaatttttttaaggaggggagctatatccaacggatgaaaccatggttcgaggtgggcgatgagaacagtgggtggagcgcccagaaggtgactaacctgcatctgatgttacaactggtaagagtgctggtgagccctactaacccccctggagctacaagctcttgccagaaagcgatgtttcagtgcggccttctccagcaactgtgcactatccttatggctacaggggtcccagccgacatactgacagagaccatcaatacggtgagcgaggtgattcggggttgccaggtgaatcaggattatttcgcttccgtgaacgccccaagcaatccgccacgacctgcaatagtggtcctgctgatgtctatggttaatgaaaggcagccctttgtcctcaggtgcgcagtattatattgttttcagtgcttcctgtacaagaatcagaaaggtcagggggagatcgtgtcaacgctcctgccttcgaccatcgacgccacagggaacagcgtttctgcaggccagctgctttgcggcggcctgttctctacagattccctgtcaaactggtgcgcggcggtcgccctcgcacatgcgctgcaggaaaatgccactcaaaaggagcaacttttgagagtccagctggccacctctattgggaaccccccagtgtccctactccagcagtgcacaaacattctttctcagggggataagatcgaccggcggggatccaaaatccaaaccagagtggggttgcttatgctcctgtgcacctggctatccaattgcccaattgctgtgactcactttttgcataattctgcgaacgtgccattcctgaccgggcagattgccgaaaacttgggcgaggaagagcagctggtccagggtctctgtgcattgttgcttggcatatcaatatactttaatgataattcgctggaatcgtacatgaaggaaaagctgaagcagcttattgagaaacggattggcaaagaaaattttatagagaagttggggtttatctccaagcatgagctttatagcagggccagtcaaaagccccagcctaacttcccttctcccgagtatatgattttcgaccatgaattcaccaagcttgttaaagagcttgaaggcgtgattacgaaagcaatatacaagagctccgaagaggacaagaaagaagaagaggtcaagaaaaccctggaacagcatgacaacatcgtgacccactacaagaacatgatcagggaacaggatctgcagctggaggagctccgccagcaagtgagtactcttaagtgtcagaacgagcaactgcaaacagctgttacccaacaggtgtcgcagatccagcagcataaggatcagtataatttgctgaaaatccagcttggcaaagataaccagcaccaagggagttacagcgagggagcccagatgaacggcattcagcccgaggaaatcggaaggttacgcgaagagatcgaggagctgaaacgaaatcaggagctgcttcagtctcagctgaccgaaaaagatagtatgatcgagaatatgaaatcatcccagacaagcgggaccaacgagcaaagctccgctatcgtgagtgctagggactcagagcaagtagccgaactgaagcaggagctggcaaccctgaagtctcagctcaactcacagtctgtggagatcactaaattgcagactgagaaacaagagctgctccagaaaaccgaggcattcgctaaaagcgtcgaggtccagggcgaaactgagactattattgcaactaaaaccaccgacgtagaaggccggctcagcgcgttgctgcaggagaccaaagagctcaagaacgaaattaaagcgctgagcgaggaaaggaccgctattaaggaacagctggacagttctaattccaccatagctattctgcagacggagaaagacaagttagagctcgagattacggactcaaagaaggagcaggatgatttactagtactcctggccgatcaggaccaaaagattctcagtcttaagaataagcttaaagacttgggccatccagtcgaagaggaagatgagctggagtccggagatcaagaggacgaggatgatgagagtgaggatccaggaaaggatctcgaccacatttag

SEQ ID NO: 17799 - DNA, 258 bp, Artificial Sequence
  Description of Artificial Sequence: Synthetic coding sequence
atggggaacagcgactcgcagtacactctgcaggggtccaagaatcactctaatacgatcaccggagcgaagcagatcccctgtagcttgaaaatcagaggcattcacgcaaaggaagaaaaatccttgcacggctggggtcatggatccaatggtgctggatacaaatcacggagcctcgctcgttcttgtctctctcactttaagtcaaatcaaccttacgctagcagattgggcggccccacatgtaaagtgtag

SEQ ID NO: 17800 - DNA, 174 bp, Artificial Sequence
  Description of Artificial Sequence: Synthetic coding sequence
tgagggagagcccctgggcccgcaataggcgggcgaagagccggggatagctgtcctggatggcggcgaagaagtagaagtagagggcgtggtcagcgcctgagccacggacccaggagaagacctcagttactgacagagacaaggaggccagtgctcgttcagtggctgtag

SEQ ID NO: 17801 - DNA, 936 bp, Artificial Sequence
  Description of Artificial Sequence: Synthetic coding sequence
atggttagcttaagagtgaaccctcttagccttgttgaaataatattacacgtggttcggcagatgacagatcccaacgtggccctgacatttctcgaaaagacacgggaaaaagtcaaaagctccgacgaggctgtcatcctttgcaagaccgccataggggcccttaaactgaacattggagatctgcaagtgaccaaggagactatagaagatgtggaagaaatgttgaataacctccccggtgtgacctctgtacattcaaggttctacgatctgtcttctaagtattaccagactattgggaatcacgccagttactataaagatgccctccgatttcttggttgtgtggacattaaagatttgcccgtctcagagcagcaggagcgggcatttaccctcggactggctggattgttgggagagggcgtgtttaatttcggtgagttactgatgcaccccgtcctggagtccctacgcaacacagatcgccagtggctgatcgataccctctacgcctttaactcagggaacgtcgagaggttccagaccctgaaaacagcctggggccagcagcccgatcttgccgccaacgaggcccagttgctgcgcaaaatccagcttctgtgccttatggaaatgacattcactagacccgccaatcacaggcagcttacgtttgaagaaatcgcaaaatccgcgaaaatcacggtgaacgaggttgaactcctggtaatgaaggccctctcagtgggacttgtcaaaggctctatcgatgaggttgacaaaagagtgcatatgacctgggtgcagccccgagtgctagatctccaacaaatcaagggtatgaaagatagactagagttttggtgcacagatgtgaagagcatggagatgttagttgaacaccaggcccacgacatcttgacctag

SEQ ID NO: 17802 - DNA, 1161 bp, Artificial Sequence
  Description of Artificial Sequence: Synthetic coding sequence
atgaagagccttaaggcatgcaaacgggaaatcaagagcgtcatgaatacagctgggaattcagccccgagcctgtttctcaaaagtaatttcgaatatctgaggggtaattaccgcaaggctgtaaaacttttgaactcctcaaatatcgctgagcacccgggctttatgaaaacaggagagtgcttgagatgtatgttctggaataacctggggtgtatccatttcgctatgagtaagcacaacctcggcattttttattttaaaaaagctttgcaggagaacgacaacgtctgcgcccagctcagcgctggcagtaccgatcctggaaagaagttctccggtcggccaatgtgcacccttctgaccaataagagatatgagctcctgtataactgcggaattcaactgctgcatatcggtaggccactcgctgcatttgagtgtctgatagaagccgtacaggtgtatcacgctaacccacgtctatggttgagattagccgaatgctgtattgccgccaacaagggtacctcagaacaggagacaaagggccttccctccaagaaggggatcgttcagagcatcgtcggccagggctatcatcggaagatagtgctggcctcccagtccattcagaataccgtgtataacgacggccagagtagcgccatcccggtggccagcatggagtttgccgctatatgccttcgcaatgcgctcctgcttttgccggaggagcagcaggatccaaagcaggaaaacggcgcaaaaaattcaaatcaactgggaggtaataccgaatcttctgaaagttctgagacttgcagtagcaaatcccatgacggagataagttcatcccagcacctccttcctccccattgaggaaacaggagctggagaacctgaagtgtagtattttggcttgctctgcctatgtcgccctggccctgggggacaacctgatggcactcaatcacgccgacaagctgctccagcagcctaaactgagtgggagtctgaagtttctgggccacttgtatgcagcggaggccctgatcagcctcgaccgaatctccgacgccatcactcaccttaaccctgagaatgtgacagacgttagcctgggtatttccagcaacgagcaggatcaaggctag

SEQ ID NO: 17803 - DNA, 1596 bp, Artificial Sequence
  Description of Artificial Sequence: Synthetic coding sequence
atgctccaggagctcaacttcggcgcctacctggggcttccagcattcctccttcccctgaatcaagaggacaatacaaacttggccagagtgctaactaatcatatacacaccggccaccatagctcgatgttctggatgagggtgcccctggtcgcacccgaagatttgagggatgacattatagaaaacgctccaactactcacacggaggaatattcgggagaagagaaaacgtggatgtggtggcataacttccggaccctatgcgactactcgaaaaggattgccgttgcactggaaatcggggctgatctgcctagcaaccacgtcattgacagatggctgggggaacctatcaaggcagccatcttaccaacttctatatttctgacaaataagaaaggttttcctgtgctgtccaaaatgcaccagcggctcatctttaggttgctgaagcttgaggttcaatttatcatcacaggcacaaatcaccacagcgaaaaggagttttgcagctatttacaatatctggaatacctaagccagaatagaccacctccaaacgcctatgagctttttgctaaggggtacgaggattatctgcagtccccgctgcagcctctgatggacaacctggaatcccagacctatgaggtctttgagaaagaccccattaaatactctcaatatcagcaggctatttacaaatgccttctcgatcgggtccctgaagaggagaaggacacaaatgtgcaggtactaatggttctgggcgcagggcgcggcccactggtcaacgcctccctccgggctgcgaaacaggccgacagacggattaaactctacgcggtagaaaagaaccccaacgccgtcgttactctggagaactggcagtttgaggagtgggggagtcaggtgacggtggtgtctagtgatatgagggaatgggtcgcacctgaaaaggccgatataattgttagtgaactgctggggtcctttgcagacaacgagctttcgcccgaatgtctcgatggcgcccagcacttcttgaaggacgacggcgtcagcatccctggcgagtatacgtccttcctcgcgcctatttccagttcaaaattatataatgaggtgcgtgcttgccgggaaaaagacagggaccctgaggcccagttcgagatgccgtacgtggtgagattgcacaacttccatcaactgagtgcccctcaaccctgcttcacctttagccatccgaaccgtgaccctatgattgacaataacagatactgtactctcgagtttcccgtcgaggtcaatacagtgctgcacggattcgccggatacttcgaaaccgtactgtatcaagatatcaccctgtccatcaggcctgagactcatagccccgggatgttcagctggttccctatcctcttcccaattaaacagccaataaccgttagggagggccagacaatatgcgttagattctggcggtgcagtaatagcaaaaaagtgtggtacgagtgggcagttacagctccagtctgcagcgccatacacaaccctacaggcaggtcctacacaatcggcctctag

SEQ ID NO: 17804 - DNA, 789 bp, Artificial Sequence
  Description of Artificial Sequence: Synthetic coding sequence
atggcgctgagcctgggctggaaagcccaccgcaaccactgcgggcttcttctgcaggctctccggtctagcggtttgttgctatttccctgtgggcagtgcccctggcgcggcgccggaagttttcttgatccagagataaaagctttcctggaagaaaatacagaagtgaccagcagcggctccctgacgcccgaaattcaacttagactccttactcctagatgtaagttctggtgggagcgggcagacctctggccacatagcgacccttactgggctatctattggccaggaggccaggccctctccagatatctgcttgacaaccctgatgtcgttcggggcaagagtgtcttggatctgggtagcggctgtggtgcgaccgcaattgccgcaaaaatgtccggggcgagtagaatcctcgccaatgatatcgatcctatcgcgggaatggcgattactctgaattgtgagctcaaccgcctgaacccttttcctatactgatccagaatattctaaatctcgagcaggacaaatgggatctggttgtgttaggggatatgttttatgacgaggatctcgctgacagcctccatcagtggttgaaaaagtgtttctggacgtaccggactcgggttctgattggggatcctgggaggccccaattttctgggcacagtatacagcatcatctgcacaaagttgtggagtatagcttactcgagtcaactaggcaagagaattcaggcctgaccacaagtacagtctggggatttcagccttag

SEQ ID NO: 17805 - DNA, 1131 bp, Artificial Sequence
  Description of Artificial Sequence: Synthetic coding sequence
atggccgctccgtcaccgagtggcacccctgtgtccagcatgcagggcaagcgcaaagcactgaagttgaatttcgcaaacccaccttttaagtccaccgcccgctttacactgaatcctaatccaaccggcgtgcagaacccccatatcgagagactgcgaacgcatagcatcgaatccagcggtaagttgaagatctcaccggaacagcattgggatttcacagctgaagacttaaaagacctgggggagatcggcagaggagcctacggaagcgtgaacaagatggttcataagccgtctgggcaaatcatggctgttaaacgaattcgctctactgtcgacgagaaggaacagaagcagctgttaatggacctggatgtggtgatgaggagctccgactgtccttacattgtgcaattctacggcgccctgttccgcgagggtgattgctggatctgtatggagcttatgtctaccagtttcgataagttttacaaatatgtttatagcgtccttgatgatgtcatcccagaggaaatcctgggtaagattaccttggccactgttaaggccctcaaccatctgaaagaaaacctcaaaataattcatcgggatattaagccatccaacatcttgcttgatagaagcggaaacatcaagctttgtgacttcggcatttccggacagctcgtggatagtatagccaagactcgggacgcgggctgtagaccgtatatggcgcccgaaaggattgaccctagtgcttctcgtcagggatacgacgtgcggtctgatgtttggtctctaggcatcactctctatgaactcgctaccgggaggtttccctatcccaaatggaactctgtattcgatcaactgacacaggttgtgaaaggcgaccccccccagctgtctaactccgaagaacgggagtttagcccatcattcatcaactttgtgaacctgtgcttgacgaaggatgagtctaaacgcccgaagtacaaggagttgctaaagcacccatttatcctcatgtacgaggagagagccgtggaggtcgcatgttacgtctgcaaaatcctcgaccagatgcccgccacaccgtcctcccccatgtacgtggattag

SEQ ID NO: 17806 - DNA, 1035 bp, Artificial Sequence
  Description of Artificial Sequence: Synthetic coding sequence
atggccggttcaggctgtgcttggggcgccgaacctccccggtttctagaagcttttggaaggctgtggcaagtccaaagccgacttggtagcggaagcagcgctagtgtctatagggtaaggtgctgcggtaaccctggcagtcctcccggcgcacttaagcagtttctgcccccgggtaccaccggagccgcagccagcgctgcagagtacggattccggaaggaaagagccgctttagagcaactgcaggggcataggaatatagttaccctttatggcgtattcacaatccacttctcccctaatgtgccctcaaggtgtttactgctggagctgttagacgtctctgtgtctgagctgctcctatattcgtcccaccagggttgcagcatgtggatgatacaacactgcgctagggacgttcttgaggctctggcctttctgcaccatgagggctacgtccatgccgatctcaaaccgcgcaacatcctctggtccgcagaaaatgagtgtttcaaactgatcgactttggcctgagcttcaaggaaggaaaccaagatgttaagtacattcagaccgatggataccgggcccctgaggcagaactccagaattgtttggcacaggctggactgcagtctgatacagagtgcacctctgccgtagatctctggagcctgggcatcatcttgctcgaaatgttctcaggcatgaagctaaagcacaccgtccgcagccaggaatggaaagccaactcttccgcaatcatagatcacatttttgctagcaaggctgtcgtgaacgctgcaattcccgcctaccacctgagggatctcataaaatccatgctgcatgacgatccttcccgaaggattccggccgaaatggctttatgttctccgtttttctccattcccttcgcaccacatattgaggacctcgtgatgctccccactccagtgctcaggctgttgaatgtgcttgatgacgattatctggagaacgaagaggagtacgagggcctgtgttag

SEQ ID NO: 17807 - DNA, 1467 bp, Artificial Sequence
  Description of Artificial Sequence: Synthetic coding sequence
atggcattgaagatgaacaccctaagtagtaaccgtgcgaacatgctcaaagaggtgcagctcatgaatcgcctgtcacaccccaacattctgcgtttcatgggagtatgtgtgcaccagggacagctccacgctctgacagaatatatcaattccggaaatttagaacaactgttagactcaaatttgcacttgccttggaccgtcagggtgaaactggcatatgatattgcagtgggtctctcttatctgcacttcaaggggatattccaccgagatctcacatccaagaactgtctgatcaagagagatgagaatggctatagtgcggttgtagcagattttggcctggctgaaaagatccctgacgtgtcgatgggatccgagaagctggcagtggtcggctcccccttttggatggcgccagaagtactgagagacgaaccctacaacgagaaggctgacgttttttcctacggtattattctgtgtgagatcattgcacgcatccaggccgatcccgactacttaccccggacagaaaattttggtctagactacgatgcttttcagcatatggtgggagattgcccccccgatttcctgcagcttaccttcaattgttgcaacatggacccgaaactgcggccctctttcgtagaaattgggaaaaccctcgaggagatactgtcgcggctgcaagaggaagagcaggagcgcgacaggaagctgcagcccacagctcgaggattacttgaaaaggcccctggggtgaagaggctgtcgagcctggatgacaagatcccccataaatcaccttgcccaaggagaacaatctggctttcgcgtagccagagtgacattttttcccgaaagccccctcggaccgttagtgtgcttgacccctactaccgccccagggacggtgccgcacggacacctaaggtcaatccatttagcgctagacaggatctgatgggggggaaaataaaattcttcgacctcccctcgaagtctgtcatttcattggtgtttgatctagatgcccccggccctggtactatgcccttagcagattggcaggagcctctggcgccgcctattcgccgatggagatctctgcctggctccccagaattcctgcatcaagaagcctgccctttcgtcggtagggaggaatctctatccgatggacctccgcccaggctgagtagcctaaaatacagagttaaggaaattcctccatttagggcatccgccttacccgccgcccaagcccacgaggctatggattgtagcatcctgcaggaggaaaacgggttcggatctaggcctcaaggtaccagtccttgtccggcgggagcaagtgaggaaatggaggttgaggagagacctgctggatcgacacccgccactttctcaacctcaggcatcgggctgcagacacaaggtaagcaggatggctag

SEQ ID NO: 17808 - DNA, 1458 bp, Artificial Sequence
  Description of Artificial Sequence: Synthetic coding sequence
atgactctgtggatcctgcctaagttcaaagccgtagatttctctccaagtctggccgcctatactcatacgtggctgctgccccgatttcttgagatcctcattcagtgcggacattgcaaacgactggctcccgaatacgaggcagcagcgacccggctgaagggtattgtgcctttggccaaagtcgattgtacagcaaacactaatacatgtaacaagtacggggtgagtggttacccgacactgaagatattccgcgacggagaggaggcgggggcatacgacggtccccgaactgctgacgggattgtgagccacttgaagaagcaagccgggccagcttccgttccactgcggactgaggaggagtttaagaaattcattagcgataaggacgcttcgattgttggtttcttcgacgattctttcagcgaggcacactccgagtttcttaaagcagccagcaaccttcgagacaattaccgcttcgcgcatactaacgtggagtcacttgtaaatgagtatgatgacaacggcgagggcataatactcttcaggccgagtcacctcacaaacaagttcgaggacaaaacggtggcctatactgagcagaagatgactagtggcaagattaagaagtttattcaggaaaatatcttcggcatatgtcctcacatgacagaggacaataaggaccttattcagggcaaggacctcctcattgcgtattacgatgtggactatgagaagaatgccaaaggctctaattactggagaaatcgcgttatgatggtagccaaaaagttcttggatgcaggccataagctgaactttgctgttgcaagtcgcaaaacctttagtcatgaactcagcgacttcggcctggagtccacagctggagagattcccgttgtcgctattagaacggccaagggggagaagttcgtaatgcaagaagagttttcaagagatgggaaagctttggagcgttttctccaggactacttcgacgggaacctgaagcgctatttgaaatctgaaccaatccccgagtctaacgacggccctgtgaaggtggtcgtcgccgagaattttgacgagatcgtgaacaacgagaacaaggatgtcctgatcgagttttatgctccttggtgcggacactgtaagaacctggaaccgaaatataaggagttaggcgagaaactctcaaaggacccaaacatagtcattgccaaaatggatgcaacagcaaatgacgtaccctccccttacgaagtccggggattcccaaccatttacttctcacctgccaataaaaaactaaatccaaagaagtacgaaggcggaagagaattgagtgattttatcagttatctacaacgcgaagccacaaatcctcccgtgatccaggaggagaagccaaaaaagaagaaaaaggcccaggaagacctgtag

SEQ ID NO: 17809 - DNA, 885 bp, Artificial Sequence
  Description of Artificial Sequence: Synthetic coding sequence
atgtccgcgcaacactttgtgtctacagagcaggttgagttgcctggcccaggccagtgggtagtggcagagtgcccagcccgggtggacttttcaggcggctggtcagacactcctcccctggcctatgagctgggtggagccgtactgggactcgcagtgagagtggacgggcgccggccaatcggcgcacgggccagacgtattcctgagcctgagctttggctggccgtgggccctaggcaggatgagatgacagtcaaaattgtatgccgatgtctggcagaccttcgagactattgtcagccccacgcgcccggcgctctcctaaaggccgcttttatctgtgccggaattgtgcatgtccacagtgaactgcaactgtcagagcagctgctgagaacctttggcggcggtttcgaactccatacctggtcagagctgccacatggaagcggactgggaacaagttccattcttgccggaaccgctctggctgccctgcagagagccgccggccgtgtagtaggaaccgaggcattaattcacgccgtcctgcacctggaacaggtgctgacaacagggggtgggtggcaggaccaggtgggcgggcttatgcccgggatcaaggtaggaaggtcccgggcgcagctgccattgaaggtggaagtcgaggaggtgacagtgcctgaaggcttcgtgcagaagctgaatgatcatctcctgctggtctacactggcaaaactcgactggcgcgcaacctactccaggatgtcctacgaagctggtacgcgaggctgcccgccgtggtgcagaacgctcactccctagtgaggcagaccgaggagtgcgccgaggggtttcggcaaggaagccatatttag

SEQ ID NO: 17810 - DNA, 945 bp, Artificial Sequence
  Description of Artificial Sequence: Synthetic coding sequence
gtcgggagaatggaaggttgttcatccccaatcgtggtcaaattcgcagacacccagaaggacaaggagcagagacggctccagcagcagttagcccaacaaatgcagcagcttaacactgcaacttggggtaacctaacagggctcggcggccttacaccccagtacttggcgctgctgcagcaggctacctcctcaagcaatctaggtgcgttcagtggcattcagcagatggctggcatgaatgctctccaattgcagaatctcgccacattagcggccgccgctgccgctgctcagacatctgcgactagtacgaatgcaaacccactctcaaccacctcctcagcgttgggtgctctgaccagcccggtggccgcctctacaccgaattctacagctggggctgcaatgaattctttgacgagtctgggaactttgcagggtctcgctggagccacagttggcctgaataatatcaacgcattggcgggaatggctgccctgaatgggggcttgggggccacagggctaaccaatggcacagctggtactatggacgctcttacgcaggcttactccgggatacaacaatacgcagcagcagccctgccaaccctgtacagccagtcacttctccagcagcagtctgccgccggctcacagaaggagggacctgaaggggccaatctcttcatataccacctcccacaggaatttggcgatcaggatatcctgcagatgttcatgccctttggtaacgtcattagcgcaaaagtgttcatcgacaaacagactaatttgtccaaatgctttggttttgtttcttacgacaaccctgtctccgcccaagccgcaatccaagcaatgaacggattccaaattggaatgaaacggctcaaagtccagctaaagcgctctaaaaatgattccaaaccgtattag

SEQ ID NO: 17811 - DNA, 1083 bp, Artificial Sequence
  Description of Artificial Sequence: Synthetic coding sequence
tccatggagaaaacttacacatccacatcaaataatagcatatctggcagcctcaagaggttagaggacacaaccgcgcggtttactaacgccaactttcaggaggtcagtgcgcacacctccagcgggaaggacgtctcggagacgcgtggttctgagggaaagggaaaaaaaagctcagctcatagctcgggccagcgaggacgaaaacccggcggcggccgaaatcctggtaccaccgtgtctgccgcatctccgtttcctcaggccggctacaagagagctcagactagtggtatcgaagaggagactgtaaaagaaaaaaagcggaagggaaacaagcagtctaagcacggcccaggccggccaaaggggaataagaaccaggaaaatgtgtcccatctatcagttagcagcgcatcccccacttcctctgtggcaagtgctgctggcagcatcactagctcaagcttacagaaatcccctacgctgctgcgcaacggctccctccaatcattgtccgtaggtagctctcccgtgggtagtgaaatctccatgcagtataggcatgacggagcatgtcccaccactacatttagcgaactgctcaacgcgatccacaatgaccgaggtgacagctctacactcaccaaacaggaactgaagttcattggaatctacaatagtaatgatgtggcagtaagcttccctaatgttgtgagtggctcaggatcatctaccccggtgtcttcttctcaccttcctcagcagagcagcggccatcttcagcaggtgggtgccctctctccatccgccgtaagttcggcagcgcctgcagtcgctactacccaagcaaatacacttagtggctcgtctctgtcccaagcccctagccacatgtatgggaacaggagcaattcgtctatggccgcacttatcgctcagtccgagaataaccagactgaccaggacctcggagacaattccaggaatctggtcggcagagggtcctctccacgcggatccttatctccacggagccccgtgtcttctctgcagatacgctatgatcaaccagggtag

SEQ ID NO: 17812 - DNA, 924 bp, Artificial Sequence
  Description of Artificial Sequence: Synthetic coding sequence
atgcagtcactgacactcgacttactcgggcccagtgaactcctgcttgctctaaacatggggaatacaagctttaacgaggtgatggaggctcagctcccatcccatggtggacctaagccgtccgcagagagtgacatggggacccgaagagactacataatggctaagtatgtcgagcatcgttttgcaaggcgatgtactcctgaacctcaacgcctatggaccgccatttgcaatcgagatttactctccgtgttggaggccttcgctaacggacaggacttcggccagccattaccgggacccgacgcgcaagctcccgaggagttggtactccacctagcagtgaaagtggcgaaccaagcctcgctgcctttggtggacttcatcattcagaatgggggtcacctggatgccaaagccgcggacggtaacaccgcgcttcactacgccgccctgtacaaccagcccgattgcctgaaactgctgctgaaagggcgggctctcgtgggcacagtcaatgaagcaggggagaccgccctggacatagcccgcaaaaagcaccataaagaatgtgaagagttgctcgaacaggctcaggctggcactttcgccttcccactccatgttgattatagctgggtgatttccactgagcccggatctgatagcgaagaggacgaggaagaaaagcgttgtctcttgaagctgccagcccaggcccactgggccagtgggagactggatatctctaacaagacgtatgaaaccgtggccagtctcggggctgccactccgcagggcgaaagtgaggactgtccgcctcctctgcccgtcaagaattcgtctcgaactctcgtgcagggatgcgcccgacacgcttccggcggtcggcgtgaggagcgcgctcgcagagagtag

SEQ ID NO: 17813 - DNA, 1497 bp, Artificial Sequence
  Description of Artificial Sequence: Synthetic coding sequence
atgagcagttgcgtctcttcccagcccagtagcaatcgtgccgcaccccaggatgagctggggggccgcgggtcttctagctctgagtcccaaaaaccttgcgaggcccttcgcggactgagtagtctgagtatccatctcggcatggagtcattcatcgtcgtgacagaatgtgaacctggctgtgccgtagaccttggccttgcacgagaccgacctctggaggctgatgggcaagaggtgcctctcgatacgtccgggagtcaagcacgcccccatttgagcggtagaaagctgtctctgcaggagcgcagccagggaggactggccgccggaggctcgctggacatgaacgggagatgtatctgtccaagtttaccctattctcccgtgtcatccccacaaagttcacccaggctgccgaggaggcccaccgtagagtcccatcatgtgagcattacagggatgcaagactgtgtgcaactcaatcagtacacccttaaagatgagatcggtaagggatcctacggggtggtgaagctggcctataacgaaaacgacaatacctactatgcgatgaaagtgttgtctaagaaaaaactcattagacaggccggctttccacgccgccctcctcccagaggcacaaggcccgcacccggcggctgtatccagcctaggggtcccatcgaacaggtgtatcaagagatagccatactcaagaaacttgatcaccccaacgtggtgaaactggtggaggttctggacgaccccaacgaagaccacctttatatggtattcgaactagtgaatcaaggtcctgtgatggaggtccccaccctcaaacccctctctgaggaccaggcccgtttctactttcaggacctcattaaaggaatcgaatacttacactaccaaaaaattatccatcgggacatcaagcctagtaacctgctagtgggcgaagacggacacattaaaatcgctgacttcggagtgtcaaacgagttcaagggcagcgatgccctgctgtctaataccgtgggtacacccgcgttcatggcccctgagtcactgtccgagacccgaaagatcttcagcggtaaagcccttgacgtgtgggctatgggtgttactctctactgttttgtgtttggccagtgcccctttatggacgaacggattatgtgcctgcattccaaaataaagagtcaggctctggagtttcctgatcagccggatatcgccgaggacttaaaggatctaataaccaggatgttggacaagaatccagagtctaggattgtggtgcccgagattaaaatactcgtcaaaacgatgatccggaagcggagttttggcaatccatttgagggatctagacgggaagagagatccctttccgcccctgggaatctgttgaccaaacagggaagcgaggataatttacaagggaccgatccgcctccagtgggtgaggaagaggtgttgctttag

SEQ ID NO: 17814 - DNA, 600 bp, Artificial Sequence
  Description of Artificial Sequence: Synthetic coding sequence
atgacacccctggccccctgggatcctaagtacgaggctaaggccggaccacgacctgtttggggggctaattgttcctctggagcctccttctctggccgaacattgtgccacccttccttctggccactgtatgaagcagcgagcggtcgggggctgcgccctgtcgcacccgctaccgggcactggaacggtcagcaggctccgccggatgccggctttccagtggtctgttgcgaggatgtgttcctgagcgatccactgctcccccgcggccagcgcgtgcctttgtacctgtctaaagcgccccagcagatgatgggcagcctcaagctgctgccacccccccctataatgagtgctagggttctcccccggccttcaccatcacggggcccatcaactgcttggctttcaggcccggaattgattgcgctgacgggtctgctgcagatgagccagggggaacctcgaccttcgtcttctgcggttgggccgcccgatcatacatccgaccctcctagcccgtgcgggtcccctagttcatctcaaggggctgatttgagcctgccacagaccccagacacccattgcccttag

SEQ ID NO: 17815 - DNA, 1248 bp, Artificial Sequence
  Description of Artificial Sequence: Synthetic coding sequence
atgtggaggaaggtgtacacacctcggtccagcttcgagctctcagcccagccaccaagttgggagcagagaaaattattggagaaatgtgccatgaccgctctgtcaagcaaacttatcagccagcagaaagcattcttcgccaagatggtggtcgacgccgtgatgatgcttgacgacctcctgcagttgaagatgatcggtatcaaaaaagtccagggtggagctctagaagattcccaactggtagcaggagtggcatttaagaaaacattttcctacgcagggtttgagatgcagccaaaaaaataccacaatcccaagatcgccttattaaacgtggagttagagctgaaggccgaaaaggataatgccgagattcgggttcacacagtcgaagactaccaggccatagtggacgctgagtggaacatattatacgataagctggaaaagatccatcactccggtgccaaagtggtgctaagcaaactgcccatcggtgatgttgctacccagtactttgctgaccgcgacatgttttgcgcaggccgcgtgccagaagaagacttgaagcgtacaatgatggcctgcggagggagtatccagacctccgtgaatgcattaagtgcagacgtccttgggcgctgtcaggtgttcgaggaaacgcagatcgggggcgagagatacaatttcttcaccggatgtccaaaggcaaagacctgtacattcatactaagagggggggccgagcaatttatggaggagactgaacggtctctgcatgatgctatcatgatagtgagacgcgcgatcaaaaatgatagcgtggtggcagggggaggcgccatcgaaatggaactgtcaaagtatctgagggattactcaagaacgattcctggaaaacagcagctcctgattggggcatatgcaaaagccctcgaaatcatacctaggcagctctgcgacaatgcgggcttcgatgcaaccaatatcctgaacaaattaagggctcgacacgcacaaggcggcacgtggtacggggtggatatcaataatgaggatatcgcagataatttcgaagctttcgtgtgggagcccgcaatggtcagaattaatgctctcacggccgcctccgaagctgcctgtcttattgttagcgtggacgagactatcaagaacccccgaagcaccgtggacgctcccacggccgctggccggggaaggggtcggggcaggccccattag

SEQ ID NO: 17816 - DNA, 3117 bp, Artificial Sequence
  Description of Artificial Sequence: Synthetic coding sequence
atggtgtcctccgcacagatggggttcaatcttcaggccctgctcgaacagctcagccaggacgagctgagtaaattcaagtatctaattacaacgttctcgctggcacatgaactccagaagataccacataaagaagttgataaggccgacggcaaacagctggtggagattttgactacacattgtgatagctattgggtggaaatggcgtccctacaagtgttcgaaaaaatgcatcgcatggacttatctgagcgcgcgaaggatgaggtgagggaagccgcccttaaatcattcaacaaacggaaacctctgagcctggcgtttaccgagacaaaaggtaatgtgatctgtctgggtaaagaagtatttaaaggtaagaaacccgataaagataatcgctgccggtacatcttgaagaccaaattccgcgagatgtggaaatcatggcccggggatagtaaggaagtgcaagtgatggccgagaggtataagatgctgattccgttctctaaccccagagtcttgcccggcccattcagttacactgttgtcctctacggcccagccggcctcgggaagactacactggcccagaagttgatgctggactgggcagaggacaacctgatccacaaatttaagtacgctttttacctatcgtgccgagagctgtctcgactgggcccgtgttcgttcgcagagctagtgttccgggattggccggaactccaggacgatattcctcatatacttgcacaagcacggaagatactgtttgtaattgatgggtttgacgagttaggcgcggcacctggggccctcatcgaagacatatgtggcgactgggagaagaagaagccagttcccgtactgctgggttcattgctgaatagagtgatgttaccgaaggctgccctcttggtgacgacacgaccgcgcgccctacgagacctaaggatactggccgaagagcccatctatattagggttgagggcttcctggaagaagacagaagggcttacttcctgaggcacttcggcgacgaggatcaagctatgagagccttcgagctaatgaggtctaatgcagctctctttcaattagggagcgcgcccgctgtctgttggattgtctgcacgaccttgaaactgcagatggagaaaggcgaagatccggtgccaacgtgcttgacccgaacaggactgtttttgagatttctgtgttctagattccctcagggcgctcagctgcgcggcgcattgagaacactgagcttgctggccgcccaaggcctgtgggctcaaacatccgtgctccaccgagaggacctggagaggttgggcgtgcaggaatccgatctcaggctgttcttggatggagacatccttagacaggacagggtctctaagggatgttacagcttcattcacctgagtttccagcaattccttacggcactcttctatacgctcgagaaggaagaggaggaagatcgtgacggacatacctgggacatcggagatgtgcaaaaacttctgtctggagtcgagaggctgcgcaatcccgacttaattcaggctggatactactcatttggtctggccaacgagaaacgcgcaaaggagcttgaggctacctttggttgtagaatgtccccggatatcaaacaggaactgctgagatgcgatatatcctgcaaggggggacatagcaccgtaactgatcttcaggagctgttgggatgcctctatgagagccaggaagaggagctggtgaaggaagtaatggcccagttcaaggagatatcactgcatctgaacgccgtcgacgtggtgcctagttcattctgcgtcaaacactgccgcaacttgcagaaaatgtctctacaggtcattaaggaaaatcttcccgaaaatgtcactgcctcagagtccgatgccgaagtcgagcgaagtcaggatgaccagcacatgctgccattctggactgacctgtgcagcatcttcggctccaataaagatctgatgggcctcgccatcaatgacagttttctctccgcctccctggtgcgcattttgtgtgagcagatcgctagcgacacgtgtcacctgcagcgagtcgttttcaagaacatcagccccgcagacgcacatagaaatttgtgccttgctctccggggccacaagaccgtcacctacttaaccctgcagggaaatgaccaggacgacatgtttcccgccctttgcgaagtgctacgccatccagagtgtaacctcaggtacctgggactggtttcttgcagcgccacaacacaacaatgggcggatttaagtctggcgctggaggtgaaccaaagtctgacatgtgtcaacttgtccgataatgaactcctggacgagggtgccaagctactgtacacgactctgaggcatcccaagtgcttcctccagagactctcgctggaaaattgtcacctgacggaagcaaattgcaaagacttagctgcggtgctggtcgtatctagagagctgactcacctgtgtctggctaaaaaccctatcggtaacacaggagtaaagttcctgtgcgaggggttgcggtacccagaatgcaagttgcagacgctcgtcctgtggaactgtgacataacatccgacggatgttgcgaccttaccaagctgttgcaggagaagagttccctcctttgtctggacctagggctgaatcacatcggagttaagggcatgaaatttctgtgtgaagctctgcggaagccactgtgtaacctccggtgcctctggttgtggggatgctctattcccccattttcttgtgaggatctgtgcagtgctttgtcatgtaatcagagccttgtgactctcgatttggggcagaatccactgggttcaagcggagttaagatgctcttcgaaaccttgacctgctcaagtggtactttgcgcactttgcgtctcaagattgacgattttaacgatgagctgaacaagttgctcgaggagattgaggaaaagaacccacagctcatcatagatactgaaaaacaccatccctgggccgaacgcccgtctagccacgatttcatgatctag

SEQ ID NO: 17817 - DNA, 1443 bp, Artificial Sequence
  Description of Artificial Sequence: Synthetic coding sequence
atgagactgagaaggttggccctttttcccggtgtagccctgttgctcgccgctgcccggctggcagctgcctccgagtttttcgccccctggtgcggccattgcaagcgactagctcccgagtacgaggctgcagctacccggctgaaaggcattgtacctctggcaaaagtcgactgcacagccaatacaaacacgtgcaacaagtatggagtgtccgggtatccgaccctaaaaatattccgcgacggtgaggaagcaggcgcctacgacggccctcgcactgctgacgggatcgtctcacacttgaaaaagcaggcaggtccggccagtgtaccccttcggaccgaggaggagtttaaaaagtttattagtgacaaagatgcgagtatcgtcggattctttgacgattccttttccgaggcacacagcgaattcctgaaggccgcaagtaaccttcgcgacaactataggtttgcgcacacgaacgtggagagcctagtgaatgaatacgatgacaatggcgaggggatcatcctgtttcggccctcacatttaactaataagtttgaggacaaaaccgtcgcctacaccgagcaaaagatgacaagcggcaagataaagaagttcatccaggaaaatatattcgggatctgcccccacatgacggaggataacaaggacctgatccaaggaaaagatctgttgatcgcgtattacgacgtagactatgagaagaatgcaaaagggtcaaactactggaggaaccgggtgatgatggtggcgaaaaaattcctcgacgctggacataagctgaacttcgctgtcgcaagtcgaaaaacgttctcgcacgagctcagtgactttggcctggaatctactgccggcgagattccagtggtagctatccgcaccgccaagggagaaaaattcgtcatgcaggaggagttctccagggacgggaaggccctggagagattccttcaagattattttgacggcaacttgaagcgatatttgaagtccgagccaatccccgaatctaacgatggcccagttaaagtagtggtcgctgaaaatttcgatgagatcgtgaataatgaaaacaaggatgtgctgatcgaattttatgctccatggtgcgggcactgtaagaatttggagcctaagtacaaggagctgggcgaaaagctgagtaaagatcccaatatcgttatcgcgaaaatggacgctacagccaatgatgtaccctccccttacgaagtgaggggcttcccaaccatctacttttcgccggcgaataagaaattgaacccaaaaaagtacgagggtggccgggagctgtcggacttcatatcgtatctgcagagagaagccaccaatccccccgtaatacaagaagagaaaccgaagaaaaagaagaaggcgcaggaagacctctag

SEQ ID NO: 17818 - DNA, 228 bp, Artificial Sequence
  Description of Artificial Sequence: Synthetic coding sequence
atgggtgtcaaacttgagatctttcggatgattatctacttgaccttccccgttgcaatgttctgggtatccaatcaggctgagtggtttgaagatgatgtaatccaacgaaagagggagctgtggccaccagagaagctacaggagctagaagagtttaaggaacgattgcgcaaacgtaagcgcagagaggaaaagctccttagggacgcgcaacagaattcttag

SEQ ID NO: 17819 - DNA, 807 bp, Artificial Sequence
  Description of Artificial Sequence: Synthetic coding sequence
atgggtagcgccaaatctgtcccagttacgcccgctcgccctcccccccacaataaacatctagctcgcgtggccgatccgcggtcccctagtgctggcatactgagaacaccgattcaagtcgaatccagcccccaaccagggttaccggccggggaacagcttgaagggctgaaacatgctcaggattccgaccccaggtcccccaccctgggaattgcccggactccaatgaagacctcttcaggggatccaccctccccacttgtcaaacagctgtctgaagtgtttgagacagaggacagcaaatctaacctgccacctgaaccagtgttgccacctgaagccccactgtcatctgaattagaccttcccctgggcacacagctgagcgttgaagaacaaatgcctccttggaaccagacagaattcccttctaaacaggtcttcagcaaagaggaggctcggcaaccaacagagacccccgtggcaagccagtccagtgataagccatcccgggaccccgaaacacccagatcctcagggagcatgaggaataggtggaagcccaattcttcgaaggtgttggggaggagccctcttaccatcctgcaggacgataattcccccggcaccctaactctgcgccagggcaaaaggcctagtcccctgagcgagaatgtgtccgaactcaaggagggagctatactcggcactggcagactcctgaagaccggcggaagggcatgggagcagggccaggatcatgacaaggagaaccagcacttccctctcgtggagtcatag

SEQ ID NO: 17820 - DNA, 351 bp, Artificial Sequence
  Description of Artificial Sequence: Synthetic coding sequence
atgctgttggagtgcggtatgcaggaggagggcctcttcagggtagctccttccgcttcaaaattaaagaaactgaaggcggcactcgactgttgtgtagttgacgtgcaagaatactccgcagacccccacgcaatcgctggggcactcaagtcatatctacgcgagcttcctgagccgctgatgacgttcgagctctacgacgagtggattcaggcttccaatgttcaggaacaagacaaaaagctccaggcactgtggaatgcatgcgagaaactgccgaaggctaaccacaacaacatccgatatctgattaagttctacccttcttgtcagaatatcaagatgtag

SEQ ID NO: 17821 - DNA, 906 bp, Artificial Sequence
  Description of Artificial Sequence: Synthetic coding sequence
atggttaggacgaaaacctggactctcaagaagcatttcgtagggtatcccaccaattctgactttgaactgaaaactgccgagcttcctcctctgaagaatggagaggtgctactggaggcattgtttttgaccgtggacccctacatgagggtagcagctaagcggctgaaagagggagacacaatgatgggacagcaggtagcaaaggtggtcgaatctaagaatgttgcactacccaaaggtacgatagtgctggcctcgccaggatggaccacacactcaatctctgacggcaaagaccttgagaaactcctgaccgagtggccagatacgatacctttgtcccttgccttgggtacagtcggaatgcctgggctgacagcctattttggtcttttggaaatatgtggtgtgaaaggaggggagaccgtgatggtcaacgccgccgcaggtgccgtgggctcagtggtgggacagattgctaaacttaagggctgtaaggtggttggggccgtgggcagcgacgaaaaagtggcttacctacagaagttaggcttcgatgtcgtattcaattacaagaccgtggaaagcctggaagaaaccctcaaaaaggcttcccccgacgggtacgattgctacttcgacaatgtgggaggggagttctcgaatactgtcattggtcaaatgaaaaaattcgggcgcatagccatctgtggagccatcagcacctataatcggacgggaccactgccaccaggaccccccccggaaatcgtcatataccaagagctgcgcatggaggctttcgtcgtataccgttggcagggcgatgcccgacagaaagccctcaaggatctgttaaaatgggtgctggagatcaagagggagaatgaagaggattag

SEQ ID NO: 17822 - DNA, 1068 bp, Artificial Sequence
  Description of Artificial Sequence: Synthetic coding sequence
atgctggggagtgggtttaaggctgaacgactcagggtgaacctaaggttggtcatcaatcgcctgaaactactggaaaagaagaagaccgagctggcccagaaagctcggaaggaaattgcagattatttagctgccggtaaggacgagagagcccgtatccgtgtggagcacatcattcgtgaggactatcttgtggaggctatggagattttggagctctactgtgacctgctgttagcccgattcggactgattcaatcgatgaaggagttggattctggtctggccgagagcgtgtcaacattggcagaactgaaaatcgtcgcagaccaactgtgtgcaaagtactcaaaggagtatgggaaactgtgtcggaccaaccagatcggtaccgtgaatgatcgactgatgcacaagctgtcagtggaagcccccccaaagatccttgtcgagaggtacttgatagagattgcaaagaactacaatgtgccatacgagcccgattcagtcgttatggcggaagctcccccaggcgtggaaaccgatctgatcgatgtaggcttcaccgacgacgtgaagaagggcggccccggtcgcggcggttctgggggctttacagcgcctgtgggaggaccggatggtaccgttcctatgcctatgcctatgcccatgcccatgccatcggctaacactccttttagctatccactgcccaaaggaccttcagacttcaacgggttgccaatggggacttaccaggcgttcccaaatatccatccaccgcagattcctgccacaccaccctcttatgagagtgtggacgacattaatgccgataagaatatcagctctgcccaaatagtagggccaggccccaaacccgaggccagcgcaaaattgccttccaggcccgctgacaattatgataactttgtgctgccagagctgccctctgtgccagacaccctgccgacagcttccgctggggcttctacctcagccagcgaggacattgatttcgatgatctgagccggcggtttgaagagctcaagaaaaagacctag

SEQ ID NO: 17823 - DNA, 2175 bp, Artificial Sequence
  Description of Artificial Sequence: Synthetic coding sequence
atgcaaatgaccatccaggctttgcaggatgagttaaggatccagcgcgaccttaaccagctgtttcaacaagattccagcagtagaactggcgaaccgtgtgttgccgaactgactgaggaaaacttccagcggttacatgccgaacatgagcggcaggcgaaggagctgttcctcctacgtaagaccttagaagaaatggaactgaggattgagacccagaagcagacactgaacgccagggatgagtcaatcaagaagctcctggagatgctacagtcgaagggtctgagtgcaaaagcaactgaagaagatcacgagagaacccgacgtttagcagaggcagagatgcacgtgcatcacctggagagtctgttggagcagaaggagaaagaaaactcaatgctgagagaggaaatgcacagacggtttgagaatgctcctgactcagccaagaccaaagcgctgcagaccgttatcgagatgaaagattctaagatttctagcatggaacgcggcctccgagatctcgaggaggaaatccagatgctgaagagcaacggggccctgagcaccgaggaaagggaggaggagatgaaacaaatggaggtgtatcgttcccatagcaaatttatgaaaaacaagattggtcaggtgaaacaggaactgtctagaaaggatactgagcttctcgccttgcagaccaaactcgaaactctgaccaaccaattcagtgatagcaagcaacatatcgaagtgctgaaggagagcctgactgccaaggagcagagggcagcgattctgcagaccgaggttgatgcactgcgactccgtcttgaagagaaggagactatgctgaataaaaagaccaagcagattcaagatatggcggaagagaaaggcacccaagctggggagatacacgatctgaaggatatgctggacgtaaaagagcgtaaggtcaacgttttgcagaagaagatcgaaaatttgcaagagcagctgagggataaggagaaacagatgtcttctctgaaggaaagagttaaatctctgcaggcagatacaacgaacactgacacagctttaactaccctggaagaagcactggccgagaaggaacggacaatcgagaggctgaaagaacagcgagatcgagacgaacgggaaaaacaggaagagatcgacaattacaagaaagatctgaaagacctcaaggagaaagtgtctctattgcagggtgacttgtcggagaaagaggcatctcttttagaccttaaagaacacgcgagcagcctcgcaagttccgggctgaaaaaggattcgcgtcttaaaaccctggagattgccttagaacaaaaaaaggaggagtgcttaaagatggagagtcagctgaaaaaagcccatgaagcagcccttgaagctagagcgtctcccgaaatgagcgaccggattcagcaccttgaacgtgagattacacggtacaaggacgaatcttctaaagcccaggcggaagtggacaggctactggaaatcttgaaggaagtcgagaacgagaaaaacgataaagacaagaaaatcgctgagctcgaatctctgactagccgacaagtaaaggaccaaaataagaaggtcgctaacctcaagcacaaggaacaggtggagaaaaagaaatccgcccagatgctggaagaggcaaggcgcagagaggacaacctgaatgacagctctcaacagttacaggtggaagagctactgatggcaatggagaaggtaaagcaggagctggaatctatgaaagccaagttgagctcaacacagcagagtttggccgagaaagaaactcacttgactaatttgagggcagagcggaggaagcatctggaggaggtactggaaatgaagcaagaggctctgttggccgcaatttcagaaaaagatgccaatattgccctcctggagctgtcttctagcaagaagaagacccaggaagaagtcgctgccttaaagcgagaaaaggatagattagtccagcaactcaagcaacagacccagaatcgtatgaagcttatggccgacaactatgaggatgaccatttcaaaagcagccactcgaaccagacaaaccataaaccatctccggaccaggacgaagaggaaggaatttgggcctag

SEQ ID NO: 17824 - DNA, 408 bp, Artificial Sequence
  Description of Artificial Sequence: Synthetic coding sequence
atggcaatcggattcaatgtggaaaccgtcacatacaagaaccttaaatttcaggtgtgggatctcggaggccagactagcatcagaccctattggagatgctactactcaaacacggacgccgtgatttacgttgtcgacagctgtgatcgggaccgcatcggcatctcaaaatcggaactggttgccatgttagaagaggaggaactgaggaaagcaatcttagtggtctttgctaataaacaggatatggagcaggcaatgaccagttccgagatggcgaattccctgggactgcctgcactaaaagatcgcaagtggcagatcttcaagactagcgctaccaaagggacaggattggacgaagccatggaatggttagtcgagaccctaaagagcagacagtag

SEQ ID NO: 17825 - DNA, 684 bp, Artificial Sequence
  Description of Artificial Sequence: Synthetic coding sequence
cgaaggcaaattttgaaagaattggccctttgccttaggcggcaagagatgtacggtccacgcgctgcttctcggaacaaagagacgtctgccggaccagttgccgtgatgggcaaggattattacaagatcctgggcattccttccggggcaaatgaggacgagatcaaaaaggcctaccgcaagatggcactcaagtaccaccccgataagaacaaagagcctaatgcagaagagaaattcaaggagattgccgaggcctacgatgttctctcagatcccaaaaagaggggattgtacgatcagtatggggaagaagggctgaagacaggcggaggcacgagcgggggctcttccggatccttccattacacctttcacggcgacccccacgcaacctttgcaagtttctttggcggtagtaacccattcgatattttttttgcctccagtcgatcaacgcgccctttcagtggattcgaccccgacgacatggatgtggatgaagacgaggatccttttggggctttcgggcggttcggcttcaatggtctgagtagggggccacggcgagcgcccgaacctctgtaccctcgaaggaaagtgcaggaccctcccgtggtacacgaacttcgcgtctctctagaagagatctatcacggatcgactaagcgcatgaagtag

SEQ ID NO: 17826 - DNA, 252 bp, Artificial Sequence
  Description of Artificial Sequence: Synthetic coding sequence
atgtcaatgctgaagccttccgggctgaaggcccctacaaaaattctcaaacccggttccaccgctctgaagacccctaccgcagtcgtggccccggtggagaagaccatcagcagtgagaaggcctctagcacgccctcttccgagactcaggaggaattcgtggatgactttcgggttggagaacgcgtctgggtaaacgggaacaagcctggttttatccagtttctcggagaaacccagttcgcctag

SEQ ID NO: 17827 - DNA, 642 bp, Artificial Sequence
  Description of Artificial Sequence: Synthetic coding sequence
atggacatgttaggtggacctggaatcgagagtcaatgcagaaaagtggacatcatagcagacgccgcttatagcattttccagaagcccaaatccttcaccggcaacttcgtgatcgatgagaacatcctgaaggaggagggtattgagaacttcgacgtgtacgcaattaaaccaggacacccgctgcagcccgacttttttctggatgagtaccccgaagcagtgagcaagaaagttgaatcaacaggcgcagtgcccgaatttaaggaagaaaagcttcaattgcagcccaaaccacgctcgggggccgtcgaggaaactttcagaattgtgaaggattctctgtccgatgacgtcgtcaaggcaacacaggccatttatttattcgaattgtcaggcgaggacggcggaacatggttcttggatcttaagagtaaaggcggcaatgtcggctatggagagccaagcgatcaggcagacgtggtaatgtcaatgaccacggacgattttgtaaagatgttctctggaaaactcaaacccacaatggcttttatgtccggcaagctgaagattaagggcaacatggccctagctatcaaactagagaagttgatgaatcagatgaatgctcggctctag

SEQ ID NO: 17828 - DNA, 1230 bp, Artificial Sequence
  Description of Artificial Sequence: Synthetic coding sequence
atgaataggacctggccgagacggatctggggaagttcccaggatgagccggaatttgcttcctctgtgcgtcgaccacacctgacatcagatgctgtcgcacttttgcgcgataacgtaacccctagggagaacgagctgtggaccagtctgggagactcctggaccagaccaggccttgagttgtcccctgaagagggcccaccctatcgtcctgaattcttctccggttgggaacctcccgtgacagacccccagtctcgggcctgggaggatcccgtagaaaaacagctacaacatgagcgaagaagaaggcaggtgactcaggcaacacagcaggggagaggctgggaggtgagaggacgcggaaggtctgcctggccgagactcactcggctgtcttacttcctgcaacagtctgcccctcaggtggccgtaaatgggcatagagatctggaaccagaaagtgagccccagctggaaagtgagactgctggaaaatgggtgttgtgtaactatgattttcaggcacgaaactccagcgagctttccgtgaagcagcgagacgtgttggaagtgctggatgactcgcgcaagtggtggaaggtcagggacccagcgggccaggagggctacgtcccatacaacatcttaaccccttacccgggcccacggttacaccatagccaatcacccgcccgaagtctaaatagtactcctcctccccccccagctccggccccagctcctcctccagccctggcccggcctaggtgggatcgcccaagatgggattcctgtgattcgctgaatggtctggatccatccgaaaaagaaaagttctcgcagatgctgatcgtaaacgaagagctgcaagcacggcttgcccaggggagatccggcccaagccgcgcagtccctggtcccagggctccagaaccccagctctcgcctggaagcgacgcctctgaggtgcgcgcctggctgcaagcaaaggggttcagtagcggaactgtcgacgcactcggtgtgctgaccggagcgcagctcttttccctccagaaggaggaactgcgagctgtgtctcctgaggagggagcccgggtatacagccaggttactgtgcaaagatccctgcttgaggacaaagagaaagttagcgagcttgaggccgttatggagaagcagaaaaagaaggttgagggcgaggtggaaatggaagtgatttag

SEQ ID NO: 17829 - DNA, 1425 bp, Artificial Sequence
  Description of Artificial Sequence: Synthetic coding sequence
atggccagtctgtcccgcgctctaagagtggccgctgcacatccacggcagagccccacccggggcatggggccgtgtaacttgtcctcggccgctggacccacggccgagaagagtgtgccgtaccagcgcactttgaaagaaggccagggtacgagcgtggtggcacagggaccgagcagaccactgccttccaccgccaatgttgttgtgatcgggggaggcagcctgggatgccagactctctatcacctggctaaattgggtatgtctggcgctgtcctgttggaaagagagagattgacaagcgggaccacctggcatacagctggtctactctggcagctccgccccagcgatgtcgaggttgaactgctagcccacaccaggagggtggtttccagggaactggaagaagaaacgggcctgcacacagggtggatccaaaatggaggattatttattgccagtaatcgccaacggcttgatgagtataagcgactgatgagccttgggaaagcttacggcgtagaaagccacgtgctgagtcccgccgaaaccaaaacactgtacccacttatgaacgtggacgacctttatgggactctttacgttcctcacgacggaacaatggaccccgcagggacttgtaccaccttggcacgggccgcctccgcccgcggcgcccaggtcattgagaactgtcccgtaactggtataagagtctggacagacgattttggcgtgcgccgcgttgccggggtggagactcagcacggttctatacagacgccctgtgttgtaaactgtgctggagtctgggcgagtgccgtcggccggatggctggcgtgaaagtccctctcgtagccatgcaccacgcctatgtcgtcacagagcggatcgagggcatacagaacatgccaaacgtcagagaccacgatgctagtgtataccttaggctgcaaggtgatgcactctcagtcgggggttatgaggccaatcctatcttttgggaggaagtctccgacaagtttgccttcggcctatttgatctcgactgggaagtgttcacacagcacattgagggcgccataaatcgggtcccagtactggagaagactggtattaagagcacggtctgcggccctgagagtttcacgccggaccataaacctctgatgggagaggctcctgagctgcgggggtttttcttaggatgtggctttaactctgctggaatgatgctgggcggagggtgcggccaagaattagcccactggatcattcatgggagacctgagaaggacatgcacgggtatgatatccggagattccaccacagcttaaccgaccatccaagatggatccgcgagcgaagtcacgagtcttaccaagagctgctgcggcgactgccgcctcgatag

SEQ ID NO: 17830 - DNA, 1893 bp, Artificial Sequence
  Description of Artificial Sequence: Synthetic coding sequence
atgtcaatcgaactgcagtcggtctccaacccggtccaccgcaaggacttggtgatccgcctgacagacgacacagaccccttcttcctgtacaacctagtgatttccgaagaagactttcagagtctgaaattccagcagggcttactagtggatttccttgcttttccacagaagttcatcgacctgttgcagcagtgtacgcaagagcacgccaaggaaatccctcgctttctactgcagctggtttccccagccgccatcctggacaatagtcccgcgttcctgaatgttgtggaaactaatccttttaagcatctgactcacctatctcttaagctgttacctggaaatgacgtggaaatcaaaaaatttctagctggctgtctaaagtgttccaaggaagagaagctgtctttgatgcaaagcctagatgatgcaacaaaacagctggacttcacccgcaagaccctagccgaaaagaagcaggagttggataagctgagaaacgagtgggctagccacacagcagccctaactaacaagcattctcaggagctgactaacgagaaagagaaggccctgcaggctcaagtgcagtaccagcagcaacatgagcagcaaaagaaagaccttgaaatcttacaccagcaaaatattcatcagctgcaaaaccgtctgtctgaacttgaggctgccaacaaagatctgaccgaaaggaaatataaaggtgatagcaccataagggagctaaaggccaagctctccggcgtcgaggaagagctccagagaacaaagcaggaagtcctttccctgagacgtgagaacagcacattagacgtagaatgccacgaaaaggaaaagcacgtcaaccagcttcagaccaaagtagccgtgctggagcaggagataaaggataaagaccagctggtgctgcgtactaaggaggcttttgacaccattcaggagcaaaaggtggttctcgaggaaaacggcgaaaagaatcaggtccagcttggaaaattggaagcaactatcaaatcactgtccgccgaacttttgaaagctaacgagattattaaaaagctgcaaggcgacctgaagacgctgatgggaaaactaaagttgaagaacacagtgacgattcagcaagagaagctattggccgaaaaagaagagaagctccagaaggagcagaaggaactccaggatgttggtcagtctctgaggattaaagagcaggaggtgtgtaagctgcaggagcaactggaggctacagtcaagaaactggaggagtcgaaacagctgctaaagaataatgagaagcttatcacttggctcaataaggagcttaatgagaaccagctggtgaggaaacaggatgtgttaggcccatccacaacaccccccgcccattcttccagtaacactatccgttcaggaattagccccaacctgaatgtggtcgacgggagactgacgtatccaacttgcggaatcgggtatcccgtttctagcgctttcgcatttcagaatacattccctcattcaatctcagcaaagaacacttctcaccccggctccggcacgaaagttcaatttaacctacagttcaccaagcctaatgcatctcttggcgatgtgcaaagcggagccaccataagcatgccctgctcaacggataaggaaaatggagagaacgtagggttggagtctaagtacctgaagaaacgggaagactctatcccactgcgcggcttaagccagaatctttttagcaacagcgatcatcagagggatggtaccttgggtgcactgcacaccagttctaagcccactgccctaccttctgcgagctccgcatacttccctggccagttacctaactcctag

SEQ ID NO: 17831 - DNA, 1170 bp, Artificial Sequence
  Description of Artificial Sequence: Synthetic coding sequence
atggaccgagagacactgatcgatgtggccaggacctctctgagaactaaagtccacgctgagctggctgatgtcctcaccgaggccgtggttgattctatacttgccatcaaaaaacaggatgaacctattgacttgtttatgatcgagatcatggagatgaaacacaaatcagagactgatacaagtctgattagaggccttgttttggaccacggggctcgccacccagacatgaagaagcgtgtggaggatgcatatatactgacttgcaatgtgtcactagagtacgagaagactgaagtgaacagcggatttttctataagagtgccgaggagagagaaaaactggtaaaagctgaacggaaatttatcgaagacagagtcaaaaagattatcgaactaaaacgcaaggtctgcggcgactcagataaaggatttgtggtgattaaccaaaaagggatagatcccttctccctggacgcgctctccaaggaggggattgtggcactgcgccgagctaaacgcagaaatatggagcgactgacattggcttgtggtggcgtggcattgaactcctttgacgacctgtcgccagactgtctcggccacgcaggactcgtttacgagtatacattgggggaggagaagttcaccttcatcgaaaagtgcaataatcctcgatccgtgaccctgctgatcaaggggcctaataagcacactctaactcagattaaggacgccgtacgcgatggactgcgggccgtgaagaatgcaatcgatgacgggtgcgtggtccccggagccggggctgtcgaagtggccatggccgaggcccttattaaacacaagcccagcgtcaaggggcgggcccaactgggggtccaggcttttgccgacgcattgctgatcattccaaaagtcctcgcccaaaattctggttttgatctccaggaaaccctcgtcaaaatccaagcggaacactctgaatctgggcagcttgttggcgttgatctcaatactggggagccaatggttgccgcagaggtgggcgtttgggacaattattgtgttaaaaagcagctgcttcattcttgtacagtgatagcaactaatattttactggtggacgagataatgagagcaggaatgtcatctctcaagggatag

SEQ ID NO: 17832 - DNA, 441 bp, Artificial Sequence
  Description of Artificial Sequence: Synthetic coding sequence
atgactgtcaatgaggccaaggaaaagcttaaagaggcacctgaaggtacgttcctgatccgagattcttctcatagtgattacctgttaaccatttccgtcaagacaagcgctggacctacaaatctccgcattgagtaccaggacggaaaattccgactcgacagcatcatctgtgtcaaatccaaattaaagcagtttgactcagtcgttcatttaattgactattacgtccaaatgtgtaaagacaagagaaccggacccgaggcaccacgaaacgggaccgtgcatttgtatctgacaaaacctttatatacatctgcaccctcactgcagcacttatgtcgcctgaccatcaacaaatgtaccggagccatctgggggctgccactgcccacccgattaaaagactacttagaggagtataaattccaagtgtag

SEQ ID NO: 17833 - DNA, 1905 bp, Artificial Sequence
  Description of Artificial Sequence: Synthetic coding sequence
atgctagaatatgcgctgaaacaggagcgcgccaagtatcacaagctaaagtttgggaccgatttgaatcaaggcgagaagaaagccgacgtttctgagcaagtctctaacgggccagtggagagtgttactcttgaaaactcccccctcgtgtggaaagaggggagacaactactcagacagtacttggaagaggtgggatacactgataccatcttggatatgcgttcaaaacgcgtgagaagcctgctgggtaggagcttggaactcaacggcgcagtggaaccctcagaaggtgcccctagagcccccccagggcccgctggactgtcggggggagagagcttactagtcaagcagattgaagagcagattaaacggaacgccgcggggaaggacggaaaggagaggctgggagggtcagttctcgggcaaatcccatttttacagaattgcgaggatgaggatagtgatgaagacgatgagttggactcggtacagcataagaagcaaagagtgaaactgccttcaaaggctttggtgccagagatggaggacgaggatgaggaggacgactctgaagacgccatcaacgagttcgacttcctcggatcaggggaggacggagagggtgcacctgatccacgtaggtgtaccgtagacgggagcccacacgaactggaatcgcggagggtgaaactacagggcatacttgccgaccttagagatgtggacggcctaccacccaaagtgacagggccaccacctgggaccccacaaccgcgcccccacgaagatgtctttattatggacaccatcggcggcggcgaagtgtccttgggagatcttgcggatctgacggtcaccaatgataacgatctgtcttgtgacctgagcgatagcaaagatgcctttaagaagacttggaatccaaagttcacactgagaagtcattatgatggtatcaggtctcttgcctttcatcacagccagtctgctctgctcactgcctctgaggacgggaccttgaaattatggaatctgcaaaaagccgtcacagccaagaagaatgccgctctcgatgtcgaacccattcacgccttcagggcccacaggggccccgtgctggctgtcgcgatgggatcaaactccgagtactgctattctggcggggccgacgcatgcattcactcctggaaaatccctgacctttccatggacccgtacgacggttacgatccctcggtgctcagccacgtgctcgagggtcacggggacgctgtgtggggactggccttctcccctaccagtcagaggctcgctagctgcagcgctgacgggacagtccgcatatgggaccctagctctagctctcccgcctgtttgtgtacgttccccacagccagcgagcatggggtgccaactagcgtagccttcacaagtactgagccagctcacatcgtcgcatcatttagatctggtgatactgtgttatacgacatggaggtggggtcagcactgctgacactggagtctagagggtctagcggcccaactcaaattaaccaggtcgtgtctcacccaaatcaacctctgactatcacagcacatgacgaccgcggcatccgattcctcgacaacagaaccgggaaaccagtgcactccatggttgcccacctagacgccgtcacatgtctggctgtcgacccaaatggcgccttcttaatgtcaggctcacacgactgctctctgcgactctggagtctggataataaaacttgtgtacaagaaatcacggctcatagaaaaaagcacgaggaagctatccacgcagtggcttgccacccctccaaagccctcatcgcaagcgctggagccgatgctctcgccaaggtgttcgtctag

SEQ ID NO: 17834 - DNA, 1368 bp, Artificial Sequence
  Description of Artificial Sequence: Synthetic coding sequence
atgagttcccttggggcctcctttgtgcagataaagtttgacgaccttcagttcttcgagaactgcgggggaggcagttttggatccgtgtatagagccaaatggatctctcaggataaagaggtcgcagtcaagaaattactcaagatcgaaaaagaagctgaaatcttaagcgtgctatcccacagaaacataattcaattctatggagtgatcctggagccccctaactatggaattgtgaccgagtacgcctcactcggttcattgtacgattacataaactcgaaccgctctgaagaaatggacatggatcacatcatgacttgggcaaccgatgtggcgaagggaatgcattacctacacatggaggccccggtgaaggtcatccatcgcgacctgaagagcagaaatgtcgttatcgcagctgatggagtgctgaaaatttgcgattttggcgccagtaggtttcataatcatacaactcacatgtccctggtcggtacttttccctggatggcacccgaggtgattcaatcactacctgtgtctgagacatgcgatacatattcttatggtgtggttctctgggaaatgctgacacgggaagtcccattcaagggcctggaaggcttgcaagtagcttggctggtggtcgagaagaatgagagattaacaataccttcgtcatgtcctagaagcttcgctgagctgctgcatcagtgttgggaggccgatgctaagaaaagacccagctttaagcagataatctctattctggagagcatgtccaatgacacaagtctgcctgataagtgcaatagcttccttcacaataaagccgagtggagatgtgagattgaggcaacgcttgagagactaaagaagctggagcgtgacttgtctttcaaggagcaggaactgaaagagcgggagaggagattgaagatgtgggagcaaaagctgactgagcaaagcaacacgccgttactgctcccactggctgcgcgtatgagcgaggaaagttatttcgaatcaaagactgaagagtccaatagcgccgaaatgagctgtcagatcactgcgacctccaacggggagggacatggaatgaatccttcgcttcaggccatgatgctaatgggattcggtgacattttctcaatgaacaaggccggtgcggtgatgcactcgggcatgcaaataaacatgcaagctaagcagaatagctccaagaccacctcaaagaggaggggcaagaaggtgaacatggcattgggcttctctgatttcgacctcagtgagggggacgacgacgatgacgacgacggagaggaagaggacaacgacatggataactccgagtag

SEQ ID NO: 17835 - DNA, 474 bp, Artificial Sequence
  Description of Artificial Sequence: Synthetic coding sequence
atgaagtctatgtctcaactcgccgtcttgtctcgcagatggaagccctcagaaatgaagttggatccatttcaggaggtggttctggagtcatccagtgtggacgagcttagggaaaagctcagtgagatttccggtataccactcgacgatatcgaattcgcaaaaggaaggggcactttcccttgcgacatttcagtgctggatatccatcaagacttggactggaacccaaaggtatcgacattaaatgtatggccactctatatatgcgatgatggtgctgttatcttctacagagataaaaccgaggaattgatggagctgaccgatgaacagaggaacgagttaatgaaaaaggagtcgtcccggcttcaaaaaactggccacagggtgacctattcccctcggaaggaaaaggcacttaaaatctacttggatggggcgccaaacaaagacttgacacaagattag

SEQ ID NO: 17836 - DNA, 1083 bp, Artificial Sequence
  Description of Artificial Sequence: Synthetic coding sequence
atgaaggctaccgctatgacgtccgcctggctggctcaaggtacaggagagggggtgaacgacgtaaggaaaggcgcgtgcgccagccatgtgtcaaccatggcctcttttctgaaaggtgcacacgtgacaattaatgcccgagctgaagaagatgtggaaccagagtgtattatggagaaagttgctaaagcctctggcgcaaattattcgtttcataaggagtctgggcgctttcaggacgttgggcctcaggcccctgtcggctccgtttatcagaagacaaacgccgtgtcagagattaagagggtggggaaggactcattttgggcgaaggccgagaaggaagaagagaatcgccggttggaggagaagcgcagagccgaagaagcacagaggcagctcgagcaggagcgtagagagcgcgaactgcgggaggctgcaagacgtgagcagagatatcaggaacaggggggcgaagctagtcctcagaggacttgggagcagcagcaagaggtagtgagcaggaaccgtaacgagcaagagagcgccgtgcacccaagagaaattttcaagcaaaaggagcgggcaatgtccacaactagtattagttccccccagccaggcaagctgcgctccccgtttctgcaaaaacagctgacccaaccagaaacccatttcggccgggagccagccgcagccattagtcgccccagagcggacctgccggccgaagagcccgctccctccacaccaccatgccttgtgcaggctgaagaagaagcagtgtacgaggaaccaccggaacaggaaactttttatgagcagcctcctctagtgcagcagcagggcgccggctcggaacacatcgatcaccacatccagggacagggtctgtccggacagggcttgtgcgccagagccctgtatgactatcaggcagcagatgatactgagatcagtttcgaccccgaaaacctgataacaggaattgaggttatcgatgagggctggtggcgtggttacggaccggacggccattttggcatgttccccgcgaactacgtggaactcattgagtag

SEQ ID NO: 17837 - DNA, 291 bp, Artificial Sequence
  Description of Artificial Sequence: Synthetic coding sequence
atgtgccacacgtcctgctcaagtggatgccagcccgcctgctgcgcacccagcccatgtcagcccgcatgctgcgtgcccgtctcatgtcagagctccgtatgtgttcctgtcagctgccgtccaatcgtttgcgcggccccctcctgccagtctagtttgtgcgtgccggtgtcttgtcgcccagtcgtgtacgcagcccctagctgtcagtctagtgggtgctgtcagccctcctgtactagcgtcctgtgtagacccatctcgtatagtatatcaagttgctgctag

SEQ ID NO: 17838 - DNA, 27 bp, Artificial Sequence
  Description of Artificial Sequence: Synthetic coding sequence
atgcccctttccagcccaaatgcctag

SEQ ID NO: 17839 - DNA, 384 bp, Artificial Sequence
  Description of Artificial Sequence: Synthetic coding sequence
atgtctagcagcatgtggtatattatgcagtcgatccagtcaaaatactcactcagcgagagactcatacgaactatcgccgccatccgttccttcccgcacgataatgtcgaggatctgatcaggggtggggctgacgtgaattgtactcatgggaccctaaaacctctgcattgcgcgtgtatggtcagcgacgctgattgtgttgaattgctgctcgagaagggcgccgaggttaatgctcttgacggatataataggacagctctgcactacgctgccgagaaggatgaggcatgtgtggaagtgctgcttgagtacggcgccaacccaaacgcactcgacggtaatagggatacgcccctccattgggcagcattctag

SEQ ID NO: 17840 - DNA, 318 bp, Artificial Sequence
  Description of Artificial Sequence: Synthetic coding sequence
caatggaccgccagcactgccacaatcacgaaagaaaaacaggatcaacctaagaaagatattagcaattatcaggtggaacaggcccaggtgttgttaaaaagagaaaaggaaattccccccaccgtgtttccaaatagaagtccctggtgccagaacccctacgtgtctgcccacccctattgccctctgatcgagccgcacaacacatctaccgccggggggcgcctagataggcagccaaggaccaggtctactagaccaaatagagctagtggctccaagaagaagaagacatcagaatcccagaaacagtag

SEQ ID NO: 17841 - DNA, 1116 bp, Artificial Sequence
  Description of Artificial Sequence: Synthetic coding sequence
atggaagaagagggactagccgacgaagaggtgcggttggttcaaaaaaaggacactggacacatttacgccatgaaaatcttgaggaaatccgacatgctcgagaaggaacaggtggcccacatccgagcagaaagagatattttggtagaagccgatggtgcttgggtggtgaagatgttctactcttttcaggacaagagaaatttatacctcattatggagttcctgccgggcggagacatgatgacactgttaatgaagaaggacacactgactgaagaagagacccaattctacatcagtgagaccgtgctcgctattgacgcgattcaccagctcggctttattcatcgcgatataaagcccgataacctgctcttagacgccaaagggcatgtaaagctctctgacttcggcttgtgtactgggctcaaaaaagcgcataggactgagttctacaggaatctgacccacaacccacctagtgatttctcctttcagaacatgaactccaaacgcaaagccgagacctggaaaaagaaccggaggcagttggcctattcgactgttggcaccccagattatatagcccccgaggttttcatgcagactggctacaataagttatgcgattggtggtcactgggcgttatcatgtatgagatgctcatcgggtacccacctttctgctcggagacccctcaggaaacctatcggaaggtcatgaattggaaagaaacacttgtgttccctcctgaagtccccatttccgagaaagctaaagacctaatcctgaggttctgtattgatagtgagaataggattgggaattcgggcgttgaagaaattaagggccatcccttttttgaaggtgttgactgggaacatatcagagaacgcccggctgccattcccattgagattaagtctattgatgatacatccaatttcgatgatttccccgaatcagatatcctacagccagttcctaatactacagaaccagattacaagtccaaagattgggttttcttgaattacacgtacaagcgatttgaaggcctgacccagagaggaagcatccctacatatatgaaggccggaaagttgtag

SEQ ID NO: 17842 - DNA, 564 bp, Artificial Sequence
  Description of Artificial Sequence: Synthetic coding sequence
atgaacaataccctcaggaaagacggaaagaaggattgctgttttgagatcagtgcaccagacaaaagaatatatcagttcacagcggccagtcctaaggacgccgaggaatgggtgcagcagctgaagtttgtcttacaagatatggaaagcgatatcattccagaagactatgacgagcgaggagagctatacgatgatgtagatcaccctctgcccatcagcaacccgctaacttcaagtcaacccatcgatgacgaaatctacgaagagcttccagaggaagaggaggactcagcgcccgtgaaggttgaggaacagcggaaaatgagtcaggacagtgtccaccacacgtccggtgacaagtctaccgactacgcaaacttctatcagggtttgtgggactgcacaggggcatttagcgacgagcttagcttcaaaaggggtgacgttatctatatattatctaaggagtacaataggtacgggtggtgggttggggaaatgaaaggggcaattggccttgtccccaaggcctacatcatggaaatgtatgatatttag

SEQ ID NO: 17843 - DNA, 219 bp, Artificial Sequence
  Description of Artificial Sequence: Synthetic coding sequence
atggcattgagcctgggctggaaggcacaccgcaaccactgcggactactactacaggcattgagatccagtggtttacttttgtttccttgcggccagtgtccatggcgcggcgctgggtcattcctagacccggaaatcaaggctttcctggaagaaaacacggaggtaacaagtagtggatccctgacacccgagatccagctgcggttgctctag

SEQ ID NO: 17844 - DNA, 2919 bp, Artificial Sequence
  Description of Artificial Sequence: Synthetic coding sequence
atggcagccgctgctgcagaacaacagcagttctacctgttgctagggaacttactttcccccgataacgtcgtgcgcaagcaggctgaggagacctatgaaaacatccctgggcaaagtaagataactttcctcctacaggctatacgcaataccacagccgctgaggaagccaggcagatggcagctgttcttttgagacggttactgtcttccgcatttgatgaggtgtacccagcacttccgtccgacgtgcagaccgcgataaagaatctgttgcccgggttcctgcaagccgtgaatgactcttgttaccagaatgatgactcagtcctgaagagccttgtagagatcgctgatacagtgcccaagtatctgaggccccacctggaagccacgctccagctttcgctgaaactatgtggagacacctccctaaacaatatgcaacgccaactggcccttgaggtaatcgtcacactgagcgaaacagcagccgccatgctacgcaagcacaccaacatagttgcgcaaactatcccgcagatgctcgctatgatggttgacttagaagaagatgaggactgggccaacgctgatgaactggaggacgacgactttgatagcaacgcagtagctggtgagtccgctctggataggatggcatgcgggctaggcgggaagctcgtcttacccatgatcaaagagcacattatgcagatgctgcagaatccagattggaaataccgtcacgccggcttgatggctctctccgctatcggtgagggctgtcaccaacaaatggagggtatccttaacgagatagtgaactttgtcctgttatttctacaggacccccaccccagagtgagatatgcagcctgtaacgcagttgggcagatggccaccgattttgctccaggatttcagaagaaatttcacgaaaaggtgattgccgctctgctgcagactatggaggaccagggaaatcagcgggtgcaggcccatgctgccgccgcactcattaatttcacggaagattgcccgaaatcactactcattccctacctcgataatttagtcaaacacctacatagcatcatggtgttgaaactgcaagagcttatccaaaaagggacgaagctggtgctggaacaggttgtaacgtctatcgcatcagtcgcagatactgcagaggaaaaatttgtgccttactatgaccttttcatgccctcactcaagcatatcgtcgagaacgctgttcagaaggagctacggctcctgaggggcaaaaccatcgagtgcatctctctgatcggacttgccgtaggtaaggaaaagtttatgcaggatgcttcggacgtgatgcagctgctgctgaagacgcagactgacttcaacgatatggaggatgacgaccctcagatctcatacatgattagcgcatgggcgagaatgtgcaaaatccttggaaaagagtttcaacagtacttgccggtggtgatgggcccattgatgaagacggcctctatcaagcctgaggtggccctgctggacacgcaggacatggaaaacatgtcagacgacgacggctgggaattcgttaacctgggggaccaacagtcatttggcatcaaaacagccgggctggaggagaagagtaccgcctgtcagatgcttgtgtgttacgccaaggagcttaaagaaggttttgtagagtacacagaacaggttgttaaattgatggttccgctgcttaaattctatttccatgacggagttcgggttgccgccgccgaaagcatgccattactcttggaatgtgcgagagtaagaggacccgaatacctcactcagatgtggcattttatgtgcgatgccctgattaaggctatcgggaccgagcctgattccgacgtcctgagcgagatcatgcactcttttgccaagtgtattgaggtgatgggagacggttgtcttaacaacgagcactttgaggagcttggcggcatcctgaaggccaagcttgaggaacattttaagaatcaagagcttagacaagtcaaacgacaagatgaggactacgatgaacaagttgaggagtcattgcaggatgaggacgacaatgatgtttatattttgacgaaggtgtcagatatcttgcactctatcttcagctcttacaaggagaaggtcctgccgtggttcgaacagctgctgcctttgatagtgaacctgatctgtcctcaccggccttggcctgacagacagtgggggctctgtatatttgacgacgtgatcgagcactgctcacccgcgagcttcaaatatgccgagtattttctgcgccctatgctccaatatgtgtgtgataactccccagaggtacgacaagccgctgcctatgggctgggcgtgatggcgcagtatggtggcgacaattatcgacctttctgtacagaggcccttccactcctggtcagggtgattcaatccgctgatagcaaaacgaaagaaaacgtgaatgccactgaaaattgcataagcgctgtcggcaaaattatgaagtttaagccagactgtgtgaatgtcgaggaagtcttgccacactggctgtcttggctacctttacacgaagacaaggaagaggcggtccagactttcaattacctgtgtgatctcatcgaatccaaccacccgatcgtgctgggtcctaataatacgaatctacctaagattttcagtattatcgctgaaggcgaaatgcacgaagctattaagcacgaagacccatgtgccaaaagactggcaaacgttgtgcggcaagtgcagacatccggcggcctgtggactgaatgcattgcacagctcagcccagaacaacaggcagcaattcaagaactgttgaatagtgcttag

SEQ ID NO: 17845 - DNA, 1428 bp, Artificial Sequence
  Description of Artificial Sequence: Synthetic coding sequence
atgcaggtaaccttcatatacgtgtgcctcaagggactgatgcttcaggacttggtaagcgccaagctgatcagcgattacactgtgaccgaaatccctgatacgatcaatgatttgcaggggtctactaaggtcctgcaggccgtgcagtggctagtgtctcactgcccccacagtcttgacctgtgctgtcagactctgattcagtacgtggaagatggaatagggcatgagttctcagggcggtttttccatgatcgtagagagcggagattggggggccttgcgtcccaggaaccaggagcaattatcgaactgttcaacagcgtgctgcaattcctggcgtccgtggtgtccagtgagcagctgtgtgacctgagttggccagtgaccgagtttgccgaggcaggtggatccaggttactgccccacctccattggaacgctcctgaacacctggcttggctgaagcaagccgtgctggggtttcagctgcctcagatggacctgccacccctcggcgctccttggctgcccgtgtgcagcatggtggtgcaatacgccagccagatcccaagctccagacagacgcaacccgtactgcagtcgcaagtggagaatctactgcatcggacatattgtcgctggaagtcgaagagtccctccccagtccatggtgcaggtccctccgtgatggaaattccgtgggatgacctgattgcgctgtgtattaaccataagctgagggattggacccctccacggcttccagtgacaagcgaggcgctgagcgaagatgggcaaatctgtgtttacttttttaaaaatgatcttaagaagtacgacgtccctctgagttgggagcaggcacggctccaaacacagaaagaacttcagttgcgcgaaggccgattggcaattaagccatttcacccctcagcgaataatttccccattcctctccttcatatgcatagaaattggaagcgttctactgagtgtgctcaggagggacgaattccttccaccgaggatctcatgagaggggcaagtgccgaggaactactggcacaatgcctctcgtcttcgctcctgctggagaaggaggagaataagcgcttcgaggatcagctgcagcagtggctctccgaagactcgggcgctttcacagacctcacctccctgccgctgtatctccctcagaccctggtctcactgtcccacacgattgagcctgtgatgaaaacaagtgttaccactagcccccagtccgatatgatgagagaacaactccagctgagcgaagcaactggcacttgcttgggcgaaaggctgaagcatttggaacgcctcatacgaagttctagagaagaggaagtggcttcggagctccatctttctgctttgttagatatggttgatatctag

SEQ ID NO: 17846 - DNA, 333 bp, Artificial Sequence
  Description of Artificial Sequence: Synthetic coding sequence
atgagcactgcactgacccacaccacggtggcgatgagatgccctatgggcgggggcggcggacccacgtatggtccaccccagccatgggggcatcctgacgtccacatcatgcaacaccacgtgctgcccatccaggcacgcctgggatcaattgccgaaatcgacctgggcgtgcctccgcccgttatgaaaaccttcaaagagttcctcctgagcctggacgactccgtggacgagaccgaggccgtgaagaggtataacgactataaattggacttccgaaggcagcagatgcaggacttttttctggctcacaaagacgaggaatag

SEQ ID NO: 17847 - DNA, 828 bp, Artificial Sequence
  Description of Artificial Sequence: Synthetic coding sequence
atgagcgccgaagtcaaagtgactgggcaaaatcaggagcagtttttgctgctcgctaagtctgcgaagggggccgccctggctacacttatccatcaggtgttagaggcacctggagtctacgtgttcggggagctcctggatatgcctaacgtcagagaactcgccgagtctgactttgcatccacattccgactattaaccgtgtttgcctatggtacctacgccgattacctggctgaagcgcgcaacctgccacccctgacggaggctcagaagaacaagttgcgacatctgtcagttgtaactttggccgccaaggtgaaatgtatcccctacgcagttcttctagaggcccttgcgctccgaaacgtgcggcagctagaggacctggtcatagaggccgtgtatgccgatgtgttacgcggatcccttgaccagcggaaccagagattggaggtggactatagtattggccgcgacatccagcgccaggacctttctgccattgcccgtacccttcaagaatggtgtgtggggtgtgaggtggtactcagtggcattgaagaacaggtctcccgtgccaatcagcataaagagcaacagttgggcctaaagcagcagatcgagtccgaggttgcaaacctgaaaaagaccatcaaggtgaccacagccgcagccgccgctgccacaagtcaagatcctgaacagcacctcacagaactgcgggaacctgctcctggcactaaccagcggcagccctctaagaaagctagcaagggtaaggggctgcgtggaagcgcaaaaatatggagcaaatcaaattag

SEQ ID NO: 17848 - DNA, 876 bp, Artificial Sequence
  Description of Artificial Sequence: Synthetic coding sequence
atgatcggagacggagaagattactttctgagtctgttcggagactctaagaaactgaccgctcatagcaactacactcagaagacactaaaatacttctctatgattctggaggaagtgggacaattcacctcatcttcacttggagatgttgagatcgccgaggtcaatgtgaaagggctgttcgtcaaactgataaactcaagtctcgataaggagatggctatcggggatcacattctccagcagaatgtgaacgggcagacgatcagtctgtatcggtttctccctaacattgtcatgcaagccaattctacagtaaccgtctgggccgctgcctcagaagccaagcaccagcccccatctgatttcctctggaaggaacaagacaagtttcgtgcaagtccggactgtatcaccatactctgtaagcccaacgggcaagctattgcctggtacacccctatacattggaaacaagcctgggaaaagctggatgcggatgtagaattcaacagatgctctgttgttagccctacattcagaaagagagtctttcagtggaccgcttccactgctactattactaaggaaaaacaggaccagccgaaaaaggacatttccaactaccaggtggagcaggcacaagtgttgttaaagcgggagaaggagattcctccaaccgtgtttccaaaccggtccccatggtgtcagaacccttacgtcagcgcgcatccttactgtcccctaatagagccccataatacgtcaacggctggcgggaggctagaccgacaaccccgtacccgctccacgcgccctaatcgtgcttccggtagtaaaaaaaagaagacaagcgaatcccaaaagcagtag

SEQ ID NO: 17849 - DNA, 1185 bp, Artificial Sequence
  Description of Artificial Sequence: Synthetic coding sequence
atggtcccatcccaagctccatacctagtgcctgcattcccactgcccgccgctacaagccccggccgtgagtatgcagctccaggaacagctcccgaaggattgcatggtttgccgttgagcgaaggtctgcaaccgtacccagcttttccattcccttacctggatacatttatgactgtgtttctgccagacccaccggtctgccctttgctatcacccagcttcctgccttgcccttttctcggcgcaaccgcatcctccgctatctccccttcaatgtcttccgctatgtctcctaccctggatccgcctccctctgtgacatcccagagaagagaggaggagaagtgggaagcccaaagtgagggccacccgttcatcaccagtagatcgtcttccccactccagctgaacttactgcaggaggaaatgccccgcccaagcgaatcaccagaccaaatgcgaaggaatacctgtcctcagacggagtactgcgtgacaggtaacaacgggtccgaatcaagcccagctacaacaggcgcattgtcaaccgggagcccgcctcgtgaaaatccgagccatccaaccgcatccgccctgagtacaggctctccccccatgaagaatccctcccaccctaccgccagcacgctaagtatggggctacccccgtcgagaacaccatcgcaccctactgcgacggtcctgtctacaggcagtcctccaagcgaatcaccaagtcgaactggctcggcggcctctggaagcagcgatagctcaatatacttgacgagttcagtgtattcctctaagatatcacaaaacggtcagcagtctcaagacgtgcagaaaaaagagacctttccaaacgtggctgaagagccgatctggcgaatgatcaggcaaacccccgagcgtatcttaatgacctatcaggttcccgagagggtaaaagaggtggtgctgaaggaagacctggaaaagctagagagtatgaggcagcaacagccacagttctcccacgggcaaaaggaggaactggccaaggtctacaattggatccagtctcagaccgtgacacaggagattgacatccaagcctgcgtaacatgtgagaacgaggactcagccgacggagcagctacctcatgtggacaggttctcgttgaggacagctgctag

SEQ ID NO: 17850 - DNA, 2424 bp, Artificial Sequence
  Description of Artificial Sequence: Synthetic coding sequence
cagggggcgtcattcgccttggctgctgctgccgcattgctgtttggctctgatatggaagatggaccgtctaacaacgcttcctgttttcgcagactcacagaatgctttttgtccccgtcgcttacagacgagaaggtgaaggcctacctatccttacaccctcaggtgctggacgagttcgtgtccgaatctgtttctgccgaaactgttgagaagtggctgaagaggaagaataataagtcagaagatgaatccgcgcctaaggaagtttctagataccaggacaccaatatgcaaggagtggtgtatgaactcaacagttatattgagcagcggctggacactggcggtgataaccagttgctcttgtacgagctctcctccatcatcaagatcgcaaccaaggcagacggattcgcactctattttttgggcgaatgtaacaattccctgtgtatcttcaccccgcccgggattaaggagggcaaacctagacttattcccgccggacccatcacccagggcactacagtctccgcatatgtcgcgaaatcccgtaagacactgcttgtggaagatatcctgggagacgaaagatttcccagggggacgggcctcgagagcggaaccaggatccagagcgtgctctgtctccccatcgtgaccgcaattggagatctgatcggaatactggagctgtacagacactggggcaaggaggcattttgtctgtcccatcaagaggtggcgaccgccaatctcgcttgggcttctgtggctatccaccaagtgcaggtgtgtagaggtctagccaagcagacggaactaaatgattttttgctagacgtgagcaagacctacttcgataacatagtggccatcgactcattgttagaacacatcatgatctacgctaagaacctcgtgaacgcagacaggtgcgccctttttcaggtcgaccacaagaacaaggaactatactcagacctgtttgatatcggagaagaaaaagagggcaaaccagtcttcaagaaaaccaaggaaattcgcttctctattgaaaaaggcatagcagggcaggtggcacgtacaggcgaagtgctgaatatcccagacgcctacgctgaccccaggtttaatagggaggtcgacctttataccgggtacactactcgcaatatactgtgtatgcctatcgtgagccgcggcagtgtgatcggggtcgtccagatggtcaataaaatctccgggtccgccttctctaaaactgacgagaataattttaaaatgtttgcagtcttttgtgccctggccctgcattgcgcaaacatgtaccataggattcgacattctgagtgtatttaccgagtcactatggaaaagctttcctatcactcaatctgcactagcgaggagtggcagggcctcatgcagttcaccctccccgttcgcctgtgtaaggaaatagagttgttccacttcgacattggcccattcgagaatatgtggcccggaatcttcgtatatatggttcaccgttcctgcgggacatcatgcttcgaattggagaagctgtgtagattcataatgtcagtgaagaaaaattataggagggtcccctaccataattggaaacacgccgtcaccgtggcccactgtatgtatgccatcctccaaaacaatcacactttgttcacagatcttgagagaaagggtctgctcatcgcatgcctgtgtcacgacctcgatcacagaggattttcaaactcctacctgcagaaatttgaccacccccttgcggccctgtattcaacgtctacaatggagcaacatcacttctcgcagactgtcagcattctccagctggaaggacataacatcttcagcacactgagcagcagcgagtacgaacaagttctggagatcatacgcaaagccatcatagccactgatctcgccctgtatttcggtaatcggaagcaactcgaggagatgtatcagacaggcagtctgaacttgaacaaccagtcccatagggaccgcgtgattggcctgatgatgactgcttgcgacctgtgttctgtcactaaactatggcccgttactaaacttaccgcaaacgatatttatgcagagttctgggccgagggggacgagatgaagaagctcggaatccagcccattcccatgatggatagggataagaaagacgaggtccctcaggggcagttgggcttttacaacgcagtggcgattccttgctacaccacactaacacagatccttccgcccaccgagcctctcttgaaagcctgtcgcgataaccttagtcagtgggagaaggtcatccgcggcgaggaaacagccacgtggatctcctcccctagcgttgctcaaaaggcagccgcctcagaagactag

SEQ ID NO: 17851 - DNA, 1677 bp, Artificial Sequence
  Description of Artificial Sequence: Synthetic coding sequence
atggcctcatgtcctgacagcgacaacagttgggtgttggccggcggcgaactgggaatctcgctgaacatgtgcctactgggggcccttgtcttgttaggcctgggcgtgctgctcttctctggcgggttgtcagagagtgagacagggccaatggaggaggtcgaacggcaggttctgcccgacccagaggtgcttgaagctgtgggcgaccggcaggacgggctaagggaacagctccaggctcccgtccctccagactcggttccaagcctgcagaatatgggcctcttactggataagttagccaaggaaaatcaagacattagactgttacaagcccagttgcaggcccagaaggaagaactccagagtctcatgcaccagcccaagggtttggaagaggagaacgcacagttacgcggagccttacagcagggggaggcctttcagagagctttagaatccgagctgcaacaactgcgtgcccgcttgcaggggctcgaggcggactgcgtcagaggacctgatggcgtgtgcctgtccggcgggcgagggccccagggagacaaagccatcagggagcaagggccccgcgagcaagaacccgagctgtcttttctcaagcaaaaggagcagctggaggctgaggcccaggctctgcgtcaggaactggaaaggcagcgccgactgctcggcagtgtgcagcaagatctcgagcggtccttacaggatgcaagcagaggtgatcccgctcacgccgggcttgcggagctcggacacagactggctcagaagttgcagggcctggagaattggggtcaggatcctggagtttcggcaaatgcaagcaaagcctggcaccagaaatcacacttccaaaattctagggagtggtccgggaaggaaaaatggtgggatggacagcgggatcggaaggccgagcactggaagcataagaaggaagaatctggccgcgaacgtaaaaagaactgggggggccaggaagatagagagcccgcagggcgctggaaggagggacggccccgggtggaagagtctggctccaagaaagaggggaagcgacagggccccaaggaaccgccacgcaaatcagggagcttccacagctctggcgagaaacagaagcaacctcggtggcgggaagggaccaaagattcgcacgacccactgccatcttgggcagaactactgcgcccaaagtacagggccccacagggttgcagcggcgtcgacgaatgtgcaagacaagagggtctgacgttcttcgggacagagttggccccggtacgccagcaggagctcgccagtttgctgcgtacttatctcgccagacttccctgggccggccagctgaccaaagagttaccactaagtcccgcctttttcggcgaggatgggatatttcggcatgaccggctgcgttttcgggacttcgtggacgctctggaggattcgctggaggaggtggctgtgcagcagaccggagacgacgacgaagtagatgactttgaagattttatcttctctcactttttcggcgataaggcgctgaaaaagagaagcggaaaaaaggacaagcatagccagagcccgcgagccgcggggccccgcgaaggacacagtcatagtcaccatcaccatcaccggggttag

SEQ ID NO: 17852 - DNA, 1881 bp, Artificial Sequence
  Description of Artificial Sequence: Synthetic coding sequence
atgggaaacgccgcaggtagtgcagagcaaccagctggcccagccgctcctcccccaaaacagcaccgctttgagaagctcatggaatatttccgcaatgaggactccaacattgacttcatggttgcttgcatgcagttcattaatatcgtggtgcatagcgtagagaacatgaactttcgtgtcttcttgcagtatgagttcactcacctgggactggacctgtacctggagcggctgagacttacggagagtgacaaacttcaggtccaaattcaagcgtacttagacaatatttttgacgtaggggccttgcttgaggacactgaaaccaagaacgcagtgctggaacacatggaggagctacaagaacaggtcgcactgttgactgaacgcttgagagacgcagaaaatgagagcatggccaagattgctgaactggagaagcagctttcccaggcacgcaaagaattagaaacattgcgagagcgattctctgagtcaactgctatgggacccagcagacggccacctgaaccagagaaggccccacctgcagcccccacccgcccttctgcattggaactcaaggtggaggaactcgaagagaagggattaattagaattctccggggtcccggcgatgccgtgtcaatcgagatcctcccagtggcagtcgctaccccaagcgggggggacgcacctacccccggggtgcccacgggctccccctcccctgatcttgctcccgctgccgagcctgccccgggagccgcaccaccgccacctccgccccctcccggtggcccacctgatgctcttggcaggcgggacagtgaacttgggcccggggtgaaggctaaaaaaccaattcagacaaaatttaggatgcctctgctcaactgggtcgcccttaagccttctcagatcacaggcaccgttttcaccgagctgaatgatgaaaaggtcctccaggagctggacatgtctgatttcgaggagcagttcaagactaagtcgcagggccccagtctcgatctgtccgctctcaagtccaaagctgcacagaaagccccaagcaaagccacactgatcgaggctaaccgggcaaagaatctggcaataaccctcaggaagggcaatctgggggctgagcgaatctgccaggccatagaggcttatgacctacaggccctgggcttagactttttggagttattaatgcgcttcttgccaactgagtatgagcggtcactgataacccgttttgaacgggagcaaagacctatggaggagctcagcgaggaggaccggttcatgctgtgcttcagcagaatcccacggctccctgaacgtatgaccacgctgacgtttctggggaacttccccgatacagcccaactgctgatgcctcaactcaatgccatcatcgctgcctccatgtcgatcaagagtagcgacaagctgagacagatactggaaatcgtgttagccttcggtaactatatgaactcctcaaagcgcggcgccgcgtacggcttcagactgcagtccttagacgctctgctggagatgaagagtaccgaccgcaagcaaaccctccttcattatctggtgaaggtaatcgctgaaaagtacccacagctgactgggttccattctgatttgcattttttggacaaggcaggtagcgtgagtctggatagcgttctggccgatgtccgctcactgcagcgtggactggaactgacgcagcgcgagttcgtccgtcaggatgactgtatggtcctgaaggagttcttgagagccaattcacccaccatggacaaattgctcgccgactcaaaaacagcacaggctgtccccaccgggggcctgtag

SEQ ID NO: 17853 - DNA, 1500 bp, Artificial Sequence
  Description of Artificial Sequence: Synthetic coding sequence
atggataaactgatagtggacggacgtggaaaggccaccatcagtaacgacggtgccacaatcctgaagctgcttgacgtcgtgcacccagccgcaaaaaccctagtcgacattgctaagtcccaggatgccgaagtcggcgacggcaccacaagcgttacgctgctcgcagcagaattcctgaaacaggttaagccatatgtggaagagggtctgcatccgcaaataatcattagagcctttcggacagccacccaactggccgtgaataagattaaggaaatcgccgtcacagtaaagaaggccgacaaagtcgaacagagaaagttactggaaaaatgtgccatgaccgccctatcttctaagctgatctctcagcagaaagcgtttttcgctaaaatggtggtagacgccgtcatgatgcttgatgatctcctacagctcaaaatgatcggtatcaagaaggtgcaggggggtgctctggaggacagccagttagtggcgggggttgcgttcaagaagactttttcatatgccggcttcgaaatgcaacctaagaagtaccacaatcctaagatcgctttgctgaatgtagagctggaattgaaggctgagaaggacaatgccgagatcagggttcatacagtcgaggactaccaggctattgtggatgccgagtggaatatcctatatgacaagctggagaagattcaccatagcggagccaaggtggttttgtccaaattgcccataggagacgtcgctactcagtacttcgccgatcgtgacatgttttgcgcaggtcgggtgcccgaggaggacttgaagcgcacaatgatggcctgcgggggcagcatacagacatcagtgaatgcactgagtgcggacgttcttggtcgctgccaggtctttgaggaaacccaaataggcggcgaaagatacaattttttcaccggctgccctaaagccaagacctgtacttttatcctgagaggcggcgcagaacaatttatggaagagactgagaggagcctgcatgatgctatcatgattgtgaggcgagccatcaaaaatgacagcgttgtggccggaggcggcgctatcgaaatggagctgagcaaatatcttcgcgattactcacgcacaattcccgggaaacaacagctacttattggcgcctatgctaaggcactcgagatcatccctcggcagctttgtgacaatgcaggattcgacgcaacgaacattcttaataagctccgggcccggcacgcacaaggcggtacatggtacggtgtcgacattaataatgaggacatcgctgataacttcgaggcattcgtgtgggagccagccatggtccggattaacgcgctgactgccgcttctgaggcagcctgtctgatagtaagcgtcgacgagactattaagaatccgcgttccactgtagacgcaccaacggcggcagggagaggcaggggacgtgggcgaccccactag

SEQ ID NO: 17854 - DNA, 78 bp, Artificial Sequence
  Description of Artificial Sequence: Synthetic coding sequence
atggcgcacgagatgatcgggactcagatagtaacagaaaggctggtcgctctgctggagtctggtactgagaagtag

SEQ ID NO: 17855 - DNA, 633 bp, Artificial Sequence
  Description of Artificial Sequence: Synthetic coding sequence
atggagaaaacggagctgattcagaaggcagtggcctacaaaaatgtcgtgggaggtagacggtccgcatggcgagtaatttctagcatcgagcagaaaacagatacctcagataagaagttacagttgatcaaagactacagggagaaagttgagtctgagctgcggtccatctgcaccactgtcctcgaattgctagacaagtatctcatcgcaaacgctacaaaccccgagagtaaggtattctaccttaaaatgaagggagactattttaggtaccttgccgaggtggcttgcggggatgaccgtaaacaaacaatcgataattcacagggagcttatcaggaggcattcgatatctcgaaaaaggaaatgcagccgacacaccccattcgcttgggactggccttgaactttagcgtgttctactacgagatcctgaataatcccgagctggcatgcacactggctaaaacggcctttgatgaggccatcgccgagctcgacaccctcaacgaagatagttacaaagacagcactctgatcatgcaactgctccgagataacctcacgctctggacatccgacagtgcaggggaggagtgtgacgctgcagagggcgcagagaattag

SEQ ID NO: 17856 - DNA, 501 bp, Artificial Sequence
  Description of Artificial Sequence: Synthetic coding sequence
atggatctgatgccattcattaacaaagcaggctgcgaatgcctcaatgaaagcgatgaacacggatttgacaattgcctgagaaaggataccacatttctggaaagtgattgtgatgaacagctgctcatcactgtggcgtttaaccagcctgtaaagctgtattctatgaagtttcaaggtcccgacaatgggcaaggcccgaaatacgtgaagatctttataaatcttcccagaagcatggatttcgaggaggctgaacggtcggagcctacccaagctctggagctgactgaggatgacataaaagaggatggaattgtgccactgaggtatgtgaaattccagaatgtaaatagcgtgacaattttcgtgcaatcaaatcagggcgaagaagaaaccaccagaatttcctacttcacctttatcggtacacccgtccaggctaccaacatgaacgatttcaaacgtgtggtcgggaagaaaggcgagtctcattag

SEQ ID NO: 17857 - DNA, 639 bp, Artificial Sequence
  Description of Artificial Sequence: Synthetic coding sequence
atggcagcgccggaggagcgagatttaactcaggagcagactgaaaaactgctgcagtttcaggacttaacaggaatagaaagcatggaccagtgccggcacacactggaacaacataattggaacatcgaagccgccgttcaggatcggcttaacgagcaggaaggagtgccgagcgtgttcaatcctcctccttcgagaccccttcaggtaaatacagctgaccaccgtatctacagctacgttgtatcgcgcccacaaccaagaggactgttgggctggggctattatctgattatgttgccctttcgattcacctattacacaattctggatatctttaggttcgcacttagattcatacgccccgacccacgttcccgggtcacagaccctgtgggagacatcgtaagctttatgcatagttttgaagaaaagtacggtcgtgcccaccccgtcttctaccaaggcacatacagccaggccttgaatgatgccaagcgggagttgagatttcttctcgtctatctccatggcgatgatcatcaggacagcgacgagttttgcaggaataccctttgcgctcccgaggtaatcagtctgataaacacaagttcgcattccttcctgctgctttag

SEQ ID NO: 17858 - DNA, 1371 bp, Artificial Sequence
  Description of Artificial Sequence: Synthetic coding sequence
atggcagattccctggaatccacacccttgccatcccccgaggatagactggccaagctccatccaagcaaggagctgctggaatactatcagaagaagatggctgagtgcgaggccgagaacgaggacctgctgaagaagctggagctgtacaaggaggcctgtgaagggcaacacaagctggaatgtgacttgcagcagcgcgaggaggagatagcagagcttcagaaagccctgtcagacatgcaagtatgcctcttccaagagcgagagcacgtactgaggctgtacagcgaaaatgaccgcctcagaatccgagagctggaggacaagaagaagatccagaatctgttggcgttggtcgggacggacgccggagaggtgacctacttctgcaaagagcccccccataaagtgacgattttgcagaagacaattcaggctgtgggagaatgtgaacagtccgaatcctccgccttcaaagcggacccaaaaatttcaaagagacggcccagcagagagcgaaaagagagcagcgaacactatcagagggacatccaaacactgatcctacaggtggaagcccttcaggcccagctcggggaacagacaaaattgagccgagaacagatcgaaggactgatcgaggaccggcgcattcatctggaagagattcaagtgcaacatcagcgcaatcaaaacaagattaaggagttgaccaagaatctccaccacacgcaagaactcttatatgagtctacaaaggattttctgcagttgaggtctgagaatcagaataaagaaaaaagctggatgctggagaaggacaatctgatgtctaagatcaagcagtacagagtgcaatgcaagaaaaaagaggacaagattggcaaagtgttgcccgtcatgcacgagtcacaccacgcacagagtgaatatattaaaagtctaaaagacaagctggtccaagaaaagaagttgtccaatatgtaccaggagcagtgtatatcgttggaagaagagctggcaagaatccgcgaggaagaaggcatgcgacgagagatcttcaaagatcggactaataaaatgggaaagagactccagatcatgacgaaaagatacgaggccctcgagcggcggaggattttagaggtcgagggttttaagacagacatcaaagtgttgcggcagaaacttaaagatctggaacaaatgttatacaaagccactgtgaacgcccgcgcgaatcaggacctggccctcctgtgcgaagtgcgggacagtaataggcgggctcacaaaatccagggagagctgaaaaatctgaagtcaaaggtgtttggattggaaaacgagctgcggttatgttag

SEQ ID NO: 17859 - DNA, 183 bp, Artificial Sequence
  Description of Artificial Sequence: Synthetic coding sequence
atggacgagcaggccctgctgggcctgaacccgaatgcagattctgattttcggcagcgggcattggcgtactttgaacagctgaagatttcacctgacgcgtggcaggtttgtgcagaagccctggcccagagaacctatagcgatgaccacgtgaagttcttctgcttccaggtgctttag

SEQ ID NO: 17860 - DNA, 339 bp, Artificial Sequence
  Description of Artificial Sequence: Synthetic coding sequence
atgtcttcctccatgtggtatattatgcagtcaatacagtctaaatacagtttgtccgagcggttaatccgaaccatcgctgccattcgatccttcccccacgataacgtggaggatttgattaggggcggggcggatgtgaactgtacacacggtacacttaagcctctgcattgtgcgtgcatggtgtccgatgcggattgcgtagagttgcttctggagaagggtgcagaggtgaatgccttagacggttacaaccgaaccgccctccattacgccgccgaaaaagatgaggcttgcgtcgaagtgcttctggagtacggcgcaaatccaaattag

SEQ ID NO: 17861 - DNA, 1173 bp, Artificial Sequence
  Description of Artificial Sequence: Synthetic coding sequence
atgtcggcagcgaaccctgagactcctaatagtaccatttctcgagaggcctccacacagtcgtcttcagctgctgcttcacagggctgggtgcttcctgaaggaaagattgtacccaacaccgtgtttgtagggggtatcgacgctagaatggatgaaacagaaattgggtcttgtttcgggagatatggcagcgtgaaggaggtaaaaatcattactaatcgtaccggagtgagcaagggttacggcttcgtatccttcgttaatgacgtcgacgtgcagaagatagtaggctcacagatccactttcacggcaagaaactcaaactcgggcctgccattagaaaacagaagctctgcgcacgccacgttcagccgcgtcccttggtggttaaccctcccccgccgcctcagtttcagaacgtgtggaggaaccccaataccgagacatacttgcagccacagatcaccccaaaccctgtcacccaacacgttcaagcctacagcgcataccctcattcaccaggtcaggtcattactggctgccaattgctggtgtataattaccaggagtatcccacttacccagatagcgcattccaggtaaccactggatatcagctgcccgtgtacaattatcagccattcccagcttatcctcgctccccgtttcaggtgaccgccggttatcagctgcccgtgtataattaccaggcattcccagcctacccaaattcccctttccaggtggcaacaggataccagtttcccgtctacaattaccagccttttcctgcatatccctcatcccctttccaagttaccgccggttatcagctgccagtctacaattaccaggcattccccgcctacccaaactccccatttcaggtcgcgaccggctatcaatttcccgtttataattatcaggcgttccccgcataccctaacagtccagtccaggtgaccaccggatatcagcttccagtctacaactatcaggccttcccggcctaccctaactcggcagtccaagtgactacaggctatcagttccacgtatataactatcaaatgcccccacagtgccctgtgggcgagcagaggcgcaatctgtggactgaggcctataagtggtggtacctggtttgcctcatccaacgccgagactag

SEQ ID NO: 17862 - DNA, 1335 bp, Artificial Sequence
  Description of Artificial Sequence: Synthetic coding sequence
atgcgtgaaatagtgcacctccaggcaggacaatgcggaaatcagattggcgccaaattttgggaagttatttcagacgaacacgggatcgaccccactggaacttaccacggggactcagacctccagctggaaaggattaatgtttattataacgaggccacaggcggtaattacgtcccacgcgccgtcctggtggacctggaaccaggcaccatggattcggtacggtcaggcccctttggtcagatctttaggccagataacttcgtgttcgggcagagcggagctggtaataattgggctaagggccactataccgagggcgccgaactggtcgacgcagttcttgatgtagtgcgaaaagaggctgagtcatgtgattgcttgcaggggttccaactgacacattccctggggggcggaacagggagcggaatgggcaccctgttgatttcaaagatccgagaagagtttccggataggattatgaataccttttctgtggtgcccagcccgaaagtctccgacaccgtcgtcgagccatataacgctacactgagcgtccatcagctggttgaaaacaccgacgaaacctactgcatcgataacgaggccctgtatgatatatgctttaggaccctcaagctgacaacccccacatatggggacctcaaccacttggtcagtgctaccatgagcggcgtgacaacttgtttgcgctttccaggacagttaaatgccgatcttaggaagttggcagtgaatatggttccattcccacggctacatttctttatgcctggattcgctcctttgaccagccggggatcacaacagtatcgcgctctgacagtcccagagctcacacagcagatgtttgacgccaaaaacatgatggcagcctgcgaccctcggcatggtaggtacctgacagtggcagcggtgtttcgcggaaggatgtctatgaaagaagtggatgagcagatgctctcagttcaatcaaaaaactcatcctatttcgtggagtggattccgaacaacgtcaagaccgcagtttgcgacatcccaccaagagggctgaagatggccgctacctttatcggcaatagcaccgcaatacaggaattattcaagcggatttccgagcaattcacggctatgttcagacggaaggcctttctgcactggtacaccggcgaaggaatggatgaaatggagttcaccgaagcagagtccaacatgaatgaccttgtgagtgaatatcagcagtaccaggacgccacagcagaagagggcgaattcgaagaggaggcggaggaggaggtcgcatag

SEQ ID NO: 17863 - DNA, 495 bp, Artificial Sequence
  Description of Artificial Sequence: Synthetic coding sequence
atggtcaactccgttgtattcttcgacatcaccgtggatggaaagcctctgggcagaataagcatcaagctgttcgctgacaagatcctgaagacagccgagaacttcagagctttatccactggagagaaaggctttaggtataagggctcctgttttcaccggatcatacccggttttatgtgccagggcggcgacttcacaagacacaatggaacaggagataaaagcatatacggggagaagtttgatgatgaaaacttgataagaaaacacaccggctccgggattctgtctatggctaatgcaggccccaacactaacggatcccaatttttcatatgtgcagccaagaccgagtggctcgacggcaagcacgtggcttttggtaaggtcaaagaacgtgtcaatatcgtggaagccatggagcacttcgggtatcggaatagcaaaaccagcaagaaaattaccatagcggactgcggccagttttag

SEQ ID NO: 17864 - DNA, 3252 bp, Artificial Sequence
  Description of Artificial Sequence: Synthetic coding sequence
atgtcccagacacaagattacgaatgtcggagtcacaacgtcgacctgccggagagccggattcctggatcaaacacaaggttggagtgggtcgaaatcatcgagccacgcacccgcgagaggatgtatgccaatctcgttaccggagaatgcgtatgggatccacccgcaggtgtccggatcaagcgcacaagcgagaaccagtggtgggaactgttcgaccctaacaccagccggttttactactacaacgcaagtacgcagcgcaccgtctggcacaggccccaaggatgcgacattattcccctagctaagctccaaaccctgaaacaaaatacggaaagccccagggcctcggccgaatctagccccggcaggggatctagtgtgtcaagggaaggctccacgagttcttctctggagcccgagcctgataccgaaaaggcacaagagctgcccgctcgagctggccggcctgcggcattcggcaccgtgaaggaggactcagggtcttcttccccccctggggtttttttagagaaagattacgagatatatagagactattcagccgacggccagctgttacattatagaaccagctctctccgatggaactccggcgcaaaagaaagaatgcttatcaaggtagccgatcgcgagccttcttttctggccgctcaggggaacgggtatgctccagatggtcctcccggcgtcaggagtcgacgacccagcggctcccagcatagccccagtctgcagacctttgctcctgaggcagatggtacaattttctttccagagaggaggcctagccccttcctgaagcgagctgaactgcctggctccagctctccattgctggcacagcctcggaagcccagcggcgactcccagcccagcagccctcgttacggttatgagcccccactttatgaagagcctcctgtagaatatcaagcacccatttacgatgaaccccccatggacgtccagttcgaggctgggggaggctaccaggctgggtccccacagcggtctccaggcagaaaacctaggcctttcttacagcctaacaaacagggtccaccctctccctgccagcagcttgttctgactaaacagaagtgcccggaaagattcctctctctagaatatagtcccgctggcaaggagtatgttcgtcagctggtgtacgtggaacaagccggaagctccccaaaactcagagctggaccccggcacaagtacgcgccaaaccccggcggcggctcctactcgctccagccctctccctgcttgctccgggaccagcggctgggcgtcaagtcaggagattatagtactatggaggggcccgagctccggcattcgcagcccccgacccctcttcctcaggcacaggaggacgcaatgagctggtcatcacagcaagatacattgtccagcacggggtactcgccgggtacaagaaagcgtaagtcgcgaaaaccttctctgtgccaggctacaagtgcaacaccgactgaagggccaggagacctacttgttgaacagccactagccgaggagcagccgccatgtgggacctccctggcacctgtgaagcgggcggagggggaggctgaaggcgcgcggggggccgccgagcctttcctggctcaggccaggctggcttgggaggcccagcaagcccactttcacatgaagcagcgctcttcttgggacagccagcaagatggatctggttacgagtccgacggcgcattaccgttacccatgccaggaccggttgtgcgtgccttctcagaggatgaggccctggcccagcaggaaaatcggcactggcgtagaggcacctttgagaaactcggcttcccccaaatcctccttgagaaatcagtgagtgtccagacaaatttggcatctcctgagccttacctccacccaagtcagtcagaggatcttgctgcctgcgctcagttcgagtctagtagacagtcaagaagcggcgtgccctcctccagctgcgtgttccctaccttcaccctgcgaaaacctagctcggaaaccgatattgagaactgggccagcaagcactttaacaaacacacccagggcctatttaggagaaaagtgagcattgcaaatatgctggcctggagctccgaatcaattaaaaagccaatgatcgtgacctctgaccgccacgttaagaaagaggcgtgcgagcttttcaaactcatccaaatgtacatgggagaccgtcgcgctaaggccgaccccctgcacgtcgcgctcgaagtagctacgaaagggtggtcagtacagggactgagggatgagctttacatccagctgtgccggcaaaccaccgagaactttcgcctggagagcctggcccgaggttgggagcttatggccatttgcctggctttctttccaccaacgcccaagtttcacagttatctcgaagggtacatctaccgccatatggatcctgtgaatgataccaaaggggtggccatcagtacttatgccaagtactgttatcacaagctgcagaaagccgccctaacgggtgctaagaaaggcctgaagaaacccaacgttgaagagatcagacatgccaaaaatgccgtgttttctccttcgatgttcggcagtgccttgcaagaagtcatgggcatgcaaagggaaagatacccggagcgacagctgccatgggtacaaaccaggttgagcgaagaagtcctggccttgaatggagatcagactgaaggcatttttagggtgccaggcgacatcgacgaggtgaacgctcttaaactgcaggtggaccagtggaaagtgccaaccggactggaggatccccatgtgcccgcttcactgctcaaactgtggtaccgggagctggaggaaccactgatccctcatgagttttatgaacaatgtatagcccattacgattcacctgaagctgccgtggccgtagtccatgcacttccccgtataaacagaatggtgctgtgttatctaattagattcctgcaggtcttcgtccaaccagcaaatgtggcagtgactaagatggacgtaagtaatttagctatggtgatggcacctaattgcctgcggtgccagagtgacgacccccgggtcatatttgaaaatacccgcaaagagatgtccttcctgagagtcctgattcagcacctggatacctcatttatggagggcgttttatag

SEQ ID NO: 17865 - DNA, 1503 bp, Artificial Sequence
  Description of Artificial Sequence: Synthetic coding sequence
atggcagccgtgaagaccttgaatcccaaagggactatgaagatgttagtgtcaggagctggtgacatcaagctgacaaaagatgggaatgtgctgctgcacgagatgcaaattcagcaccctaccgcttctctgatcgctaaagtggctactgcgcaggacgacatcaccggggatgggacaacctctaatgttcttattattggggagttattgaagcaggccgatctctacattagcgaagggctccacccccgaataattaccgagggcttcgaggcagccaaggagaaggcacttcaatttctggaagaagtcaaagtcagccgggaaatggacagggaaaccctcattgatgtagccaggacgtccctgcggactaaagtccacgctgagctggccgacgttctcaccgaagctgtagtggactcgatcctggcaatcaagaagcaggacgagccaatcgacctgttcatgattgaaataatggagatgaaacacaaatcagaaaccgacacaagtctgatcagggggctcgtgctagaccacggcgcaagacaccccgatatgaaaaagagggttgaagacgcctacattctaacatgcaatgtcagtttggagtatgaaaaaacagaagtgaactcagggttcttttataagtctgccgaggagcgagagaagctggtgaaggctgaacgcaagttcatcgaggatagggtgaagaaaataatcgagctgaaaagaaaggtgtgcggcgactcagataagggatttgtcgtgataaatcagaagggcatagatcctttctcactcgatgctctgtctaaggagggaatagtggccctgaggcgtgcaaagcggcggaatatggagcggctgacattagcttgcggaggcgtggcgcttaactccttcgacgacctcagccccgactgcctcggacatgctgggcttgtgtacgaatataccttgggtgaagagaaatttaccttcatcgagaagtgtaataatccccgctcggtcaccctcctgattaaagggcctaataagcataccttaacacagattaaagacgcagtacgggatggcctgcgagccgtcaagaacgccattgacgacgggtgcgtagtcccaggcgcaggcgctgtggaagtggctatggcagaagccctgatcaaacacaagccctccgtgaaaggccgggcacaacttggcgtccaagcttttgccgatgctttactcataatccccaaagtgttagctcagaatagtgggtttgacctgcaggagacactcgtgaagattcaagccgagcatagcgagagcgggcagctagtgggagtggacctgaatacaggcgagcctatggtggccgccgaagtcggcgtttgggataattactgcgtgaaaaagcagcttcttcacagctgcacagtgatcgcaacgaacattctgctggtcgacgaaatcatgagggcaggtatgagttcattgaaagggtag

SEQ ID NO: 17866 - DNA, 1542 bp, Artificial Sequence
  Description of Artificial Sequence: Synthetic coding sequence
atgtgggatgtctgcatggaacgaggccacagggacctcgagcagtttgaaagggttcacagatacatctctgatcagcttttcacaaactttaaggaacgaaccgagcgtcttgtcattagtcccctcaatcagctgctctccatgtttaccgggccccacaaactggtgcaaaagcggttcgacaagctgttagatttctataattgtacagagcgtgctgaaaagcttaaagacaaaaaaaccttggaagagctgcagagtgcaagaaataattacgaggcccttaatgctcagctcctcgacgaactgccaaagtttcaccagtatgcacagggcctgtttactaattgcgtgcacgggtacgcggaggcacattgtgactttgtccatcaagctctggagcagctgaaaccactgctttctctgctcaaagttgcgggacgcgaaggcaatctgatcgcgatatttcacgaggagcactcgagagttctgcagcagcttcaggtttttaccttttttcccgaatctctgcctgcaacaaaaaaacctttcgagagaaagacaatcgatagacaatctgcgcgcaaacccttgctcggcttaccatcttacatgttgcaatctgaggagttgcgggcgagcctccttgctcggtatcctcccgaaaaattgttccaagctgaacggaacttcaacgccgcacaggacctcgatgtatcattgctagagggggacctagtgggggtgatcaagaagaaggatccaatggggagtcagaatagatggttgattgacaatggggtgacaaaaggtttcgtgtactcttctttcctaaagccttataacccccgccggtcacactccgacgcttcggttggcagtcactcatcgacagaatctgagcatggatcctcaagtccgcggttccctagacagaacagtggctctactttgacattcaacccttcctctatggcagtaagcttcactagcggcagctgtcagaagcagccccaggacgctagcccgcccccaaaagaatgtgatcaaggaacccttagtgccagcctgaatccaagcaatagtgaatcctctccttcgcgatgcccttcagaccctgacagcacctctcagccaagaagcggggactcagctgatgtcgcccgagatgtcaagcagcctacagcgacacctcgatcatatcgcaactttagacacccagaaatcgtggggtacagcgtgcctgggagaaatgggcagtcgcaggatttggttaagggctgtgcccgaaccgcacaggccccagaagaccggagcacagaacctgacggatcagaagccgaaggaaatcaagtttattttgcagtgtatacctttaaggctagaaatcccaatgagctgtcagtgtctgccaatcaaaagctgaagatcctggagtttaaggacgtgacgggcaacactgagtggtggctggcagaagtaaacggtaaaaagggatacgtgccctcaaattatataaggaagactgagtacacgtag

SEQ ID NO: 17867 - DNA, 153 bp, Artificial Sequence
  Description of Artificial Sequence: Synthetic coding sequence
atgatgcagaatgtccacttggcacctgagaccgatgaggacgatctctactcggggtataatgactataatcctatctacgacattgaggaattagagaacgatgcggctttccagcaggctgtgcgaacatctcacggaaggagaccatag

SEQ ID NO: 17868 - DNA, 4317 bp, Artificial Sequence
  Description of Artificial Sequence: Synthetic coding sequence
atgagcatgctgaaacccagtgggcttaaggctcctacaaagatcctgaagcctgggtcaactgccttgaaaactcccacagccgtcgtggcgcctgtcgagaaaacaatttcgagcgaaaaagcttcttcaacccctagttccgaaacccaggaagagttcgtggacgacttcagggttggagaaagagtctgggtgaatggaaacaaaccaggctttatccagttcctgggcgagacgcagtttgctccaggacagtgggctggtatcgtgctcgatgaaccaataggaaagaatgacggttcagtggctggcgtgaggtactttcagtgtgaacctcttaagggaattttcacccgccctagcaagctgacaagaaaggtccaggccgaagacgaggccaacggcctgcagacaactcctgcttctcgcgcaacctcgcctttatgtacaagtactgcttcgatggttagcagctccccctccactccatcaaacattcctcagaagccgagtcaaccagccgcaaaggagccttcggccacaccccctattagcaacctaaccaagaccgccagtgaatccatctccaatctgtccgaggcaggtagtatcaagaaaggcgaacgggagcttaagatcggagacagagttctcgtcggtggcactaaagcgggcgtggtgcgcttcttgggcgagacagacttcgctaagggggagtggtgtggcgtggagttggacgaaccgctcggtaagaatgatggggccgtggccggaactagatatttccaatgccagccaaaatacgggttgttcgcccctgtgcacaaggttacgaaaatcggctttccctccacaacgcccgccaaggcaaaagcaaacgccgtcagacgcgtcatggccacaactagcgcatccctgaaaagatctccctcggctagctctctatcttcgatgtcctcagtggccagctccgtgagttccaggcccagtcggaccgggctgctgacagaaacctcctctcgatacgcgcggaagattagtggcacaacagccctgcaggaggcccttaaggagaaacagcagcatatcgaacagctgctggcggagcgcgacttagagagggcagaagtggcaaaagctacgtctcacgtcggggagattgagcaggaacttgcgttggccagggatgggcacgaccagcatgtactggagctggaggccaagatggatcagcttagaactatggtcgaggcagctgatcgcgaaaaagtagaactgcttaaccagctggaagaggagaaaagaaaagtcgaagatctacagtttcgagtggaggaggaaagcataactaagggcgacctggagcagaagagtcaaatttcagaagaccctgaaaatacccagacaaaacttgagcacgcccggattaaggagttagagcagtcactgttgtttgagaagaccaaggcggataaactgcagcgcgaactggaggatactcgcgtagcgaccgtctccgagaagtcccgcattatggaactcgagaaggatctggcacttagggttcaggaagtggcggagctcaggcggaggctagagtcaaataagccagccggtgacgtcgacatgtctctatctctgctgcaggagatttcttctctacaggaaaaactggaggtaacaagaaccgatcaccaaagagagattacttctttgaaggagcatttcggagcaagggaggaaactcaccagaaagaaatcaaagccctgtacacagcaaccgaaaaactgagcaaagaaaatgaaagtttgaaatccaaactggagcacgccaataaggagaactcagatgtgatcgctctgtggaagagcaaacttgagaccgcaatcgcctctcaccagcaagcgatggaggagctgaaggtttccttcagcaaaggactaggaactgaaacagctgagtttgccgaactcaaaacccaaattgaaaaaatgaggcttgattatcagcacgagatcgagaacctgcagaatcagcaggactccgaacgggcggcccacgcgaaggagatggaagccctccgggcaaagttaatgaaggtgataaaagagaaggagaattcactcgaagctattaggtcaaagttagacaaagcagaggatcagcacctggtggagatggaggatactctcaacaagttgcaggaagcagagatcaaggtgaaagaactcgaagtgttgcaggccaagtgcaatgaacagacaaaggttatcgataactttacctctcagcttaaggcaaccgaggagaagctcttagatctggatgccctgcgtaaagcttctagtgaaggaaagtccgagatgaagaaactgcggcagcagctggaggcagcggagaagcagattaagcatttggagattgagaagaacgctgagagcagtaaagcctcgtctattactcgtgaactccaagggcgcgaactgaagttaactaaccttcaggaaaatttgagcgaggtttcacaggtgaaggagaccttagagaaggaattacagatactcaaggagaagtttgctgaggcctccgaggaagcagtgtccgtgcagaggtcgatgcaggagaccgtgaacaaacttcaccaaaaggaggagcagtttaacatgctatccagtgacctcgaaaagttgagagagaacctggctgacatggaggccaaatttcgcgaaaaagatgaacgtgaggagcagctcattaaggccaaagaaaagctggagaacgacattgccgagattatgaagatgtcaggcgacaattcttctcagctgactaagatgaatgacgagctccgcttgaaagagagagatgtcgaggaactgcaacttaagctaactaaagccaacgagaatgcttcttttttgcaaaaaagcattgaggacatgaccgtaaaagctgagcagtcccagcaggaggcagccaaaaagcatgaagaagaaaagaaagaacttgagaggaagctgagcgacttggagaaaaagatggagacaagccataatcagtgccaagaactcaaggctagatacgaaagagccacgtcagagaccaagacgaagcatgaagagatcctgcagaacctgcagaagaccttgttggatactgaagacaagctcaaaggtgcccgggaggagaatagcggtctgctgcaggaattggaggagttacggaaacaggccgacaaagccaaagccgcccagacagcagaggacgccatgcagatcatggagcagatgacaaaggagaagactgaaacactggcatcactcgaagacaccaaacagactaacgcaaagctccagaatgaattagacaccctgaaggaaaataatctgaaaaacgtggaggaattgaacaagtcaaaggagctgctgactgtagagaaccagaagatggaagaattccggaaagaaattgagacactgaaacaggccgctgcgcagaagtctcagcaattgtctgctcttcaggaagagaatgtaaaattggcagaggaactcggcagaagcagagacgaggtaacttctcaccagaagctggaggaggaacggtctgtgctcaacaatcagctcctcgagatgaagaaacgggaatctaaattcataaaagatgccgacgaggaaaaggcgagcctgcaaaagtccattagcattacatcagcactccttacagagaaggacgccgagctggagaagttgaggaatgaggtgaccgtgctccgcggagagaacgcttctgctaaatccctccatagcgttgtgcagaccctcgaatcagataaagtgaaactggaacttaaggttaagaatttagaactgcagctcaaagagaacaagaggcagctcagcagttcttctggaaacaccgatacccaggctgacgaagatgagcgtgcacaggagagccagatcgatttcttgaattccgtcattgtggatctgcagcgaaaaaatcaggacttaaagatgaaggtggaaatgatgtcagaagcagctctgaacgggaacggggatgatctcaataattacgatagtgatgatcaggaaaagcagagcaaaaagaaacctagactattctgcgatatttgtgactgcttcgatttgcacgatacagaggactgtccgacccaggctcagatgtctgaggatccaccacacagcactcatcatgggagtaggggcgaggagagaccatactgcgaaatttgcgagatgtttggacattgggctaccaactgtaacgacgatgagacattttag

SEQ ID NO: 17869 - DNA, 636 bp, Artificial Sequence
  Description of Artificial Sequence: Synthetic coding sequence
atggcctttgcggatagccacttgtggaaactcctggaccgtcatgctaacacgatccggctctttgtgctcctgcccgaacagtcccccgtgagctacagtaagcgcaccgcataccaaaaggcgggcggcgactccgggaatgttgacgatgactgcgaaagagtcaagggcccagtgggtagtttgaaatcagtggaggcgattctggaggagagcaccgagaagctgaagagcctaagcttgcaacagcagcaagatggcgacaatggcgattcctccaaaagtactgagaccagcgacttcgaaaatattgagtcaccattgaacgagagagacagctccgcttcggtggacaatcgggagctcgagcagcatatccagacatctgaccccgagaattttcagtctgaagagagaagtgatagtgacgtgaataatgacaggagtaccagcagcgtcgattctgatatcctgtcatcgagtcatagcagcgatacattgtgcaatgccgataatgcccagatccctctggctaatggattggattcccactccatcacctcttctcgcaggactaaagccaacagggaaaagagaaatatgggctactctaggagacgcctctggaattag

SEQ ID NO: 17870 - DNA, 2136 bp, Artificial Sequence
  Description of Artificial Sequence: Synthetic coding sequence
atgctcgcctctctcaaagtgaagaaacaagagcttgctaacagctccgacgctacactgccagacagacctctgtcaccccccctgacagcaccaccgacgatgaaaagctccgagttttttgagatgctggagaagatgcaaggaattaagctggaggagcagaagccaggcccgcaaaaaaacaaagatgactacatcccttaccccagcatcgatgaggttgtcgagaaaggaggtccttatccacaagtaattctgccacagttcggcgggtattggatagaggatcctgaaaatgtcggaactccgacttctctggggtcttcaatatgtgaggaggaagaggaagacaacctgtcacctaacacgtttgggtataagctggagtgcaaaggagaggcaagagcctaccggcgccacttcctaggcaaagaccatttaaatttctattgtaccggttcctcgttgggaaacctgatattatctgtcaaatgtgaagaggcggagggcattgaatacttaagagtaattcttcgctctaagctgaaaactgtgcacgaaaggatccccctggctggactgagcaaacttccctctgtccctcagattgccaaggccttctgtgatgatgccgtcggtctgaggtttaaccctgtcctatacccgaaagcatcacaaatgatcgtgtcttatgatgagcacgaagtgaataacaccttcaaattcggtgtgatctaccagaaggcccgccaaactctggaggaggagcttttcgggaacaacgaggaaagtccggcttttaaggagttcctcgacctcctgggagataccattactctgcaggatttcaaaggctttagaggcgggctggacgtcacccatggtcagaccggggtcgagtcagtgtacacaacattccgcgatcgggaaatcatgtttcacgtgagcacaaaactcccgttcaccgacggagatgctcagcagctccagcggaagcgacacattgggaatgatatcgttgccatcatttttcaagaggagaataccccattcgtacctgacatgatcgcatccaattttctccatgcttacattgtcgtgcaggtggaaacccctgggacagagacaccctcctataaggtcagcgtgactgccagggaagacgtcccaacctttggcccacctctgccgtctccgcccgtcttccagaaaggccccgaatttcgagaattcctgctcacgaagctgaccaacgctgaaaacgcttgttgtaaatccgacaagttcgccaagttggaggatcgaaccagagccgctctccttgataatttgcacgatgagctacatgcccatacacaagccatgttgggcctcggcccggaggaggacaagttcgaaaacggtgggcatggcggcttcttggagtcgttcaaacgggcaatccgagttaggtctcacagtatggaaaccatggtgggaggtcaaaaaaagagccactcgggcgggatcccaggatcactttcgggcggaatctcccacaactctatggaggtaacgaaaaccaccttctcccccccagttgtggccgcaactgtgaagaatcagagtaggtctcctatcaagaggagatctggcctgttccctcggttacatacggggagcgaggggcaaggcgactctcgggccagatgtgactctacctcctcaactccgaaaacacctgacgggggacactctagccaggagattaagagcgagactagttctaacccgtcttcgccagaaatatgccctaataaagagaagccattcatgaagttaaaggagaatggacgggctatctctcgttcaagtagctctacatcctctgtatcgagtaccgcaggcgagggagaagctatggaggagggcgacagcggagggagccagccctctaccacaagcccctttaaacaagaggtgtttgtctacagtccaagcccttcgtccgaaagccccagccttggagcggccgccacacccattattatgagcaggtctccaacagatgcgaagtctagaaacagcccaaggtccaatttgaagttccgtttcgacaaactgagccacgccagttcaggcgccggacactag

SEQ ID NO: 17871 - DNA, 1089 bp, Artificial Sequence
  Description of Artificial Sequence: Synthetic coding sequence
atggatggcctcgacgacgtggaaaattcaatgctctactataaccaagcagtcatcctttaccacctgagacagtacactgaagccatctctgttggcgagaagctgtatcagtttatcgagcccttcgaggagaaatttgctcaggccgtgtgcttcctattggtcgacctatatattctaacctaccaagccgaaaaagcactgcatctactggcagtgttggagaagatgatatctcaggggaataacaacaaaaatggtaagaacgagacgggaaataataataacaaagatgggtctaaccataaggccgagagtggcgctttgattgaggctgctaaatctaaaatccatcagtataaggtgcgggcttatatacagatgaaaagcctaaaggcttgcaaacgcgagattaaatcggtgatgaatactgcaggcaactccgcaccctccctgtttttgaaatcaaatttcgagtacttacgggggaattataggaaggcagttaagcttctgaattcctccaatatcgcagagcatcccggcttcatgaagaccggcgagtgcctacgctgtatgttctggaataaccttggctgcattcacttcgccatgtcgaaacataacctgggcattttctattttaaaaaggccctccaggagaatgacaacgtgtgtgctcagttatctgctggctccaccgatccaggcaagaaatttagtggcagacctatgtgcacccttctgactaacaagcgctatgagttgctgtacaactgtgggatccaactcctgcatatcggcaggcctctggctgcctttgaatgcttaattgaagctgtacaggtataccatgctaaccctagattatggctgagactggccgagtgctgcatcgccgccaacaagggaacctctgagcaggagacaaagggactcccctccaaaaagggaattgtccagagtattgttggccagggctaccataggaagattgtactagcgagccaaagcattcagaacactgtgtataatgacggccagagcagcgccatcccagtggccaaggccggaaaatgggggtag

SEQ ID NO: 17872 - DNA, 1821 bp, Artificial Sequence
  Description of Artificial Sequence: Synthetic coding sequence
atgtgtggagctggattcgggcattttgagtggctggccggcggcggtgctgggcaagacgtaggacgaagctgtattctggtgagcatcgccggaaaaaatgtcatgcttgattgtggaatgcatatgggttttaatgatgatcgaagatttcccgacttcagctatattacacagaatgggaggctgaccgacttcctggattgcgtgatcatctcacattttcacctagatcactgtggcgcccttccttatttcagcgagatggtggggtacgatggccctatctatatgactcacccaacccaggctatctgccctattctcctggaggactacagaaaaatagctgtggataagaaaggtgaagccaacttctttaccagccagatgataaaggactgcatgaaaaaggtcgttgcagtgcacctacaccaaactgtgcaagtagacgacgagttggagataaaggcctactatgctggccatgtactgggggccgccatgtttcagattaaagtcgggagcgagtctgtagtgtataccggtgactataatatgacccccgatcggcaccttggtgccgcgtggatcgacaagtgcaggcctaatctgttgatcaccgaatccacatatgccacaactatccgcgactctaagagatgccgtgaacgcgattttctgaaaaaagtgcacgagaccgttgagcggggcgggaaagtcttaatccctgtgtttgctttaggcagggcccaagaactttgcatcctgctcgaaaccttttgggaacgaatgaatctgaaggttcctatctatttctcaacaggtttgacggaaaaggctaatcattactacaaactcttcattccatggaccaatcagaagatacggaagacgtttgtgcagcgtaacatgttcgagttcaagcatataaaggcttttgatagggcgtttgcagacaaccctgggccaatggtggttttcgctacacccggcatgctgcatgcgggtcagtcactccagatcttccgaaaatgggcagggaacgagaagaacatggtaattatgcctggctactgcgtccaaggcactgtggggcacaagattttgtctggccaaagaaagctggagatggagggaagacaggtgttagaagtcaaaatgcaggtcgaatatatgtctttctccgctcacgccgatgccaaggggatcatgcaacttgtaggacaagcggagcccgaaagtgtcctcctagtccatggtgaggcgaagaagatggagttccttaagcagaaaatcgagcaagagttgagggtgaattgctatatgcccgctaatggggagaccgttactcttcctacctcccctagcatccccgtgggaatctccctgggcctgctgaagcgcgaaatggcccagggtctgcttccagaggctaaaaagccacgcctcttgcatgggacgctgattatgaaagacagcaatttcagattagtatcaagtgagcaggctttgaaggaattaggcctggccgagcatcaactccggttcacctgcagagtgcacttgcacgatactaggaaagaacaagagaccgcccttagggtgtacagccacctgaaaagcgtattgaaagatcattgcgttcaacacctcccggatggtagcgtcacggtggagagcgtactgttgcaagccgcagcaccaagtgaagacccaggcacaaaagttctgttagtctcctggacataccaggacgaagagctaggctctttcctgacctctttgctgaagaaggggcttccgcaggccccctcctag

SEQ ID NO: 17873 - DNA, 399 bp, Artificial Sequence
  Description of Artificial Sequence: Synthetic coding sequence
atgaaaaaggtccggctcaaagaactggagtcacgactgcagcaggtggacgggttcgagaagccaaagctgttgctggagcagtacccaactcgtccgcatatcgctgcgtgtatgctctacacaattcacaatacttatgatgatatcgaaaataaagtggtagctgacctggggtgtggatgtggcgtattgtcaattgggactgccatgctcggagcaggcctgtgtgttggatttgatatcgatgaggatgccctggagatttttaaccgcaatgccgaagaatttgagctccagatattgacatggtttaacgtgatgtgcgcctattacctgacagaatgcccaagccactccattcagaattatgagagtagcctatgggaccagaagtag

SEQ ID NO: 17874 - DNA, 1371 bp, Artificial Sequence
  Description of Artificial Sequence: Synthetic coding sequence
atgatggtaggcgatggcaccactagtgtgactctgctggccgcagagtttcttaagcaggtgaagccctacgtggaggagggccttcatcctcagataataatccgagcttttcgcaccgcgactcagctcgccgttaacaaaatcaaggagatcgccgtcactgtgaagaaggcggacaaggtcgaacagcggaagctccttgagaagtgcgccatgacggcgctgtcctctaagctcatcagccagcagaaggcttttttcgccaagatggtcgttgatgctgtcatgatgctggatgatctgttacagttaaaaatgattggaataaaaaaggtgcagggtggtgctcttgaagattcgcagctggtggccggagtggcctttaagaagactttttcatatgcaggtttcgagatgcagccaaagaagtaccataatcctaaaatcgcgttactgaacgtggagttggaactgaaggccgagaaagataacgcggagatcagggtccatactgtggaggactaccaggctattgtggacgccgagtggaatatcctctatgataagctggaaaaaattcaccatagcggggctaaggtggtactgtctaaattacctatcggcgacgtcgctactcaatattttgcagatcgtgatatgttctgtgcagggcgagtgccagaggaggatctgaaacgaacaatgatggcctgcggtgggagcattcagacaagtgttaacgcgctttctgccgacgtgttgggtcggtgccaggtgttcgaagaaacccagataggcggtgagcgctataatttcttcacaggctgccccaaagctaagacctgtacatttatactgaggggaggagcagagcagtttatggaggaaactgaaaggtctctccacgacgcgataatgatcgtgcgtagagccattaagaacgatagtgtcgtggccgggggaggagccattgaaatggaactgagtaaatatttgcgggactactctcgcaccattcctggaaaacaacagcttctgataggtgcgtatgcgaaggcactcgaaataattcccagacagttgtgtgacaatgcaggcttcgatgcaacgaacatcctgaacaagctcagagcacgccatgctcaaggcggcacatggtacggcgtggatataaataacgaggacattgcggataactttgaggcatttgtgtgggaacccgcgatggtcagaatcaatgccctcactgctgcatccgaggctgcctgcctcattgtctccgtcgacgaaacaatcaaaaatccccggtcgacagttgacgctcctacggcggcaggccgcggaaggggtaggggacgcccccattag

SEQ ID NO: 17875 - DNA, 2520 bp, Artificial Sequence
  Description of Artificial Sequence: Synthetic coding sequence
atggacggtaaggctgacgttaagagcctgatggccaaatataacactggagggaatcccacagaggatgtgagcgtgaatagtagaccctttagggtgacgggtccaaatagcagcagcggaatccaggcccggaagaatctgttcaataaccagggcaatgcctcacctccagccgggccatcaaacgtgccgaagttcggctccccaaagccccctgttgcagtgaaaccgagctctgaagagaaaccggataaggagcccaaaccccctttcctgaagccgaccggagcaggccagcgatttggaactccagctagtctaacaaccagagatccagaagccaaagtggggttcttaaagccagtcggccccaagcccataaacttgcctaaagaggatagtaagcctacatttccctggcctcccggcaacaaaccctctctgcatagcgtgaaccaggaccacgatctgaagcctctcggacctaaatctggacctactcctcctacatccgagaacgagcaaaagcaggcatttcccaagcttactggagtcaagggaaagttcatgtcggcatctcaagatctggaaccgaagcctctgtttccaaagcctgcctttgggcagaagccaccgctgagtaccgagaactcacacgaagatgagtccccaatgaagaacgtgtcctcatctaaaggttctccggcacctctgggagtccggagcaaaagcggaccgttaaagccggccagagaagacagcgaaaacaaggatcacgccggagagatctcaagtctacccttccccggggtggtattgaaacctgcagccagccgcggcggacccggcctctcaaagaacggcgaggagaagaaggaggacagaaagatcgatgccgcaaagaacacctttcagagcaaaatcaaccaggaggaattagcgtcgggcactccaccagccagatttcccaaggccccgtccaaattaacggtgggaggaccttggggacaatcacaagaaaaggaaaagggggacaagaacagtgccacaccaaagcaaaaaccactgccacccctgttcactctcggtccgcccccacccaagcccaatagacccccaaacgtcgacctcactaagttccataagacttcaagtggaaatagtaccagcaaaggccagactagttatagcaccactagtttacctccaccccccccatcacaccccgcgtcacagccacccctgccagcatctcatccgtcccaaccaccagtccccagccttccgccccggaacattaaacctccatttgatctgaaatcgcccgtcaacgaggataaccaggacggagtcacgcactccgacggtgcaggtaacctggacgaagagcaagactctgaaggagagacgtatgaggacattgaggcctcaaaggaaagggagaagaaaagggagaaggaagagaaaaaacgtctagagcttgagaaaaaagaacaaaaggagaaggaaaagaaggagcaggagatcaaaaagaagtttaaacttacgggaccaatccaggtcattcacctcgcaaaagcatgttgcgatgtgaagggcggcaagaacgaactttctttcaaacagggcgaacagatcgagatcattcggattacagacaaccccgaaggtaagtggctagggcggactgcccggggtagttatggttacatcaaaacgaccgcagtggaaattgattacgactccttaaaattgaagaaggattctctcggcgccccaagtagacctatagaggacgaccaggaagtgtacgacgatgttgcagagcaggacgatatcagtagccactcgcagagtggctccggaggcattttcccaccaccccctgatgatgacatttatgacggtattgaagaggaggacgccgacgatgggtcaacattgcaagtgcaggagaaaagtaatacttggtcatggggcatcctgaagatgctaaaaggcaaagatgatcggaagaaatctatccgcgagaaaccaaaagtgagtgacagcgacaataatgaagggtcctcttttcccgccccgccaaagcagctcgacatgggcgacgaagtgtacgacgacgtggacacttccgatttccctgtctctagtgccgagatgagtcagggaacaaacgttgggaaagcaaagacggaggagaaggatctaaagaaactgaagaagcaggaaaaagaagaaaaagactttcgaaagaagttcaaatatgatggggagattagggtcctctatagcacgaaagtgacaacaagcatcacctctaagaaatggggaactcgcgatttgcaggtaaaacctggggagtctttggaagttattcagacaacggacgataccaaagtgctatgtcgcaacgaagagggcaagtacggctacgtcctgcggtcttacctggccgataacgatggcgagatttacgacgatatagccgacgggtgcatttatgacaacgactag

SEQ ID NO: 17876 - DNA, 1017 bp, Artificial Sequence
  Description of Artificial Sequence: Synthetic coding sequence
atgggtcatcggtacattgaggtatttaaatcacacaggacggaaatggactgggtgctgaagcactccgggcccaactccgcggacagcgccaacgacggatttgtgcgcctcaggggactcccctttggatgtactaaggaagaaatcgtccaattctttagtggtctggaaatcgttcccaacggcataaccctgcctgtcgacccggagggcaagatcaccggagaggcttttgtgcagtttgcatctcaggaacttgcggaaaaagctctgggcaagcacaaggagaggataggacacagatatatcgaggtcttcaagtcatctcaggaggaagttagatcatattccgaccctcccctgaagtttatgagtgtgcagagaccaggaccatacgacaggcccggcaccgcccgtcgttacattggaattgtaaagcaggctggactggaaaggatgcgccccggagcttactctactggatatggcggttacgaggaatacagtgggctgagcgatggctatggcttcactacggacctgttcgggcgcgatttatcttattgcctttctggcatgtacgaccatcgctacggagactcagaattcacagttcagagtaccactggacactgtgtccacatgagaggattgccttataaagccaccgagaatgacatttataacttcttttctcccctgaaccctgttagggtacacatcgaaattggtccggacggacgagttacaggcgaagctgatgtcgagttcgcaacacatgaggaggctgtagcagcaatgtctaaggaccgggcaaacatgcagcatcggtatatcgagctctttctgaacagtacaactggggcctccaacggtgcatattcatcccaagtcatgcaggggatgggagtttccgcggcacaggcaacttatagcgggctcgaaagtcagagtgtttccggctgttatggagcaggctattccggacagaatagcatgggcggctacgattag

SEQ ID NO: 17877 - DNA, 1536 bp, Artificial Sequence
  Description of Artificial Sequence: Synthetic coding sequence
atggcctccgtcgttgagtataaggggctgagggccggttatcactgcggctactgtgatagcaaagagggaaaggcatcttgcggcatgtgggcccatagcatgacagttcaggactatcaagacttgattgatcgggggtggagacgttccggtaagtacgtgtataaacccgtgatgaaccagacatgttgtccgcaatataccattagatgtcgaccgttacagttccagcccagtaagagccacaaaaaggttctgaaaaaaatgctaaaatttttagccaagggagaggtcccgaagggcagttgtgaggatgagccaatggattcaacgatggacgacgcagtggccggcgacttcgcattgatcaataaacttgatatccagtgtgatctcaaaactttaagtgacgatataaaagagtctctcgagtccgagggtaaaaacagcaagaaggaggaaccgcaagagttgttgcaatcccaggactttgtaggggaaaaactgggctcaggcgaaccttctcattccgtgaaggtgcatacagtacccaaacccggtaaaggcgcagatctgagtaagcctccatgtagaaaagctaaggaaatccgcaaagagcgcaaacggctcaagttgatgcagcagaaccctgcaggtgagttagaggggtttcaggcacaaggtcatcctccttcgctcttccccccgaaggccaaatccaaccaacccaagtcactggaagatttaattttcgaaagccttccagaaaatgcttctcataaattagaggtccgactcgtgcctgtgtctttcgaagacccagagtttaaaagttcattctcccagagcttctccttgtacgtcaagtatcaggtcgctatacatcaagacccccccgatgagtgcggcaagactgaatttacaagattcctctgctctagcccacttgaagcggagacccctccaaacggccccgattgcggctacgggtccttccaccagcagtattggttggacgggaaaatcatcgcggtgggcgttatcgacattctcccgaactgtgtttcttcagtgtacctctattacgaccccgattactccttcttgtccctcggggtttacagcgcactaagggagattgcttttacaagacagttacacgagaagacctctcagctatcctattattatatgggcttctatatccatagctgtccaaagatgaaatacaaggggcagtatcggccttctgacctcctctgcccagaaacatatgtgtgggtgccgatcgagcagtgtctgccgtctctggaaaacagcaaatactgtcggttcaatcaggatcctgaggcagtggacgaagatcggtccactgaacccgacagacttcaggtattccacaaaagagctatcatgccgtatggggtctataagaagcagcagaaagatccaagcgaagaggccgcagttctccagtatgcctcccttgtgggccagaaatgtagtgaaaggatgctattgttcagaaactag

SEQ ID NO: 17878 - DNA, 3963 bp, Artificial Sequence
  Description of Artificial Sequence: Synthetic coding sequence
atgcaggatgactccatagaggcaagtacttcaataagtcagctgcttcgggagagctatctggctgagacccggcatagagggaacaatgaaagatctcgagccgaacccagctcgaacccatgccatttcgggtcaccatctggggccgccgaaggcggcggagggcaggacgacctcccagatctgtccgcctttttgtcccaagaggagctagacgaaagcgtaaatctagcaagacttgcgataaattacgaccctctcgaaaaggctgatgaaactcaggcgcggaagcgtctgtccccagaccagatgaaacattctcccaatctttcatttgagcccaatttttgccaggacaatcctcgcagtccaacatcctcaaaagaatctccccaggaggctaagcgacctcagtattgttcggagacacagtcgaaaaaagtctttctcaacaaggccgccgattttatcgaggaactgagctcgttgtttaagtctcactcgtccaagcgaattcgaccaagagcctgtaaaaaccataaatcgaagctagaatcacagaataaagtgatgcaagagaactctagtagcttttccgacctctcggagagaagagagcggtcatctgtgcctattccaattcccgctgacacacgggacaatgaagttaatcatgcccttgaacaacaggaagcgaaacggagagaggcagagcaggcagccagtgaggccgccggaggcgacacgactccagggtctagcccctcctctctttattacgaggagcccttaggccagcccccccgatttacacagaagctcaggagcagagaagttcctgagggtaccagggtgcagctggattgcattgtagtaggtataccgcccccacaagtgagatggtactgtgaaggtaaagagctggaaaacagccccgacatccacatcgtgcaggctggaaaccttcacagcctaaccatcgcagaggctttcgaagaggacacagggcgttactcctgctttgcctctaatatttatgggacagatagcactagtgctgagatctacatcgaaggggtatcttctagtgatagcgagggagatcctaacaaagaggagatgaacaggatccagaagccgaatgaagtaagcagccctccaacgacaagcgctgtcattcccccagccgtcccgcaggcccagcatctcgtggctcaaccacgggtagctaccatacaacagtgtcagagccccaccaactatctgcagggtctggatggcaagcctattattgctgctcccgtgttcacaaagatgctgcaaaaccttagtgcctccgagggccagctggtggtgtttgagtgtcgcgtgaagggcgcccccagccctaaggtcgaatggtatcgagagggtacccttatagaggacagtccggatttccggattctgcagaaaagacccgtgtgtatggagcacattgaggaaatatgtaccctagtcatagcagaggtgtttgcagaagatagtggctgtttcacatgcaccgcctccaacaagtacggcaccgtttctagtatcgcccagctgcacgtacgtgggaatgaggacctgtccaacaacggttcattacattctgcaaacagtaccaccaaccttgccgccattgaaccccagccaagcccacctcatagtgaaccaccctccgtggaacagccgccgaagcctaaacttgaaggcgtgttagtgaatcataatgagccgaggtccagctcacgaattgggctaagggtccatttcaatctgcctgaagacgataaagggtccgaggcctccagcgaggccggggtcgttactacgaggcagacaaggcccgatagctttcaggagcgtttcaatggtcaggccaccaaaaccccagagcctagctccccagtgaaggagcctccccccgtccttgcgaaacccaagcttgacagcacccagttacagcagctgcacaaccaggtgttgctcgagcagcatcaactgcagaatcctcctccaagctcaccaaaggagttccccttctccatgactgtactcaacagcaacgcaccccctgccgtaacgactagtagtaagcaggtcaaagcacctagttcccaaacgtttagtctggctaggcccaagtacttttttccatctacgaataccacggctgccacagtggctccttcctcctctccagtgttcaccctgtctagcacaccccagacaattcagcggacagtatcaaaagaaagcctgttggttagccacccgagcgtgcaaacaaagtcccccggcggcttgagcattcagaacgagcctctgcccccagggcccacagagccgaccccccctcctttcacattttcaatcccatcgggcaatcagtttcagcctcgatgcgtatcacccatcccagtgagtcccacgagccgtatccagaatcctgttgcctttctgtcctctgttctgccttccttacccgctattccaccaacgaatgccatgggtctcccgcggtcagccccttccatgccctcacaaggcctcgcgaagaagaataccaagtctccccagccagtgaacgacgacaacatcagagagaccaagaatgcggtaatcagggatctgggtaaaaagattaccttttccgatgtgagacctaaccagcaagaatataaaatctcgtcctttgagcagcgcctcatgaacgagatcgagtttagattagaacgcaccccagtagacgagagtgatgacgaaattcagcacgacgagatccccacgggcaagtgcatcgcccccatttttgataaacgcctcaagcacttccgagtgacggaaggctctccagtgactttcacctgcaagatagtaggcatacccgtgcctaaggtttattggttcaaggatggcaagcagattagtaaaagaaacgaacactgtaagatgcggcgggaaggggatggcacttgcagcttacatattgaatctacgacatcggatgacgatggaaattacaccataatggccgccaatcctcaaggcaggataagctgctcaggccacttgatggtgcagagcctcccgatcagatccagactaacaagcgccggtcagtcccacaggggtcgtagtagagttcaggagcgcgacaaggagccattacaagaacgcttcttcaggcctcattttctccaagctccgggcgacatggtggcccatgagggccgcctgtgccggttggactgtaaggtttccggactgccaccaccagaattgacctggctgctgaatggccaacccgttttgccggacgcgtcacacaaaatgctggtccgcgaaacaggggtccactcactgctcatcgatcccctgactcagcgcgatgcaggcacatataagtgtatagctaccaacaagacaggccagaattcctttagtctggagctgtccgtggtagccaaggaggtaaagaaggcccctgtgattctcgaaaaactccaaaattgcggcgttccggaaggccatcccgtacggctagagtgtcgggtgatcggcatgccccctccagtgttctattggaaaaaggacaatgagacgataccatgcactagagagcggatctccatgcaccaggataccaccgggtatgcatgcctgttgatacagcctgcaaagaaatctgacgctggctggtacacactgtcagcaaaaaacgaagctgggatcgtgagctgcactgctcgccttgacatttatgcacagtggcaccaccagatccctccccctatgtctgttagaccatctgggtcacgctacggatcactcacctctaaaggtctcgacatcttctcggccttctcctccatggagagcaccatggtctactcctgttcctcgcgctcagtcgttgagtctgacgagctttag

SEQ ID NO: 17879 - DNA, 2292 bp, Artificial Sequence
  Description of Artificial Sequence: Synthetic coding sequence
atgcaggatcttggagataagctgcggatgatcgtgatgggtcatcggcgagtacatatctcacgtcagctcgaggtggagcccgaagagcctgaggccgagaacaagcataaacctcgaaggaagtcgaagagagggaagaaggaggcagaggacgagcttagtgcccgacaccccgcagagctcgccatggaacctacccctgaattgcccgctgaggtgctgatggttgaggtcgagaatgtagtgcacgaagattttcaggttacggaggaagtgaaggccctgacagcagaaatcgtgaagacaattcgcgacatcatcgccctgaatccgttgtacagagaatccgtgctccagatgatgcaagccggccagcgggtggtggacaacccaatttatctctccgacatgggagcagcgttgaccggagccgagagtcatgaattacaggatgtcctcgaagagacgaatatccctaaacgcctgtacaaagcactatcgctgctgaaaaaggagtttgagttaagcaagctgcagcagaggctgggcagggaggtggaggagaagattaagcagacccaccgaaaatacctgttgcaggagcagctgaagattatcaagaaagaactgggtcttgagaaagatgataaggatgccatcgaagagaaattcagggaaagactcaaggaacttgtggtcccaaaacatgtcatggatgtggtcgatgaggagctttctaagctggggctgttggacaatcattcctctgagttcaatgtgacaaggaactacctggattggctaactagtataccctggggcaaatattcaaacgaaaacctggacctcgcccgcgctcaggcagtcttagaggaagaccactatggaatggaggatgtgaaaaagcgtattcttgagttcatagcagtgagccagctgagaggctccacacaaggaaagatcctgtgtttctacggacctcccggggtggggaagactagcatagctcgctccatagcccgcgctctgaaccgagagtattttcgattctccgttggcggcatgactgatgtagctgagattaagggtcacagacgcacctacgttggcgcaatgccagggaagatcatccagtgcctgaagaagacaaaaaccgaaaaccctctgatcctaatcgacgaggttgacaaaattgggcgaggatatcaaggggatccctcatccgcactcctggaactcctcgatccggagcagaacgccaattttctggaccactacctcgacgtgcccgtcgatctatctaaggttctgtttatttgtactgccaacgttacagatacgatcccagagcctctccgcgatcggatggagatgataaatgtctctggctatgtggcccaggaaaagcttgccatcgctgagcgctatctggtacctcaggcacgcgccctttgtggcctcgatgaaagtaaagccaagctatcaagtgatgttctaaccctcttgattaagcaatactgtagagaaagcggcgtgcgaaacctgcagaagcaggtggagaaagtgctcaggaagagcgcctataagatcgtgagcggggaggctgaatccgtggaggtgacacccgagaatctgcaagatttcgtaggcaagccagtctttacagttgagagaatgtatgatgtgacacccccaggggtcgtgatgggcctggcatggaccgcaatgggcgggtcaaccctgtttgtcgaaacttccctgcgtagaccccaagacaaagatgccaagggagacaaagatggaagcctggaggtaactggccagctcggggaagtaatgaaagagtccgcacggatcgcctacaccttcgccagggcattcctgatgcaacacgcaccggccaatgattacttagtgaccagtcatatccatttgcacgtgcctgagggagccacacctaaagatgggccaagtgctggctgcaccatcgtcaccgctctgttgtcactggctatgggccgacctgtaaggcagaatctggcaatgaccggagaggtgtctttgaccggtaaaatcctgccagttggaggtatcaaagagaaaacaatagctgcgaaacgcgcgggagtgacctgcatcgtattgcctgctgagaacaaaaaggacttctatgacctagcagccttcatcaccgaggggttggaagtccacttcgttgagcactatcgggagatcttcgacatagcgttcccagacgaacaggctgaggctctggccgtggaacggtag

SEQ ID NO: 17880 - DNA, 558 bp, Artificial Sequence
  Description of Artificial Sequence: Synthetic coding sequence
atgaacaataaccagatcgtcgcaaaggatctccaggatgaaaagatactgtatccagaattcaacaagctcaaggaacgcaacagggagctgaaaacactcctcagtattggcggctggaactttggtacaagtcgctttaccacaatgctcagtacttttgctaaccgggaaaaattcatagcttctgtgatttcattgttgaggacccacgacttcgacggcttggatctgttctttctttacccaggactgagagggtctcccatgcacgatcggtggaccttcctgttcctaatcgaggaacttttatttgcatttaggaaagaggctctcctgaccatgagaccccgccttctgctctctgctgccgtttctggcgttccacatattgtgcagacttcatacgatgtacgctttctgggacggttcgttcccttgagcggagagcgcagatctacagggctcataacatcgatgtcgaggatgcccacaagagggaagtccggacttgcaatgaccatgccctcggcaagtgtcactagacacggcctgtag

SEQ ID NO: 17881 - DNA, 1269 bp, Artificial Sequence
  Description of Artificial Sequence: Synthetic coding sequence
atgagcggaggcaccccttacatcggcagcaaaatctcactgatttccaaagcggaaatcagatatgagggcatactgtacacaatcgacactgaaaactccacagtggcactcgcaaaggttagatcttttggaaccgaggatcgacccactgaccggccaatccccccccgagacgaggtgttcgagtatattattttccggggctcagacatcaaagatttgaccgtctgcgaacctccaaagccacagtgctccctcccacaggaccctgcgattgttcagtcatcccttgggtcctccacatcttcatttcagagcatgggctcatacgggcccttcggccgaatgccaacctacagtcagttctcaccaagcagcctggttggacagcagttcggagcagtcggagttggaagatcttcccctcaacttgatcctctcaggaaatctccaacaatggaacaggcagtccagaccgcttctgctcacctccctgcccccgcagccgtgggccgtcggtctcctgtgagcacccggccgttgccgagtgcctcccagaaagcgggagagaaccaggagcaccgcagagctgaagtgcataaagtgtcgcggccagagaacgagcagctccgcaacgataataagaggcaggtggcaccaggcgccccaagcgctccaaggcggggccgggggggacatcgcggaggtcgaggccgctttggcattcgtagggacggcccaatgaagtttgagaaggatttcgattttgagtctgccaatgcacagttcaacaaagaggagatagatagagagttccacaacaagctaaagctcaaagaagacaaactggagaagcaggagaagcccgtaaatggggaagacaagggggacagtggagtagacactcagaatagtgagggaaacgcagatgaggaagaccccttgggacctaactgctactatgacaagaccaagtcgttttttgataacatatcctgcgatgataatcgggagaggcgtcctacctgggctgaggagagaaggttaaacgctgagacattcggcattcctctgcggcctaatagagggagaggtggttacagaggaagaggagggcttggattcagaggcggcaggggtcgcggtggtggccgtgggggtactttcacagcaccacggggattcagaggcggattccgggggggaagaggtggccgggaattcgccgatttcgagtacagaaagaccacagcctttgggccttag

SEQ ID NO: 17882 - DNA, 1266 bp, Artificial Sequence
  Description of Artificial Sequence: Synthetic coding sequence
atggcgagttcaagtgtgccgccagcaactgtctctgctgcaacagccggtcctggaccaggctttgggtttgcatccaagactaagaagaaacatttcgttcagcagaaagtgaaggtgttccgcgctgctgaccctcttgttggggtatttttatggggcgtggcacatagcatcaatgaactctcccaggtcccaccaccagtgatgttattgcccgatgacttcaaggccagttctaaaataaaagtgaataaccacctctttcatcgggagaatttaccaagccacttcaaatttaaagagtactgtccccaggtatttaggaatcttcgtgataggtttggtatagacgatcaggactacctggtgtctctgacgcgcaatcccccatcagagtccgagggcagtgacggccgcttcctcatttcctatgatcgtacattggtaattaaagaggtgagttccgaagatatcgcggacatgcactctaacctcagcaactaccatcagtacatcgtgaaatgtcacggcaacactctcctgccacagtttctcggtatgtaccgggtgagtgtggacaacgaagattcatacatgctggtcatgaggaatatgttcagtcaccgactgcccgtgcaccggaagtatgacctgaaaggatccttggtaagtcgagaggccagtgacaaggagaaggtgaaggagttgcctaccctgaaagacatggatttccttaacaaaaaccagaaggtgtatattggagaagaagaaaaaaaaatcttcctggagaagcttaaaagagacgtggagtttcttgtacagctaaagatcatggactactccctgcttctgggtattcatgacatcattcgtggatctgagccggaggaggaggcacccgtaagagaggatgaatccgaggttgacggtgattgcagcctgacgggcccccctgccctggtcggctcgtatggcacttcacccgagggaatcgggggctacatccacagtcaccggccccttggtcccggtgaattcgaatcatttattgacgtgtatgcaatccggtcagccgaaggagctccccagaaagaggtatacttcatgggccttattgacatcttgacacagtacgacgcaaagaaaaaagccgcacacgcggccaaaaccgtcaagcatggcgccggggccgagatctccacggttcacccagaacagtacgccaagcgctttctcgacttcattactaatatcttcgcctag

SEQ ID NO: 17883 - DNA, 756 bp, Artificial Sequence
  Description of Artificial Sequence: Synthetic coding sequence
atggattcagagctgatgcactcaatcgtggggagctaccataaacctccagaacgggtttttgtgccctcattcacacagaatgaaccttcccagaattgccatccagccaacctggaggtcacctcgccaaaaatattacactcccccaactctcaggccctcatcctggctcttaagacgctgcaagagaaaattcatcggctcgagctggagcgcacacaggccgaagacaatctgaatattctctctcgggaagccgctcagtataagaaagctctcgagaatgagaccaacgaaaggaaccttgcacatcaagagttaattaaacagaagaaggatatcagtatccagttaagttcggcccagtcacgatgtacactgctggagaaacagttggagtatacgaagcggatggtcttgaacgtcgagagggaaaaaaacatgatcctcgaacagcaagcccagctccagcgggagaaagaacaggaccagatgaaactttatgccaagctagagaaactcgatgtgctggagaaggaatgtttccgccttactactactcagaaaaccgcggaagataagatcaaacacctggaagaaaagctgaaggaggaggaacaccaaaggaagctattccaggataaggcttccgagctgcagacgggattagagatctcaaaaatcatcatgagctccgtgtcgaatctaaagcatagtaaggagaaaaaaaaatcttctaaagtctgtatttag

SEQ ID NO: 17884 - DNA, 1980 bp, Artificial Sequence
  Description of Artificial Sequence: Synthetic coding sequence
atggactcccagggcagagtgtgggctcaagaaatgttgcttcgggtgagccctgaccatgtgacattactggaccctgcaagtaaagaggaactggagtcctatcctttgggagctatcgtacgttgtgatgccgttatgcctcctgggcgcagtagatcccttctgctgctcgtctgccaggagcccgagcgggcccagccagatgttcacttctttcagggcctgagactgggcgccgagctcatacgggaagacatccagggggccctacacaactatcgctccgggcggggtgagcgcagggctgccgctctacgagctacacaggaagaactccaacgtgatcggtcacctgctgcagaaactcctccgttacagaggcggccatccgtacgtgccgtcatcagtacagtcgaacggggcgctggaaggggccggcctcaggctaaaccaattccagaagccgaagaagcacagcgcccggagcccgttgggacaagctccaatgcagactcagcaagtccagatttaggaccgcgagggcccgacctcgctgtcctgcaggcagagagggaagtcgacatactaaaccacgtgttcgatgacgtagagtcgttcgtttctagactccagaagagcgcagaagcagcgagagtcttagagcaccgagaaagaggaaggcgctcgagaaggcgggccgccggggaaggcctgcttactctccgcgccaagcctccttcggaggcggaatatactgacgtcttgcagaagatcaagtacgcttttagcctgctggctaggcttagaggaaacatcgccgacccaagcagccctgagttgctccactttctgttcgggccgctgcaaatgatcgtcaataccagcggaggccccgagtttgccagtagtgtgaggcgtcctcaccttacttctgacgctgtggcgttactgcgtgataacgtgaccccaagggaaaacgaactgtggactagcctaggagattcttggacgcgcccaggattagagctttcaccagaggagggaccaccctatcgccccgagttcttttcagggtgggagccccctgttaccgatccccagagcagggcgtgggaggaccccgtggagaagcagctgcagcacgagcgcaggagacgtcaacagagcgccccccaggtagccgtgaacggccacagggatctggagcccgagagtgagccccaactcgagtccgaaaccgccggtaagtgggtgctgtgtaattacgattttcaagcccggaactcaagcgagttatctgtgaaacagcgcgacgttctggaggtactcgacgacagtcggaaatggtggaaagtaagggacccagcggggcaggagggttatgtgccatataatatccttaccccctacccgggacccagactgcaccacagccaatcaccagcacgaagcctgaactctacacctccccccccccccgctccagccccagccccacccccagccctcgctaggcccaggtgggatcggccacgatgggactcatgtgacagtctgaatgggctcgatcctagcgagaaagagaagttttcccagatgctgatcgtcaatgaggaactgcaggccaggttggcgcagggaaggagtggtccaagcagagccgtgccggggccccgggcgccggagccacaactgtcacctggttctgacgcttcagaggtcagggcgtggttacaggctaaaggttttagctctggcactgtggacgcactcggagtgttgactggggctcagcttttctccttacagaaagaagaactgcgtgccgtgagtccagaggagggagctagggtatacagccaggtgacggtccagcggtctctcctcgaagataaggaaaaggtgtcggagctggaagcggtgatggagaagcagaaaaaaaaagttgaaggggaagtggagatggaggttatctag

SEQ ID NO: 17885 - DNA, 3702 bp, Artificial Sequence
  Description of Artificial Sequence: Synthetic coding sequence
atgaatactaaaaaaagaggtagccccgccagaacccatagcatgatgtcattgtcggtgaggcctcaacgcaggttgctaagtgctcgcgtgaaccgcagccaatcttttgctggagtcctcggcagtcacgaaaggggaccacggagctttccagtattctcaccaccaggaccgccaagaaagccgccagccttgtctcgggtgtccaggatgttctccgtagcacaccccgccgcaaaagtcccccagccagaacgcttggacctggtgtacaccgccctgaaacggggcttgacagcatacctagaggtccatcaacaagaacaggagaagctgcagggacagatccgcgagagtaaaaggaattcacggctgggctttctgtacgacctggacaaacaggtaaagtccattgaacggtttctcaggcgcctcgagttccacgcatcaaagatcgacgaattatacgaagcctactgtgtgcagcggaggttaagagatggtgcatataacatggtaagggcctacacaaccggatccccaggatccagggaggctagggattcgctggccgaagctacgcgaggacaccgcgaatacacagaatctatgtgccttctggaatcagaattggaggcacaacttggcgaatttcatcttaggatgaaggggcttgccggtttcgcgagactctgtgttggcgaccagtatgagatttgcatgaagtacggacgccagaggtggaagttgagggggcgaatagaaggcagcggcaagcaagtgtgggactccgaggagactatcttccttccactactcaccgagttcctgagtataaaagtgacagagttgaaggggcttgctaatcatgttgtggtgggttcggtctcctgcgagactaaagatctcttcgctgctcttccccaggtggtggctgtggatattaacgatcttggaaccatcaaattatctctcgaggtgacatggtcgccttttgacaaggatgaccagccctccgctgcctcctcagtcaataaggcttcaacagtcactaagcggttttccacctacagccagtcccctccagacacccctagtctgagagaacaagcattctataacatgctgcgtagacaggaggaactggagaatggcactgcatggagtctctcttctgagagctccgatgactcaagtagtccacagctgagcgggacggcgcgccacagtccagctcccaggcctctggtgcagcagccggagcccttgcctattcaggtggcctttaggcgacccgagacgccttcatcaggacctctcgacgaggaaggggctgttgcaccagtccttgctaacgggcacgccccatactcccgcactctatcacacataagcgaagcatccgtggacgccgctctagcggaggcgtctgtcgaagccgtagggcctgagagcctggcttggggacccagtcccccgacacaccccgccccaactcacggtgagcatccatctccagtgccacccgcattggatcccggacacagcgctacgagcagcacattaggcaccacaggctcggtgcccacgtcaactgatccggcccccagcgcccatctcgattcagtgcataaatcaaccgactccggtccatccgagttacctggacctacccacacaacgactggaagcacgtactcagccatcacgacgacacacagcgccccttcaccactgacacacaccactaccggctccacccacaaacctattatctcgacgctaacaacaactgggcctaccctgaacatcatcggcccggtgcagactaccacttctcccactcacacaatgccatcccctacccacacaaccgcctcccctacccacacatcaactagtcctactcatactcctactagtcccacccacaagacctccatgagcccacccactacaacttctcctacaccctcaggcatggggcttgttcagacagcaacttctccgacccatccaaccacttcacccacacatccaaccactagtcctatactgataaacgtcagtccctcaacgtcactggaactagccactctgtcatcaccgagtaaacatagcgacccaacactgcctgggacggacagtctcccttgttctcccccagtgtccaatagctacacccaggccgaccctatggccccacgcacaccacatccgagcccggcccactcttccaggaaacccttgacaagccctgctcccgatcccagcgaaagcacggtgcagagccttagtccaacgccatccccacctacccctgccccccaacactcagacctgtgcctcgccatggcagtgcagacgcctgtacccactgcagcaggcgggtctggggaccggtctttggaggaagctctcggggctctgatggcggcactggacgactataggggacagttccccgaactccaaggtttggagcaagaagtgacgagactggagagcctgcttatgcaacgccaaggcttaacaaggtccagagccagcagtttatctatcacggtggagcacgctttggagtcgttttcatttctcaacgaagatgaagacgaagataacgatgttcccggggacaggcctcccagttctccggaggccggagcagaggatagtatagattctccctccgcacgccccttgagcaccggctgccctgccctcgacgccgccctcgttaggcacttgtaccattgctcgaggttgttacttaagctaggaacattcgggcccttacggtgccaagaggcttgggcgttggaacgcctgctgagagaggctagagtgttggaagctgtttgcgaattctccagacgatgggagatacccgcatctagcgcccaggaagtggttcagttctctgcctcccggcccggcttccttaccttctgggaccagtgcaccgaacggctctcatgtttcttatgccctgttgagcgggttctgctcacattctgtaaccaatacggcgcacgtctcagtctgcggcagcccgggcttgcagaggcggtttgcgttaagtttctggaagatgcactgggccaaaagttaccacgccggccccagccaggaccaggggagcaactgaccgttttccagttttggagcttcgtcgaaacgctggattcacctaccatggaagcgtatgttacagagacagccgaagaagtcctgctcgtgcgaaatctgaactctgatgatcaggctgtggtcctgaaagccctgaggctggccccagaaggccgacttcgcagagatgggcttcgggccctgtcaagtctccttgtacacggcaataacaaagtcatggccgccgtatccactcagttgaggtcactgtcgctcggaccaacattccgcgagcgtgcattgttatgtttcctggaccagttggaagatgaggacgtgcagactagggtggccggctgccttgccctcggctgtatcaaagcccctgaagggatcgagccactcgtctacctatgtcagactgataccgaggcagttagggaagcagctagacagtcactgcagcagtgcggggaggagggtcagagcgcacatcgtcggctcgaggagtctcttgacgccctgccccgaatttttggccctggatctatggctagcactgcgttctag

SEQ ID NO: 17886 - DNA, 1428 bp, Artificial Sequence
  Description of Artificial Sequence: Synthetic coding sequence
atggatcagatggtgcagcaccctgcagcaaagatgatcgtgatggccagtcacatgcaagaacaggaggttggggatgggaccaacttcgttctagtgtttgccggggccctgctggaactcgccgaagagctgttaagaatcggactgtcagtttcagaggtgatcgagggatacgagatagcttgccgcaaagcccacgagatcttgcccaacctggtgtgttgcagcgcaaagaaccttcgtgatatcgatgaggtgagttccctcctgaggacctccatcatgagcaagcaatacggcaacgaagtgtttctagcgaaactcatcgcccaagcttgtgtgagtatttttccagattccgggcacttcaatgtggacaacatccgcgtgtgcaaaattctcggtagcggaatctcctccagttctgtgctacacggcatggtctttaagaaagagaccgaaggtgacgtgacttccgtgaaagatgcgaaaatcgctgtctacagctgtccatttgatggaatgatcaccgagactaaagggaccgtgttgatcaaaacggcagaagagcttatgaacttcagcaagggggaggaaaatttaatggatgcacaggttaaggctattgcagataccggcgctaacgtggtcgttaccggtggtaaagtagcggacatggcgcttcactatgccaataagtacaatattatgctggtgaggcttaatagtaagtgggacctgagaagactgtgcaaaaccgtcggcgcaaccgcgctccccaggttgaccccacctgtactggaagaaatgggacactgtgattccgtgtacctcagcgaagttggggatactcaagtcgtcgtgttcaagcatgaaaaggaagacggagccatctcgaccattgtcttgcgcgggagtaccgataatcttatggacgacattgagcgtgcggtggacgatggcgtgaacacttttaaagtccttacccgtgataaacgcctggttccaggcggaggggccactgagatagagctggccaaacagatcacatcctacggagagacgtgtccaggcctggagcagtatgctattaagaagttcgctgaggcgttcgaggccatcccccgcgcattggcggaaaactctggagtgaaggctaacgaagtgattagtaaactgtacgctgtgcatcaagagggaaataagaacgttgggctcgacatcgaggcagaagtgcccgccgtcaaggatatgctggaagctggcatcttggatacttacctggggaaatactgggctatcaagctggccacaaacgccgccgtgaccgtattgagagtggaccagatcatcatggccaagcccgcaggcggacctaaacccccctcaggaaagaaagattgggacgatgaccagaacgattag

SEQ ID NO: 17887 - DNA, 1626 bp, Artificial Sequence
  Description of Artificial Sequence: Synthetic coding sequence
atgagagccctgttgcacaagcctgagatgatcaaacaaattcttccagaacattccgtcttgcagaacattaatttcgtggaagcatttcaggacgagttgctggtgaccgaagtctatgacctgccacagcggccaaatgatgtgcagttattctatggctcaatgtgtaagatcatcctttccgttatcggcgagtttcgcgactgcatttcttcaagggaattccttcagccttcttctaaagcaagcctcgagtctacatcagatcttggcgcgagcggaaagcacggcggaaatgtatctctggacgtactgccagttaagggaccacaaggctcgccattactgagccgagcggctcggccgcccctggaccaacttgcatccgaggaaccctggaccgttctgccggagcatctcatactggtcgcacctagtccttgcgacatggccaagacaggaagattccagatagttaataacagcgtacgcttactgagattcgagctctgttggcctgcccactgtctgaccgtgacgccgcaacacggctgtgtcgctccagagagtaaactgcagattctggtgagtccaaattcatctttgtctaccaagcagtctatgtttccctggtctggtctaatctacatccactgtgacgacgggcaaaagaaaatcgttaaggtacagatccgggaggatctgacccaggttgaactgctgactcggttgacaagtaagcctttcggaattctgagccctgtttcggaaccttctgtcagtcatctggtcaaacctatgaccaagcccccctccacaaaagtggagattagaaataagtcgattactttcccaactaccgagccaggtgagacatccgagagctgtttggagctggagaatcacggaaccacggacgttaagtggcacttatcttctctagcaccaccttacgtcaaaggcgtggatgaatcaggagatgtcttcagagccacatatgccgctttccgctgcagtcccatctccgggttactagagtctcacggcatccagaaggtgtcaatcacattcctgccacggggacggggggactacgcccagttttgggatgtggagtgtcaccctctgaaggagcctcacatgaaacacaccctcagatttcagctatccggtcagtcgattgaggctgaaaacgagcccgaaaacgcctgtctgtctaccgactccctcatcaaaatcgatcacctcgtgaagcctaggcggcaagccgtaagcgaggctagtgcccgcattccagaacaattagacgtgacggcacgaggggtgtacgcccctgaggatgtatacagattccgtcccacctccgtgggcgaaagtaggactctaaaagttaacctgagaaataactccttcatcacccactcgctaaaatttctatcacccagggagcccttctacgtcaagcattctaaatattctctgagggctcagcactacataaacatgcccgtgcagttcaagcccaaaagcgctggcaagttcgaggctctactagttatccagaccgatgagggaaagtccatcgctattcgtctgatcggagaagccttggggaaaaattag

SEQ ID NO: 17888 - DNA, 1737 bp, Artificial Sequence
  Description of Artificial Sequence: Synthetic coding sequence
atgagcagcaaggggtcttcaaccgatggaaggacagacctcgccaacggctcgctgagcagttcccccgaggagatgtccggagccgaggagggacgggagacaagttccggcatcgaggtggaggcctccgatctcagtctgagcctcaccggggacgatggcggcccaaacagaacttctatggaggatacaggccactattctataaacgatgaaaatagagtgcacgatcgcagcgaggaagaagaggaggaggaggaagaagaagaagaggaacagccacgacggagagtacagaggaagagagccaaccgagaccaggacagtagcgacgatgagcgcgctttggaagactgggtgagctctgagacttctgccctgccacggccgcggtggcaggctcttcctgccctgcgagagagggaactcggaagtagcgctcgcttcgtgtacgaggcctgtggagcccgggtctttgtccagaggttcaggttgcagcacgggctcgaaggccacaccggttgtgtgaacacccttcattttaaccaaagagggacttggctagcttcgggatctgacgatctaaaagtggtggtctgggattgggtgaggagacagcccgtacttgatttcgaatctggtcataaaagtaatgtgtttcaagctaaattcctacctaactccggagattccacgctggccatgtgcgctagagacggtcaggtccgtgtggcagagctgtctgccactcagtgttgcaagaacactaagcgagtggctcaacacaaaggtgcatctcataaattagccctcgaaccggattccccctgcacgttcctgtccgctggggaggacgcagtggtattcaccatcgatctgcggcaggacaggcccgcctccaagctcgtcgttaccaaggagaaggaaaaaaaggtcggattatacaccatctatgtgaacccagcgaacacacaccaattcgcagtaggcgggcgcgatcaatttgtgcgcatctacgaccaaagaaaaatcgatgagaatgagaataacggcgttctcaagaaattttgcccccaccatttggtgaacagcgagagtaaggcgaacattacctgcctggtgtacagccatgatggcaccgagttgttggcctcctataacgacgaggatatttatttattcaattcaagccactcggatggagcccagtacgtcaaacgatacaaaggccacaggaacaacgccacagtaaaaggggtcaatttctatgggcccaagagcgagttcgttgtgtcaggcagcgactgtggccacatcttcttgtgggaaaagagcagctgccaaataattcagttcatggagggtgacaagggcggcgtcgtaaactgcttggaacctcatccccaccttcctgtgttggccactagtggcctggaccacgacgtcaagatctgggcccccactgcagaggcgagtacagaactaaccggcttgaaggatgttattaaaaaaaacaaacgagagcgggacgaggacagcctacaccagactgatttattcgactcacacatgctctggtttctgatgcatcaccttcgccagcggcggcaccaccggcggtggcgggagccaggtgtgggcgccactgatgccgacagtgacgagtccccatcatcatcagatacctcagacgaggaggaagggcctgacagggtacagtgcatgccttcttag

SEQ ID NO: 17889 - DNA, 426 bp, Artificial Sequence
  Description of Artificial Sequence: Synthetic coding sequence
atgggaggcaaacccagacattcactttacttcattggctatcaggacgatttcttgttatatctcgacccacactattgtcagccgaccgtcgacgtgtcccaggccgattttccactggagtccttccattgcaccagccccagaaagatggcatttgccaagatggacccatcctgcacagttggcttttacgccggagacaggaaagaatttgagacactctgctccgagctgacccgcgtcctcagctcaagctctgctaccgaaaggtaccctatgttcaccctggcggagggccatgcacaagatcattctctggatgatctgtgcagccaactggcacagccaaccctaaggctcccaaggacaggcaggctgctgcgggccaagagaccgtcctcagaggatttcgttttcctctag

SEQ ID NO: 17890 - DNA, 570 bp, Artificial Sequence
  Description of Artificial Sequence: Synthetic coding sequence
atggtgttgctgcacgtaaaacgcggagacgagtcacagtttttgctgcaggccccaggttccacagaactggaggaactcacggtccaggtcgccagggtttacaacggccgactaaaagttcagcggctctgctcggcccccaacgagaagatgaaacaagtcctcaagaagactatcgaagaagctaaggcaataatctctaagaagcaggtggaggcaggcgtctgcgtcacaatggagatggtgaaggatgctctggatcagctcaggggggcagtgatgatcgtgtatcccatgggtctccccccatatgatccaatccggatggagtttgaaaacaaagaggatctgtccgggacccaagccggactcaatgtaatcaaggaagccgaggcccagctgtggtgggccgctaaggagctccggcgaacgaagaaactgagtgactatgtcggcaaaaacgagaaaaccaaaataatagccaaaatccagcaggtgtcaacattttgttttaacgtgagcgtggtgttcgtgatcagccttcagaccgataaaaacgttcaatag

SEQ ID NO: 17891 - DNA, 2031 bp, Artificial Sequence
  Description of Artificial Sequence: Synthetic coding sequence
atggcagctatccagcacgggcatgaggccgtagtgcgcctattaatggagtggggcgcggatcctaatcacgccgccagaacagtaggatggagccccctgatgttggccgctttgaccggaaggttaggtgtagcccagcagctggttgaaaagggtgctaaccccgatcatttaagtgtgctagagaagaccgctttcgaagtggcactggattgcaagcacagagacctggtggactatctggatccccttaccacagtgaggcccaaaactgacgaagagaagcgccggccggacatatttcacgcgctcaagatgggaaacttccagctggtaaaggaaatcgccgacgaggatccatcgcacgtgaatctcgtaaatggggatggagcaactcctctaatgctggccgctgtcaccgggcagctggccttggtgcaactccttgtggaaaggcatgccgatgtggataaacaggactctgttcacggctggacagccctgatgcaggccacttaccacggcaataaggaaatagtcaagtatttgctgaatcaaggagcggatgtgacacttagggctaaaaatggctataccgcattcgacttagtgatgctgcttaatgatcctgatacagagctcgttagattactggcatctgtgtgtatgcaagtcaacaaagacaaggggcgcccatcccatcagccacctctgccccattccaaggtccgacagccttggagcataccagtactcccagacgacaagggaggattaaaaagttggtggaaccgcatgagcaatcgctttcggaagctgaaactaatgcagacgttgcctcgggggctgtcctctaaccaacccctgcctttcagtgacgaacccgagcctgccctggactctaccatgcgcgcggcgccccaggataaaacttcacgcagtgccttgcctgatgctgccccagtaaccaaggacaatgggcccggtagtaccaggggagagaaggaagacacccttcttacgacaatgctgagaaacggcgcacccctcactagattaccaagcgacaagctgaaagccgtgatcccacccttcctgccaccatccagctttgagctctggtcctccgaccggtccaggacccggcacaatggtaaggctgaccccatgaagaccgcgctgccacaacgcgcttcaagaggccatcctgtgggaggggggggcactgacaccacgcccgtgagaccagttaaattcccatccttgccccggagcccggcctcatctgctaattcaggaaattttaaccattctcctcactcgtcagggggatccagtggggttggcgtgtctcgccacgggggagagctgctgaacaggtcaggtggctctatagacaacgtgttgagccagattgccgcacagagaaagaaagccgcaggactcctggaacaaaagccgagccaccgtagcagtccagtgggcccagcccctgggtcttccccatcagaactgcctgcttcccctgcggggggttcggcccccgtagggaaaaagctagaaaccagcaaacgccctccaagtggcaccagcacaacctccaaatcaacaagccccaccctgaccccaagcccatcaccaaaaggccacacagctgaaagttctgtgagttcgagttcttcccacaggcagtctaaatcttccggggggtcgtcttccggtacaattacggacgaagacgaactgacaggtatacttaagaaattatccctggaaaagtatcagcctattttcgaagagcaggaggtcgatatggaggcattcctcaccctcacagatggtgacctcaaagagctcggcattaaaacagacggatctcgccaacaaatcctcgccgctatttcagaactgaacgcaggcaaaggccgcgaaaggcagatccttcaagagaccatccacaatttccattcatcttttgagagttccgcatcaaacactagggcgccagggaacagcccatgcgcctag

SEQ ID NO: 17892 - DNA, 2319 bp, Artificial Sequence
  Description of Artificial Sequence: Synthetic coding sequence
atgaggcaccagaagaggaacgtgtaccactgtaacaaatgtaggcttcaattcttgttcgctaaggacaagatagaacataagttgcaacaccacaagacatttagaaagccaaaacaacttgaggggctaaagcctggaaccaaggtcaccatccgggccagtcgtggacagcctaggactgttccagtgagctccaacgataccccaccaagcgctctccaggaagcagcacctcttacctcctccatggatcctctccccgtgttcctgtacccacctgtgcagagaagtattcagaaaagggcagtccgcaagatgagcgtgatgggtcggcagacttgccttgaatgctcatttgaaataccagacttccctaatcatttccccacctacgtgcactgtagcttatgtaggtactctacctgctgctctagagcctacgcaaaccatatgatcaacaaccacgtacctaggaagagtcccaaatatctggccttattcaagaactccgtcagcggaattaaactggcctgcacaagctgtaccttcgtaacttctgttggtgatgcgatggcaaagcatttggttttcaacccttctcaccggagctcctccattctcccaagggggctcacgtggattgcccattcacggcacgggcaaacccgtgacagggtccatgacaggaatgtgaaaaacatgtacccgccgccctcttttccgacaaacaaggccgccaccgtcaagtctgcaggggcaacccctgctgaacctgaagagcttctcacacctttggcacccgccctgccctcacctgcctctacggctacgccgccaccgacacccactcaccctcaggcactggctctacctccactggccacagagggcgcagagtgccttaatgtcgacgatcaagacgaaggaagccctgtgacccaagagcccgaacttgcaagcggcggaggaggttctggaggagtcgggaaaaaggagcagctaagcgtgaagaagctgagagttgtgctcttcgcgttatgttgcaatactgagcaggctgccgagcacttcagaaacccccaaaggcggatcaggagatggctgagaaggtttcaagctagccagggtgagaacctggagggcaagtacctttcatttgaagccgaggagaaactcgccgaatgggtgctcacacaaagagagcagcagctcccagtgaacgaggagacactcttccaaaaggcgaccaaaatcgggagaagcctggaaggaggtttcaaaatctcctatgagtgggcagtccgattcatgttacgtcatcatctgacgcctcatgcacggagagctgtcgcacacacgctgccaaaggatgtggcagagaatgcaggactgttcattgacttcgttcagcgccagattcacaaccaggatctgccgttgtccatgatcgtggccatcgacgagatatcgctgtttttggacacagaggtgctgtcttctgacgatcgaaaagaaaatgctcttcagaccgtcggcaccggcgaaccatggtgtgacgtagtgttagccatcctggctgacgggactgtgttgccaacacttgtgttttataggggccaaatggatcagcctgccaacatgcccgatagtatcttgctggaagccaaggaatccggatactcagatgatgagatcatggagctttggagtaccagagtttggcaaaagcacacggcatgccagcgatccaaagggatgctggtgatggactgtcacaggacccacctgagcgaggaagttctggctatgttaagcgccagctctacattgcctgccgttgtgccggctggctgtagctcgaaaattcaacccttagacgtttgtataaaacgtactgtgaaaaattttctacacaaaaagtggaaagagcaggctcgggaaatggctgacaccgcttgcgactccgacgtcctcctgcagcttgtgcttgtttggctgggagaggtcctgggagtgatcggcgattgccctgaattagtgcagcggtcatttctggtggcatcagtattacccggacccgatgggaatattaattcgcctaccaggaatgccgatatgcaggaagagctaatcgcttcgctggaggagcagctcaaactatctggggagcacagcgagagcagtacccctagacccaggagcagtcccgaagaaaccatcgaacctgaaagtctccatcagctgtttgagggcgaaagtgaaactgagtctttctacggattcgaggaggcggaccttgacctgatggagatttag

SEQ ID NO: 17893 - DNA, 285 bp, Artificial Sequence
  Description of Artificial Sequence: Synthetic coding sequence
atggccatgaccgccggaacaacaaccactttccccatgtccaaccacacgcgggaacgtgttacagtggctaagctgacccttgagaatttttattcaaacctaattctgcaacacgaagagcgggagactcgccagaaaaagcttgaagttgcgatggaagaggagggccttgctgacgaggagaagaagctgcgtcggagccagcacgcacggaaggagaccgagttcctgagactgaaaagaactcgcctgggcctggatgactttgagtcactgaagtag

SEQ ID NO: 17894 - DNA, 1047 bp, Artificial Sequence
  Description of Artificial Sequence: Synthetic coding sequence
atgggcaaagactactataaaattctgggtatcccttctggtgctaatgaagacgaaattaagaaggcctacaggaaaatggctctcaagtaccacccagacaagaacaaggagcctaacgctgaggagaaatttaaggagatagccgaggcctacgatgtgcttagtgaccccaaaaagaggggtttatacgatcaatatggcgaggagggcttgaaaaccgggggcgggacttcagggggatccagcggatcctttcactacacttttcacggagatcctcacgcaacctttgcgtcgtttttcggaggtagcaatccctttgacatttttttcgcatcctctcgtagcacaaggccatttagtggattcgaccccgatgatatggatgtggacgaggacgaggatccctttggggcttttggccgattcggtttcaatggtctgtcccgggggccgagacgcgctcctgagccactctatccccggcgcaaggtgcaggacccacctgtagtgcatgaattacgggtgtctcttgaggagatctaccacgggagcaccaagagaatgaaaattactcgaagaagattgaatccggatggtcggactgttcgaacagaggacaaaattctgcacattgtaataaagcggggatggaaagaaggaaccaagattacattcccaaaagagggagatgcgaccccggacaacattcccgcagatatagtgttcgtccttaaagataagccccacgcccacttcaggcgtgacggcacaaatgtactgtacagcgccctgatctcattgaaggaggcactgtgtggctgtaccgttaacatcccaaccatcgacggaagggttatacccctaccatgtaacgacgtaatcaagcctggtaccgtgaagcgactacggggtgaaggccttcccttccctaaagtgccgacccagagaggtgacttgattgtggaattcaaggttcggttccctgatcgacttacccctcaaacccgacagattcttaagcaacacctgccgtgctcttag

SEQ ID NO: 17895 - DNA, 888 bp, Artificial Sequence
  Description of Artificial Sequence: Synthetic coding sequence
atgccggttcatacactgtcacccggcgcaccatcagcgcctgccttaccgtgtaggcttaggaccagagttcctggatacctccttcgcggacccgcggatggcggcgccagaaaaccaagtgccgtcgagcggttagaggccgacaaggctaaatacgtaaaatctctgcacgtggcaaatactagacaggagccagttcagcccctgctcagtaagcagcctttgttctccccagagacccgaaggacagtgctgactcccagccggcgcgctctccccggaccatgccgtcgtccgcagctggatctggatattctgtcctcactcatcgacctttgcgactcgccagtgtctcctgcagaggcgtcccgcacgccaggccgtgcagagggcgctggacgccctcccccagccacaccgccccgaccaccgccaagcacttctgccgtacgaagggtggacgtgcggccccttcccgcatcaccggcccgaccttgtccatcacctggccccgcagcagccagctcaccagctaggccccctggcttgcagaggagcaagagcgatctgagcgaaaggttttcccgggcagccgcagatctcgagaggttctttaacttctgtggactggaccctgaagaggcgagaggcctcggggtggcgcaccttgcacgagcgtccagcgacatcgtcagcttggccggacctagcgcaggaccgggttcttcagaaggcgggtgctccagacgcagtagtgtaactgtggaggaaagagctcgtgaaagggtgccttacggggtgagcgttgttgaaaggaacgcccgcgtaattaagtggttgtatggccttaggcaggcgcgagagtcccccgccgcggaaggttag

SEQ ID NO: 17896 - DNA, 258 bp, Artificial Sequence
  Description of Artificial Sequence: Synthetic coding sequence
atgccctacaacgaggccgaaaacaaacggtcttaccacctttgtgatctctgtgaccggatcattatcggggacagggagtgggcagcccatattaaaagcaaaagccacctgaaccaactgaagaagaggcggcgcctggatagcgacgcagtcaatactattgaatcccagagcgtgagccccgaccataataaggaaccaaaagaaaaaggatccccagggcagaacgatcaagagttaaaatgttccgtctag

SEQ ID NO: 17897 - DNA, 396 bp, Artificial Sequence
  Description of Artificial Sequence: Synthetic coding sequence
atggccatgaccgctggaactactacgacttttcccatgtcgaatcacaccagggaaagggtcactgtggccaagctgactctagagaacttttattctaacctgatcctgcagcacgaggagcgcgaaactcgccaaaagaagctggaggtggctatggaggaggaaggactggccgacgaggagaagaagctccgtaggagccagcacgcacgaaaagaaacggaattcctgagactgaaaagaaccaggttagggttggatgacttcgagagtcttaaagtcattggcaggggagcctttggggaggtgcgcctcgttcaaaaaaaggatacaggccatatttacgctatgaaaattctacgaaaaagcgatatgctggaaaaagagcagtag

SEQ ID NO: 17898 - DNA, 21 bp, Artificial Sequence
  Description of Artificial Sequence: Synthetic coding sequence
atggcacacgagatgatatag

SEQ ID NO: 17899 - DNA, 2199 bp, Artificial Sequence
  Description of Artificial Sequence: Synthetic coding sequence
atgggcttccgcgatgaagcagcgggctattttcataaggctgtaaagttgaaccccgacttttctgatgcgaaggaaaacttctatcgagttgccaattggctcgtcgagaggtggcactttattatgttaaatgacactaaaaggaataccatttataatgccgcaatccaaaaagcagtgtgcctcgggtccaaaagcgtattggatattggagccggcactggaatcctgagtatgttcgctaagaaggccggggctcacagcgtctacgcctgtgagttgagcaaaactatgtatgaattagcttgcgatgtcgtggccgctaataagatggaggcgggcatcaaattgttgcacacgaaatcgctcgacatagaaattccgaagcatattcccgaaagggttagtctggtggttactgaaacggtagacgcaggcctattcggtgagggtatagtcgagtcccttatacacgcctgggagcatctcctgctgcagccaaagaccaaaggggaatccgcgaattgtgagaagtatggaaaagtaattccagcatccgccgttatctttggcatggctgtcgagtgcgcagaaatccgcagacatcatagggtggggatcaaagacatcgcaggcattcacctgccaaccaatgtcaagttccagtcccctgcttactcgagtgttgataccgaggagacaatcgaaccctacacaaccgaaaaaatgtctcgggtcccgggaggatacctggctctgacggaatgcttcgaaattatgactgtggatttcaataaccttcaagagctcaagagccttgctactaagaagcccgataagatcggaattcctgtgattaaggaaggcatactggatgctatcatggtttggtttgttctccagctggacgatgaacattctctgtccacatccccctctgaggaaacctgctgggagcaagcagtctatcccgtgcaagatctggccgattactggataaaacctggtgatcatgtaatgatggaggtatcctgccaagactgctacctaaggatccagagcatcagtgtactgggtcttgagtgtgagatggatgtggccaagtccttcacgcagaataaggatctcctttcattggggaatgaggccgaactgtgctcagccctggccaatttacagacctccaagccagacgcggtggagcagacatgtatcctggagtccacagagattgcgctgttgaacaacatcccttaccacgaagggttcaaaatggctatgtcaaaggtacttagctctctgacacccgaaaagctttaccagaccatggatacccattgccaaaacgagatgtcctccggaactggccagagcaatacagtccaaaacattctggaacccttctacgtcctggatgtaagcgagggcttcagcgtcctacccgtaatcgcggggacccttgggcaagtcaaaccttactcgagtgtggaaaaagaccagcatcggattgccctggacctgatttctgaggccaatcacttccctaaggagacgctggaattctggcttcgccacgtggaagatgaaagtgccatgctgcaaagacccaagtcggacaaactctggtccatcataatcttggacgtgatcgagccaagcggcttgatacagcaggagattatggagaaagctgcgatctccagatgtttgctacagagcgggggaaagatattcccccagtacgtactgatgtttggcctgctagttgaaagccaaactttgttagaggaaaacgcggttcaggggaccgagaggacgctgggactcaatatcgctccattcatcaaccagtttcaggtgccaattagggtgttcttggatttatcttcgctcccttgtatcccccttagtaaacctgtggagctgctccgtctggacctgatgacgccatacttgaatacatctaacagagaggtgaaggtgtacgtttgtaaaagcggcaggcttaccgctattcccttttggtaccatatgtatctggacgaagagattaggttagacacctcttctgaggctagccattggaagcaagccgctgtggttcttgacaaccccatccaagtagaaatgggtgaagagctggtactgagcattcagcatcacaaatctaacgtcagcatcaccgtgaaacagtag

SEQ ID NO: 17900 - DNA, 1554 bp, Artificial Sequence
  Description of Artificial Sequence: Synthetic coding sequence
atgtgctccttggcctcaggggctactggcgggaggggggccgtggaaaacgaggaggatctcccagaactgtcggatagcggggacgaagcagcttgggaagacgaagacgacgccgacctgcctcatggaaagcaacagacaccctgcctgttttgcaaccggttattcacctcagccgaggagacattttcccactgcaagtccgagcaccagtttaacatcgattctatggtccataagcatggcctagaattctatggctacatcaagcttattaatttcatccgcctgaagaacccaaccgtggagtatatgaactctatctacaatcctgtgccctgggaaaaggaggagtatctgaaaccagtgctggaggacgacctgttgcttcagtttgatgttgaagatttatacgagcccgtgagtgtgccttttagctatccaaacggcttatctgagaacacgagcgtcgtggagaagcttaagcatatggaggcaagagcgctttcagcggaggctgctctggccagagcccgggaagacctgcagaaaatgaagcagttcgcgcaggactttgttatgcataccgacgtacgtacgtgctcctcttctacatcagtgatcgctgacctgcaggaggatgaggacggagtctacttctcctcctatggccattatggcatccacgaggaaatgctgaaggacaagataaggaccgaaagctatcgagattttatctatcagaatcctcatattttcaaggataaagtggttctggacgtgggttgcggaaccgggattctcagtatgttcgccgccaaggcaggggcaaagaaagtcctgggcgtggatcagtcagagatcctctatcaggccatggatattattagactcaacaaactggaggacacgattacactgatcaagggtaagatcgaagaagttcatctgcccgtggagaaggttgacgtgattattagcgaatggatggggtactttctacttttcgaatcgatgctggatagcgtgctctacgcgaagaacaagtacctcgcgaaaggcggatctgtatatccagacatatgtactatcagcttggtcgccgtttccgacgtgaataagcacgcagatcgtatcgcattctgggacgacgtctacgggttcaagatgtcctgtatgaagaaagccgttatccctgaggccgtagtggaggtccttgatcccaagacactgatctctgagccctgtgggataaaacatattgactgccataccacaagtatatcagacctggagttctcctctgacttcacattaaagatcactcgcacatcaatgtgtaccgcaatcgccggttacttcgatatttatttcgaaaaaaattgccataatcgggtagtattctctaccgggccgcagagtactaagacccactggaagcagacagtcttcctgttggagaaacccttcagtgttaaggctggggaagcactgaaggggaaggtgaccgtgcacaaaaataaaagagaggtgctgatcgtgggtatttag

SEQ ID NO: 17901 - DNA, 1560 bp, Artificial Sequence
  Description of Artificial Sequence: Synthetic coding sequence
atggaacaagaaaagtttgacttgcaaaaacaacacaccgaaaacattcaggaacttttagaagacacgaacgttcggctgaataaaatggaaagcgagtacatggcccagactcagagtaccaaccacatgatcaaagaattggaggcccgcgttcagcaactgactggagaagctgagaattccaatctacagcgccagaaactaatacaggagaaagctgagttggaaagatgctatcagattacctgttctgagctgcaggaggtgaaggctcgtcgaaacacactgcataaagaaaaagaccaccttgttaatgattatgagcagaatatgaagctacttcagacgaaatatgatgccgatatcaaccttctgaaacaggagcacgccctcagtgcatcgaaggcaagttctatgatagaagaattggagcagaacgtttgccagctaaagcagcagctacaggagtcggaacttcagcgcaagcagcagctgcgggatcaggagaacaaattccaaatggaaaaatctcatctcaaacacatctatgaaaaaaaagcccacgatcttcagtctgagctagacaagggcaaagaggatacacaaaaaaaaattcacaaattcgaagaagcccttaaggaaaaagaagagcagcttacccgcgtgaccgaagtgcagaggttgcaagcacaacaggccgatgccgcactggaggagttcaaaagacaagtggagttaaactccgagaaagtgtacgctgaaatgaaagagcaaatggaaaaggtcgaagctgacttgactcgatccaagtccctgcgcgagaagcagtctaaagaatttctgtggcagctggaggatatccgccagagatatgagcagcagatagttgagctaaagcttgagcacgaacaggaaaagacccatctcttgcagcagcataacgcggaaaaggattcactggtgcgagatcatgagagagagatagaaaatctcgagaagcagctccgagcggctaacatggagcatgagaaccaaattcaggagtttaaaaaacgtgacgctcaagttattgcagatatggaggcgcaggttcacaagctgcgagaagagctcatcaacgtgaactcacagcgcaagcagcagttggtggagctgggcttactccgggaagaggagaaacaacgggcgacgagggagcacgaaattgtggtcaataagctgaaggcagagtccgagaagatgaaaatcgagctcaagaagacccacgccgctgagacggagatgactctcgagaaggtcttgcaggatgagctggagaaccggagcaaccaggtgaggtgtgctgagaagaagctgcagcataaggagctggagtcacaggagcagatcacctacattcgacaggaatacgagaccaagctgaaaggtttgatgcccgcctcactacgccaggaattggaagataccattagttccctcaaatctcaagtgaatttcttacagaagagagcatccatcctgcaagaggaactaacaacttaccaggggaggcggtag

SEQ ID NO: 17902 - DNA, 1743 bp, Artificial Sequence
  Description of Artificial Sequence: Synthetic coding sequence
atgaataatatccatgtcgagaacgagtccctcgacaacttcctgaaggaaactaataaggagaacctgctcgatattctgacggagcctgagcgaaaacccgacccaaagctttacacaaggtcgaagccaaagacagactcttacaaccagaccaagaattcactcgttccgaagcaggcactggggaagtcatcggtgaacagtgctgtgctgaaggatcgcgtcaacaaacagttcgtaggcgagacacagagccgcactttccccgtaaagagtcagcaactttccaggggagctgacctggcgcggccaggggtcaagccttctcggaccgtgccgagccacttcattagaacccttagcaaagtgcagtctagtaagaagcctgtggtaaagaatatcaaagatatcaaggttaacaggagtcagtatgaaagaccaaacgagaccaagattcggagctatcctgtgacagaacagcgtgtgaagcataccaagccccggacctatccaagcctcttgcagggagagtacaataataggcatcctaacattaaacaggatcagaaatccagccaggtgtgcatcccacagactagctgtgtgctccaaaagagtaaggcgattagccagaggccaaatctgaccgtgggccgattcaactcggccatcccttcgaccccaagcatccggcccaatggcacgtctggaaataagcacaataacaacggatttcagcagaaagctcagaccctggactcgaaactaaagaaggcggttccccagaatcactttttgaacaaaaccgcaccaaagacgcaggctgacgttacgaccgtcaatgggacccaaacaaatccaaacataaagaaaaaggctaccgccgaagacagacgcaagcagcttgaagagtggcagaagtctaagggcaaaacgtataagcgtcctcctatggagctgaagacaaagcgcaaggtgattaaggagatgaatattagcttctggaaatccatcgagaaagaggaagaagagaaaaaggcccagctggagctctcaagcaaaatcaataacacactgacagagtgcctgaatctaattgaggggggcgttcctagcaacgaaatcctgaacatcctgagcagtatccccgaggctgagaaattcgctaagttttggatttgtaaggcaaagttgttagcttcaaagggcacatttgatgtcatcgggctctacgaagaagccataaagaatggagctacccccattcaggagctgcgtaaagtagtcctgaacattctgcaagattccaaccgaacgactgaaggcattaccagcgattccctggtggctgaaacttctataacctctgtagaggaattagccaagaaaatggagtcggtcaaatcttgcctgtctccaaaagagcgggagcaagtgacagcaacacctcggatcgctaaggccgagcagcacaactaccctggaattaaacttcagattggccccatccccaggattaatggcatgcctgaggttcaggatatgaaattcattactcccgtgaggcgcagctcccgaatcgaacgggcggtgagccgctacccagagatgcttcaggagcacgatctggtggtggcatcgttagacgagttgctcgaggttgaggaaactaagtgcttcattttccgaagaaacgaggccctgcctgtcacgctgggattccaaactccagagagctag

SEQ ID NO: 17903 - DNA, 705 bp, Artificial Sequence
  Description of Artificial Sequence: Synthetic coding sequence
atgtatatggacttggtagacggcatctttctgaaccaaatcatgctccagatcgatccgaggccgaccaaccagcggatcaacaaacatgtgaacaacgacgtgaaccttagaattcagaatcttacaatactggtacgcaatatcaagacgtattaccaggaagtgctacaacagctgatcgtgatgaacctacccaatgtcttaatgattgggcgggaccctctctccggcaaaagtatggaagagatcaagaaggtgcttcttcttgtgctcggctgtgccgtgcagtgcgaaaggaaagaagaattcatcgaacgtattaaacaactggacattgagacacaggcgggcatcgtagcacacatccaggaagtaacacacaatcaggagaacgttttcgacttacagtggctggagttgcctgacgtcgcccctgaagaattagaagccctgtctcgatcaatggtgttacacttgcggcgactgattgaccagagggatgagtgtactgagctgattgtggacctcacccaggagcgagattacctacaagcacaacaccctccaagccccatcaaaagctccagtgccgactcgacaccatcccctacatcaagcctgagctccgaggacaagcagcacctggccgtagaattggcggatactaaggccagattaaggagagtgcgacaggagctgtag

SEQ ID NO: 17904 - DNA, 1161 bp, Artificial Sequence
  Description of Artificial Sequence: Synthetic coding sequence
atgaccgatatccggaaaattaggttgggggagcggttggtagaggtattctcagcggagaaggtctatatggttagactcagaaacccactgggcaggcaggaatggtccgggccatggagcgaaatctccgaggagtggcagcaacttactgcttcggacagaaaaaatcttggcctcgtgatgtctgatgacggcgaattctggatgtctctggaagacttctgcagaaactttcacaaactaaacgtctgccggaacgtgaataaccccatctttggacggaaagagcttgaatccgtgctgggatgttggactgtggacgacgatccattgatgaatcggtctggcggatgctacaataatagggacacatttctgcaaaacccccaatacattttcacggttccagaagatggacacaaagtaattatgagtctccagcaaaaggatctgcggacttaccgtcggatggggcgaccggataactacattataggctttgaactgttcaaagttgaaatgaacaggaagtttaggcttcaccatctgtatatccaggaacgggcaggaacatcgacctacatcgatacaagaacggtgttcttgagcaagtaccttaagaagggtaactatgtactcgttccgaccatgtttcagcatgggaggacatctgagttcctcctgcgcatcttcagtgaagtgccagtgcagctgagggaacttactctcgatatgccaaagatgtcctgctggaacctggcccggggctacccgaaagtggttacccagatcactgttcacagcgctgaggatttagagaaaaaatacgctaacgaaaccgttaatccctatttagtgataaagtgcggcaaggaagaggtgcgctcacctgtgcagaaaaacaccgtgcatgcaatctttgatactcaggccattttttatcgtcgaaccaccgacatcccgattattgtgcaggtgtggaacagtcggaagttctgtgaccagttcctggggcaagtcacactcgatgcagatcccagcgattgtagagatctcaagtccctatatttgcgcaagaaggggggacccacagcgaaagtcaagcagggccacatcagtttcaaggtaatctcctcagatgacctgacggaattgtag

SEQ ID NO: 17905 - DNA, 966 bp, Artificial Sequence
  Description of Artificial Sequence: Synthetic coding sequence
atgaccgaattatcgctgcagaaggagcagctgcagttgaagatcattgaaattgaggatgaagcagagaagtggcaaaaggaaaaggaccgcatcaaatctttcacaaccaacgaaaaggcaatactggaacagaacttccgggatctggtgcgggacctggagaaacaaaaagaggaggttcgagctgcgctggaacaacgtgagcaagacgctgttgaccaagtcaaagttattatggatgcattggatgagcgcgccaaagtactgcacgaggacaagcaaactagagagcagcttcacagcatatcagattctgtactgtttctccaggagtttggcgccttaatgagcaactattccctcccacccccactgcctacttatcacgtgctgttggagggggagggcctggggcaatccctcggtaatttcaaagatgacctgctgaatgtctgcatgaggcacgttgaaaaaatgtgtaaagcagacctctccagaaatttcatcgaacgcaatcatatggagaatggcggagatcataggtacgttaacaactataccaactcatttggaggtgaatggtctgcgccagacacaatgaagcgctacagtatgtacctgactcctaagggcggagtcagaacatcttaccagcccagtagtcccgggcgcttcaccaaagagactacgcagaaaaatttcaacaacctctatggcactaaaggaaattatacctcacgagtatgggagtactcctcttcaattcagaatagcgacaacgacctccccgtcgttcaggggagctcgagttttagccttaagggatacccatcattgatgagatctcaaagtccaaaggcccagccacagacatggaaatccggcaagcaaacgatgctcagccactatcggcccttctatgtgaacaagggaaatggaatcggcagcaacgaggccccttag

SEQ ID NO: 17906 - DNA, 687 bp, Artificial Sequence
  Description of Artificial Sequence: Synthetic coding sequence
atgtaccgtcagcggtttctctatagcctgtatcggcacacacattgggtgcgctgtgccaagttcagccccgacggtagactgatcgtctcctgttctgaggacaagacaatcaagatatgggatactacaaataaacaatgtgtgaataatttttcagattctgtgggcttcgcaaacttcgtcgatttcaacccaagcggaacctgtatcgccagcgccggatcagaccagacagtaaaggtttgggacgtgcgcgtgaataagctgctgcagcactatcaagttcatagcggcggggtgaattgcatctcgttccacccctccggcaactacctcattactgcatcgagtgatggaactctgaaaatcctcgatctgctcgaaggaagactgatctacacactacaaggacacactgggcccgtttttaccgtttccttctcaaaaggcggcgaattgttcgccagcggtggcgcggacacgcaggtcctgttatggaggacaaactttgacgagctgcactgcaagggcctcacaaagagaaacttgaaaagactgcatttcgactctccgccccaccttctggatatttatccccgcaccccacatccgcacgaggaaaaggtagaaaccgtggaagattttttcttacacctgctgcgactcatccagtccttgaggtag

SEQ ID NO: 17907 - DNA, 1686 bp, Artificial Sequence
  Description of Artificial Sequence: Synthetic coding sequence
atgcgcgccgtacgacggcacttgttcccccagcatagcgccccagggcggggggttgtttgggagtggctgagcgatgacggcagttggaccgcatatgaagcatctgtgtgcgattacctggaacagcaggtggcccgcggaaaccagctggtggacctggctccactgggctacaactataccgtcaactacaccacccacactcagactaataagacgagcagcttctgtagaagcgtgcggagacaggcaggacctccatatccggtgacgaccataatagcacccccaggccatacgggggtggcctgtagttgtcaccaatgccttagtgggagcagaacggggcccgttagtggtcgctacagacactctatgaccaacctaccggcttatcccgtgccacaacatcccccccatcggaccgccagcgtcttcggaactcaccaagcctttgccccttacaacaagccctctcttagcggggctaggagtgcaccacggttgaacaccaccaacgcgtggggagccgcaccaccgtccctggggagccagccgctgtacaggtctagcctatctcacctcggaccccagcatctccccccaggttcatcaacatctggcgccgtgtccgcatccctccccagcggaccgtcctcatcacctgggtccgtgcccgcgacggtgccaatgcaaatgccaaagccatccagggtgcagcaagccttggccgggatgactagtgtgctcatgtctgctattggattgcccgtgtgcctctcccgggctcctcagccgactagtcctcccgcttcaaggctggcaagtaagagtcatggctctgtgaagaggttgaggaagatgagtgtcaagggcgcaacacccaagcctgagcctgagcctgagcaagttattaaaaattatacagaggaactcaaggtgcctccggacgaggattgcattatctgtatggaaaagcttagcacagcctcaggatactcagacgttaccgacagtaaggcaatcgggagcctggcggtgggtcatctgaccaaatgcagccatgccttccacctcctgtgcctactagctatgtactgcaacggaaacaaggacggctcactacagtgcccgagctgcaaaaccatctatggggagaaaacgggcactcagccccagggcaagatggaagtgttgaggttccagatgtctctgccgggtcatgaagattgtggcacaattctaattgtgtactcaataccccacggtatccaggggccagagcatccaaatcccgggaagcccttcactgcccgcggatttccgaggcaatgttatttgcccgacaatgcccagggacgcaaggtgctggagcttctcaaggttgcatggaaacggcgcttaattttcacagttgggacgtcctctaccacgggggaaacagatacagtcgtatggaacgagattcatcacaaaacagaaatggatcgcaacatcacagggcacggctaccccgaccccaactatttgcagaacgtacttgccgagctggcggctcagggcgtgaccgaagactgcctggaacagcagcatgcccgcctgtggtggccaccccgctgtcctatggctggctgggtggcccgtcaggaagtcccctcacctcgaggatgggaagtgtgttag

SEQ ID NO: 17908 - DNA, 2565 bp, Artificial Sequence
  Description of Artificial Sequence: Synthetic coding sequence
atgaaagtggaggcatgtacatgggctggatatagtggcctatatgaggctatcgaatcttgggacttcaaaaaaatcgagaaactcgaggaataccggttgttgctgaagagactgcaaccagaattcaaaacaagaataatcccaaccgacattatttctgacctgtcggagtgcttgattaatcaggaatgcgaagagatactgcaaatctgttccaccaagggtatgatggctggtgcggagaaactggtagagtgcctgttaagatcagataaagaaaactggcctaagaccctcaaactggcgcttgaaaaggaaagaaataagttctctgagctgtggattgtcgagaagggtatcaaggacgtggaaaccgaagacttggaagataaaatggaaactagtgatattcagatcttttaccaagaagatccagaatgccaaaatcttagtgaaaattcatgccctccctccgaggtgagtgatacaaacttgtactccccctttaaacctaggaattaccagcttgagctggccctgcccgctatgaaaggcaagaatacaataatttgcgccccgaccgggtgcgggaagaccttcgtgtctctgttgatttgcgagcaccacctcaaaaagttcccacagggacagaaagggaaggttgtcttttttgccaatcagataccggtgtacgagcagcagaagagcgtgttttcaaaatacttcgagagacatggctaccgcgttaccggcatctctggcgccacggccgagaacgtccctgtggagcagatcgttgaaaacaacgatatcatcatcttgacccctcagattctggtaaataatttaaaaaagggaacgattccaagcctgtcaatattcaccttgatgattttcgacgagtgccacaatacaagtaagcagcacccttacaacatgatcatgttcaactatttggaccagaagctgggaggtagcagcggaccactgccacaggtgatagggctgaccgcttccgtcggcgtgggcgacgcaaagaatacagacgaggctctggactacatctgtaagctctgcgcttctctagatgctagcgtgattgctactgtcaaacataacctcgaggagctcgagcaggttgtatacaaacctcagaagttcttccgcaaggttgagagcaggatcagcgataaatttaagtacattatcgcccagctgatgcgcgatacagagtccttggccaagcggatatgcaaagaccttgagaatctgagtcagatacagaaccgggaatttgggacacagaaatatgaacagtggatagtgaccgtccaaaaggcgtgcatggtttttcagatgccagataaagatgaggaaagtcggatatgtaaggcactgtttctttatacctcgcacctgaggaaatataacgacgcactcatcatttctgagcacgctcgaatgaaggacgcacttgattacttaaaagacttcttttccaacgtaagggccgcgggctttgatgagatcgaacaggacctgacccagcgtttcgaggaaaaacttcaggagctagaaagtgtctctcgggacccctccaacgagaaccccaaactggaggacctctgttttatactacaggaggaataccacctgaatccagaaactattaccattctgtttgtgaagacacgagcactcgttgatgcactgaaaaactggatcgaggggaaccccaagttatcctttctcaaaccaggtatcttaacgggtagaggaaagactaatcaaaacactggcatgactctgcccgctcagaagtgtatcctggatgccttcaaggcatctggcgaccataatatcctgatcgcaactagtgtagcagatgaagggattgatatagcacagtgtaatttggtaattctctacgagtacgtcggcaacgtcattaagatgattcagactcgcgggcggggccgagcccgaggttccaaatgttttcttctgacaagtaacgctggagtgatagagaaggagcagattaatatgtacaaagaaaaaatgatgaacgactcgatcctccggttgcagacatgggacgaagctgttttcagagagaagatactccacatccagacgcacgaaaagtttattcgcgattcccaggaaaaacctaagcccgtgccggacaaggagaataagaagttattgtgccggaaatgtaaggccttggcctgctatacagcagatgttagggtcatagaggaatgtcactacaccgtgcttggagacgcgttcaaagagtgctttgttagtagaccccatcctaagcctaaacaatttagctccttcgagaagcgggccaagatattctgcgctaggcagaactgcagccacgactgggggatacatgtcaagtataaaactttcgagatcccggtgataaagatcgagagcttcgttgtggaggacatcgccaccggggttcagaccctgtactccaaatggaaagatttccacttcgagaaaatcccattcgatccggcagaaatgtccaaatag

SEQ ID NO: 17909 - DNA, 813 bp, Artificial Sequence
  Description of Artificial Sequence: Synthetic coding sequence
atgcaaatagagcacatcattgaaaacattgtggcagtgaccaaagggctgtcagaaaaactgccagaaaagtgggagagtgtcaagctgctgttcgtgaagacagaaaagtccgccgcactgcccattttttctagtttcgtctcaaactgggacgaggctaccaagcggtctttgctcaacaagaagaaaaaggaggcacgtagaaagcgccgagaaaggaacttcgaaaagcagaaggagagaaaaaagaagcggcaacaagcaagaaagactgcaagtgtgttgagcaaggacgatgtggcccccgaaagcggcgacacaactgtgaagaaacccgagtctaagaaggagcagactcccgaacatggaaaaaagaaacgtggccggggcaaggcccaggtgaaagcaactaatgaaagcgaagacgagattccgcagttggtgccgatcggaaagaagacaccagctaatgagaaggtagaaatccagaaacatgcaacggggaagaagtcccctgcgaaaagcccaaatccttccacaccccgtggcaaaaagcggaaggcgctccctgctagtgaaacgccaaaggctgcagaatcagaaaccccgggtaagtctccggaaaagaaaccgaagataaaggaggaagccgtgaaggagaaaagtcctagtctggggaagaaagatgcccggcagaccccaaagaagcctgaggctaaattcttcacgacaccttccaagtcagtccgtaaggctagccacacgcctaaaaagtggccaaagaagcccaaagtcccccaaagtacttag

SEQ ID NO: 17910 - DNA, 1059 bp, Artificial Sequence
  Description of Artificial Sequence: Synthetic coding sequence
atgagctcacgtaaactcagcggccctaagggaagacggctctccatccacgtggtcacatggaatgtagcttctgctgctccacccctagatctgtctgatctcctgcagctgaacaatcgaaatctgaatcttgacatttacgttatcggcctccaagaactcaatagcggaatcatctctcttctaagcgatgctgcatttaacgacagctggtcaagcttcctgatggacgtgctgtccccactttctttcatcaaggtgtcccatgtacggatgcagggaatcttattgctggtatttgcgaagtatcagcatctaccctacatacagatcttgagcaccaaatcaacgcccacaggactcttcgggtattggttgagcatagccaagaaacatgacccactgcttagagaatttcaggagggccgcctactgttccccccaacctacaaatttgacagaaattccaatgattacgataccagcgagaaaaagcgcaagcccgcatggaccgaccgtattctttggcgcctgaagagacaaccatgtgcagggcccgacactcccatcccacctgcctctcatttctccctgtcgttgaggggctattcttcacacatgacatacgggattagtgaccacaagcccgtgagcggtacctttgatctggaattaaaaccgctcgtgagcgctcctttaatagtgttaatgccagaagacctttggactgttgagaacgacatgatggtgtcttactcgtccacgtccgacttcccttcctctccttgggattggatcggtctgtacaaggtagggctaagggatgtcaacgactatgtgagctacgcctgggtgggcgattctaaagtgagttgctcggacaacctcaatcaggtctacatcgatatcagtaatatcccgacaaccgaggacgagttcttgctgtgctattatagtaatagtttgaggtcagttgtgggaatctctcggccatttcagataccccccggatccctgagggaggatcctcttggagaagctcaaccacagatctag

SEQ ID NO: 17911 - DNA, 375 bp, Artificial Sequence
  Description of Artificial Sequence: Synthetic coding sequence
atgactggctcttgttgcgggagcactttttcctcattatcctacggtggcgggtgctgccaaccctgttgctgccgcgatccatgttgttgtcgacccgtaacatgccagaccacggtgtgccgtcccgtgacttgtgtccccagatgtaccagaccaatttgcgaaccctgtcggagacccgtttgctgcgatccgtgctccctgcaggaggggtgctgccgtcccattacttgttgcccatcctcatgcactgctgttgtgtgtcgcccatgttgctgggcgaccacctgttgccagcctcctgtgtccgttcagtctccttgcgggcaacctactccttgtagtacaacatgtcggacctcatcctgttag

SEQ ID NO: 17912 - DNA, 927 bp, Artificial Sequence
  Description of Artificial Sequence: Synthetic coding sequence
atgaaacgggcacaccctgagtattcttcatccgactcggagctcgatgaaaccatagaggtggagaaagagtccgctgacgaaaatggaaatctcagcagtgccctaggatctatgtccccgaccacttctagccagatactggctagaaaaaggcggagaggcatcattgagaagagaaggcgagatcgcataaacaatagtctctcagagctccggcgcctggttccatccgctttcgagaagcaggttatggaacagggaagcgctaagctggagaaagcagaaattctccagatgacggtggaccatctgaagatgcttcacactgccgggggaaagggctattttgatgcacatgcgttagccatggactatagaagtctgggttttcgcgagtgtctggccgaggtggctcgttacttgagcattatcgaagggctggacgcttctgacccgctgagggtcagactggtgagtcacctgaataactatgcttcccagagagaggcagcatccggcgcacatgcaggccttggccacatcccttggggaactgtgtttggtcaccacccgcatatcgctcaccctttactgttgccgcaaaacgggcacggtaacgctgggacaactgccagtcctaccgagcctcaccatcaaggacgattaggctcagcccacccggaagccccagcgttgcgtgcacctccttccggctccctcggtcctgtcctacctgtggttactagtgcttccaaactgtcacctcccctgctgagctcagtcgcatccctcagtgcctttccattttcgttcggaagctttcatctgctgagcccgaacgctctctctccttctgcacccacacaggcagccaacctgggaaaaccatatagaccgtgggggacagagattggggcattctag

SEQ ID NO: 17913 - DNA, 2943 bp, Artificial Sequence
  Description of Artificial Sequence: Synthetic coding sequence
atgaccgagggtaggcactgtcaggtgcacctccttgacgacaggaggctggagctgctggtgcaacctaagctgctggctcgggaactgctggacctcgtcgcttcacattttaacctgaaggaaaaggagtatttcggaatcacatttatcgacgataccggccagcagaactggttacagctggaccatcgggtgttggaccatgatctccccaagaaacctggtccaacaatactgcatttcgccgttcggttttacatcgaatcgatctccttccttaaagataagacgaccgtagaactcttcttcctgaatgccaaagcatgtgtacacaaagggcagatcgaagtggagagcgaaactatcttcaagctcgccgcttttattctccagtctccgaaggtaagcctcacccatgatgagaacgcaagaaaggatctcaagactctccctgcctttcctactaaaaccctccaggaacatccgtctttggcatactgcgaggatcgggtgatcgaacactacctgaaaatcaaaggtttgactcgcgggcaggcagtggttcaatacatgaaaatcgtggaagctctgccaacctacggcgtccattattacgcagtcaaggataaacagggacttccatggtggctcgggatcagctacaagggtattggccaatatgacatccaggataaagtcaagccgagaaagctatttcagtggaagcagcttgaaaatctatattttcgtgagaagaagttcgcggtcgaggttcacgacccccgcaggatcagtgtgtcaagaagaaccttcggccagtcaggcttgtttgtgcagacatggtatgcaaatagcagtctcatcaaatccatctgggtcatggccatcagccagcaccagttttatctagaccgaaagcagtccaaggctaagattccctcagcgcgatccctggatgaaattgccatggacctcactgaaactggcactcaacgggccagcaagttggtgacacttgagacaaaaagccagttcataatggcctctaatggctctctgatttcctccggttctcaggattccgaggtgagcgaagagcagaagcgcgaaaagattttagaactgaagaagaaggagaagctgctccaggagaaactgctcaaaaaggtggaggagcttaaaaaaatctgccttagagaggctgaactgactgggaaaatgcccaaggaatacccactgaacatcggcgaaaagccccctcaggtaagaaggcgggttgggaccgccttcaaacttgatgataacctgctaccctccgaagaggaccctgctctgcaggagctggagagcaactttttgatacaacagaaactcgttgaagctgctaagaagcttgccaacgagcctgacttgtgcaaaaccgtgaagaaaaagagaaagcaagactataccgatgcaatgaagaaattgcaggagatcgaaaacgctattaatgagtacagaatccgatgtggaaaaaaacctagccagaaagccactgttctcccagaagatataattccttcggagagctcatctttgtccgacaccacaacttacgacgaccctagtgacgcctttacattccctggccagcggtcatcgagcgtgccgcatagccccagaattttgcctccgaaatccctgggcattgaaaggatccattttcgcaagtcgagcatcaatgagcagttcgtagatacccggcagagtagagagatgctctctacccacagttccccctataaaacactggagcgccggcctcagggaggcaggtccatgcctacaacgcccgttctcacccgcaatgcatactccagttctcacttagaacctgaaagtagttctcagcactgtcgacaaaggagcgggtccttggagagtcagtcccatctgttgagcgaaatggactcagataagccgttctttagtctgagtaagtctcagagaagcagtagcaccgagatactcgatgacggctccagctacacctcacagtctagtactgagtattactgtgttactccggtgactggcccttattatactactcagactttagacacccgcactcggggtcggcgccggtccaagaagcaaaacgtgtctacctctaactcaggaagcatgcccaatttggcacagaaagatagcctacgtaatggcgtctattcaaagagccaggagcctcctagctcatcatattacatcgcagggtatacaccctacgctgagtgtgatttctactactcagggggctacgtgtacgagaacgataccgagggccaatacagtgtgaatccatcatatagatcttcggctcattacggttatgaacgccagagagattattctagatcatttcatgaagacgaagtggatcgcgtccctcacaacccatacgctactttgcggttgcctcggaaggccgctgcgaagtccgagcatatcaccaagaacattcataaagccctggtcgcagagcatctaagagggtggtaccagcgggctagtgggcaaaaagaccaggggcactcacctcagacctcatttgattcagaccgaggctcccagcgctgtcttggttttgctggactgcaggtaccttgttccccatcatcacgcgcatcatcctactcttccgtttctagtactaacgcctcgggcaactggcgaacccagctgacgatagggctgtctgattacgaaacacccgcgcattcttcttacactagctgctatggaaacgtatacaacccattgccctcgccttccaggcagtatacggagatctcacagctggacggtacagacggaaaccagctcgaagacaacttggaaagttcagaacagcgactgttctggcacgaggactccaagccaggtaccttagtgtag

SEQ ID NO: 17914 - DNA, 2979 bp, Artificial Sequence
  Description of Artificial Sequence: Synthetic coding sequence
atgtacggctctgctcggtctgtgggaaaagtggaacctagctctcagagcccaggcaggagcccgagactgccaagaagccctcgcctgggtcaccggagaactaacagcaccggtggttcatctggcagctccgtcggcggaggcagtggcaagacactctcaatggaaaacatccaatcacttaacgctgcttacgccacatctgggcccatgtacttgtccgaccatgagaacgtgggctccgaaacgcccaaaagtacgatgactcttggtcgaagcggaggcaggctcccttacggggttcgcatgaccgccatggggagtagtccaaatatagcgtcaagcggcgtggcgtctgatacaattgcttttggcgagcaccatctcccaccagttagcatggcatccactgtgccgcacagcctgcgtcaggcaagagacaataccatcatggatttgcagacacagctgaaggaggtgctgcgagaaaatgaccttctccgtaaggacgtagaggtgaaggaatccaaattatcctctagtatgaactcgataaaaaccttctggtctccagaactgaaaaaagaaagagccctcaggaaagatgaggcatctaagatcacaatctggaaagagcagtatagagtggtgcaggaggagaatcagcacatgcagatgacaattcaggccctacaggacgaactcaggatccaacgcgatctgaaccaattgtttcagcaggatagctcatctagaacaggggagccatgtgtcgcggaactaactgaagaaaactttcagcggctccacgccgaacacgagaggcaggccaaagagttgtttctcctccgaaagacgctggaggagatggagcttaggattgagacgcagaagcaaacactcaacgcaagggatgaatcaattaaaaagcttctcgagatgcttcagagcaagggactctcagctaaggccaccgaggaagatcatgaacgcacaagaagattggcagaggccgagatgcacgtccatcacctcgagtcactcctggaacagaaggagaaggagaattccatgttacgcgaagagatgcacagaagattcgagaatgcccccgactctgcgaagaccaaggctctgcagacagtcatcgagatgaaagacagcaaaattagtagcatggagcgtggattgcgggatttggaagaggaaatccagatgctcaagagcaatggcgctctgtctaccgaagagcgtgaagaggagatgaaacagatggaagtgtaccgctcacatagcaaattcatgaagaataagatcggccaggtcaaacaagaactgagcaggaaggacactgaactgctagcactccaaaccaagttggagactttgacaaatcagttttctgattccaaacaacacattgaagtattgaaggagtcactgacagcaaaggaacagcgggccgccattcttcagacagaagttgatgctctgaggcttcgactggaggaaaaagagactatgctgaacaaaaagactaagcagattcaggatatggcggaggaaaagggaacacaggccggcgagatccacgacctgaaagacatgctcgacgtgaaagaacggaaggtcaacgtgttacagaaaaaaattgagaacctgcaggaacaactgcgagacaaggagaagcaaatgtcctcattaaaagagcgcgtcaagtcccttcaggccgataccaccaataccgacacggctctgaccacacttgaagaagcccttgcagagaaggaacgaaccattgagcggctgaaagagcagagggacagggatgagagagaaaagcaagaggaaattgacaactacaaaaaggacctgaaggatttgaaagagaaggtgtcccttcttcagggcgacctatccgagaaagaagctagcctcttagacctgaaggagcacgccagcagccttgccagttccggcctgaaaaaggattcccgcctgaagacgctggagatcgcattagaacaaaagaaagaggagtgcctaaagatggaaagccagctgaaaaaggcccacgaagcagccctagaagcccgtgcatcccccgagatgtcagatagaatccagcacctggagcgagagatcacccgttataaggacgagagctctaaagcccaggccgaggtggacaggctcctggagatacttaaggaagtcgagaacgagaaaaacgataaagacaagaaaatcgccgagctcgagagcctgactagtagacaggttaaagaccagaacaagaaagtggccaacctcaaacataaagagcaggttgagaagaagaagagcgcccagatgctggaggaggctcgtagacgagaggataacctcaatgacagcagccagcagctgcaagattccctgcgcaagaaagatgaccggatcgaagagctggaggaggccctcagggagagcgttcagataaccgcagaacgtgaaatggtgcttgcgcaagaagaatcggccaggaccaacgccgagaagcaggtggaagagctgctaatggcaatggagaaggtgaaacaagaactcgagagcatgaaggctaagttaagctccactcagcagtctctggccgagaaggaaacacacctgacgaacctcagggcagagcgtcgcaaacaccttgaagaagtgttggagatgaagcaggaagccctgctggcagccatatccgagaaggatgcaaatattgcattgttggagttatcctcttccaagaagaagacccaggaagaggttgccgcacttaagcgggagaaagaccggctcgtccagcagctgaagcaacagacacagaatcgcatgaagctaatggcggacaactatgaggatgatcactttaaaagctcccactccaatcagacaaaccacaagccgagccccgaccaggacgaggaggaaggtatctgggcctag

SEQ ID NO: 17915 - DNA, 3138 bp, Artificial Sequence
  Description of Artificial Sequence: Synthetic coding sequence
atgctcactgtgcaagtaaagacttcgtccgcaattgagctacctgattctttagccttcctgtggattattccaatgtggtactgcgaggggaaagagctggagaatagcccagacattcacattgtgcaggcagggaatctgcacagtctcactatcgcagaggcgtttgaagaggacaccggcaggtacagctgctttgcctccaacatatatggaaccgattcaacgagcgctgagatctatatcgagggagtttctagtagcgatagtgagggtgaccccaacaaagaggagatgaaccggatccaaaagccaaatgaggtgagctcgcctcccaccacctccgcggtgatcccaccagctgtgcctcaagcgcagcatctggtggctcagcctagagtggcaactattcagcagtgtcagtcccccaccaactaccttcaaggcctcgacggtaagccaatcattgctgccccagtcttcacaaagatgctgcagaatttatctgcttctgagggtcaacttgttgtgttcgaatgcagagtcaaaggggcgccttcccccaaggttgaatggtatcgtgagggtaccctcatcgaagactcaccggacttccgcattctccagaaacgaccggtttgcatggaacatattgaagagatttgcacactggtgatagctgaagtgtttgcggaggatagcggctgctttacatgtacggcttctaacaaatacgggactgtgtccagcattgcacagctgcatgtacggggcaacgaagatctgtcgaacaatggcagcctccattctgcaaactccaccactaacctagccgctatcgagcctcagccgagccctccacattccgagccaccttccgtggaacaacccccgaagccgaagctcgaaggggtgctggtcaaccataacgagcctcgatctagcagtcgtattgggctgcgcgtgcacttcaacctaccagaagacgataagggctcggaggcgtcctctgaagcaggagttgtgacgacaaggcagacgaggccggattccttccaggaaaggttcaacgggcaggctacaaagaccccagagccaagctctcccgtaaaggagcctccccccgtgctggccaagcccaaattggacagcacccaactgcagcagctgcacaaccaggttctgctggagcaacatcagttgcagaatccccctccaagctcccccaaggaatttccatttagcatgacagtgctcaacagcaatgcccccccagctgtaacgacctcctcaaagcaggtgaaggcaccgtcatcccagactttttccttggccagacccaaatatttcttcccgtccacaaacaccacagccgctacggtcgccccaagcagtagtcccgtgtttaccctctcctcaactcctcagactatccagcggacagtctcgaaggaaagccttcttgtatcacatccttctgtacagactaagtcacccgggggactgagtattcagaacgaacctctgcctccgggtcccactgaacccacccctccaccattcaccttttcaatcccttctggaaaccagttccagcctaggtgtgtgagcccaattcccgtctcgccaacctccaggattcagaatccggtcgccttcttaagctccgtcctccctagtttgcccgcaatacctccaactaatgccatgggcctgccccgttctgccccatctatgccttcacagggtttggctaagaaaaacactaaaagtccgcagcccgttaatgacgacaacatccgcgaaaccaagaatgctgtcattcgcgacttggggaagaagatcacattcagtgatgtaagaccgaatcagcaggaatacaaaatttccagttttgagcaacgcctcatgaacgagatcgaatttcgcctcgagcgtactcccgtagacgagagcgatgatgagatccagcacgacgagatccccaccgggaagtgtattgctcctatttttgataaacggctgaagcatttcagggtgaccgagggttccccagtcacatttacctgtaaaatcgtggggatcccggtgcctaaggtttactggttcaaggatggcaaacaaatcagtaagaggaatgagcattgtaagatgaggcgagagggtgacggaacgtgttcactgcatatagagagcaccaccagcgatgatgatggcaactatactatcatggcagcgaatcctcagggtaggatctcctgcagcggccaccttatggttcagtctctccccattcgctcaaggctgaccagcgccggccagtcgcaccggggcaggtcacgcgtccaggaacgtgataaagaacctctgcaggaaaggtttttccgaccacacttcttgcaggcccccggagatatggtcgcccatgagggtagactatgccgactcgactgcaaggtgagcggtctacctcctcccgaacttacctggctgctcaatggacagcctgtgctccctgatgcttcccataagatgctggtcagggagaccggcgtccactcactattgattgaccccctgacccagagggacgcggggacatataagtgcatagcaaccaataaaacagggcagaacagtttcagcttagagttgtcggtggtggctaaagaggtgaagaaagcaccggtcatcctggagaagctccagaactgcggcgttcccgagggtcatccggtgcgcttagaatgcagagtaattggaatgccccccccggtattctactggaaaaaggacaacgagaccattccatgcactcgggaacgaattagcatgcatcaggataccaccggttacgcatgtctccttatccagccagccaaaaagagtgatgctggctggtacacattgtccgccaagaatgaggccggtatagtttcctgcaccgcaaggctagatatctatgcccagtggcatcaccagatccctccccccatgagtgttcggccctccggcagccgctatgggagccttaccagtaagggccttgacatctttagtgctttttctagcatggagtccaccatggtctacagctgcagctctcggagtgttgtcgaaagcgacgagctttag

SEQ ID NO: 17916 - DNA, 72 bp, Artificial Sequence
  Description of Artificial Sequence: Synthetic coding sequence
gtgcgtctcgcttgggggttcgtttcagccctagggtctttccataccgccgacccagaaggtgcagcatag

SEQ ID NO: 17917 - DNA, 1608 bp, Artificial Sequence
  Description of Artificial Sequence: Synthetic coding sequence
atggaggctcctacagtcgaaactccaccagatccctcaccaccatcagcccctgcccctgcactggtgccattgcgcgcacccgacgtggcaaggttgcgtgaggaacaagagaaagtcgtgaccaactgccaggaacgcatacaacactggaaaaaagtggacaatgattataatgccctaagggagagactgtcgacattgccggacaagttatcatataatattatggtcccctttggaccctttgccttcatgcccggaaaattagtccataccaacgaagtgactgtcctactcggggacaactggtttgccaagtgctctgcgaagcaggcagtggggttggtggaacatagaaaagagcatgtgcgcaagactattgacgatctgaaaaaagttatgaaaaattttgagagccgggtagagtttacagaggaccttcagaaaatgtccgatgcggctggggatattgtagacatccgtgaggaaataaagtgcgatttcgagtttaaggccaaacaccgaatcgcccacaaacctcactccaaacccaagaccagcgacatttttgaagccgacattgcgaacgacgtcaagtccaaagacctccttgccgacaaggaactctgggcacgcctcgaggagctggagcgacaagaagagctcctgggcgagctcgattctaagccggatacagtaatcgcaaacggtgaagatacaacgagtagtgaggaggagaaagaggataggaacaccaatgtgaacgccatgcaccaggtgacggactcccacaccccctgccacaaagacgtggcctccagtgaaccattcagtggacaggtgaattcacagctgaactgcagtgtgaatgggtcctccagttatcacagcgacgacgatgatgacgacgacgatgatgatgacgacgataatatcgacgatgatgatggtgacaacgatcatgaagcactgggtgtgggggataattccatccccacgatttatttctcacataccgtagagcccaaaagagtgcgcattaacactggaaaaaatactacgctgaagttctccgagaaaaaagaggaggccaaacgaaaacgcaagaacagcaccgggagtggccactccgcccaggaactgcctaccattcggacacctgccgatatctatcgtgccttcgtggatgtcgtaaacggcgaatatgtgccgaggaagagcattcttaagtccaggtcccgtgagaattccgtgtgtagtgatacttcggagagctctgcagctgaatttgacgacagacggggtgtgctacggtcaatatcttgtgaggaggccacatgctctgacacgagcgagtctatattagaggaggaacctcaggagaaccagaaaaaactgctgcctctttctgtgacacctgaagctttttccggaaccgtgattgagaaagaattcgtctcaccctccttgacaccaccaccggctatagcacatcccgccctcccaactattccagaacggaaagaggttctgcttgaagcttctgaggaaacaggcaagagggtttccaagtttaaggccgcgcggctgcagcagaaagattag

SEQ ID NO: 17918 - DNA, 1731 bp, Artificial Sequence
  Description of Artificial Sequence: Synthetic coding sequence
atggaaggactgagaagaaggcgcggccgagaggcaggccctccgcagcccatggtaccactggccgtagaaaaccaggccggaggcgagggagccggcggagagctcggtatctcacttaacatgtgcttgcttggcgctctagttctgttgggcctcggcgtgctgttgttcagtggtggcctgtcagaatctgagacaggtcccatggaggaagtagagcggcaggtcctccccgatcccgaggtgttggaggcagtgggggacaggcaggacggcttacgggagcagctgcaggcaccagtgccacctgattccgtgccctctctccagaacatgggactgttgctggataaactcgccaaagagaaccaagacatcaggctcttgcaggcccagctccaagcacagaaagaggagctgcaatcgctcatgcaccagcctaagggcctggaggaagaaaatgctcagctccggggggctctccagcagggagaggcatttcagagggccttagagtcggaattacagcaactaagggctaggctgcagggcctagaggcagactgcgtcagaggaccggatggcgtgtgtcttagcggcggccgaggtccacagggcgataaggcgatccgggagcaagggcccagggagcaggagccagagctttcttttctgaagcagaaggaacagctggaggcagaggcacaggccctgaggcaggagcttgagcgccagcgacgactgctgggctccgtacaacaagacctggagcggtctctgcaagacgcttccaggggggacccagctcacgccggactggccgagctgggacaccggcttgcacaaaagctccagggactagaaaactggggtcaagacccaggcgtcagcgccaacgcatcaaaggcctggcatcaaaaaagccactttcagaatagcagggaatggtctggaaaggagaagtggtgggacggccaaagagatagaaaggccgagcattggaagcacaagaaagaagagagtgggcgcgagcggaagaaaaactggggtggacaagaagatcgggaacctgctggacggtggaaagagggtcgcccaagagtggaggagtctggctcaaagaaggagggcaaaagacagggtcccaaggaaccgcccagaaaatccggcagctttcatagttccggggagaagcagaagcagcctcgctggagggaaggtacaaaagatagtcatgacccactcccaagctgggccgagctattgagacctaaataccgtgccccacagggatgtagtggtgtcgatgaatgcgccagacaggaggggctcaccttctttggcactgagctggcccccgtacgccagcaagagctggccagcctgctgcgtacttacctcgcgcgactcccctgggccgggcaattgaccaaagagctgccacttagtcctgcgtttttcggtgaggatggcatttttaggcatgatcggctgcggtttcgggattttgtggacgccctcgaggacagcctggaggaggtcgctgtgcagcagactggtgacgacgatgaggtagacgacttcgaagactttatcttttctcattttttcggagataaggcgcttaagaaacgaagtggcaaaaaggataagcacagtcagagcccaagagccgcgggcccacgggaggggcatagccacagccatcaccaccatcatagggggtag

SEQ ID NO: 17919 - DNA, 2244 bp, Artificial Sequence
  Description of Artificial Sequence: Synthetic coding sequence
atggccaagtataacacgggtggtaaccctactgaagatgtatccgtcaattctagaccattccgcgtgactggacctaactcaagttctggtatccaggctaggaagaacctctttaataaccagggtaacgcctcgcctccagctgggccatccaacgtcccaaaatttggttctccgaagccgcccgtggcggtcaagccatcttcagaggagaagccagataaggagcccaagccccccttcttgaagcccaccggagccggccaaagattcgggacacctgcgtctctgacaactagagaccccgaagctaaggtgggtttcctgaagcctgtaggacctaagccgatcaacctgccaaaggaggactcaaaacctacatttccatggccccccgggaacaagccctctttacactccgtaaaccaggatcatgacttgaaacccttaggcccaaagagtggaccaactcctccgacaagcgagaatgaacagaagcaagcctttccaaaactgaccggcgttaaagggaagtttatgtctgcatctcaggacctggaaccgaaacctttattccctaaaccagcctttggccaaaagccacctcttagtaccgagaacagtcatgaggatgagtcccctatgaagaatgtgagctcctccaagggaagcccagccccactgggtgtccgctcaaagtctggcccgctcaagcccgccagagaggactcagaaaacaaagaccacgctggcgaaatctcatcacttcccttccctggtgtagtcctcaaacctgccgcgagccggggaggtcctggtctctccaaaaacggcgaagagaagaaagaggaccgcaagatagatgctgccaagaacaccttccagtccaagataaatcaagaagaactggcctcaggaaccccccccgctcgcttcccaaaggctccttctaaactgaccgttggggggccctggggccaatcacaggagaaggagaaaggcgacaaaaattctgccaccccaaaacagaagcctctgcccccactgttcaccttagggccccctcctcctaagccaaatcgccctcctaacgtggatctgaccaaatttcacaaaaccagctccgggaacagcacgtccaagggacagacaagttacagtacgacttcactgccaccgcctccaccttctcacccagcaagccagcctccgctaccagcatcacatcctagtcagccccccgtaccctccttaccccctagaaatatcaagcctcctttcgatcttaagagccccgtgaatgaggacaaccaggacggcgtgacacactccgatgtagtgattccactggaccatgagcaggatagcgagggcgagacttatgaagacatcgaggcttccaaggaaagggagaaaaaacgagagaaagaggagaagaagcggttggagctcgaaaaaaaggagcaaaaggagaaggaaaaaaaagaacaagagataaaaaagaaatttaagttgacgggacctatacaggtaatccacctcgcaaaagcttgctgcgacgtaaaaggcggaaaaaatgaactgtccttcaaacagggcgaacagatcgagataattagaatcaccgacaatcctgagggcaagtggctcggccggaccgctagaggctcgtatggctatatcaagaccaccgccgtcgaaattgattacgattcactgaaactgaagaaagacagtcttggagccccaagccgtccaatagaggatgaccaggaagtatatgatgatgtcgctgagcaggacgacataagcagccattctcagtccggctcgggggggattttccccccccctcccgacgatgatatctacgacggcatcgaggaggaggatgccgatgatggcagcacactgcaggtccaggagaaatccaacacctggtcatggggtatccttaagatgttaaaaggcaaggacgataggaaaaaaagcatcagggagaagcccaaagtttcagattcagataataatgaagggagctccttccccgctcccccgaagcagctcgatatgggcgatgaggtttatgatgacgtcgacacgtctgactttcccgtctcttccgctgagatgtcacaagggacaaacgtgggtaaagctaagacggaagaaaaggacctgaagaagctcaaaaaacaggagaaagaggaaaaggacttcagaaagaagttcaaaaagtag

SEQ ID NO: 17920 - DNA, 1566 bp, Artificial Sequence
  Description of Artificial Sequence: Synthetic coding sequence
atgacgagtgccttcaagcttgactttctgccagatatgatggttgaaggaagactgctggtgccagaccgaatcaatggcaccgcaaataagatgaacggcgcactggaccattccgatcagccggaccctgacgcaataaagatgtttgttggacaaatccctcgatcttggtcggagaaagaactgaaagagctgtttgaaccgtatggagcggtgtaccagatcaacgtgctccgagatcgatcacagaatcccccacagtccaaaggctgctgttttgtcactttttatacccggaaagcagctctagaggcccaaaatgccctccataatattaaaacccttccagggatgcaccaccctattcaaatgaagcccgcagactctgagaaatctaatgccgtagaggatcgtaagctgttcatcggaatggtgagtaagaagtgtaatgaaaatgatattcgtgtaatgttttccccatttgggcagatcgaggagtgcaggattctgcgcggtcccgatgggttgagcaggggatgcgccttcgtgacgttctctaccagagccatggctcagaatgccatcaaagcgatgcaccaatcacagactatggaggggtgctcaagccctatcgtggtcaaattcgctgacactcagaaggacaaggagcaacggcgcctgcagcagcaactggcacagcaaatgcaacagcttaatactgccacttgggggaacctgaccggacttggggggctgaccccacaatacctcgctttgctgcagcaggcaacctcctctagcaacctcggcgccttttccggtatccagcagatggcaggaatgaacgcattacagttgcagaatttggctactctcgccgcagccgccgcagccgcccaaacatctgccacaagtacaaacgcaaaccctttgtcaaccaccagctctgccctcggcgctctaacctcccctgttgctgcttctacccctaactcaacagcgggggccgccatgaactcgcttaccagcctgggtactcttcagggattggcgggagcaactgttggcctgaacaacatcaatgcgttggctgtggcacagatgctcagcggcatggctgcactgaacggcggtctgggagctactggactaacaaatggtacagccggcacaatggacgccctgacacaggcatacagcggtatacagcagtacgccgcagcagcacttccaactctctacagccagtcccttcttcagcaacagagcgcggccgggtcccagaaggagggccctgaaggcgctaatctcttcatctatcatctgccacaggaatttggtgatcaggatatcctgcagatgttcatgccatttggtaacgtgatttcagcgaaagtatttattgataaacagactaacctaagtaagtgtttcggatttgtgtcgtatgacaacccagtcagtgcacaggccgctattcaagccatgaacggattccagatcggtatgaaacgtctgaaggttcaactgaagaggagtaaaaacgacagcaaaccttactag

SEQ ID NO: 17921 - DNA, 1710 bp, Artificial Sequence
  Description of Artificial Sequence: Synthetic coding sequence
atgcttcgggacatgactggacttccccacaaccggaaatgtttcgactgcgatcaacggggacccacgtacgtcaatatgacagtcggctccttcgtgtgcaccagttgtagcgggtccctccgcggattaaatcccccgcatagggtgaaaagcatcagcatgaccacgtttacccagcaggagatcgagttcctccagaagcacgggaatgaggtttgcaagcagatatggctggggctctttgatgatcggtcgagcgccatccccgatttccgagacccacaaaaagtgaaagagtttttacaggaaaaatatgagaagaagagatggtacgtcccgcctgagcaggcaaaagtcgtggctagcgtgcacgcaagcatatcaggatcctcagcatcctcaacaagctctacccccgaagttaaacccttgaagagtctcctcggcgatagcgccccgaccctgcatttgaataagggcacccctagccagtcacctgttgtgggtcggtctcagggccagcagcaagaaaagaagcaatttgaccttttatcagatctagggtcagatatttttgctgcacctgcaccgcagagcacagccaccgccaattttgccaattttgcccacttcaacagtcatgctgcacaaaatagcgccaacgctgattttgccaacttcgatgctttcggccagtcctctggatcgagcaattttggtgggttccccacagcttcacacagtcctttccagccgcagaccacagccttccggatgctgtcctccagttgtagctttggggagtttactagtgcttttccgttgcaagcgactcattctggatccgcagcaagcgtgaacgccaacttcgctcacttcgataatttcccaaagtcaagctccgcagactttgggaccttcaacacttcacagagtcatcagaccgcgtctgcagtgtccaaagtgtctactaataaggctggactacagacagctgacaaatacgccgcattggccaacttggataacatcttttccgccggacagggtggcgatcagggatctgggttcggcaccaccggtaaggccccggttggctctgttgtgagcgtaccttcacagagctctgcgtcaagtgataagtacgctgccctcgccgaattagatagcgtattcagtagtgctgcaaccagcagcaatgcctacacctctacctctaacgcctctagcaatgtgtttggaacagtgccagtagttgcaagcgcacaaacgcaaccagcatcgtcctcagtccctgctccatttggagctacaccgagcaccaacccttttgtggccgcagcaggtcccagcgtggccagctccactaacccattccagacaaacgcacggggagcaactgccgctacatttggaacagcttctatgtccatgccaaccggtttcggtactcctgccccctattctcttcccaccagcttttctgggtccttccaacagcccgcctttcccgcgcaggccgcttttccccagcagactgcattttctcagcagcccaatggattcgctgcctttgggcagaccaagcccgttgtgacgcccttcgggcaggtggccgcggcaggcgtaagtagcaatccgtttatgaccggggctccaaccggccagtttccaaccgggtcttcgagcactaaccccttcctgtag

SEQ ID NO: 17922 - DNA, 2007 bp, Artificial Sequence
  Description of Artificial Sequence: Synthetic coding sequence
atgagtaaactggccgcggctcacaggggagcaatccgggctctgcagatgtttgttacccagttcaccgatagaggagagcaccctctgccagctcgctgtaaagagttaggatcactaatccgacaactgtctctatgctccgttaagcttgatgccgatccatcagtgccagacgtggtcatcgatatattgcagcaaattgaagctcttgagagcttactcgaaaagaaactgtcaccaaagaaagtcaaaaagtgtttttccgaaatacgctcacgattccccataggcagccagaaggctcttgagaggtggcctagtacatctccaaaaggggaacggagacctctgaccgccaaggacaccttccctcaagaaacttcacgaccatccgtggccaagcagctgctcgctgacaaataccagcctgatacagaactcccagaaacccagagacttcagagtgagctggatgtcctggacgctgacattgtcctggaagagggtccttttatactggatcaaagtgctagttttaaggatgaagttctggctgttgcaaaaacaaaggccggaaaaaagaaaccggtgaccgaaaatgtgcccttccggaaaaaggacacgcttgcccccgcaaggcagcagggcctcagaaaggccgagcggggccgccagagccaaccacacagtaagtccagggtacaacaaactacggtgtctagccggttgaaaatgaataggcagccggtcaaagaccggaaggccccttggatcccccccaacccaaccagccctccagcaagccctaagtgtgctgcatggcttaaggttaagaccagtccccgggacgccaccaaggagcccctacagcaggaggatccacaggaagagagccacctgaccggggccgtagaacacgaggcagctagactcgcttggctggacgccgaaaccagcaaacgccttaaagaattggaggagttgaaggccaaggagatcgatagcatgcagaagcaaaggttagattggttggacgcggagaccagtaggaggaccaaggagttaaacgagctgaaagccgaggagatgtatagactgcagcagctgtcagtgagcgccacccatctagcagacaaggtcgaagaggcggtgctagatcgactgaagcccctactggttaaagcccagagggtgaattccacaaccgaggctaatatacatcttaaagatgggagttctgtgaacactgccaaggcccaacccgcccaagaggtggccgctgtggactttgagtctaacaacatccgccaactggacgactttctggaagactgtgcatcagaattgtgggcagtgacgcatgccaagattctggggagcgagactttagccactgtggaggactctaaggactctcctgacctagagatcatgatgcgcaggatggaagagatggagaagtatcaggagtccgtcaggcagaggtacaataaaatagcctacgctgaccccaggctgtggatgcaggaggagaacaatgaccagaaaatcagtgcaatcagcgaaaaaccgctctcacctcatccaatcagaataaccaagaccgtggaccgaaaggaccccgccgttaacattatgctcgagcggccatgtaacggaaactccttagacgagtctgttggcacagaggagggcagcgagaaacgtgaggctcctcttctgtccctggccgaggattcccaacagaaggaggggcgcgctcccctgttcgtacctcctgggatgcagcactccatcggcgactactgtagcaggttcgaacaatatctgcgaattatctctcacgaagccgttgggtcttttaacccatggctgatcgccgagtctttttctgaggaattggtggacgaggctttgggggcagtggccgctgaactgcaagatatgtgcgaggactatgcagaagccgtcttcactagtgaattcctcgaggctgctacttag

SEQ ID NO: 17923 - DNA, 3612 bp, Artificial Sequence
  Description of Artificial Sequence: Synthetic coding sequence
atgcccgcaaggatcggctattatgagatcgatcgtacaattggcaagggaaatttcgccgttgttaagcgcgctacacatctggtcacaaaagccaaagtcgccataaagattatcgacaagacacagctggatgaggagaatctgaaaaagatttttagggaggtccagattatgaagatgctgtgtcaccctcatatcattaggctgtatcaggtaatggagactgaaagaatgatctatctcgttactgaatatgcctccggcggagaaatttttgatcacctcgtggcacacggccgcatggctgagaaggaggcccgaagaaagttcaagcaaatcgtcaccgccgtctatttctgccactgcaggaacatcgtgcatagagatctgaaggcagaaaatctgctactggatgctaatctcaacattaagattgccgattttgggttctccaacctgttcacacctggccagctcctcaaaacttggtgtggaagcccgccctacgccgctccggaactctttgagggtaaagagtacgatggtccaaaggtggacatctggagcctcggggtcgtactgtacgtgctggtctgcggagcattgccattcgacggttccacactgcaaaatttacgggctcgggtcttaagcggcaagttccgcattcctttctttatgtccaccgaatgcgagcatctgatccgccatatgcttgtgttggaccccaataagcggttgagcatggagcagatctgtaagcataagtggatgaagctgggagatgctgatcctaattttgataggctgatagccgagtgtcagcaactcaaggaggagcgtcaggtggatccacttaatgaagacgtcctgttagccatggaggatatgggactggacaaagagcagacactgcaggccgaacaggcaggcacagcaatgaatatctccgtcccacaggtgcagctgattaatcctgagaaccagattgtagagccggatggcacgctcaacctagacagcgacgagggtgaggagcctagcccagaggcccttgttcggtatttatctatgcgccggcacacagtgggagtggccgatcctcgaacagaggtcatggaggacctgcagaaactgctgcctgggttccctggcgtaaacccacaggctcctttcctgcaagttgccccaaatgtgaatttcatgcataaccttctccctatgcaaaacttgcagcctactggacagcttgagtataaggagcagtctctgctgcagccccccaccttacagttattaaacggaatggggcccctaggaagaagagcctcagatggaggtgcaaacatccaactccacgctcagcaactcttaaaaagaccaaggggacccagccccctggtcaccatgaccccggcggtgccggctgttacaccggtggacgaagagtcttccgacggtgaacctgaccaagaagctgtgcaacggtatctggcaaaccggtccaagagacacacgctggcaatgactaaccctacggccgagatccccccagaccttcagcgccaattgggacaacagccgttccgctcacgggtgtggcctccccaccttgttccagatcagcaccgcagcacgtataaggattctaatactctgcacttacctactgaacgcttttccccggtgcgtcggttctcagacggcgcggccagtatacaagcctttaaggcccaccttgagaagatgggtaacaattcatccataaagcagctccaacaggagtgtgagcagctccagaaaatgtacggaggccagattgacgaacgcaccctggagaagactcagcagcagcacatgctgtatcagcaggagcaacatcaccagattttgcagcagcaaatccaggactctatttgccccccgcagccttccccacccctccaggcggcctgtgagaaccagcctgcactgctcacccaccagcttcagaggctgcgtatccaaccgtcatcacccccaccaaaccatcccaacaaccatttgttccggcagccttcaaatagcccaccgccaatgtcctcggccatgatacagccacatggagctgcatccagttcccagttccagggattgccctcccggtcagccatcttccaacaacaaccggagaactgcagctctcctcctaacgtcgccctgacatgtctggggatgcaacaacctgctcagtcccagcaggttaccatccaggtccaggagcccgtcgatatgctttcaaatatgcctgggacggcagctggcagctccggtagggggataagtatcagcccgagcgccggccagatgcagatgcagcatagaaccaacctgatggctaccctgtcctacgggcaccgccccctcagcaagcagctgagtgcggactctgcagaagcgcacagtgcgcaccagcagccaccacactatacaacttctgcactgcagcaggccttactgtcgccaaccccccccgattacacgagacatcaacaggtcccacacattctgcaaggactgcttagcccaagacactcactgaccgggcatagtgatattagactgccccccaccgaattcgcccagctgatcaagcgccagcagcagcagcggcagcaacaacagcagcagcagcagcagcaggagtaccaggaactgtttcggcatatgaaccagggcgacgccgggagcttagctccctctttaggaggacagagtatgactgaacgacaagcgctgtcttaccaaaacgccgattcttaccatcaccacacttcccctcagcatctgttgcagatccgggcacaggagtgtgtatcccaggcaagtagtcctacgcccccccatggctacgcgcatcagcccgccctgatgcattcagagtcaatggaggaggattgttcttgcgagggagccaaggatggtttccaggattccaagtctagcagtacacttacaaaaggatgtcatgactctccactactgctgagcaccggtggtcctggcgacccggagtctctcctgggcaccgtgtcccatgcacaggaactgggaattcacccttacggtcatcagcccacggcagcctttagtaagaacaaggtgcccagcagagaacccgtgataggaaattgtatggatcggagcagcccagggcaggctgtggagctccctgatcataatggtttgggctatcccgctcgtccctcggtgcatgaacaccaccgcccgcgagctctgcagaggcaccacacgatacaaaatagcgatgatgcatacgtgcagctggacaatctgcccgggatgagcctcgtggctggaaaggccctttcttcagctagaatgagcgacgcggtcttaagccagtcctctcttatgggtagtcagcagttccaggatggagagaatgaggaatgcggcgcctctttagggggtcacgagcaccctgacctcagcgatggttctcagcatctgaactcaagttgttatccaagcacatgtattactgacatactgctgtcgtataaacacccagaggtctctttttcaatggaacaagccggagtgtag

SEQ ID NO: 17924 - DNA, 2046 bp, Artificial Sequence
  Description of Artificial Sequence: Synthetic coding sequence
atgatcgaaaaaatgcagggaagcagaatggatgagcaaaggtgctcattccctcctcctctgaagaccgaagaagactacatcccttacccttcggtacatgaggtgttaggcagagagggcccctttcccttaattctcttaccgcagttcgggggatattggatcgagggaaccaatcacgaaatcacatcgatcccagaaactgagccattgcagagccccactactaaggtaaaactcgaatgcaatcccacagcacgaatttaccggaaacatttcctggggaaagagcactttaactactactccctggatgcggctctggggcatctcgtattctccctgaaatacgatgtgattggtgatcaggagcacttacggttgctgctgaggaccaagtgtcgaacttaccatgacgtcattcccatctcctgtctgaccgagtttcccaatgtggtccagatggcgaagcttgtgtgtgaggacgtgaacgtggatcggttttaccctgtcctgtacccaaaggctagcagactgattgttacctttgatgagcacgtgatatcgaacaactttaagtttggtgtgatctatcaaaagctgggccagacatccgaggaggagctgttttcgacaaatgaagagtcacccgcttttgtggagtttctggagttcctcggccagaaagtcaagttgcaggacttcaagggatttaggggcggactagatgtcacccatggccagacaggcactgaatctgtgtactgtaactttagaaataaggagatcatgttccacgtgagcaccaagctcccatacaccgagggggatgctcaacagctgcagaggaaaagacacatcggtaatgatattgtggcagtcgtcttccaggacgaaaatacgccgttcgtgcccgatatgattgctagcaatttcctgcatgcgtatgtggtggttcaggctgaaggcggcggacctgacggtcccctgtacaaggttagcgtcacagccagagacgatgttcccttcttcgggcccccccttcccgaccctgcggtgttccgaaaggggccggagtttcaagaattcctgctgacaaagctgattaacgccgagtacgcatgctataaagctgagaaatttgcaaaactagaagagaggacgagagcagcccttctggaaactctgtacgaggaattacacattcacagtcagagcatgatgggactgggtggcgacgaggacaaaatggagaacggatctggaggcggcgggttttttgaaagttttaaacgggtgatcagatctcgttctcagtctatggacgccatgggtttatcgaacaagaagcccaatacagtgtcaacttcccattctgggagttttgcccccaacaaccccgatcttgctaaggcagcggggataagcctcctcatccctgggaagtccgctagccggtttggcagaagaggctctgctatagggattggtactgtggaagagtcgctcattgtgcccggaaagagccccacgaggaagaaatctggtccatttgggagtcggcgctcctcggcaataggaattgaaaacattcaggaggtgcaagaaaaaagggaatctcctcctgccggacagaagacccctgactctggccatgtgtcccaagagcccaagtctgaaaacagctctacacagtcctcaccagaaatgccaaccaccaagaatcgggccgagactgctgctcaaagagcggaggccctcaaggacttctcgaggtcgtcatcatctgcctcttcctttgctagtgtggtggaggaaactgagggagtggatggagaggacaccggacttgagagcgtgagtagtagcgggactcctcacaagcgagattcctttatctacagcacatggctggaggatagtgtgtctaccacttccggagggtcttcacccgacgctgggaaactcggcgaccctgcttgcccggaaattaagatccagctcgaagccagcgaacagcatatgccacagctgggttgttag

SEQ ID NO: 17925 - DNA, 675 bp, Artificial Sequence
  Description of Artificial Sequence: Synthetic coding sequence
atgtccgtgggctacgcgaatggaattcgggtgatgtccatgacccacacaggagaaccaggtttcatgttgtacattcctatcgagtacgcgctgcatgtgtacaatgaggttatgtccgtggggcaaaagtatggtatccggaatgcaggctactatgctctgaggtctctgcggatcgaaaaattctttgcattttggggtcaagatattaataacctcactacaccactggagtgcggccgagaaagccgagttaaactcgaaaagggtatggacttcatcggccgagacgcattgctccagcaaaagcaaaatggtgtttacaagagacttactatgttcatcctagatgaccatgactcggacctggacctctggccctggtggggagagcctatctatcgaaatgggcagtacgtggggaaaacaactagtagcgcctacagttacagtctggaaagacatgtctgtctcggcttcgtccacaacttttcagaagatactggcgaggagcaggtggtgacagcagacttcatcaaccgcggcgaatatgagattgatatcgctggttatagatttcaggccaaagcgaagctctacccagtcgcttctttatttactcagaagcggaggaaggatgatatggagcttagcgatctgcacgggaagtag

SEQ ID NO: 17926 - DNA, 1590 bp, Artificial Sequence
  Description of Artificial Sequence: Synthetic coding sequence
atgcatttcagtggcctcgaggaagccgtgtatcggaatattcaggcctgcaaggaattagcacagacaacccggaccgcctatggcccaaatggaatgaacaagatggtgattaatcacttagagaaactttttgttaccaatgatgcagctaccatccttagagaactggaggttcagcaccccgccgctaaaatgattgtcatggccagccatatgcaggaacaggaggttggcgacgggaccaacttcgttctggtgtttgccggagcgctcttggagctcgccgaggagctgctgcgtatcgggctcagcgtgtcggaggttattgaaggttatgagatcgcttgccgcaaggctcacgagatcttgcctaacctagtatgttgcagtgccaaaaatctgcgggacatcgacgaagttagttctcttctgcggactagcatcatgtcgaaacagtacggtaacgaggtttttttggctaagttaattgcccaggcctgcgttagcatctttccagattccggacactttaacgtggacaatatcagagtctgcaagatcctgggtagtggcatctctagctcttccgtgctccatggaatggtgtttaaaaaagagaccgagggtgatgtgacctctgtcaaggacgccaaaatcgccgtgtattcttgtccttttgacggaatgattaccgagactaagggcacggtgctgataaaaactgccgaagagctcatgaacttctccaagggagaggagaacctgatggatgcacaggtcaaagctatcgccgacactggagccaacgtagtcgtgacgggtggcaaagtcgctgatatggcactgcactatgcaaataagtataatatcatgttggtgcggctgaattccaagtgggacttaaggaggctgtgcaaaaccgtcggggctaccgcactaccccgactgactccgccggtcctggaggaaatgggccactgtgactctgtatatctaagtgaggtgggagatacccaagtggtggtgtttaagcacgagaaagaggatggcgccattagtacaattgtgctgagaggcagcaccgacaatctcatggacgacatcgagcgcgctgtggacgatggagtaaacaccttcaaggttttgacccgagacaaacggctggttcccggtggaggcgcaaccgaaatcgagttggcgaaacagattacttcctacggagaaacatgccctggcctggaacaatacgctatcaaaaaattcgcagaagccttcgaagctattcctagagccctagccgaaaactcgggggtcaaggcaaacgaggttatcagcaagttgtatgcagtccatcaggaaggaaacaaaaatgtgggcttggacattgaagcggaggtccctgcggtgaaggatatgcttgaggccggcattcttgacacttacctgggcaagtattgggccatcaagctggccactaacgctgccgtgacagtactgcgggtggaccagatcatcatggctaaacctgccggcggtccaaaaccgccctccggcaagaaagattgggacgacgaccaaaatgattag

SEQ ID NO: 17927 - DNA, 2193 bp, Artificial Sequence
  Description of Artificial Sequence: Synthetic coding sequence
atgttcggacggaagaggagcgtctctttcggtggcttcgggtggatcgataaaactatgctcgctagccttaaggtgaagaagcaggagctggcgaattcgagcgacgccacactgccagaccgccctctatcaccaccactgaccgcccctcctactatgaaatctagtgaatttttcgaaatgctggagaagatgcagggaatcaagctggaggagcaaaaacctggcccccagaagaacaaggacgattacatcccctacccaagcatagatgaggtggtagagaagggcggaccttatcctcaggtcatactcccgcagttcggcggatattggatcgaagatccagagaacgtgggaacaccaacaagcctggggtcaagtatctgcgaggaagaagaagaggataatctgtctcctaacaccttcggatacaagctggaatgtaagggtgaagcccgcgcctaccggagacactttctgggtaaagaccacctaaacttttattgtacagggagctccttgggcaacctgatcctgtctgtcaaatgtgaggaggcagaaggcatcgaataccttcgtgtgatcttgaggtcaaagctgaagacagtccacgaaaggattcccctggccggcctttccaaactgccatcagtgccccagatcgcgaaggcattctgtgacgacgctgtggggctaaggtttaatcccgtcctctacccaaaggcttcacagatgatagtctcctacgatgagcatgaggtcaataataccttcaagtttggtgtgatttatcaaaaagcacggcagacactggaggaggaactgttcggtaataacgaagaaagtcccgccttcaaggagttcttggatctccttggggatactattaccctgcaagacttcaaagggtttagaggcgggctggacgtgacgcacggccagaccggtgttgaatccgtttatacaacgttcagagacagagaaattatgttccatgtgtctacgaaactgcctttcacagacggcgatgcccagcagctgcagagaaagcggcacattggaaacgatattgttgccatcatatttcaggaagaaaatactccgtttgtgccggacatgattgcatcaaatttccttcacgcatacatagtggtgcaggtggagaccccaggtactgagacaccctcttacaaggtgtccgtcaccgcgagggaggatgttcctacctttggccccccactgccgtcaccacctgtctttcagaaaggtcccgagttccgagagtttctacttaccaagctgacaaatgccgagaatgcatgctgcaaaagcgacaagttcgctaagcttgaggacagaacccgggccgccctactggataacctgcacgacgaactgcatgcccacacccaggcaatgttagggctggggcctgaggaggacaagttcgagaatggaggccacggtggattcctcgagtcattcaagcgggctattcgcgttcgctcacactctatggaaaccatggtgggtggacagaaaaaatcccacagtggcggaatacccgggagtctgtccgggggaatctctcataattccatggaagttacaaagaccaccttctcgccaccagtggtcgctgctacggtgaaaaatcagtcgaggagtcctatcaaaagacggtcaggcctattcccaagactgcatacaggatctgagggccaaggagattctagggcccgctgtgatagcacgagttccacacctaaaacacctgacggtgggcacagttcgcaggaaataaagagtgagacctcgagcaatccctcaagtccagagatctgtcctaacaaggaaaagcccttcatgaagctgaaggagaacggccgcgccatttcccggagcagctcctctacctccagtgttagctccaccgctggtgagggggaggccatggaagagggcgatagcggaggttctcaaccgtcaacaactagtcctttcaagcaggaggtttttgtttactcacctagcccgagttcagagagcccaagccttggcgctgcggctacacccattatcatgagcaggagccccaccgacgccaagagcaggaattccccgagatcaaacttgaagttcaggtttgacaagctgagccatgcttcatcaggcgccggccattag

SEQ ID NO: 17928 - DNA, 2271 bp, Artificial Sequence
  Description of Artificial Sequence: Synthetic coding sequence
atggtcgcccccgtcctggagacgtcacacgtgttctgttgccccaatagagtgagaggggtactaaattggagctctggacctcgtgggttactggcgttcggcaccagctgctccgttgttctttatgacccccttaagagggtagtggttacaaacctaaacggacacacagctcgggtcaattgtatccagtggatctgcaaacaggacggctcaccatccacggaactggttagtggtgggtcagacaaccaggtcattcactgggagatcgaagataaccagcttctcaaggccgtccacctgcaggggcatgagggcccagtgtacgctgttcatgccgtgtatcagagaagaacctccgaccctgcactgtgcaccctcatcgtcagcgccgccgcggattctgctgtccgattatggagtaagaaagggcccgaagtccccattttagcttgcggcaatgacgactgtagaatccacatctttgctcagcagaacgatcagttccagaaagtgcttagcttgtgcggccatgaagattggatacgaggggtggaatgggccgcgtttggccgggatctattcctggcctcatgttctcaagactgcctgatccgaatttggaaactgtatatcaagagtacctctctggagactcaggatgacgacaacatacggctgaaagagaacacattcaccatagaaaacgaaagcgtgaagattgccttcgccgtgacactggagacagttctggcagggcatgagaactgggtcaacgccgtgcactggcaaccagtgttctataaggacggggtgttgcagcaaccggtgcgcctgctgtctgcctcaatggataagactatgatcctttgggcacctgatgaagaaagcggggtgtggcttgagcagagggagtggacccccgaaattgtcatatcgggccattttgacggagttcaggacctggtgtgggaccccgagggggagttcatcattacggtgggaactgaccaaactaccagactatttgctccctggaaaaggaaggatcagagccaagtgacctggcacgagatcgcacggccacaaatccacgggtacgacctgaaatgtctcgcgatgatcaatagatttcagtttgtgagtggtgccgacgagaaggtgctgcgcgtgttcagcgccccaaggaacttcgtggaaaacttctgtgcaataacaggtcagtccctgaaccacgtcctctgcaaccaggactccgacctgcccgagggcgcgactgtgcctgcattagggctctcaaataaagccgttttccagggcgacatcgctagccagcctagcgacgaggaagagctgcttaccagtaccggcttcgagtatcaacaggtggcatttcagccttcaattttaactgaaccacctacagaggatcatctgctgcagaatacgctgtggcccgaggtgcaaaaactgtatggccacggctacgaaattttttgcgtaacctgtaactcctccaaaaccctgttggcatctgcttgcaaggccgccaaaaaggagcatgctgcaatcatcctgtggaataccacaagctggaagcaggttcaaaatctcgtgtttcacagtctcaccgtgacacagatggcattttcccccaacgagaagtttcttcttgccgtttctcgcgataggacatggagtctttggaagaaacaggacactataagcccagagtttgagcctgtgttctctcttttcgcatttacaaacaaaattaccagcgtccattctcgaataatctggagttgtgattggtcccctgactctaaatacttctttaccggaagccgtgataaaaaggtggtggtttggggggagtgcgatagcacagatgattgcatcgagcacaacatcggtccttgcagttcggtcctggatgtgggcggggccgtgactgctgtgagcgtctgccctgtgctgcacccctctcagcgctatgtagttgcagtggggctggagtgcggaaagatctgcttgtatacatggaagaagactgatcaggtgcctgaaatcaatgactggacccactgcgtcgagactagtcagagccagagtcataccctagcaatacggaagctgtgctggaagaactgtagtggaaagacagagcaaaaggaggccgagggagcagaatggctacactttgcttcttgtggagaggaccacaccgtaaaaattcatagggttaacaaatgcgctctgtag

SEQ ID NO: 17929 - DNA, 1272 bp, Artificial Sequence
  Description of Artificial Sequence: Synthetic coding sequence
atgaatcgccagccagtaaaagataggaaggctccttggatccccccaaatccgaccagccctcccgcctctcccaaatgcgcagcctggttgaaagtaaaaacctctccccgcgacgcaactaaagagcccctgcagcaggaagacccccaggaagagtctcaccttacgggcgccgttgagcacgaggccgcacggttggcctggctagacgccgagacgtcgaaacgactgaaagagctcgaggaattaaaggccaaggagattgattcaatgcagaaacaacgcctcgattggcttgatgccgaaacgtcacgacgtacaaaggaacttaatgagctaaaagctgaagagatgtataggttgcagcagctgtcagtctccgcgacacatctggccgacaaagtagaggaggctgtgctggacaggctgaaacctttgctcgtaaaagcccagagagttaatagcactaccgaagctaacatacatttgaaagacggcagcagcgtgaatactgctaaagcgcagcccgctcaagaggtggctgctgtggattttgaatctaataacattcggcaactggacgacttcttggaagattgcgcgtccgagctgtgggccgtgacacacgctaaaatcctggggtccgaaacattggccaccgtggaagatagtaaggattcacccgatctggagattatgatgcggagaatggaggagatggaaaagtaccaagagtccgtgcggcagaggtacaacaagattgcttatgcagacccacgcttatggatgcaagaggagaataatgaccagaaaatctccgccatcagtgaaaagcccctgtcccctcaccccatccgcatcacgaaaacagtggaccgtaaggatccggctgtgaatatcatgctagagcgcccatgcaacgggaactccctcgacgaaagtgtgggcaccgaagaggggtctgagaaaagagaggctccactgttaagtcttgcagaagattcacagcagaaggagggcagagcccctctgtttgtgccacccggaatgcagcactctataggcgactattgttcaagattcgaacagtatcttcggatcatttcccacgaagctgtaggcagctttaacccttggctgattgccgaatcattctctgaggaactcgttgacgaggctcttggggccgttgcagccgaactgcaagacatgtgcgaagactatgcggaggctgtctttacctctgaattcctggaggctgccacatag

SEQ ID NO: 17930 - DNA, 777 bp, Artificial Sequence
  Description of Artificial Sequence: Synthetic coding sequence
atggcccggctgcaggaggaacacggcgatcagctgctctctatccgctgccagcaccaagaacaggttgaggatctgactgcgtcccacgatgccgctctgcttgaaatggaaaacaaccacactgtggcgataacaatacttcaagatgatcatgatcataaggtgcaggagcttatgagtactcatgagttggaaaagaaggaattggaggagaattttgagaaattaagactgtcgctgcaggaccaggttgatactctgacatttcagtcccaatcgctgcgagaccgcgccaggcgctttgaagaggctctgcgaaagaacacagaagagcaattggagattgcgctagcgccataccagcacttggaagaggacatgaagagcctgaaacaggtattggaaatgaagaaccaacagatccacgagcaggagaagaagatcctcgagttggagaaacttgccgagaagaacattatcctcgaagaaaagatacaagttctccagcaacagaatgaagatctgaaagcgagaatcgaccagaataccgtggtcactaggcagctgtcagaagaaaacgccaacctccaggaatacgttgaaaaggagactcaggaaaagaagcggctcagccgaaccaatgaggagttgctctggaaactccagacgggggatcctacaagcccaattaagctatctccgacaagtccagtctaccgtgggtccagcagcggccccagtagtcctgcaagagtgagcaccacccccagatag

SEQ ID NO: 17931 - DNA, 1053 bp, Artificial Sequence
  Description of Artificial Sequence: Synthetic coding sequence
atgtgtcccactaccacttggccacgcgggcgccgatggtctcgaaatctgcgcgatactcaggcagtgcgccactataagatctggcgcagggcaggcgggcggctgcacctcaatgaagccgtctcattcctttccctgccggagctagtaaactaccacagggctcagagtctgtcccacggcctacgtctggccgccccgtgcaggaaacatgagcccgagcccctgccacactgggacgattgggagagacctcgtgaggagtttacgctctgtaggaaactgggatctggttatttcggcgaggtgtttgagggcctgtggaaagacagggtgcaagttgccatcaaggttatcagccgggataatttactgcaccaacaaatgttacaatcagaaatccaagctatgaagaagctgcggcacaagcacatcctagccttgtacgcagtcgtgtctgtgggagaccccgtttatatcatcaccgagctcatggctaaggggagcctgctcgaactgctccgggattcagatgaaaaagtcctgcccgtgtcggaactgctagatatagcttggcaggtcgcggaggggatgtgctatctcgagtcacagaactatatacatcgcgacttggccgctaggaatatcctggtgggagaaaacaccttatgtaaggtgggcgactttgggttagctcggctgataaaagaggacgtgtacctgtcccacgaccacaatatcccctacaagtggacagcccctgaagctttaagccggggccactactcgacaaaatctgatgtctggtcctttgggatattactccatgagatgttttcgcgtggccaggtaccgtatccggggatgtctaatcatgaagcttttctccgagtggacgcaggatacagaatgccatgtcctctagaatgccccccgtctgtgcacaagctcatgctgacgtgctggtgtcgagatccggagcaacggccgtgtttcaaagcgctgcgcgagcgcttgtcatcttttacctcgtacgaaaatcctacctag

SEQ ID NO: 17932 - DNA, 3480 bp, Artificial Sequence
  Description of Artificial Sequence: Synthetic coding sequence
atggtatcgtcttctccctccacaccctccaatattcctcagaaaccctcacaaccagctgccaaggaacccagtgctacgccacccatttccaacctaacaaaaaccgcaagtgaatccatcagtaatctcagcgaggctggttcaattaagaagggggaacgagagctcaaaattggagacagagtgctggtgggcggcaccaaggccggcgtagtgagattcctgggagagaccgacttcgccaaaggtgagtggtgcggggtcgaactcgatgagcctctaggtaagaacgacggcgccgtagctggaaccagatatttccagtgccagccaaagtatggtttgtttgcccccgtccataaagtcacaaagattggcttcccatcgacaacaccagcaaaggctaaggctaatgcagttcgacgggtcatggcgacaacgtctgcaagcttgaagcgctctccgtctgcatcatctctgagttctatgagctccgtggcctctagcgtgtcatctaggcctagcagaactgggttgctgacggaaacttccagccgctacgcaagaaaaatttccggtaccacagccctgcaggaagccctcaaggagaaacagcagcacattgagcaactgctggctgaacgcgatttggagagagccgaggtggccaaggcgacctcacatgttggggagatagaacaagaattagccctggcccgggacggccatgaccagcacgtgcttgaacttgaagccaagatggatcagctgcgcacgatggtcgaagccgcagatcgcgaaaaggtggagctgctcaatcaactcgaggaggagaagaggaaagtcgaggacttgcagtttagggtcgaagaggaaagtattaccaagggggacctcgagactcagaccaagttagagcatgctcgcatcaaggagctggaacagtcccttctgttcgagaagacaaaagccgataagttacagagggaacttgaggacacgagagtcgctaccgtgagtgaaaaatctaggattatggaattagaaaaggacttagccctcagggtgcaagaggttgcagaactgaggagaagactcgagtctaataagccagctggagatgtggatatgagccttagtcttctgcaggagatctcatctcttcaggagaaattagaggtgaccaggaccgatcaccagagagaaatcacgtccctgaaagagcacttcggcgcccgggaagagacccaccagaaggagatcaaagctttatacacggccacagagaaacttagcaaggagaatgagtcactcaagtcaaagctggaacatgccaataaggagaacagcgacgtgattgctctctggaagtctaagctggagactgcgattgcttcacatcaacaggctatggaagaactgaaagtaagcttttcaaagggcctgggtactgagaccgcagagtttgccgagctgaaaacacagatagaaaagatgagacttgattaccagcacgaaatagagaacctccaaaatcagcaggactctgagagggcagcacatgcaaaagagatggaagctttgcgagcaaagttgatgaaggttatcaaggagaaggagaattccttggaggctatccggagcaagctcgataaggcggaggatcagcatttggttgagatggaggacaccctcaacaagttacaggaagctgaaattaaaaaggaaaagttcgctgaagcctctgaagaggcggtgtctgtccaacgttctatgcaggagaccgttaataagctacaccaaaaggaggagcaattcaacatgctgtcctccgatctcgagaagctccgagagaacttggccgacatggaagcaaaatttcgcgaaaaggatgagcgggaagagcaactaataaaagcaaaggagaagctcgagaatgacatcgccgagatcatgaaaatgtccggtgacaactcttcacaattgaccaaaatgaacgacgaactgcgactgaaagagagagacgttgaggagctgcagctcaaattgacaaaggccaacgaaaacgccagcttcctacagaagagcatcgaggacatgaccgtcaaagcggaacagtctcagcaggaggccgcaaagaaacatgaggaggagaagaaggaattagagcgtaagctctccgatctggagaaaaagatggagacgagccataaccagtgtcaggagctgaaggccaggtatgaacgggcgacttccgagactaagactaagcatgaggaaatcttgcagaatctgcagaagacacttctggacactgaggacaaactcaagggcgctagggaggagaacagtggcctactgcaggaactggaagagttacggaaacaggccgacaaggctaaggctgcccagacggcggaagacgcaatgcagataatggagcagatgacaaaagaaaagacggaaacccttgcatccctggaggacacgaagcagacgaacgctaaacttcaaaatgaactagacaccttgaaagagaacaatctaaagaacgtagaggagctgaataagagcaaggaacttctgacggtagagaaccagaagatggaggaatttaggaaagaaatcgagacattgaaacaggccgctgcacagaagtctcaacagttatcggcactgcaggaggagaatgtcaaactggccgaggagctgggccgctcccgggatgaagtgaccagtcatcaaaagctcgaggaggagagatccgtccttaacaatcagctccttgaaatgaaaaagagagaatctaaattcatcaaggacgccgatgaggagaaagccagtttacagaaaagcatttcaatcacctccgccctgttaacggaaaaagacgcagagcttgagaagcttaggaacgaagtaactgtgctgagaggagaaaatgcatccgcgaagtcgctccatagcgtggttcagactctggaatctgacaaggttaagctagagttgaaagtcaaaaatctagaactgcagctgaaagaaaataagcgccagctgtccagttcctcaggcaacaccgatactcaggcggatgaagacgagagagctcaggaatcacaaaaccagatcgattttttaaactctgtgattgtggatctccagcgaaagaatcaagacctcaagatgaaagtcgaaatgatgtccgaggccgccttgaatggaaatggcgacgacttaaataactatgacagtgatgaccaggagaagcagtccaagaagaaaccccgtttattttgcgacatttgcgattgttttgacctgcacgatactgaggactgcccaacacaggcccagatgtccgaagatccaccccacagtacacatcacgggtccaggggcgaagagaggccctactgcgagatctgcgagatgttcggccattgggctaccaactgcaatgatgatgagactttttag

SEQ ID NO: 17933 - DNA, 756 bp, Artificial Sequence
  Description of Artificial Sequence: Synthetic coding sequence
atgactacagagcagcggcgcagtctgcaggcgttccaagactatataagaaaaacattagatccaacttacatcctgtcatacatggcaccatggttccgagaggaggaggtacagtacattcaggctgagaagaacaacaagggccctatggaagcagccacactctttctgaagttcctgctggagctgcaggaggagggctggttccggggctttcttgatgccctggatcacgccgggtatagtgggttgtacgaagcaatagaatcttgggattttaagaagattgagaagctggaagagtatagactgctccttaagcgtctgcagcctgagtttaaaactagaattatcccgaccgacattatcagcgatctgagcgagtgtttaatcaatcaggagtgtgaggagatactccaaatctgctctacaaagggaatgatggccggtgcagagaagctcgttgaatgtctcttacggtcagataaagaaaattggccaaaaacgttgaaactcgctctggaaaaggaacgtaacaagttctctgagctttggattgtagagaaagggataaaagacgtcgagaccgaggatcttgaggataagatggagacttctgatattcagatcttctaccaggaggaccccgagtgccagaatctgtccgagaatagttgcccacccagcgaagtctccgacaccaatctatactctccttttaaaccaattaaaaaaaagaagaagaagaagtag

SEQ ID NO: 17934 - DNA, 3189 bp, Artificial Sequence
  Description of Artificial Sequence: Synthetic coding sequence
atggtcagttctgcacaaatggggtttaatcttcaggccctgcttgagcagttaagtcaggatgagctgtcaaagtttaaatatctcattactaccttctccttggcccacgagctgcaaaaaattccacataaagaagtagataaagcagatggcaagcaactggtcgagattctgactacgcattgcgacagttactgggtggaaatggcatctctgcaggtgttcgaaaagatgcataggatggacctttcggagcgggcaaaagatgaggttcgggaagcagctttgaagagtttcaacaaacgcaagccacttagcctagggataactagaaaagaacgtcctcctctggatgttgatgaaatgctggaaaggttcaaaactgaggcacaggccttcacggaaacaaaaggcaatgtgatttgcctcgggaaagaggtattcaaggggaaaaaacccgacaaggataatcgatgccgctatatcctgaagactaaattccgagagatgtggaagtcttggccaggtgatagcaaggaagtgcaagtcatggctgaacgctacaagatgctcatcccatttagcaatccccgagtattgcccggccctttttcatacaccgttgtcctttatgggcccgctggtttgggcaagacaactctcgctcaaaaattgatgctggactgggcagaagataatctaatccacaaattcaaatacgctttctatctctcttgtcgcgagctgagtcgcttaggtccctgctcttttgcagagcttgttttccgcgattggccggagctgcaggacgacatcccccatattctggcccaggcccgcaagatcctgttcgtcatagatggctttgatgaattaggcgcagctccaggggccctgatcgaggacatttgtggggactgggaaaaaaaaaagcccgtgccagtattgctcggcagtttactgaatcgcgtcatgttgcctaaggcggcactgctggttactacccggcctagggccctgcgggacttacgaattctcgccgaggaacctatatacattcgcgtagagggctttctggaggaggatcggagggcgtattttctaaggcactttggcgatgaagatcaggccatgcgcgcttttgagctgatgcggtcaaatgccgccctgttccagctcggatctgcccccgccgtgtgctggatcgtctgcaccactctgaagttgcagatggagaaaggggaagacccagtccctacatgcctcacccgaaccggcctattccttagatttctatgtagcagattcccgcagggggcccagctacgaggcgcccttagaaccctctcactgcttgccgcccagggactgtgggcccagacctctgtgctgcacagggaggatctggaaaggctgggcgtgcaggaatccgacctcaggctgtttctagacggcgatatcctcaggcaggacagagtctcaaagggatgctacagctttatccacctttccttccagcagtttctgacggccctgttctacacgctggagaaagaagaggaggaggaccgggacggccacacctgggacatcggtgacgttcagaagcttctgtctggcgtggaaaggctgagaaacccagatttaatccaggctggatactatagttttggtctggcgaatgaaaaacgcgcaaaagaactggaggccaccttcggttgccgcatgagccctgacataaaacaggagttactgagatgtgatataagctgcaaggggggacatagtaccgtgactgacctccaggagctgctcggttgtctgtacgagtcccaggaagaagagcttgtgaaagaggtgatggctcagttcaaagaaatatcacttcatctgaatgcagtcgatgtagtaccgtcttccttctgtgttaagcactgccgcaatctccagaagatgtcacttcaagtaatcaaggagaatttgcctgaaaacgtaaccgcatctgagtcagacgcagaggtggaaaggtctcaagatgatcaacacatgctgcctttctggaccgatctgtgcagtattttcggctctaataaggacttaatgggccttgccatcaacgattctttcctctcagcctcattggtgaggattctctgcgagcagatagcgagtgatacctgccaccttcagcgagtagtgtttaaaaacatcagcccggccgatgcacaccgtaacctgtgtctggctttgcgcggccataagacagtgacatacctcaccctacagggcaatgatcaggacgatatgtttcctgctctgtgtgaggtgctgaggcacccggaatgcaacctgagatacctaggcctcgtgagttgttctgccactacccagcagtgggctgacctctcccttgccttggaggtgaaccagtcgttgacctgtgtaaacctgtcagacaatgagctcctcgatgaaggagccaagcttctctacaccacccttagacacccaaaatgcttcctacagcgactcagcctggaaaactgccacttaacagaggcaaactgcaaagaccttgccgccgtcctggtcgtcagtagagaactcacccatctgtgcctggccaaaaacccaattgggaatacaggggtgaagttcttgtgtgaaggcctaaggtaccctgaatgtaagcttcagactctcgtgttatggaactgcgacattacttcggatgggtgttgtgacctaacaaaactgttgcaggaaaagtcaagtttgctctgcctcgatctcgggctcaatcacatcggggttaagggcatgaaattcctctgtgaagcgctccggaagcccctttgtaacctgaggtgcctgtggctgtgggggtgcagtattcccccattctcctgtgaagatctctgctcagcactcagctgtaaccagagcttggttactctcgacctggggcagaacccgctgggttcatcaggggttaaaatgctttttgagaccctcacttgcagcagtggcacacttagaactctccgattaaaaatagatgacttcaacgacgaactaaataaattattagaggagatcgaagagaagaacccacagctgataatcgatactgagaaacaccacccctgggcggaacgcccctcctctcatgatttcatgatctag

SEQ ID NO: 17935 - DNA, 363 bp, Artificial Sequence
  Description of Artificial Sequence: Synthetic coding sequence
atgtggagcatagaaaacattgcctttggcagtggcggaggtcttttgcaaaagttgacacgggacctgctcaactgttcttttaaatgttcctatgtggtgacaaatggactcggcattaacgtgtttaaagaccctgtggccgacccaaacaagcgatctaaaaaggggaggctctcattgcatcgcactccggccggcaacttcgtgaccctggaagagggcaaaggggatctggaggagtacgggcaggacctactccacacggtctttaagaacggaaaggtgaccaagagctattcgtttgatgaaatccgaaagaacgctcaactgaacattgagctggaagccgcccatcattag

SEQ ID NO: 17936 - DNA, 936 bp, Artificial Sequence
  Description of Artificial Sequence: Synthetic coding sequence
atgtaccatctcgataatcaccccgaaaaacagttttccaccgatgtcctcaaacaggctatagaactctcaccagacaatcagtacgttaaggtcttgctggggctgaaactgcaaaagatgaataaggaagccgagggcgagcagtttgtagaggaggccctggagaagagtccttgccaaactgacgtattgagatccgcagcgaagttttatcgtaggaaaggggatctagataaggcaattgagctattccaacgtgtgctcgaatccacccccaataatggatatctgtatcaccagattgggtgctgctataaggctaaggtgcgccaaatgcagaatacaggagaatctgaggccagtggcaataaggagatgatcgaggccttgaaacaatatgcaatggactattctaataaagcactagaaaaaggtctgaatcccttgaacgcctacagcgaccttgctgaattcctggagacggaatgctaccagaccccatttaataaggaggtgcctgatgctgaaaaacagcagtcccaccagcggtactgcaatctgcagaagtacaatggcaaaagcgaagatacggccgtacaacacggcctcgaggggctgagtatctccaaaaagtccacagacaaggaggagatcaaggaccaacctcagaatgtgtccgagaatctgcttccacaaaacgcacccaattactggtatctacagggactgatccataagcagaacggcgatctactccaagctgccaaatgttacgaaaaggagttggggaggctactaagggacgcaccgagcggtatcggaagcatcttcctgtcagcttccgagctagaggatggcagcgaggagatgggacagggagctgtgtcttcttcaccacgggagctgttgtccaatagcgagcaactgaattag

SEQ ID NO: 17937 - DNA, 3267 bp, Artificial Sequence
  Description of Artificial Sequence: Synthetic coding sequence
atgtatgggtccgcccggtccgttggcaaggtcgagccctcatcacagtctcctgggagatcgcctcgattgccccggagcccaagactcggccacagacgaaccaactcaacagggggatcaagtggatccagcgttgggggcggttcaggcaaaactctttcaatggaaaacattcaaagcctgaacgccgcatacgcaacatccggacctatgtaccttagcgaccacgagaatgttggcagcgagacgcccaagagcacgatgacattgggtagatccggggggcgtttgccatacggggtgcgtatgactgctatgggctcctctcccaatattgcatccagtggggtcgcatctgacacaattgctttcggggagcaccacctgccccccgtgtcaatggcctccaccgtgcctcacagcctgcgccaggcccgggataataccatcatggatctgcagacacagctgaaagaggtcctgcgtgaaaacgacttgctgcgcaaggatgtcgaagtaaaagaatccaaactgtccagcagcatgaacagcattaaaacattctggtctcccgagttgaagaaggaaagagccctgcgtaaggacgaggcttcaaaaatcaccatctggaaggagcagtacagagtggttcaggaggagaatcagcacatgcaaatgacgattcaggctctgcaggacgagctacgcatacagcgggatttgaaccagctgttccagcaggactcatcgagccgcacgggggagccgtgcgttgctgaactcacagaagaaaatttccagagattacatgccgaacatgagcgccaggcgaaggagctcttccttcttcgcaagaccctggaagaaatggaattacggatcgagacccaaaagcagacgttgaacgcaagagacgaatctatcaagaaactgttagaaatgttgcagagcaaagggctgtcagcaaaggcaacagaggaagaccacgagaggaccagaagacttgccgaagccgagatgcacgtccatcatcttgaatctctgctggagcagaaagagaaggagaacagcatgcttcgtgaagaaatgcaccgaagattcgaaaacgcccccgatagcgccaaaaccaaagccctgcagaccgtgatagagatgaaagactcaaagatctctagcatggagcgagggcttagggatctggaggaggaaattcagatgctgaagtctaatggcgccctgagcactgaagaacgggaagaggagatgaaacagatggaagtgtacaggagccactctaagttcatgaagaacaagatcggccaggtcaaacaagagctctcgcggaaagatacggagcttttagccctgcagaccaaactcgaaaccctcacaaatcaattcagtgacagcaagcagcacattgaggttctgaaagagagcctcactgcaaaggaacagcgcgccgcaattttgcagacagaggtggacgcgttgaggctgcgcttggaagaaaaagaaaccatgctcaataaaaaaaccaagcagatccaggatatggcagaagagaaaggcactcaggctggcgaaattcatgacctgaaagatatgttggacgtgaaagaacgtaaggtgaacgtcttgcagaaaaaaatcgagaacctgcaggagcaactgagggacaaagaaaagcaaatgtctagccttaaggagagagtcaagtccctgcaagccgacactaccaacacagacaccgctttgaccaccctcgaagaggctcttgctgaaaaagagaggaccattgaaagactgaaggagcagcgcgaccgggatgaacgcgaaaagcaggaagaaatcgacaactacaaaaaagatctcaaggatttgaaagaaaaagtatccctgctccaaggggacttatccgagaaggaagcttctctgctggacctcaaagagcacgcctccagcctcgcgtcctctggtctgaagaaggattcccggttgaagaccctggagattgcccttgagcaaaagaaggaggagtgcctgaagatggagagtcagttgaagaaggcgcacgaagctgccctggaagcacgtgcctctcccgagatgtctgatagaatccagcatctcgagagagaaataaccagatacaaagacgaatcgagcaaggcccaggccgaggttgaccgcctcctggaaatactcaaggaggtggagaatgagaagaacgataaggacaagaaaatcgccgagctggagcgccaagtgaaagaccagaacaaaaaggtcgctaacctgaaacataaagagcaggtggagaaaaaaaagtctgcccagatgcttgaggaggcaagaagacgtgaggacaacctcaacgacagctcacagcagctccaggactccctgaggaaaaaggacgacaggatcgaagaactcgaggaagccctgagagagtctgtgcagattaccgccgagagagagatggtgctggcccaggaggagagcgcgcgcaccaacgcggaaaagcaagtggaggaactcttgatggcaatggagaaggtgaagcaagaactcgagtccatgaaggccaaactatcgtctactcagcaaagcctggccgaaaaggagacccacctgaccaatctcagagctgagcggcgtaagcacctcgaggaggtgttagaaatgaaacaggaggccctcctggccgcaatcagtgagaaagatgccaatatcgctttactcgaactgtctagttccaaaaaaaagacacaggaggaggtggcagctctgaaaagggagaaagatcgcctggttcaacagctgaagcagcagacacaaaaccgaatgaaactcatggcagacaactacgaggacgatcactttaaaagcagtcacagcaaccaaaccaatcacaagccttcccccgaccagattattcagcccttgttggaactagaccaaaatcgcagcaaactgaagctctacattggccatctcactaccttatgccacgaccgcgacccactcatcttgagaggattaactccgccggcctcctacaatcttgacgatgaccaggccgcatgggaaaacgagctgcagaaaatgactcgtggacagctccaggatgaactagaaaagggcgaaagggacaatgccgagctgcaggaatttgccaatgcgatccttcagcagattgcggaccactgtcctgatatactggagcaggtcgtcaatgctctcgaagaatcttcctag

SEQ ID NO: 17938 - DNA, 1485 bp, Artificial Sequence
  Description of Artificial Sequence: Synthetic coding sequence
atgaaactggttaatctgtataagggagccgtcctgtacctcctccggggcagaaaaacatttcttattcctgtgctgtttaataattatattactgctgcattgaaacttcttgagaagttgtataaggtcaacctaaaggttaaacatgtggagtacgacactttctatattccagaaatttctaatctggtggatattcaggaagactacctcatgtggtttttgcaccaggccggaatgaaagcgcggccaagtataattcaggatactgtcacactgtgctcttatcctttcatctttgacgcacaggctaagacgaagatgctccagactgacgccgaacttcaaatgcaggtcgcagtgaacggggccaacctccagaatgtattcatgctcctcaccctggaaccgctgctagccaggagcccatttctggtgcttcatgttaggcgaaacaacctggttggcgatgctttgcgggagctctctatccacagcgacatagacttaaaaaaacccctgaaggttatcttcgacggcgaagaggccgtggacgcgggcggggtcacgaaggagttttttctgttgctgcttaaagaactcttaaatcccatttacgggatgtttacctactaccaggactctaacctactgtggtttagcgacacctgttttgtggagcataactggttccacctcattggcatcacttgtgggctggctatctacaatagtacagtggtagatctccacttcccactggcactctacaaaaagctgcttaacgtcaaacccgggctggaagaccttaaggagctgtctcccaccgagggccgctcactccaggagttgttggattatcccggcgaagatgtggaggaaaccttttgcctgaatttcactatttgtagagagtcttatggagtgattgagcagaaaaagttgattccagggggagacaatgttactgtttgcaaagacaacaggcaggaatttgtcgacgcctacgtaaactatgtgttccaaatctcagttcacgaatggtataccgcattctcatcgggatttctgaaggtgtgtggaggcaaagtgttggaactatttcaaccatctgaactaagggccatgatggtaggcaacagtaattacaactgggaagaactggaggagacggccatttataaaggggactatagcgccacacatccgactgtaaagctcttctgggaaacttttcatgaatttcccttggagaagaaaaagaaattcctcctttttcttaccgggagtgaccgcatcccaatttacggcatggcctccctgcaaatcgtcatccaaagtactgcgagtggggaagagtaccttccagtggcccatacttgctacaatctcttagatcttcccaaatactccagcaaggagattttaagtgcgaggcttactcaagcactcgataactacgagggtttctcactggcttag

SEQ ID NO: 17939 - DNA, 2370 bp, Artificial Sequence
  Description of Artificial Sequence: Synthetic coding sequence
atgtgtccaagcagccagagcccgcggcctccgctgcttcggccaccctgtagttacagggaggtcccttcttctgttcagtcaccagcccagcagcaggtgcctgcccgtccgggggcaccctccgtgcaggttccatccccttttttgttgcagaatcagtacgaacccgtgcagccccattggttttattgcaaagaagtcgaatacaagcagctgtggatgccgttctccgtgttcgatagtctgaacctcgaggaaatatacaacagtgtgcagcccgacccagagtcagtggtgctggggacagatggaggtcgatacgacgtgtatctgtacgatcgtatccggaaggcagcctactgggaggaggaacccgctgaagttcgtaggtgtacctggttctacaagggggataccgattcacggtttatcccttatacagaagaattttcagagaagttggaagccgagtacaaaaaagcagtaacaaccaatcaatggcaccggaggcttgaatttcccagcggcgaaaccatagtcatgcacaatcctaaggtgatcgtacagttccagccgtcaagcgtacctgatgaatggggcacgacccaggacgggcagacacggccgagagtggttaagcggggcattgacgataatctggacgagattccagatggcgaaatgcctcaggtggatcacctagtctttgtcgtacatggcatcggccctgtgtgcgatctccgctttaggtccattatcgagtgcgtcgatgatttccgagtggtttctcttaagctgttaaggacccactttaaaaagtctctggacgacgggaaagtgagcagggttgagtttctgcctgtgcactggcactcttccctgggaggcgatgccacgggcgtagatagaaacatcaaaaaaataacactgccctctattggtcggtttcgccactttaccaacgagacgctgctggatattcttttttataatagcccgacttattgccagacaatagtggagaaagttggtatggaaataaaccacctccatgcgctcttcatgtcccgtaatccagatttcaagggaggcgtgagcgtggccggccatagcctgggcagcctaattctatttgatatccttagcaaccaaaaggatttgaatctatccaaatgccctgggccattggcagtggcgaacggcgtggtcaagcaacttcatttccaagaaaagcagatgcccgaagagccaaagctaactttggacgagtcttatgatctcgttgtcgagaacaaggaagtgctgactctacaagaaaccctcgaagctttatcattgtctgaatatttcagtaccttcgaaaaggaaaaaattgacatggagtcactgcttatgtgcaccgtcgatgatttgaaagagatgggcatcccattaggacccagaaaaaagatcgcaaacttcgtggagcacaaagcggccaagttaaagaaagcagcctccgagaagaaggctgtagccgcaacatccaccaaaggacaagagcagagtgcccagaagactaaagatatggccagcctgccctctgagtcgaatgaacccaaacgcaaactgcctgtcggagcctgcgtatcatcagtgtgtgttaactacgaatcatttgaagtgggagcaggccaagtctcagtggcctataattctctggattttgagccagaaatcttttttgctctcggcagccccatagcaatgtttctgaccatcagaggagttgacaggattgacgagaattactccctgcccacctgcaaaggctttttcaatatatatcatccactcgacccggtcgcctaccgcctggaacctatgatcgtgcccgatcttgacctcaaggcggttctaataccccaccataagggacgcaagagactacacctcgagttgaaggaatctctgtcacgcatggggtccgacctgaagcagggcttcatcagctctctgaaaagtgcctggcaaacactgaatgagtttgcaagagcgcacacttctagcacccagctgcaggaagagctcgaaaaggtcgccaaccagattaaagaggaagaggagaagcaggttgttgaagctgagaaagtcgtggagtcacccgatttctccaaagatgaagactatctgggcaaagtcgggatgctgaatggtggtaggaggatcgactacgttctccaagaaaaaccaatcgaaagcttcaacgaatatctttttgcactccaatcccacctatgctactgggagtccgaggatacggccctgcttctcctcaaggaaatatataggaccatgaacatctccccagagcaaccgcaacattag

SEQ ID NO: 17940 - DNA, 828 bp, Artificial Sequence
  Description of Artificial Sequence: Synthetic coding sequence
atgtccgcggaggtgaaggtcacggggcagaaccaagagcagttcctcttgctggccaagagcgcaaaaggagccgccctggccactctcattcaccaggttctggaggccccaggagtgtatgtgtttggagagctgttggacatgcccaatgttagagaacttgcggagtctgattttgcttctacctttcgcctcctgactgtgttcgcctatggaacgtatgctgactatctggcagaggcccggaatttgccgccactcaccgaagcgcagaagaataaattgcgccatttgagcgtggtcacgctggccgctaaagtcaagtgcattccatacgctgtgctcctcgaagctctggccctacggaatgtgaggcagctggaggacttagtgatagaagccgtctacgccgacgtgctgcgagggagtctcgaccaaaggaatcagcggttagaagtggactactccataggccgtgacatacagcgacaggacctctccgcgattgcccgcaccctgcaggaatggtgtgtagggtgcgaggtggtactgagcggaattgaggagcaggtttctagggccaaccagcataaggaacagcagttgggtctcaagcaacagattgagtctgaagtggccaatctgaaaaagaccattaaggtgacgacagccgctgccgcggcggcaacttcgcaggaccccgaacaacatttgacagagttgcgggagcccgcccccggcacgaaccagcgacaacctagcaaaaaagcgtccaaggggaaaggcctacgcggttctgctaaaatatggagtaaaagcaactag

SEQ ID NO: 17941 - DNA, 240 bp, Artificial Sequence
  Description of Artificial Sequence: Synthetic coding sequence
atgaacgggaccctcgaccacccagaccagcctgatcttgacgcgataaagatgttcgtgggtcaggtccccaggacttggtccgagaaagatctgcgcgagctttttgagcagtacggcgccgtgtacgaaatcaatgtgttgcgagaccgtagccaaaatcctccacagtcaaagggttgttgtttcgtaactttctacactcgcaaagccgctctggaggcccagaacgcgttgtag

SEQ ID NO: 17942 - DNA, 738 bp, Artificial Sequence
  Description of Artificial Sequence: Synthetic coding sequence
atggttctgctgcacgtcaagcgcggcgatgaaagccaattcttacttcaggctcctggaagcaccgagttggaggagctgacagtgcaagtagccagggtctataatggccgactaaaagttcagcgactgtgtagcgagatggaggaactcgccgaacatggcatttttctcccgcctaatatgcagggtctgaccgatgaccaaatcgaagaacttaaactgaaggacgagtggggtgagaagtgtgtacctagcggtggggcggtcttcaagaaagatgacatagggagaagaaatgggcaggcaccaaatgaaaagatgaaacaagtcttgaaaaaaactatcgaggaagccaaggcgatcatctccaagaagcaggtcgaggcgggagtctgcgtgactatggagatggttaaggatgctttggaccagctgcgcggcgctgtgatgattgtttaccccatgggactaccgccctacgatcctatcagaatggaattcgagaacaaggaggacctcagcggaacacaagccggccttaacgtgataaaagaagccgaagcacaactgtggtgggcagccaaagagctcagacggacgaagaaactttcagactacgtgggcaagaatgaaaagaccaagattattgccaaaatccagcaggtgagcaccttctgttttaatgtctctgtggtctttgtgatctcccttcagaccgacaagaacgtacagtag

SEQ ID NO: 17943 - DNA, 396 bp, Artificial Sequence
  Description of Artificial Sequence: Synthetic coding sequence
atggctatgaccgcgggcaccacgactacgttccctatgagtaatcacaccagggagagagtgacagtggcgaaattaacactggaaaacttttacagcaacctgatcctgcagcacgaggaaagggaaaccaggcaaaaaaaactggaggttgcgatggaggaggagggtttagctgacgaagaaaagaagctgcggcgctcccaacatgcccgcaaggagaccgaattcttgcgactgaagaggactaggctggggcttgacgactttgagagcctgaaggtgattggtagaggcgcatttggtgaagtgcgattggtacagaagaaagacaccgggcatatctacgcaatgaagattctccgcaagtccgatatgctcgaaaaggaacagtag

SEQ ID NO: 17944 - DNA, 2517 bp, Artificial Sequence
  Description of Artificial Sequence: Synthetic coding sequence
atgacaggtgcagagattgaaccatccgctcaagccaagcccgagaaaaaagccggggaagaagtgatagcaggaccagaacgtgagaacgacgtgcccctcgtcgttcgccccaaggttcgaacccaggcaaccacgggcgcacggcctaagaccgagacaaaatcagtgcccgcagctaggcccaaaactgaggcccaagcaatgagcggcgctcggcccaagacagaggtgcaggtcatggggggcgctaggccgaagacggaggctcaggggatcacaggcgcgcggccgaagacagacgcccgggccgtggggggggccagatcaaagacagatgccaaagccattcccggggccagacctaaggatgaggctcaggcttgggcccagtccgagttcgggactgaggccgtgtctcaggctgaaggcgtgtcgcagactaacgctgtcgcatggcctctggcaaccgccgagagtggatcagtcaccaaaagtaagggcctgtccatggacagagagcttgtaaatgtggatgcagagacgtttcccggaactcagggacaaaaaggtatacagccctggtttgggccgggcgaggagaccaacatgggtagttggtgctactctcggcccagggcccgagaagaagccagtaatgagagtgggttctggtctgccgacgagacttctaccgcaagcagcttttggacgggtgaagagacgtccgtccgaagctggcccagagaagagagcaatacgcggagcaggcacagagccaagcaccagaccaatcctaggtcgcggccacggtccaagcaggaggcctatgtcgacagctggagcggctcagaagacgaagcttccaatcctttctcattttgggtaggggagaatacgaacaacttgttccgaccgagagtgcgtgaggaagctaacatcagatctaagctaaggaccaatagagaggattgcttcgagagcgaaagtgaagacgagttctataagcaatcgtgggtgctaccaggcgaagaggcgaattcgcgcttccgtcatagagataaggaggatcctaacaccgccctgaaactccgagctcagaaggacgtggattctgaccgggtaaagcaagaacctcgattcgaagaagaggtgattataggctcatggttttgggccgagaaagaggcaagtctggagggcggcgcctctgcaatttgtgagtccgagcccggcacggaggagggtgcgatcggagggtcagcttactgggcggaggaaaagtccagtttgggagctgtcgctagagaagaggccaagcccgagtccgaagaggaggccattttcggtagctggttttgggaccgcgacgaagcatgtttcgacttgaacccctgtcccgtgtacaaagtgagcgacagattccgcgatgccgccgaggagctgaacgccagctcaagacctcagacctgggacgaagtcaccgtggagttcaaaccaggcttgttccatggcgtggggttccggtcaaccagtccctttggtataccagaggaagcaagcgaaatgctggaggcaaaacctaaaaatctggagttgtctccggaaggagaagaacaggaatctttgctccagccagaccagccatctccagagttcactttccagtatgaccccagttatcgctcagtgagagaaatccgggagcacctgcgagccagggagtcagcggagtctgagtcctggtcttgtagctgcatccagtgtgagttgaagataggaagcgaagaattcgaggaattcctcctgctcatggacaaaatcagggatcccttcatccacgagatctctaaaatcgccatgggcatgaggtcagcttcacagttcactagggatttcattcgtgactcaggcgttgttagtttgatagagactctgctgaactacccttcatcaagagttaggacctctttcctcgaaaacatgattcacatggcccccccctacccaaacctcaacatgatcgaaacatttatctgtcaggtgtgtgaagagacactagctcactctgtggacagcctggagcagttaactgggattagaatgcttaggcacttaactatgactatcgactatcatactttgatagccaattatatgagcgggttcctgtctttgctgacgactgccaacgctaggactaagtttcacgtgctgaaaatgctactgaacctatctgaaaatcctgccgtcgctaagaaactgttctccgctaaggccctctcaatcttcgtgggtctattcaatattgaagagactaatgacaatatccagatagtcatcaaaatgtttcagaatatcagtaacatcattaagtccggcaagatgtccttgatagacgacgactttagccttgagccactgatcagcgccttccgggaattcgaagaactcgcgaaacagctgcaggcccagattgataatcagaatgaccctgaagttggccagcagtcctag

SEQ ID NO: 17945 - DNA, 1215 bp, Artificial Sequence
  Description of Artificial Sequence: Synthetic coding sequence
atggatttcaacatgaagaaattggcctctgatgctgggatcttcttcacacgcgccgtgcagttcacagaagaaaagttcggccaagccgagaagacggaactcgacgcacactttgagaacctcttggcgcgagccgacagcacaaaaaattggactgaaaagattctcagacagacggaggttctcctccaaccaaacccaagcgctagagtggaggagttcctctatgagaaactggacagaaaggttcccagtcgggtaacaaacggagagctgctcgctcagtatatggccgacgcagccagcgaactgggtcccaccactccatacggaaaaacactaataaaggtggccgaagccgagaaacagcttggggccgccgagcgtgactttatccatacagcttccatctcatttctgacacctctgcgcaattttctcgagggagactggaagaccatctccaaggaaagacggctgctgcagaatcgacggctggacttggatgcctgtaaagccaggttgaagaaagctaaggccgctgaagcgaaggcaacggccgagggtcccaccgtgcctgatttccaggaaactcggccaaggaattacatactgagtgcaagtgccagtgctctgtggaatgacgaggtagacaaagccgaacaggaattgcgcgtggctcagactgaattcgatcgccaggccgaagtgactcgcctgctcctcgagggaatttccagcacccacgtcaaccacctacgctgtcttcatgagtttgtcaaaagccagacaacttactatgcccaatgttatcgccacatgcttgatctgcaaaaacaactggggtcatcccagggcgccatctttccgggaacgttcgtggggaccacagagccggctagtccaccgctgagctccacttcgcccaccactgccgcagctacaatgcccgtcgtgccatccgtcgcgtcactggctccccccggtgaggcctccctgtgcctggaggaggtcgcacccccagcatccggcacaagaaaggctcgtgtgctgtacgattatgaggcggctgacagctccgagctggccctgctggcagacgagctgatcacggtgtatagtctccctggaatggacccggactggctgatcggggagcggggtaataagaaggggaaggtgcccgttacttacctggagctcttgtcttag

SEQ ID NO: 17946 - DNA, 495 bp, Artificial Sequence
  Description of Artificial Sequence: Synthetic coding sequence
atgacatgctgccagacctccttctgtggctaccctagcttctcaattagtgggacatgtggctcttcgtgctgccagccgtcctgttgcgagacttcgtgttgtcaaccccgaagttgccaaacgtccttttgtggctttccgagcttttcaactagtgggacctgttcttctagttgctgtcagccttcctgctgtgaaacctcctgttgccagccttcatgctgccagatctcaagctgcggaaccgggtgtggtatcggaggcggcatttcctacggccaggagggctcctccggcgccgtgtccaccagaattcggtggtgtcgccctgactcaagagtcgagggtacatacctgcccccgtgttgcgtggtttcgtgcacaccacctagttgctgccagctacaccatgcgcaagcatcctgctgcagaccgtcttattgcggccaatcttgctgtcgtccagtatgttgttgtgaacccacttgctag

SEQ ID NO: 17947 - DNA, 846 bp, Artificial Sequence
  Description of Artificial Sequence: Synthetic coding sequence
atgctgactaagttgcagattaaacagatgatggaagcggccacaaggcagatagaggaacggaagaaacagctgtcattcatctcaccaccaaccccacagccaaaaaccccaagtagcagtcagccagaacgcctgccaattggcaacacgatccaaccctctcaggcagcaacctttatgaacgacgcgattgagaaagctagaaaggcagccgagctgcaggcaagaatccaggcacagctcgcactcaagcctggacttatcggaaatgctaatatggtcggcctggccaatttacacgccatgggaatagcgccacctaaagttgaactgaaggatcaaaccaagcctacaccactcatccttgacgaacaaggccgcactgttgatgccaccgggaaggaaattgaattgacccatcgaatgcctactctgaaggcaaatattcgggcggttaagcgtgagcagtttaaacagcagctgaaggagaagccaagtgaggacatggagtcaaacaccttttttgaccccagagtgagcattgctcccagtcagcgccagcggaggacatttaaatttcatgacaaagggaaatttgagaaaatcgctcagcgattgcggactaaagcacagctggagaaactgcaggccgagatctcccaggccgcccgcaagacaggcatccacacgtccacgcgccttgctctgattgctcccaagaaagagctcaaagagggcgatatcccagagattgagtggtgggactcctacatcattcctaacggattcgatctgggcaagtcgcaggaacgtcggttgttctggaaccacaaaagttgctag

SEQ ID NO: 17948 - DNA, 693 bp, Artificial Sequence
  Description of Artificial Sequence: Synthetic coding sequence
atgcgtggccacgagtcatcagtgttttctatcagtgtgcatgccagtgggaagtacgcaataaccacgagtagcgacaccgctcagctgtgggacctcgacaccttccaacgcaagcggaagcttaacatcaggcagtctgttggtatacagaaggtattcttcctgccactcagtaacaccatcttgtcctgctttaaggacaatagtatctttgcctgggagtgtgatacactcttttgtaagtatcagcttcctgcaccacctgagtcgtcatcaatcctgtacaaggtgttcgccgtcacccgggacggcagaatcctggcagcaggcggcaagagtaatcacctgcacctctggtgtctcgaggcacgacaactcttcagaatcatccaaatgccgacgaaggtcagagcgatccgacatttagagttccttcctgatagttttgacgccgggagcaaccaggtcctgggagtcctctcacaggacggcattatgagattcattaatatgcagacttgcaagttgcttttcgagataggatctttggacgaaggtatttcaagttcagccatttcccctcacggcagatacatcgccagcattatggagaacggaagcctcaacatctactctgtccaggcactcacccaggagataaacaaagaggaagtaagagcacagaactag

SEQ ID NO: 17949 - DNA, 1212 bp, Artificial Sequence
  Description of Artificial Sequence: Synthetic coding sequence
atggacagcaccatggacgatgcagtggcgggtgactttgcactgatcaataaactggatattcagtgcgacctaaaaacactctccgatgatatcaaggaatccttggagtctgaaggaaaaaactctaagaaagaggagccgcaggaattgcttcagagccaagattttgtgggcgagaagttgggctctggggaaccgagccattcggtgaaggtgcatacagtgcccaagccggggaaaggcgccgacttgagtaagcccccttgcaggaaggctaaagaaattcggaaggagagaaagagactcaagttgatgcagcaaaaccctgccggagagctggagggcttccaggcacagggacaccccccctctctgtttcctccgaaagctaagtcgaaccagccaaagagtctagaagatctgatctttgagtcattaccagaaaacgccagccacaaattggaagttcgggtggtgcgcagtagtccaccttcctctcagtttaaagcaaccctgctggaaagttaccaagtgtacaagcgttaccagatggttattcacaaaaatccccccgacacacctaccgaatctcagttcacacgcttcctgtgtagttcacccttggaggccgagaccccgcctaatggccctgattgcggatacggatcctttcaccaacaatactggctggacggaaagatcattgcagtcggcgtgatcgacattctgcctaattgcgtgtcctcagtctacctctactacgatcctgattatagctttttgtcactgggcgtatattctgctcttagagagatcgcgttcactcgccagttgcatgaaaaaacctctcagctgtcttattattacatggggttttatatacacagttgtcccaagatgaaatacaagggtcaatatcgcccttcggacctgttatgccctgaaacctacgtatgggtcccaatagagcagtgcctaccaagcctggaaaactccaagtattgtagattcaaccaggaccccgaggccgtggacgaagacagatctactgaacctgatcgattgcaggtgtttcacaaacgcgcaatcatgccatacggggtgtacaaaaagcaacagaaggacccgtccgaagaggccgcagttcttcagtatgcctctctggttggacagaagtgcagtgaacgcatgctgctgtttagaaactag

SEQ ID NO: 17950 - DNA, 909 bp, Artificial Sequence
  Description of Artificial Sequence: Synthetic coding sequence
atgccactctacgaggggctaggctccgggggcgaaaaaaccgcagttgtgatcgacttgggagaagcctttactaagtgcgggttcgcaggggagactggtccacggtgtatcattccctctgttattaaaagggctggaatgccaaagcccgtgagagtagtgcaatataacatcaacaccgaagaactttatagttacctgaaggaatttattcatatcctgtactttaggcaccttctagttaatccaagggatagaagagtggttataattgaatctgtcctgtgtccatcccacttccgggaaactttaacccgggttctctttaagtattttgaggtgccttctgtgctgctggcgccttcacacctgatggccctgttaacactagggatcaacagcgccatggtcctcgactgtggctatagggaaagcctcgtgctgcctatatatgaaggcatccctgtgctcaactgctggggcgctctacccctgggagggaaagcgctgcacaaggagctggaaacccaattgctggagcagtgcaccgttgatacctctgtagcaaaagagcagtccctgccctcagtgatgggctccgtgcctgaaggggtgctcgaggacatcaaggcgaggacttgtttcgtgtccgatttgaaacggggactcaagatccaggcggccaaatttaatatcgacgggaataatgagagaccatctcctcccccgaatgtagactacccgctggacggggagaagatactgcatattttggggagcatccgggactctgtagtggagattctcttcgagcaggacaacgaagagcaaagcgttgccacactgatcctggacagcctgattcagtgctgctcatgctgccctgggtggtctgcaatggcctag

SEQ ID NO: 17951 - DNA, 378 bp, Artificial Sequence
  Description of Artificial Sequence: Synthetic coding sequence
atgtcatcttgtgtctccagccaaccaagcagcaatcgagccgccccgcaggacgagctgggggggaggggctcttcctcaagcgagagccagaaaccctgtgaagccctgaggggcttgtctagcttgagcattcacctcggaatggaatctttcatcgtggttacagagtgtgagccaggctgtgccgtggatctcgggcttgcacgcgaccgacccttggaggcagacggccaggaagtgcccctcgatacaagtggaagtcaggctaggcctcatctcagcggccgtaaattgagcctgcaggagcgcagtcagggaggcctggcggctggcggtagcctcgacatgaatggacggtgcatctgcccaagttag

SEQ ID NO: 17952 - DNA, 1161 bp, Artificial Sequence
  Description of Artificial Sequence: Synthetic coding sequence
atggcggacagcctcgagtctacccctctgcccagtccagaggatcgattagctaaactgcatccttccaaggagctgctggagtattaccagaaaaagatggccgagtgtgaagccgagaacgaagacctgttaaagaaactcgagctctacaaggaggcttgcgaaggccagcacaaactcgagtgcgatcttcagcagagagaagaggagatcgccgaactgcagaaagccctgagcgacatgcaggtctgtctgtttcaagagagggagcacgtcttacggctttattctgaaaacgacaggttacgtattcgcgagctggaggataaaaaaaaaatccagaatcttttggctctggtagggacggatgcaggggaagtgacctacttctgcaaggaacctccgcataaagtgacaattctgcaaaaaaccatccaggccgttggtgagtgcgagcagagtgagagctctgcatttaaagcggacccaaagattagcaaacggagaccttcccgcgagaggaaagagtcctccgaacattaccagagagatatccaaacactaatcctccaggtagaagccttgcaggctcagttgggagagcagactaaactgagtagagagcagattgagggcctgattgaggataggaggatccatctggaagaaattcaggtgcaacatcagcgcaatcagaataaaattaaggagctcactaagaatctgcaccacacacaggagctattatatgagagcactaaggacttccttcagctcaggagcgagaatcagaataaggaaaagtcttggatgctcgagaaagacaatcttatgtccaagattaaacagtatcgggttcagtgtaagaaaaaagaggacaagattgggaaggtgcttcctgtaatgcacgagagtcaccacgcacagtcagagtacattaaaagcttgaaggacaaattggtccaggaaaaaaaactgtcaaatatgtaccaggaacaatgtatcagtcttgaggaggagctggccagaatccgggaggaggaagggatgcgccgcgaaatcttcaaagaccgaaccaataagatgggaaagcgtttgcagatcatgactaagcgatatgaggccctcgagagacggcgcatccttgaggtcgagtag

SEQ ID NO: 17953 - DNA, 999 bp, Artificial Sequence
  Description of Artificial Sequence: Synthetic coding sequence
atggagtacttaggaggcggaagtgcgctcgacttgctgaaaccgggtccactggaggagacatatattgccaccattctgcgtgaaatcctgaagggtctcgattacctacatagcgaacggaaaattcatcgtgatatcaaagctgccaacgtgttgttgagcgaacagggagacgtgaaactggccgatttcggcgtggcaggacaactaacggatactcagatcaaaaggaacacatttgtcggcacacccttttggatggcccctgaggtaattaagcagtctgcttacgactttaaggccgatatttggtcgttgggcatcacagcaatcgagctagccaaaggggaaccaccgaacagcgatttacacccaatgcgcgtactgtttctgattccgaagaactccccccccacgcttgaagggcaacacagcaaaccgtttaaagagtttgttgaggcctgcctgaataaggatccaaggttccgtcctacagccaaggaactgctgaagcacaaattcatcacccgatacaccaagaaaacaagctttctcacggagctgatcgataggtataaacggtggaagtcagaagggcatggggaggagagcagtagcgaggacagtgatattgacggggaggcagaagatggggagcagggtccaatatggaccttcccacccacaatccgcccctctccacattctaaactgcataagggaacagccctgcattcctctcaaaaaccggcggagccggtcaaacgccagccccggtcccagtgcctctccactctggtgcgaccagtatttggagagcttaaagaaaagcataagcagtcaggaggatcagtgggcgcattggaggagctggagaacgcattttccctggctgaagagtcctgtcctgggattagtgacaagctgatggtgcatctcgttgagcgtgtacaacgcttcagccacaaccgcaaccatctgactagcaccaggtag

SEQ ID NO: 17954 - DNA, 1524 bp, Artificial Sequence
  Description of Artificial Sequence: Synthetic coding sequence
atggaggaggtggagcgccaggtgctgcctgatcctgaagtgctggaagccgtgggggacagacaggatggcctccgtgagcagctgcaggccccagtgccgcccgactcagtgccttctctgcaaaatatggggctgcttctggacaaactggcgaaggagaatcaagatatcagactcctgcaggctcagctgcaggcccagaaagaagagcttcagtccttgatgcaccagcccaagggcttggaagaggaaaacgcacagttgcgaggcgcgctgcaacaaggcgaggcctttcagagggctctcgagtccgagttgcaacaactccgtgcccggctacagggcctcgaggcagattgtgtgcgtggacctgatggcgtctgcctttccggcggccggggcccccaaggggataaggcgatcagagaacagggaccaagggaacaggagccagagctgtcattcttgaagcagaaagagcaactggaggcagaagcccaggctttacgccaagagttagagagacaacgacgcctcctcgggtccgtgcagcaagatctggagaggtccctgcaggacgctagcagaggggaccccgcacacgcaggcctggccgagctcggccaccgtctagctcagaagctacagggtctcgagaactggggtcaggatcccggcgtctcagcaaacgcctccaaggcttggcaccagaagagtcactttcagaactcaagggaatggtcagggaaggagaagtggtgggatgggcagcgtgatagaaaggcagaacactggaaacacaagaaggaggagtctggacgcgagagaaagaaaaactggggaggacaagaggacagagaacccgccggcaggtggaaggagggccgccctcgggtggaagagtccggatccaagaaagagggtaaacggcagggcccgaaagagcctcctcgaaagagtggttccttccattcaagcggcgagaagcagaagcagcctaggtggcgagagggcaccaaggatagccatgatccgctcccgtcatgggctgagttgctccgcccaaagtaccgggcccctcaaggatgcagcggggttgacgagtgcgccaggcaggaaggactgactttcttcgggacagagctggcccccgtgagacagcaggagctggcatctctgctccggacttatctggcacgcttgccctgggcggggcagctgacaaaagagcttccgcttagtcccgcttttttcggggaggatggcatctttcgtcatgatcggctcagatttcgggacttcgtcgacgcgctggaggacagtttagaggaagtcgcagtgcagcagactggggacgatgatgaggtagatgactttgaagactttatatttagccatttctttggtgacaaggccttaaaaaagcgctcaggtaaaaaggataagcatagtcaaagtcccagagccgcaggtcctcgcgaggggcactcacactcccatcatcatcaccatagggggtag

SEQ ID NO: 17955 - DNA, 2472 bp, Artificial Sequence
  Description of Artificial Sequence: Synthetic coding sequence
atgactcttttaagttcacagtcctcttcgctagtggcccccagcggaagcgtcagcgccgaaaacccagagcagcggatgctggagaaaagagccaaggtcatcgaggaattgctacaaacggaaagagattatataagagatcttgaaatgtgcatagagcggatcatggtgcctatgcagcaggcccaagtgcctaacattgacttcgaaggccttttcggtaatatgcaaatggttatcaaggtttccaagcaactacttgctgcgctcgaaatcagcgacgccgtcgggccggtcttcctgggccaccgggacgagctggaaggcacttataagatctactgtcagaatcacgatgaggctattgcattgttggagatatatgaaaaagatgagaaaatccagaagcatctccaggacagcctggcagatctgaagagcctgtacaacgagtggggctgtactaattatattaaccttgggtcctttttgattaaacccgtgcagcgagtgatgaggtacccactgcttctcatggaactccttaactctacccccgaatcacacccggacaaggtgcccttaacaaatgccgtactcgctgtgaaggagataaacgtgaacatcaatgagtacaaacgcagaaaggatctcgttcttaagtataggaaaggggatgaagattcccttatggaaaaaatttccaagcttaacattcatagtatcataaaaaagtccaatcgcgtgtcgagtcatttgaagcacctcaccggtttcgccccccagattaaagatgaggtcttcgaggagaccgagaagaatttcaggatgcaggaacgtcttataaagagcttcattcgagatttgtccctgtacctgcagcatatcagggagagcgcctgtgtcaaggtagtagcagctgtatctatgtgggacgtttgtatggagagggggcatcgtgacctggagcagttcgaaagggtgcaccgctacatctcagaccaattatttacaaatttcaaagagcgcaccgagagacttgtcattagcccacttaaccagctgctttcaatgttcacaggcccacacaaactagtccagaagcggttcgacaagcttcttgatttctacaattgcactgagcgagcagagaaactcaaagataaaaaaaccctggaagaactacaaagtgcccggaataactacgaggctctaaatgctcagctgcttgatgaactccccaaatttcaccaatatgcacaggggttgttcaccaattgtgtgcatggctatgcagaggctcactgcgactttgtgcatcaggccctagaacagctgaagcccctgctgtcactgctcaaagtggccggacgtgagggcaatttgatcgctatctttcatgaggaacactcgcgggtgttacaacagcttcaagtcttcacattcttccccgagagcctccctgccacaaagaagccttttgagagaaaaaccatagaccggcagtcagcccgcaaaccattactgggcctcccaagctacatgctccaaagcgaagaacttcgcgcatcactattggctcggtatccccccgagaagctgttccaggccgaacgaaacttcaacgctgcccaggacctagacgtatccctgttagaaggggatctcgttggcgttattaagaagaaagatcctatgggttctcagaatagatggctcattgacaatggcgttactaagggcttcgtgtatagtagttttctcaaaccgtataacccccggagatctcattccgacgccagtgtcggcagccacagctccacagagagcgaacatggcagcagctccccaagatttccccggcagaattctgggtccacgctgactttcaacccatcctccatggcagtaagcttcacgagcgggagctgccagaagcagccccaagatgcatctccaccacccaaggagtgtgaccaaggcacgttgagcgcctccttaaacccatccaactctgagtcatccccctcacggtgtccgtcggaccctgattccacctctcagcccagatccggcgacagcgcggatgtggcccgggacgtcaaacagcctaccgcaacaccaagatcatacagaaattttaggcaccccgagattgtgggttattctgtccccggcaggaatgggcaatcacaggatctggtaaagggctgcgcccgtaccgcccaggcacccgaggataggtccacagagcctgacggatccgaagccgaggggaaccaggtgtatttcgctgtttacaccttcaaagcccggaacccaaacgagttgagcgttagtgccaaccagaaactgaagatactcgaattcaaggatgtgacagggaacacagaatggtggctagccgaggtcaacggcaagaaaggttatgttccttcaaactacattcgcaagactgaatacacctag

SEQ ID NO: 17956 - DNA, 492 bp, Artificial Sequence
  Description of Artificial Sequence: Synthetic coding sequence
taggacaaattccgcgcgtctcccgactgtatcactatcttgtgcaagccaaacggacaggcaattgcgtggtacacgcctatccattggaagcaggcttgggaaaagctggacgccgacgtggaattcaacaggtgtagcgttgtgagtcccacattcaggaaacgcgtcttccagtggacagcatccaccgcgacgatcaccaaggagaaacaggatcagccaaagaaggatatttccaattatcaggtggagcaggctcaggttcttctgaagcgcgaaaaggaaatcccccccaccgtgtttccaaaccgaagcccctggtgtcaaaacccctacgtgagcgctcacccatactgtcccttgattgagccacataacacatccactgcaggaggccgtcttgatcgacagcccagaacccgcagtacaagaccgaatcgcgcaagtgggtcgaaaaagaagaaaacctcggaatctcagaagcagtag

SEQ ID NO: 17957 - DNA, 771 bp, Artificial Sequence
  Description of Artificial Sequence: Synthetic coding sequence
atggctactcagagaaagcaccttgttaaagatttcaatccgtatatcacctgttacatctgtaagggatatctgatcaaaccaacgaccgtgactgagtgtctgcacacattttgtaaaacttgcatcgtgcagcacttcgaggatagcaacgactgtccaagatgcggcaatcaggtgcacgagaccaacccacttgagatgttgagactcgacaatacattagaagagatcattttcaagttggttcctggcctgcgcgagcaggagctggagcgagagtcggagttctggaaaaagaataaaccccaggaaaatgggcaggatgacacgtctaaggcggataaacccaaggttgacgaagagggcgacgagaatgaggatgataaggactatcacagatccgacccccaaatcgcaatatgtctggactgcctccgcaacaacggccaatccggggataatgttgttaaaggcctgatgaagaagtttattaggtgttctactagggtgacagttggcactatcaaaaagtttctcagtctcaagctgaagctgcctagttcctatgagcttgacgtgctgtgtaatggggaaataatggggaaggatcataccatggagtttatttatatgaccaggtggagacttcgaggggagaactttcgctgcctgaactgctccgcgtcacaagtgtgctctcaggacggacctttgtatcagagctacccaatggttcttcaatatagaccgcgtatagattttggttag

SEQ ID NO: 17958 - DNA, 2793 bp, Artificial Sequence
  Description of Artificial Sequence: Synthetic coding sequence
atgtcagaatttagaattcaccatgatgtaaacgaacttctcagtctgctgagagtgcatggcggtgatggagccgaagtctacattgacttattgcagaagaaccgcacaccctatgttaccacaacagtctctgcccatagtgccaaggtgaagatagctgaattttctcgtacaccagaggacttcctaaagaaatatgatgagttgaagtctaaaaacactcgtaatttggacccacttgtgtaccttctcagtaagctcaccgaggacaaggagacactgcagtatttgcagcaaaatgccaaagagcgcgctgaactggctgccgccgctgttgggagtagcactacatctatcaatgttcctgcagcagcgtctaagatctctatgcaggagctggaagaactgcgtaagcaattaggttccgtcgcgacaggaagcaccttgcaacagagcttggaactaaaacgaaagatgctgcgcgataagcagaataagaagaatagcgggcagcaccttccaatttttcctgcctgggtttacgagagacccgcattgataggagacttcctgattggggccggcatctccacagataccgcactgcccattgtcttgctgcgatggaacttggctctgagcccccggctgaagtgtagcggagtcattagcgcccattgcaatctgcatctcccgggtacgttacccctggcctctcaagaatccgctgtagtcgaggatcttctctacgtacttgtcggagttgatggacggtatgtgagtgcccagccacttgctggaaggcagtccagaacttttcttgtggatcctaacttagacctgagtatccgagagcttgttcatcgcatccttcccgtggccgcgtcttatagcgcagtgaccaggtttattgaggaaaagagcagtttcgagtacggacaggtgaatcatgcactggcagcagctatgcggacactcgtcaaggagcacctgatcctggtgtcccaactggagcagttgcacaggcagggcttactctccctccagaagttatggttttatatacagccggctatgcgtaccatggatatccttgcttctttagcaactagtgtggataagggcgagtgtttaggaggctcgacgttgtctcttctgcacgaccgttccttctcctacactggtgatagtcaggcccaggaactgtgcctttacctgaccaaagcagcttctgcaccctacttcgaagtgttagaaaagtggatctatagaggaatcatacacgacccttactccgaattcatggtggaggagcatgagctcaggaaagagcgcatccaagaggactataatgacaagtactgggaccagaggtacactatagtgcaacagcagatcccatcattcctacagaaaatggccgataaaatcctgagtacaggcaaataccttaacgtggtcagggaatgtggccacgacgtgacctgtcccgtggccaaagagataatttacacattgaaggagcgggcctatgtggaacagatcgaaaaggccttcaactatgcctctaaggtactcctggactttctgatggaggagaaggagttagtcgcccacctcaggtccataaagagatactttttaatggaccagggagactttttcgtgcatttcatggatctcgctgaagaggaactgcgcaagcctgtggaggacattacacccccaaggctagaggccctcctcgagttggctctcagaatgagtacggccaatactgatccttttaaggacgacctgaaaatcgatttgatgccccacgacttgattactcaactgctgagggtgctcgccatcgaaactaagcaggagaaggcaatggcacacgccgatccaaccgaactcgccctctcgggtctcgaagcgtttagcttcgattacattgtgaagtggcccctgtccttaatcatcaatcgcaaggccctgacaagatatcaaatgttatttaggcacatgttctactgcaagcacgtagaacggcagctgtgtagcgtttggatctctaataaaaccgcgaagcagcattcactgcattccgcacaatggtttgccggggcattcactttgagacagagaatgctaaattttgtgcagaatattcaatattacatgatgtttgaagtaatggagcctacatggcacatcctggaaaagaatctgaagtctgcctccaacatcgatgatgtcctgggccaccacacaggctttttggacacatgcctgaaggactgcatgttgaccaaccccgagctgctgaaagttttttcaaaactgatgtcggtctgtgtgatgtttaccaactgtatgcagaagtttacccagtcaatgaagctggacggagagctcggggggcaaacccttgagcatagtacagtcctgggcctgcccgccggggccgaagaacgagcgcgcaaggagctggccagaaagcacctggctgagcacgctgataccgtgcagctagtatccggatttgaggccaccattaataaatttgacaagaattttagcgctcacctgcttgatctcctcgctcggcttagtatttattctacctctgattgtgagcacggtatggcgtccgtcatctcaaggttggacttcaacggcttttacacagagagactggaaagactgtccgccgagcggtcccagaaggctacacctcaggtgccagtcctccgcggcccccctgccccggcaccaagagtcgcagtaaccgctcagtag

SEQ ID NO: 17959 - DNA, 129 bp, Artificial Sequence
  Description of Artificial Sequence: Synthetic coding sequence
atgtgcctgctgcccatccgggtcaaggaggctgaagaagtgtgtaggcaaaagaagggcaaaagtttgtacaagattaagcctaggcacgacagcgggattaaggccaaaatttcaatgaaaacatag

SEQ ID NO: 17960 - DNA, 456 bp, Artificial Sequence
  Description of Artificial Sequence: Synthetic coding sequence
atggactgtcgggagatggacctctatgaggattatcagagcccttttgactttgacgcgggcgtgaacaagtcttacttgtacctctcaccctccggcaattcatcaccacctggcagtcctactcttcagaagttcggcctgctccggacggatccagttcctgaggaaggagaagatgttgctgccaccatcagtgccacggaaacactcagcgaagaggagcaggaggaactgagacgagaacttgctaaagtggaggaggaaatccagactctgagtcaggtcctggccgctaaggagaaacacttggcagaaatcaaacgcaaactgggtattaattcgctgcaggaactcaaacagaacatagctaaggggtggcaggatgtgacggctacctctgccagatccaagctcctggccgctgaaacggaactgttgtgcttgttatattag

SEQ ID NO: 17961 - DNA, 627 bp, Artificial Sequence
  Description of Artificial Sequence: Synthetic coding sequence
atgtctgcaggcggagattttggcaacccccttagaaagtttaagctggtgtttctcggcgaacagagtgtcggaaagacatcactgattacgagatttatgtacgactcattcgacaacacatatcaggccaccatcgggatcgactttttgtctaaaacaatgtaccttgaggacagaacagtcaggctacagctgtgggatactgctgggcaagagagatttagatccctcattcccagctatataagagattctacagtggcagtggtcgtgtacgatataacaaacttaaatagctttcaacaaacaagcaagtggattgatgatgtgagaacggagcgtggtagcgacgtgataatcatgttagtgggaaacaagaccgacctggcagataaacgccagatcacaatcgaggagggcgaacaaagagccaaagagttatccgtcatgttcattgagacatctgccaaaaccggctacaacgtcaagcagctttttagacgggtagcgtccgcactacccgggatggaaaatgtacaggaaaagtccaaagaggggatgattgatatcaaactggacaagcctcaggaacctccagcaagcgagggaggctgttcttgctag

SEQ ID NO: 17962 - DNA, 1575 bp, Artificial Sequence
  Description of Artificial Sequence: Synthetic coding sequence
atgaagcgttctagcgtctcgtccggaggagccgggagactgagcatgcaggaactcaggagccaggatgttaacaagcaagggctgtatacaccccagaccaaggaaaaacccacattcggcaagctgagtatcaacaagcccacatctgaacggaaggtctcactgtttgggaagcggacctcaggtcacggtagtaggaactcgcaattaggcatatttagcagcagcgaaaagatcaaagaccctagacccctgaatgataaagcttttatccagcaatgtatccgacagctgtgcgagttcttgacagaaaatgggtacgcccataacgtgagcatgaagagtcttcaggccccatccgtgaaggatttcctcaagatctttaccttcttgtatgggttcctgtgtcctagctacgagctgcctgacaccaagtttgaggaggaggtcccaaggattttcaaggatctggggtatcccttcgccctaagcaagagttctatgtatacggtgggtgcaccgcacacttggccccatatagtggccgctctcgtgtggctgatagactgcatcaaaattcacactgccatgaaggaatcctcccctctgttcgatgacgggcagccatggggcgaagagactgaggacggcatcatgcacaataaactgttcctcgactacaccatcaagtgttatgaatcattcatgtcgggcgcagacagttttgatgagatgaatgctgaactacaatctaaattgaaagatctgtttaacgtggacgccttcaagttagaaagcctggaagccaaaaatcgagccctgaacgagcagattgcgcgattggagcaggagagagagaaagagcccaatcgccttgaatcccttcggaagctgaaggcatctcttcagggcgatgtgcagaagtatcaggcctacatgtcaaatctagagtcccacagtgcgatacttgatcagaaactcaacggactcaatgaggagatagcacgcgtggagctcgagtgcgaaactataaagcaggagaacactcgtctacagaatattatcgataaccagaaatactctgtcgctgacatcgagcgcatcaaccacgagcggaacgaactgcagcagaccattaataagcttaccaaggatctggaagccgagcagcagaagttgtggaacgaggaactcaaatatgccagagggaaagaagccatcgaaacgcagctggctgagtaccataagctggcacgtaagctgaaactaatcccaaagggtgcagagaattccaagggttacgatttcgaaatcaaattcaacccagaggctggtgcgaattgtctggtcaagtatcgcgcccaagtgtacgtccctctcaaagaactactgaatgagaccgaagaggagataaataaggcactgaacaaaaaaatgggtctggaagataccctggaacagcttaacgctatgatcactgagtctaaaagaagcgtgcgaacactcaaagaagaagtccagaaactggacgacctttatcagcagaaaattaagaaagaacggaagaagtag

SEQ ID NO: 17963 - DNA, 1248 bp, Artificial Sequence
  Description of Artificial Sequence: Synthetic coding sequence
atgatgctgggaccagaaggaggtgagggctttgtcgtaaaactgcggggactaccatggtcatgctccgtggaggatgttcaaaatttcctctccgattgtacaatccatgacggggccgccggcgtgcatttcatctacactcgcgagggcagacaaagtggcgaagcatttgtcgagctggggtctgaggacgacgtcaagatggctctgaaaaaggaccgagagagcatgggccacaggtatatcgaagtcttcaagtcccacagaacagagatggattgggttctgaagcactccgggcccaactctgccgactctgcaaacgacgggttcgtgaggcttcgggggctccctttcgggtgtactaaggaggaaattgttcaattcttttccgggctggagatcgtgccaaacgggatcactcttccagtggatccggaaggaaaaatcacaggggaggctttcgttcagttcgccagtcaagagttagccgagaaagcactaggtaagcataaggagagaatcgggcacaggtatattgaagtatttaaatcaagccaggaggaggtgaggtcttactccgatccacctctcaagtttatgtccgtgcaacggccaggcccatacgatcggcctggaaccgctaggcggtacataggcattgtgaagcaggcgggtctggaaaggatgaggcctggtgcctactccacaggctacggcggctacgaagaatatagcgggctgagtgacggttacggattcaccactgacctgtttggtcgagatctgagctactgcctcagcggaatgtacgatcacaggtacggggactccgaattcaccgtgcagtctaccaccggccactgtgtgcacatgcgaggactcccatacaaagcaacagagaatgacatatataacttcttcagcccattgaaccctgtccgggtgcacatcgaaataggtcctgacggacgggtaactggcgaagccgacgtggaatttgcaacacacgaggaagctgtggccgccatgtcaaaggatcgcgccaacatgcagcaccgctatatcgagctcttcctcaactccacaaccggggcttcaaacggcgcttattcatctcaggtaatgcagggaatgggcgtgtctgctgcacaggcaacctattccggacttgagtcccagtccgtgagcggatgctatggggctgggtactccggacaaaacagcatgggtggatacgattag

SEQ ID NO: 17964 - DNA, 1512 bp, Artificial Sequence
  Description of Artificial Sequence: Synthetic coding sequence
atggctagtaaccacaagtcgagtgctgcgcgccccgttagccggggcggggtcgggttgaccgggcgtcccccaagcggcatacggccgctgtctggaaacatcagagtagcaaccgctatgcctccgggcaccgctcggcccggcagcagagggtgcccgatcggaacgggcggggtcctgagcagccagatcaaagtcgctcatcggccggttacgcagcaaggactcacaggcatgaagactggtactaagggaccacaacgccagatcctagacaagtcttactaccttggacttttaaggagcaagatttcagagctgaccactgaagtcaataagctacagaagggtatcgagatgtataaccaggaaaacagcgtatacttatcatatgaaaagagagctgaaacattggctgtggagatcaaagaactccagggacagctcgcagactataacatgctcgtggacaagctaaacacaaataccgagatggaagaggtgatgaacgactataatatgcttaaggcacagaacgatagggagacacaatctcttgatgtgatatttactgagcggcaggcaaaagaaaaacagatacgctctgtggaagaggaaatcgaacaagaaaaacaagcaaccgacgacatcattaaaaacatgtcttttgagaatcaggtcaagtatttggagatgaaaactacaaacgaaaagctcctccaggaactggatactttgcagcagcaactggactcccagaacatgaagaaggaatcactcgaggctgaaatagcacattctcaagttaagcaggaggcagtgctcttgcacgagaagctttatgagctcgagtcccatagagatcaaatgattgcagaggacaagtctataggctctcctatggaggagagggagaaattgctcaagcagattaaagatgacaatcaggagattgcaagtatggaaaggcaacttacagatacaaaagagaaaattaaccagttcattgaggagattcgtcaactggacatggaccttgaggagcatcaaggggaaatgaatcagaagtacaaagagctaaagaagagggaggagcatatggacacgttcatcgaaaccttcgaggagacaaagaatcaagagctcaagcgcaaagcacagatagaagctaacatcgtggccttgttagagcactgcagcagaaatatcaacagaattgaacagataagcagcatcactaatcaggagttaaaaatgatgcaggacgatttaaatttcaagtccaccgaggttcagaagtcacagagcacagcacagaacctgacctccgacatccagcgtctgcaattggatctccagaaaatggaactcctggagagcaaaatgaccgaagagcagcattctttgaaatctaaaataaaacaaatgacaacagacttggaaatctataacgacctgcccgcgcttaagtcatccggcgagaaaaagaaaaagaagaaaaaaaagtag

SEQ ID NO: 17965 - DNA, 1461 bp, Artificial Sequence
  Description of Artificial Sequence: Synthetic coding sequence
atgacatgcgggtcttattgcggcggtcgagccttttcttgcattagcgcatgcggacctcgaccgggcagatgctgcatcaccgcggcaccttacagaggtatcagttgttaccgcggattaacaggtgggttcggctcccatagtgtgtgcggaggtttccgggccggcagttgcggaagatcatttggataccgtagtggtggagtctgtggacccagccctccctgcataaccacagtttccgtgaacgaatccctgctgacccctctcaatctagagatcgatccaaatgcgcagtgcgtgaaacaagaggagaaggagcagattaagagtctcaactcccgttttgcagcatttattgataaagtaagatttttggaacagcagaacaagctgcttgaaacaaaactgcagttttaccagaatagggaatgctgccaatctaacttagaacccctctttgaagggtacattgaaacactgagacgagaagccgaatgtgtggaggctgattcagggcgtctggcctctgaactcaatcatgtccaggaggtgttggaaggctataaaaagaagtacgaagaggaggtctcacttcgggcaaccgctgagaatgaatttgtggcgttgaaaaaggacgtggattgcgcctacctccgaaaatcagacctggaagcgaatgtcgaagcccttattcaggaaatcgactttctgcgccgactatacgaggaagagataagagtactgcaatctcacattagcgataccagtgtggttgtgaaactggataacagtcgcgaccttaatatggattgcattatagcggaaatcaaggcccagtatgacgacatagtgacccggtcaagagccgaagctgagagctggtatcgctcaaaatgcgaggagatgaaggccaccgtgatccggcacggtgagacccttagaaggacaaaggaggaaattaatgagctgaatagaatgattcagcgtttgaccgccgaggtcgagaacgccaagtgtcagaactccaagctcgaggccgcggtggcccagtctgagcagcagggagaggctgcactgtctgatgctaggtgcaaattggccgagctcgaaggcgcccttcagaaggcgaagcaggatatggcctgcttgatcagagaataccaggaggtgatgaatagcaagcttggtttggatatcgagatagcaacgtacagaaggttgttggagggcgaggaacaaaggctgtgtgaaggagtgggaagtgtcaacgtgtgtgtgagctcatcccgcggcggcgtggtttgcggcgatctgtgtgcatccacaaccgcgccagtagtgagtactagggtttcctcagtgcccagcaattccaatgtggtggtaggaacaacaaacgcctgcgcccctagtgcacgggttggcgtatgtggcggttcatgtaagcggtgttag

SEQ ID NO: 17966 - DNA, 1011 bp, Artificial Sequence
  Description of Artificial Sequence: Synthetic coding sequence
atgtgtaccatgcataaggacgaaaaagctaagcgggaagtttcctcctggaccgtcgagggtgacataaacactgacccatgggctggctaccgatataccggaaagctgcgcccgcactacccgcttatgccaacccggcctgtgccgagttatattcaaagacctgattatgccgaccatcctttagggatgtccgaatcagaacaagccctcaagggtactagccagataaagctactgtcctccgaggatatcgaggggatgcggctcgtatgccggctggcgagagaggttttggatgtggcagcaggcatgattaaaccaggggtaacaactgaggaaatagatcatgccgtccacctggcttgcatagcacggaactgttatccttccccattgaattactacaactttccgaaaagttgctgtacatcagtgaatgaggtgatctgccatgggattccagacaggcgacctctgcaggaaggtgatatagtgaatgtggatatcacactgtaccgaaacggctaccatggcgatctcaacgaaaccttctttgtgggcgaagtcgacgacggggcgcgcaagcttgttcagaccacatatgaatgtttgatgcaggcaatcgacgccgtgaagcctggggttcggtaccgggagctggggaacatcatccagaagcacgcgcaggctaatggattttctgtcgttcgatcttattgtggacatggtatccataaacttttccacactgcacccaacgtgccccattacgcgaagaataaagccgtgggcgtaatgaagtccggacatgtgtttactatagagccgatgatctgcgagggcgggtggcaggacgagacctggccagacggatggacggccgtcaccagagatggaaagcgtagcgctcaattcgagcataccctgctggtgacagacaccggatgcgagatactcacaagaagactcgacagcgcgagaccgcacttcatgtcccaattttag

SEQ ID NO: 17967 - DNA, 3102 bp, Artificial Sequence
  Description of Artificial Sequence: Synthetic coding sequence
atggcaggaatgattgatcgcttttctcctgctaacactggcatcagatcctgggacgtggaccccggggtctgtaacctcgacgaacagctgaaagtattcgtttccaggcacagtgcgacattcagcagcatagtcaagggacagaggtcattacatcacaggggggataatttggagacactagtgctgctcaatccatctgataagagcttgtacgatgaacttagaaatctccttcttgatccggccagccataagttgctggtgcttgcagggccgtgtttggaagaaactggagaacttctcctccagacgggcggattttcccctcatcatttccttcaggtgcttaaagatcgggaaataagggacatcttggctacgactcctccgccagtacagccaccaatcctcacgattacatgtcctacttttggggactgggcacaactcgccccagcagtgcccggtctgcaaggcgctttgagactgcaactgcgcctgaatccccctgctcagctgccaaactcagagggcctatgtgaattcctggagtatgtcgctgaaagccttgagcccccttcaccttttgagctcctcgaaccgccaacaagcgggggatttctaagactagggcggccatgctgctacattttccccggaggcctgggggacgcagccttcttcgccgtaaatgggttcaccgttcttgtcaacggtggcagtaatcctaaaagcagcttctggaagctcgtgagacacctggacagagtggacgctgtgttggttactcatcccggtgccgactcgcttcctggtctcaacagtcttctgcggaggaagttagctgaaaggtctgaggttgctgccggagggggttcctgggacgatagacttagaaggctcatctcccctaatttaggcgtcgtgttttttaacgcgtgtgaggctgcatctcggctcgcaaggggcgaggacgaggcggaactcgccttgagcctgctcgcccagttaggtataacccctctccccttgtctaggggccctgtgccagccaaaccaaccgtcctcttcgaaaagatgggcgtaggaagactcgacatgtacgtgttacaccccccatcggctggcgcagagaggacactggcctccgtgtgcgctttgctggtctggcatccagcgggaccaggggaaaaagtagtgagggtgctgttccctgggtgcacccccccggcgtgcctgttagatggactagtccgactgcagcatctgaggtttctgagggaacctgtcgttaccccgcaggatctggaagggccgggcagagcggaatcaaaagaatcagtgggctcacgagactctagcaagcgggagggcctcctagccactcatcctaggcctgggcaggagcgacccggggttgcccgaaaggagccggcccgagcggaggctcctagaaagactgagaaggaggccaagactccgcgcgaactgaagaaggaccctaagccttccgtttcgcgaacccagcccagagaggtccggcgagcagcctctagtgtccccaatctgaagaagaccaacgcccaggcagcccccaaacccaggaaggccccttctactagtcattcaggattcccccccgttgccaatggtcccaggtccccaccaagtttgcgatgtggtgaagcctctcctccatctgcggcctgtggctccccagcaagtcagctcgttgccacaccctcccttgaattagggcctatcccagcaggggaggagaaggctctagagctaccactggccgccagttccattccgcgcccgcgcactccctctcccgagtcccataggtcccctgccgaagggtctgagcggctgtccctcagcccactgaggggcggtgaggctggccccgatgcctcaccaaccgtgactacccccacagtgaccacaccatccttgccagccgaggtcggctctcctcacagcacagaagttgacgagagcctcagcgtgtcattcgagcaagtgctcccacccagtgctcccacctctgaggcagggctgtctcttcctctgcggggaccacgggcaaggaggtccgcaagccctcatgatgtggacctatgtctcgtgtctccctgtgaatttgaacataggaaggctgtgcccatggctccagcacccgcttctccaggttcatctaatgactcatcagctcgcagccaggaacgagctgggggcctgggcgcagaagaaacacctccaacgtccgtcagtgagagtctaccaacactgtcagattccgaccccgtgccacttgcccccggagcagctgactccgatgaagacacagaagggttcggagtaccacggcacgatccgcttcctgatcccctgaaggttcccccccctctgccagacccctcctccatttgtatggtggacccagagatgttgcctcccaagactgcgagacagacggaaaatgttagcagaaccaggaagcctctggcccgacccaactctcgggcagccgcaccaaaggctacgcccgtggcagcagctaaaacgaagggactggccggcggggaccgcgcatcccgccccttgagtgcacgctcagagccgtcagagaaaggaggaagggcccctctttcccgaaaaagcagtaccccaaagacggcaactcgcggccccagtggctcggcgtccagccgtccaggtgtctccgctaccccgccgaagtcacctgtctatttggatctcgcttatctcccttccgggagcagcgcacatcttgtcgatgaggaattctttcagcgtgtccgtgccctttgctacgtcattagcgggcaggatcagaggaaggaggaaggaatgcgagccgtcttggacgctctgttggccagcaaacaacactgggatagagacctccaagtcactctcattcctacattcgatagcgttgccatgcatacttggtacgctgagacgcacgccaggcatcaagctctcggaatcaccgtccttggaagtaattcaatggtgtccatgcaggacgacgcctttccagcatgtaaagtagaattttag

SEQ ID NO: 17968 - DNA, 2223 bp, Artificial Sequence
  Description of Artificial Sequence: Synthetic coding sequence
atgcgcgacctagagggttatcgggaaacccgctatcagctcttgcagctgaggcccgctcaacgtgcctcctggatcggatacgccattgcctaccacttattggaagattatgagatggcagccaagattcttgaggagttcaggaaaactcaacaaacctcaccagacaaagtcgattacgagtactcggaattactgctttatcaaaatcaggttctgcgggaggctggtctgtacagagaggcattagaacacttgtgtacatacgagaaacaaatctgcgataagttagctgttgaggagacaaaaggcgagttgctcttgcagttgtgtcgtcttgaagacgcagcggacgtttatcggggtcttcaggaaagaaaccctgagaattgggcctactacaaagggctggaaaaggcactgaaacccgccaatatgttggaacgactgaagatttatgaggaggcctggaccaagtacccccggggactggtgcccaggcggctgcccctgaattttctgtctggtgaaaagtttaaggagtgcctggacaagttcctaagaatgaactttagcaagggttgtcctcccgtgttcaataccctcaggtcactgtacaaggacaaagagaaggtagctattattgaagaactcgtcgtaggatatgaaacatctctcaagtcttgtaggctgttcaacccgaacgacgatggtaaagaggagcctcccaccactctgctgtgggttcaatactacctcgcgcagcactatgataaaatcggccagccttctattgctctggagtacatcaacacggctatcgaatccacacccactctgatcgaactcttcctggtgaaggcaaagatctacaagcacgccggcaacattaaagaggcggccagatggatggacgaggcacaggcactcgataccgccgatcgcttcattaattcaaagtgcgctaagtacatgctgaaggctaacctcattaaagaagccgaggagatgtgtagcaaatttacccgggaaggtacctcagctgttgagaatctcaatgagatgcaatgtatgtggtttcagactgagtgcgctcaagcatacaaggccatgaacaagtttggtgaggccctcaagaaatgtcatgagatcgagcggcatttcattgaaatcactgatgaccagtttgatttccacacttattgtatgcgaaagatcactctgagaagttacgtggacctgttgaaacttgaggatgtcttacgacagcaccctttttacttcaaggctgccaggattgcaatagaaatctacctaaaactgcatgataatcccctgacggatgaaaataaagagcacgaagctgatacagcaaatatgtcagacaaagagctcaaaaaactgcgaaacaagcagaggagagcccagaaaaaggcccagatcgaagaagaaaaaaaaaacgctgagaaagagaagcaacagcgcaaccaaaagaaaaagaaggatgacgatgacgaggagatcgggggtcctaaggaggaacttatccccgagaagctggccaaggttgaaactcccctggaagaagccatcaagttcctcacacccctgaaaaatctggtcaagaacaaaattgaaacacacctctttgctttcgagatatattttcgaaaagaaaagttcctgctgatgttgcagtccgttaaaagagccttcgcgattgattctagccatccatggcttcacgagtgtatgatcagactgttcaataccgctgtatgtgaatccaaggatctgtcggacaccgtgagaactgtgttaaagcaggagatgaatcgcctgttcggagcgaccaatcccaaaaattttaacgaaacgtttctgaaacggaacagcgactcacttccccataggctaagcgcagcgaaaatggtgtactacttagatccctcaagtcagaagagagcaattgagttggcgaccactctcgatgagtcgctgacaaaccggaacttgcagacgtgtatggaagtactggaagcgctctacgacggaagtttgggcgactgtaaggaagcagctgagatctaccgggcaaattgtcacaagctgtttccgtacgccttggcattcatgccgcctgggtacgaagaagacatgaagatcacagtgaatggggattcttccgccgaagccgaagagcttgcgaacgagatttag

SEQ ID NO: 17969 - DNA, 183 bp, Artificial Sequence
  Description of Artificial Sequence: Synthetic coding sequence
atgtcctgtactatcgaaaaggcattggctgacgctaaagcgcttgtcgaacgattgcgcgaccacgatgacgccgccgagtctctgattgaacagacgaccgcgctgaataaaagggtagaagccatgaaacagtaccaggaggagatccaggagctgaatgaggtggcccggcaccgatag

SEQ ID NO: 17970 - DNA, 1419 bp, Artificial Sequence
  Description of Artificial Sequence: Synthetic coding sequence
atggggaaagagcaggagctcttggaagcagcgcgtaccgggcacttgccagccgttgaaaagctcctgtccggaaaaagattgtcctctggctttggtggcggaggcggcggcggttcagggggcggcggcggcggttcagggggtgggggaggaggtctcggctccagctcgcatccattatcaagtcttctcagtatgtggcgcgggcccaacgttaactgcgtggatagtactggatacacccccctccaccatgcagccctgaacggacataaggatgtagtagaggtgcttctccggaacgatgccctgaccaacgtcgcagactcaaaggggtgctaccccttacatctggcggcctggaaaggggacgcccaaatcgtccggctgttgatccatcagggcccttcacatacgagggtaaatgagcagaataacgacaatgagacagctttacattgtgccgcccagtacggacatacagaggtagtcaaggtgttattggaagagctcacagatcctactatgcgcaacaacaaattcgagacgcctttggacctagcagccctgtatggaaggctggaggttgtgaagatgttactcaatgctcaccccaatctgctctcttgtaacaccaaaaagcacactccgctgcatctggcagctagaaacggacacaaggctgtagttcaggtcttgctcgatgcaggcatggatagcaattaccagaccgagatgggcagtgctctgcacgaagccgcactattcggaaagacagacgtggttcaaatcttgcttgctgccggaactgatgttaatatcaaagacaaccacggtctgactgccttggacaccgttcgggagctgcccagccagaagagccagcagattgccgcattgatagaagaccacatgaccggcaaacgctccaccaaggaggtggataaaacacccccgcctcagccacccctaatctcctccatggacagtatctcacagaagtcccagggagacgtcgagaaagctgtaacagagttaatcatagattttgatgctaatgcagaggaagaggggccgtatgaggctctttacaacgccataagttgccattcactcgacagtatggcctcagggcggtcaagtgaccaagactctacaaacaaggaggcagaagcggcaggcgtcaagcctgcaggggtacggcctagagaacgacctccaccccctgcgaaaccccctccagacgaggaggaagaggatcacatcgacaaaaagtactttcccctcacagcctcagaggttttgtccatgcgtccccggatccacggttccgcggcgagggaggaagatgaacacccttatgaactgttgctcacagccgaaacgaagaagaagaaaaaaaaaaagaagaagtag

SEQ ID NO: 17971 - DNA, 1392 bp, Artificial Sequence
  Description of Artificial Sequence: Synthetic coding sequence
atgagcggaggcacgccctatattggctctaagataagcctgatcagcaaggctgagatccgatatgaggggatcctgtatactatcgatacagagaattctaccgtggctctggcaaaggttcggagcttcggaacagaggaccgcccaacggacagaccaatcccgcctcgagacgaagtatttgagtacatcatctttagggggagcgatatcaaggacctgacagtgtgcgagcctcctaagccccaatgctctctcccgcaagaccctgcgattgtacagagttccctcggtagctccacgtcaagttttcaatccatgggctcctatggcccattcggacgtatgcccacttattcccaattctcaccttcgagtctggttggccagcagttcggggctgtaggagtggccggttcctcactaactagcttcgggaccgaaacgtccaacagtggcacgctgccacaatcttctgccgtgggttcagcattcacacaggacacaagatcgctcaaaactcagctgtcgcagggtcgtagctcgccacagcttgatcccctcagaaaaagccccactatggagcaggctgtacagaccgcatcagctcatctccctgctccagccgctgtgggccgtcggtctccagtatctactcggcctcttcccagtgcttcacagaaggctggcgagaaccaggagcataggcgcgccgaagtccacaaagtgtcccgacctgagaatgagcaactccggaacgacaacaagcgacaggttgccccaggagccccttccgcccctagaagaggtcgcgggggccacaggggtgggagaggtcgcttcggaataagacgcgatggacctatgaaattcgagaaagatttcgactttgaaagcgccaatgcgcagttcaataaggaagaaatcgaccgggagtttcacaataaactcaaactaaaggaggataagctagagaaacaggagaagccggtgaatggcgaagacaagggagattcgggcgttgacactcagaacagtgaaggcaacgcggatgaggaggaccccctagggccaaattgctattatgacaagaccaaaagtttctttgacaatatctcatgtgatgacaatcgggaaaggcggcctacctgggctgaagagcgtcgcctgaatgcggagacttttgggatcccattgcgcccgaacaggggtagaggaggttacagagggagggggggcctgggcttcagaggagggagaggtcggggcggcggaagaggagggaccttcactgccccaaggggattccgcggcggcttcagaggaggaaggggaggacgggagttcgccgatttcgagtatcgcaaggacaacaaggtggccgcctag

SEQ ID NO: 17972 - DNA, 1287 bp, Artificial Sequence
  Description of Artificial Sequence: Synthetic coding sequence
atgggtgggggggttggtgcctcaagtagtggcgggggaccaggggggagcggaggtggaggaagcggcggaccaggcgccggtacctctttccctccgcctggtgtcaaactggggcgcgatagtggaaaggttacaacagttgtcgccactctcgggcagggcccagaacgctcccaggaggtcgcctacactgatattaaggtcatcggaaacgggagctttggcgttgtgtaccaggcgcgcctggccgaaacccgcgaattggtagccattaagaaagtgctgcaggataagcgtttcaagaaccgagagctgcagatcatgcgcaaactcgaccactgtaacattgtgcgcctccggtacttcttttactcttcaggtgaaaaaaaggatgagctttacctgaatcttgtccttgaatatgtacctgaaactgtctaccgagtggcgaggcatttcactaaggctaaactcactattcccatcttgtatgtcaaggtctatatgtaccagctgttcaggagcctggcgtatattcacagtcagggcgtctgccaccgcgacatcaagccacagaacttactcgtagacccagacaccgccgtcctcaaactgtgtgattttggcagtgctaagcagctagtgagaggtgagcccaacgtttcgtatatatgttctcggtattaccgggctcctgaattgatttttggggccactgactacacaagttctattgatgtgtggtctgcgggttgcgtgctggccgaactcctgctaggtcagcccatcttccctggagactccggggtggaccagttggtggagattatcaaggtgttgggaactccaacccgggagcagattagggagatgaacccaaattacacagagttcaaattccctcagattaaggcacacccctggacgaaggtctttaaatctagaacaccgcctgaggctatagcactttgtagtagtctcctagagtataccccttcttcacgcttgtcccccctggaagcctgcgcccacagctttttcgacgagctcaggtgtttagggacacagctgcccaataatagaccattgcctccccttttcaacttcagtgccggagagttatcaatacagcctagtttgaacgccattctgatcccaccacacctccgatccccagccggcactaccacgctgacaccctcttcccaggcactgaccgagactcccacgtcatccgactggcaaagcacagatgctaccccaacactgaccaatagcagctag

SEQ ID NO: 17973 - DNA, 657 bp, Artificial Sequence
  Description of Artificial Sequence: Synthetic coding sequence
atggatgccgaacatccagaacttcgctcctatgcacagagtcagggatggtggaccggcgagggcgaatttaactttagcgaagtgttcagtcccgtggaagatcacttggattgtggtgccggcaaagactctttggagaagcaggaggagtccatcaccgtgcaaacgatgatgaatactttaagggacaaagctagtggggtatgtatcgactccgaattcttccttactactgcctctggagtctctgtgcttccacagaacagatcgagcccatgcatccattacttcaccgggactccggacccctcccgatctatcttcaagccttttatctttgtcgacgacgtcaagctggtccccaagacacagtccccatgcttcggggatgacgaccctgccaaaaaggagccaaggtttcaggaaaaacctgatcggaggcatgagctctataaagcccacgagtgggctagggcgattattgagtctgaccaggagcaaggacgcaaacttagatctacaatgctagaattggaaaagcagggcctggaggccatggaggaaatcctgacgtcctcagagcctctcgatcctgctgaggtaggagacttattctacgactgtgtggacaccgagattaagttctttaagtag

SEQ ID NO: 17974 - DNA, 573 bp, Artificial Sequence
  Description of Artificial Sequence: Synthetic coding sequence
atggccctcctggctgagcacctgctgaagcctttgcccgccgacaagcagattgagacgggccctttcctggaagcggtgtcccacctgcctcctttcttcgactgcctgggaagcccagtgttcaccccaattaaggctgatatctctggcaatatcaccaaaattaaagccgtgtatgatactaacccagcaaaattccggactcttcagaatatcttagaggtggaaaaggagattggtttacgattcatccaagtctttctgcagagtatctgcgacggggagcgagacgaaaaccatcccaacctcatcagagtgaatgccactaaagcttacgaaatggcactcaaaaagtaccacgggtggatcgttcaaaagatttttcaagctgcactgtatgctgctccttacaagtctgactttcttaaggcactgagcaagggtcagaacgtcaccgaagaagaatgccttgaaaaaataagactgttcttggtgaattatacagcaaccattgatgtaatctatgagatgtacacacagatgaatgctgaactgaattacaaagtctag

SEQ ID NO: 17975 - DNA, 762 bp, Artificial Sequence
  Description of Artificial Sequence: Synthetic coding sequence
atgtccatctgcagtagcctggcacggaaatttccaaagcttaccataattggcgaagaggatcttcccagtgaagaagtcgaccaggaactcatcgaggatagccaatgggaagaaatactcaagcaaccttgtccatcacagtattctgccattaaggaagaagacctggtggtctgggtggatcccctcgacggaaccaaggaatacaccgagggcttgcttgacaacgtcacggtgttgattggcatcgcgtacgaaggtaaggctatcgcaggtgtcatcaaccagccatactacaactacgaggcgggccccgatgccgtgctagggagaactatttggggcgtgctgggcttgggggccttcgggtttcagctgaaagaagtgcccgccggcaaacacataataactactacacgcagtcattccaacaaactggtgaccgattgtgtggccgctatgaaccccgatgctgtgctccgcgtggggggcgcagggaataagatcattcagctgatcgagggaaaagcaagtgcttacgtgtttgcgagtccaggctgcaagaaatgggatacatgcgcacccgaggtgatcctacacgcagtcggggggaagttgaccgatatacacggaaacgtgctgcagtatcataaggacgtcaagcacatgaattcagctggtgtcctcgccacattgcgtaattacgactattacgcgtctcgggtgcccgaatccatcaagaacgcccttgtcccgtag

SEQ ID NO: 17976 - DNA, 1590 bp, Artificial Sequence
  Description of Artificial Sequence: Synthetic coding sequence
atgggcgcctacttgtcccagcctaacactgtgaaatgttctggcgatggcgtgggcgttagcatggaagatgctcacaactgcatccccgagctggactctgagacagcgatgttctccgtgtacgacggccacggtggagaagaagtggcactctactgcgctaaatatctcccagacatcattaaagaccaaaaggcctacaaggagggtaagcttcagaaagctttggaggatgccttccttgcaattgacgccaaactgaccaccgaagaagttatcaaagagcttgcccagatcgcaggtagacctaccgaggacgaggacgagaaggagaaggttgcagacgaggatgatgtcgacaatgaagaggcagccctgctccacgaggaagctacaatgaccatcgaggagttgctgactcggtacggccagaattgccataaagggcctcctcactccaagtcaggggggggaactggcgaagagcctgggagccagggcctgaacggggaggcaggacccgaagactcaacacgtgagaccccatctcaggaaaatggcccaacagcaaaggcatataccggattttccagcaatagcgagcgggggacagaggcgggccaggtgggggaacctgggataccaaccggggaggctggccccagttgctccagcgctagtgacaagctaccccgtgtcgctaaatccaagttctttgaggacagcgaagacgagtcagatgaggccgaggaagaggaagaggactcagaggagtgttctgaggaggaggacgggtactcttcagaagaggcggaaaatgaggaagacgaagacgacaccgaggaagctgaggaggatgacgaagaggaagaagaagagatgatggtacctggcatggagggcaaggaggagccaggatccgacagcggtaccaccgccgtggtggccctcattcgggggaagcagcttattgtagccaacgccggagactctagatgcgtggtgagcgaggcagggaaggcattagatatgtcttatgatcataagcccgaagacgaggtagagctcgccaggataaaaaatgccgggggaaaggttactatggatggcagagtgaacggtggcctaaacctgtcgagggccatcggggaccacttttacaagcgaaataagaatctgccaccggaggagcagatgatcagcgccttgccggacatcaaagtgctgactctgacggatgaccacgaatttatggttattgcttgtgacgggatatggaatgtgatgtcctcacaggaggtggtggactttattcagagcaagatctctcaacgggacgaaaacggcgagcttcgactgctgtccagcatcgtggaggaacttctggaccagtgcctggcacccgatacatctggagacggcaccggatgtgataatatgacttgcatcattatctgcttcaaaccccgcaacaccgcggagttgcagccagaaagtgggaagcgcaaacttgaagaagtgctgtccaccgaaggggccgaggaaaacgggaactctgataagaaaaagaaagctaagcgggattag

SEQ ID NO: 17977 - DNA, 1293 bp, Artificial Sequence
  Description of Artificial Sequence: Synthetic coding sequence
atgacttttgagctatatgatgagtggatccaggcaagtaacgtccaagaacaagacaagaagctgcaggccctgtggaatgcctgcgaaaagctcccaaaggctaaccataataacattcgttacctcatcaagttcctgagcaaattaagcgaataccaggacgtcaacaagatgacccctagcaatatggcaattgtgctaggacccaacctgctctggcctcaggccgaaggtaacatcaccgagatgatgaccactgtctctctgcagatcgtgggaattatcgagccaattatccagcatgcggactggtttttccccggagagattgaatttaacatcacaggcaactacggctctcccgtccatgtaaaccacaacgctaactattcttccatgccaagtcccgatatggaccccgcagataggcggcagccagagcaagcccggcgacctctgagcgtcgcgactgataatatgatgctggagttctacaaaaaagacggtatgggcgtgcgcgtgatggatacaaattgggttgcccgacggggaagcagcgctgggcgaaaggtgtcctgcgctcctccgtcaatgcagcccccagcaccacccgccgagctggcagcaccactaccctcgccgctgcccgagcagccactggacagtccggcagcccccgccctgtcaccctcggggctgggcctccagccagggcctgagcgcacctccacaacaaagagcaaggagctctctcctggtagtgcacagaagggaagccccgggtctagccagggtacggcatgtgctggaacacagccgggggcccagcctggggcccagcccggcgcctccccctcgccatcacagcctcccgccgaccagagcccccacacactacgaaaagtgtccaaaaaactggcccctataccaccaaaggtaccctttggccagcccggcgccatggcagatcagtccgccggtcagccctctcctgtgtctctgtccccgactccaccatccactcccagcccctatggcctttcatacccacaaggctactcactcgccagcgggcagctgtcaccagcagccgccccacccttggcttcaccaagtgtgtttacatctacgctctcgaaatcacgccccactcccaaacctcgccaaaggcccactctgcctccgcctcagccgcccacggtcaacctgtcggccagttctccacaaagtacagaagccccaatgctcgacgggatgtctcccggggaatctatgtctactgctgtttag

SEQ ID NO: 17978 - DNA, 846 bp, Artificial Sequence
  Description of Artificial Sequence: Synthetic coding sequence
atgcccggaccaaggaggctgaggtcacccggggggagcggatgcagtagccgtgggtccggccctcgcctgagcacacgacggtggcggccatgctgctactgtggcgggagtggagtctggcttcttcgcactccacccagccctagcgcctggccagccaggcggtgcccaagacatcgcttcgagttttgcgaacctgcattcgtggtgggcaactgcttacaaatagcttccgacagtcaccagtatgatcgtatttactgcggggccggcgtgcagaaagaccacgaaaattacatgaagatacttttaaaggtgggcggcatcctagtgatgcctattgaggaccagcttacacaaatcatgcgcaccggtcagaacacgtgggaatccaagaacatcttggccgtatccttcgctcctctggtgcagccgtctaagaatgataatggtaaaccagactccgtggggctgcctccctgtgcagtccgtaacctccaagacctcgcgcggatatacatccgacggaccctcagaaatttcattaacgatgagatgcaagctaaggggattcctcaaagggctccgccaaagcgcaagaggaagcgagtcaagcagaggataaatacctacgtgtttgtgggtaaccaactgatccctcagccgctcgatagcgaggaggatgagaaaatggaggaggacaacaaagaggaggaggaaaaagatcacaacgaggctatgaagcctgaggaacccccgcagaatttactgagggagaaaataatgaaattacccctgccagagtccctgaaagcctatctgacttactttcgagataaatag

SEQ ID NO: 17979 - DNA, 1251 bp, Artificial Sequence
  Description of Artificial Sequence: Synthetic coding sequence
atgtctccggcaatgctgtcggtgctggtaaagatgatgctcgcccaggcccaggagtcagtgttcgagaaaatttcacttccaggaatccggaacgagttttttatgctcgtgaaggtagctcaggaagcagcaaaggtgggcgaggtctaccaacagctgcacgccgcaatgtcccaggcgccagttaaagagaacattccatattcatgggcgagtcttgcctgcgtaaaagctcatcattacgctgccttggcgcactattttactgctattctcctgatcgaccaccaggtcaaaccaggcacagacctcgatcaccaggagaagtgcctcagccagctgtatgaccatatgcccgaaggccttacacctctggcaaccctgaagaatgaccagcagagacggcagttgggaaaaagccatttgcgccgggctatggcgcaccacgaagagtcagttagggaagcatcactttgcaagaagctccgttcaattgaggtcctgcaaaaagtgctctgcgcagcacaggaacgttcccgcctcacttacgctcagcaccaggaagaagacgatctcttgaatctgatcgacgccccctctgtcgtggctaaaactgaacaggaagtggatattattttgccccagttttctaagttgacagtgactgattttttccaaaagctcggccccttatccgtcttttccgccaataaaagatggacacctccacgcagcattaggtttactgctgaggaaggagacttaggattcactctccgtggtaatgcccctgttcaggttcacttccttgatccctactgtagcgcctcagtcgctggtgcacgagaaggcgattatattgtatctatccagttggttgactgtaagtggttgactctgtccgaagtgatgaagctgctgaagtcctttggcgaagatgaaattgagatgaaggtcgtcagcctgttggactctactagctctatgcataataaatctgccacatacagtgtggggatgcagaagacttactccatgatttgcctcgccattgacgatgatgataaaactgacaagaccaaaaaaatatccaagaagctttcattcctctcatggggcaccaacaagaacaggcaaaagagcgccagtacactgtgcctccctagtgttggagcagcaagaccgcaggtgaaaaaaaagttgcctagcccattttccctccttaactcagactcctcgtggtactag

SEQ ID NO: 17980 - DNA, 6201 bp, Artificial Sequence
  Description of Artificial Sequence: Synthetic coding sequence
atgtgcagcacaccaggcatgccagcccctggggcctctctcgctctaagggtgtccttcgtcgatgtgcacccagatgtgattccagtccaattatgggggctggtgggagaaaggcggggcgaatacctccgcttgtcccgcgagatccaggaagcagcagccactagggggcaatgggctctgggatctgcctcagcatcccctggcgaactatgtctggtgcaggtaggtctcctttggcataggtgcagagtcgtgtctcgccaagcccaagagagcagagttttccttctggatgagggtcggaccataacagcaggagcgggcagtctggcccccggccgcagagagtttttcaacctcccttcggaagtgttgggctgcgtgctggctggcctggtgcctgccgggtgcggtgccggttccggcgaacccccgcagcactggccagcggacgccgttgacttcctctccaacttgcagggaaaagaggtgcatgggtgtgtgctggacgtcctattgctgcaccgcttagtgctcctggaggtaccagatgtttttcagcagatgagagagctcggacttgcaagacgggtgcctgattccctttttaggtcgctgctggagcggtacttgaccgctgctacagcctctgtgggtagcggggtccccgtcctctctagagtcccactgaaacagaaacagcctggacttgattatttttaccctcagctacagcttggggtgactgaagccgtggtaattacccaggtgtgccaccctcaccgcattcactgccagctgaggtccgtctcccaagagatccacagactgagcgaaagcatggctcaggtgtaccgaggcagcactggcactggggacgagaatagtacgagcgccacttgggaggagcgtgaggagagtcccgacaaacctgggtccccttgtgctagctgcggcctcgatggacactggtatcgtgctctgctgctggaaacgttccgtccccagagatgtgctcaagtgctgcatgtcgactacggtcggaaagaactcgtctcatgctcttcattacgatatctactgcccgagtactttaggatgcccgtcgttacgtacccgtgcgctctgtatggcttgtgggacgggggccgagggtggtctaggtcccaagtgggagatcttaaaactctgatactgggcaaggcagtaaatgcaaaaatcgagttttattgttcatttgaacacgtctactatgtcagtctgtacggtgaggacggcattaacctgaatagagtattcggcgtccaatcctgctgcctggctgaccgagtgttacagagtcaggccacagaggaagaggagccggaaacttcccagagccagtccccagctgaagaagtagatgaggaaatttccctgcccgctttgcgctccatacgccttaagatgaatgcattctacgatgcgcaagtggagtttgtaaaaaatccatccgaattctggatccggctgagaaagcataacgttactttctccaaactcatgcgtcgaatgtgcggtttttatagcagtgccagcaagctggatggggttgttttgaaacccgagccggatgacctgtgctgtgtgaagtggaaagagaacggatactaccgcgccatcgtaacgaaactggatgataagtctgtggacgtctttcttgtggatcgtggcaattcagagaatgttgactggtacgacgtgaggatgttgctcccccagttccggcaactgccgatcctggctgtgaagtgcactcttgcagatatctggccactggggaaaacttggtcgcaagaggccgtgtcattttttaagaagacagtgcttcacaaagaactcgttattcatatactggacaaacaggatcaccagtacgttatagagatcttggacgagtcacgcacaggcgaggaaaatatttctaaggtgattgctcaggcaggttatgctaaataccaggaattcgagacaaaagaaaacatcttggtgaacgcccattccccagggcacgtgagtaatcacttcaccaccgagagcaacaagattccattcgccaagacaggggaaggagagcagaaagccaaacgggagaataagaccacctcagtgagtaaggcgctttctgacacaaccgttgtgacaaacggcagtactgaactggtggtccaggagaaagtgaaacgggcgagtgtgtatttcccattgatgcagaattgtttggaaataaaacctggctccagcagcaagggagaactggaggtggggtcgacagtggaagtcagagtgagctacgtagagaacccggggtacttttggtgccagctgacaagaaacatacagggactgaaaaccctgatgtcagatatccagtactattgtaagaatacagctgcccctcaccagcgcaacaccctggcatgtctagccaaacgcacagtcaaccggcagtggagcagggccctcatcagtggcattcagagcgtggaacacgtaaacgttaccttcgtagattacggggaccgggagatggtctccgtaaagaacatctactctatctctgaagagtttctgaaggtaaaggcgcaggcctttagatgctctctctacaatctgatacagccagtgggtcaaaatccttttgtctgggatgtgaaagctattcaggccttcaatgaatttatcgacaacgcgtggcaaaagaatctggaacttaagtgtacaatttttgcactggcctctattaacgaagaactgttcaatatcgtggatctgctgactccgtttcagtctgcgtgccactttttggtagagaagcgcctcgccaggcccgtgaagctccagaagcccctcgagtcctccgtgcagctgcacagttatttctactcaacccacgacatgaaaatcgggtctgaggaacttgtctatattactcacattgacgacccctggacgttttattgccagctggccaggaatgcaaatatcctggagcaacttagctgctctataactcagctgtccaaggtattgctaaacctgaaaacgtcccccttgaaccccggcacactgtgcctcgcaaaatataccgatggcaactggtatcgcgggatcgtgatcgaaaaggaacctaagaaggttttctttgtggactttggaaacatatatgtggtcacaagtgatgaccttctgcctatcccaagcgatgcgtatgacgttctgctgttgcctatgcaggcagtaaggtgttctttgtctgacattcccgatcatatacccgaagaggtggtggtgtggttccaggaaacgatcttggacaagagtctgaaggctctggtggtcgcaaaagatcctgatggtactctcataatcgaattgtacggagacaacatccagatttccgcttcaataaataagaaactgggcctgctgagctataaggatcgtatccgaaagaaagaaagcgaagtgttgtgtagcactaccgaaacactggaggagaagaacgagaatatgaaactgccttgcaccgagtatctgagcaaaagtgtcggctataagctacctaataaggaaattcttgaggaaagttataagcctcagataaatagctcctacaaagaattgaagctgctacagagcctgaccaagacaaatctggtcacccagtaccaagattccgttggcaacaagaattcccaagtttttcctctgaccactgagaagaaagaggagataagtgccgagacacccttaaaaaccgcacgtgttgaggcaactctatctgagcgcaagattggcgacagctgtgacaaagatcttcctcttaagttttgtgagttcccacagaagactatcatgcctggatttaaaactaccgtctacgtttcacatattaacgacctctctgatttctacgtgcagctaatagaggacgaggctgaaatttcccatttatctgagaggcttaacagtgtgaaaacacggcctgaatattatgtgggccccccccttcagcgcggcgatatgatctgcgcagtgttccctgaagataacctgtggtatcgcgccgttatcaaagaacagcagcccaacgacttgctatccgtgcagtttatcgattacggaaatgtcagcgtggtccatacaaacaagatagggagactggacttggtcaacgctatcttaccaggcctatgcattcactgcagtctccagggctttgaggtgcccgacaataaaaatagcaagaaaatgatgcactattttagtcagagaaccagtgaagctgccatcagatgcgagtttgtaaaattccaagataggtgggaggtgatcctggctgacgagcatgggatcatcgcagacgatatgatttcacgctacgcacttagcgaaaagtcacaagttgagctgtcaacacaggtgatcaaaagcgcttcatcaaaaagcgtgaataagtctgatattgatacttctgtttttctcaattggtataaccctgagaaaaaaatgataagggcctacgccacagtcattgatggacccgaatatttctggtgtcagttcgcagataccgagaagctgcaatgcctggaagttgaggtgcagacagctggggaacaggttgccgataggcgtaattgtatcccttgtccatatataggcgatccctgcattgtgcgctaccgggaggatggacactattaccgagctctgattactaatatctgtgaagattacctggtatctgtcaggctggtggattttgggaacatcgaagattgtgtcgaccccaaggctctctgggcaatcccctccgagttgctgagcgtgccaatgcaagcatttccttgttgtctgtcgggatttaacatttcggaagggctgtgttctcaggagggtaatgactatttctacgaaatcattacggaggacgtcttagagatcactatcctggaaatccggcgcgatgtatgcgatattcctctcgccattgtggatttgaaatctaaaggaaagagcatcaatgaaaaaatggagaaatattctaagacaggcataaaaagcgccctaccgtacgagaatatagattccgagattaagcagaccctggggagttataacttggacgtgggtctgaagaaattgtccaataaagcagttcagaacaagatctatatggaacaacagacagatgagctcgctgagatcacagaaaaagacgttaacatcattgggactaagccttccaattttcgggaccccaagaccgataacatctgcgagggcttcgagaacccatgcaaagacaaaattgatacagaggagctcgaaggggagttggagtgccatctagtcgacaaggcggagtttgacgataagtacctgatcaccggtttcaacaccctgctgcctcatgctaacgagacaaaggagatccttgagttgaattctctcgaggttccactctccccagacgatgaaagtaaagagttcttggaattggaatctattgagcttcagaattccttagttgtcgacgaagaaaagggggaactcagtcccgtccccccaaacgtccctctcagccaggaatgtgttaccaagggagctatggaattgtttactctgcagttgccattgtcctgtgaggccgaaaaacaacctgagcttgagctgccaaccgcccaactgcccctcgacgacaagatggatccactgtcactcggtgtgagccaaaaagctcaagaaagtatgtgcacagaagacatgcggaaaagcagctgtgttgagtcctttgacgatcagcggcggatgtcgttacatttgcatggggctgactgtgatcctaaaacccagaacgagatgaacatctgtgaggaagagttcgtggagtataagaatagagatgccatcagcgccttaatgccgcttttttcagaggaagagagtagcgatggttctaaacacaataatggtctccccgaccacatctcagcacagttgcagaacacatatactctgaaggctttcaccgtcggatcaaagtgcgtggtatggtcctccctgaggaatacttggagcaaatgtgaaatcctggagacagccgaagaaggaactcgcaagcgagggctcgaggtcatggaaatctag

SEQ ID NO: 17981 - DNA, 264 bp, Artificial Sequence
  Description of Artificial Sequence: Synthetic coding sequence
atgtcctcttgtgtgagtagccaaccctccagcaatagagccgcgcctcaagacgaattgggcgggaggggcagttcgagtagcgagtctcagaagccttgtgaagccctaagaggactgtccagtctttcaatccacctggggatggaatcctttattgttgttacagaatgtgaacctggatgtgcggtggatctgggcctggcacgcgataggcctcttgaggccgatggacaggaggtacctctggacacgtcggggtag

SEQ ID NO: 17982 - DNA, 2469 bp, Artificial Sequence
  Description of Artificial Sequence: Synthetic coding sequence
atggccgccgagggagatccagagtgggggcccactccaccgtccacatccgccacgactgcggctcgccgagctgtcaacaaggttgtgtacgacgatcacgaatccgaggaggaggaggaagaagaggacatggtctctgaggaggaagaggaagaagatggcgacgcggaggaaactcaggactccgaagacgatgaggaggatgagatggaagaggatgacgacgactcagactatccagaagagatggaggatgatgatgatgacgcttcttattgcacagagtccagcttcaggtcccatagtacatacagctccacccctggccgcaggaaacctcgagtccaccgacctcgatcaccaatcctggaggaaaaggacattccgccccttgaatttcccaagtcgagtgaggatctcatggttcctaacgagcatatcatgaatgtgatcgcgatatatgaagttttgaggaatttcggcactgtgctcaggctttcgccctttagatttgaagacttctgtgcagccctggtttctcaggagcagtgcactctgatggcagagatgcatgtagtcttgctcaaggccgtgctgcgggaagaagacacttctaatactacatttggccctgcagacttaaaggatagcgtcaattccactctctacttcattgacggcatgacctggcccgaggtgctaagggtgtactgtgaaagtgacaaagagtatcatcatgtcctgccataccaggaggccgaggattatccttacggacctgtcgaaaataagattaaagtcctgcaattcctcgtggaccagttcttgacaaccaatatcgctcgggaggaacttatgtccgagggggtcatccagtatgatgaccattgtcgagtgtgccacaagttaggagatctgctgtgttgtgaaacttgttctgcggtgtatcatctggaatgtgtaaaaccgcccttagaggaggtccctgaggatgaatggcagtgcgaggtctgtgtcgctcacaaggttcctggagtgacagactgtgtcgctgaaattcagaaaaataagccttatatcaggcatgaacctattggatacgatcgtagtagacggaaatactggtttctcaatagaagactaatcatcgaggaagacaccgagaacgaaaacgagaagaagatatggtactactccacgaaagttcagttggcggagttgatagactgcctggacaaggactattgggaagctgagctgtgcaagatcttggaggagatgagggaagagattcaccgacacatggatatcacggaggacctaacaaacaaggcaaggggctctaataaatcttttctggccgctgccaatgaagaaatactcgagagtatccgcgccaaaaagggtgacatagacaatgtcaagagtccggaagagactgaaaaggacaagaatgagactgaaaatgacagcaaagacgccgagaagaatcgggaagagttcgaggaccagagtctcgaaaaagatagcgacgacaagacgcccgacgacgatcctgaacagggcaaaagtgaggagccaactgaagtaggcgacaaaggtaactctgtgagtgccaatctaggggacaacacaacaaacgctaccagcgaagaaacctccccctctgaggggcgctccccagtgggatgtctttctgagactccagactctagtaatatggcagaaaaaaaggtagcttctgagctgccccaggacgtgcctgaggagccaaacaagacctgcgagtcatcgaacacaagtgccacgacgacatcaattcaacccaatctggaaaatagtaacagttcctccgaacttaatagcagccaatccgaatccgcaaaagcggccgatgatcccgagaacggtgaaagggaatctcacactccagtttccatccaggaagagatagttggggacttcaaaagcgagaagagtaatggcgagctaagcgagtctcctggcgcgggaaagggagcctctggtagtacccgtattatcacccgccttagaaaccctgattccaaactgtcacagttaaaatcacaacaggtggctgccgcagctcacgaggccaacaaactgttcaaagagggaaaggaggtccttgtcgttaattcacaaggcgagatcagccgcctgagcacgaagaaagaggtcatcatgaaaggaaacatcaacaactacttcaagctggggcaggagggtaagtatcgagtgtaccataatcagtactctactaatagcttcgccctgaataaacaccagcatcgagaggaccatgacaaacggaggcatctggcacataagttttgcctgaccccggctggagagtttaagtggaacggctccgtacatggctctaaagtgttaaccatttccaccttaaggcttacaataacacagtatggggagaatctttag

SEQ ID NO: 17983 - DNA, 552 bp, Artificial Sequence
  Description of Artificial Sequence: Synthetic coding sequence
atgctgcagcaaacttggacgtcgcgatgcttgatgaagttctacgccgtcgtggcgacctccccagcttcatgggaaagccataagattgcggaacgcattgagcaacgaatactaaacagtaatccagtgatggaggcattcggcaacgcctgtacattgaggaacaataattcttctcgttttggcaaattcattcaattacagctcaatcgtgcacaacagatgaccggcgccgcagtccagacatatttgcttgagaaaacaagggtcgcctgtcaagcgtcatcagagaggaattttcatatattctaccaaatctgtaaaggcgcgagcgaagacgaacgccttcagtggcacctgccagaaggagccgctttttcctggctcccaaatcccgaacggtccctggaggaggactgctttgaggtgacaagggaagcaatgcttcatctggggatcgacactcccactcagaacaacattttcaaggtgcgccggaaggccactccgctgaagttcggaagagatgacggtcaaccttttgcatag

SEQ ID NO: 17984 - DNA, 744 bp, Artificial Sequence
  Description of Artificial Sequence: Synthetic coding sequence
atgctgaaattccttgtctggtttcttcagtggtgcgtttgcgtgttggtgcagccggccaaggaactcctgcactgcctaaaaatgcagatgaggattagtaagtacacaaaatgcttgcaggctcagattgcaatcacggtaccaaagacctggaaaaaaccaaaggaccggacacgtaccacagaagaaatgctagaagccgaactcgaactgaaggcggaagaggaactgagtattgataaagtgcttgagtctgagcaagataagatgagccagggtttccatcccgagcgcgaccctagcgaccttaaaaaggtgaaagcagtcgaagagaatggagaggaagccgaacctgtcagaaacggggccgaaagtgtcagcgagggcgagggtattgacgccaacagtggcagtacggacagctctggcgatggggtcacatttccatttaagccagagtcttggaagccaacggatactgagggcaagaaacagtacgaccgcgagtttcttctggatttccagttcatgcccgcctgcatccagaaacccgagggcctcccccccatctccgatgtggtgttagacaagattaaccaacccaagttgcccatgaggaccttagaccccagaatcctgcctaggggccctgatttcactcccgcctttgcggacttcggtcggcagaccccagggggcagaggtgtgcccgttagcgccagttccttgcagctgacctag

SEQ ID NO: 17985 - DNA, 981 bp, Artificial Sequence
  Description of Artificial Sequence: Synthetic coding sequence
atgctggggggcgtgggtgaagagaatgaaaagctgtggtcattcaccaaaaaagcttctcacatccaattagacagtctcccagaggtccctctgctggtggatgtgccgtgcttgtcagcacagctggatgacagcatcctcaatattgttaaggaccatatcttcaagcatggtaccgtggctagccggcctccagtgcagatcgaggagcttatcgagaagccgggcggtatcatcgtgcgatggtgtaaggtggatgacgactttacagcccaggactacaggttacagtttaggaagtgcaccagcaatcatttcgaggacgtctacgtgggatccgagacagagttcattgtcctccatatcgatcctaacgtggattaccagttccgagtctgcgctcgcggtgatggccgccaagagtggagcccatggtccgtgccacaaatcggccattcaaccctggttcctcacgaatggacggctggcttcgagggctattcactgtcatcacgcagaaatatcgccttgcggaacgactctgagagcagtggtgtcttgtactctcgtgcacccacctacttttgcggccagacgctcaccttcagagttgagacagtcgggcagcctgaccgccgcgacagtatcggcgtgtgcgctgaaaaacaggacggctatgactctctgcagagagatcaggccgtgtgcatcagtacaaacggtgccgtgtttgtgaacgggaaggagatgaccaaccagctgccagcagttactagcggttccactgtcacatttgacatcgaagctgtaaccctcgggaccactagtaataatgaaggagggcactttaaacttagggtgactattagcagtaacaacagagaagtcgtttttgattggctgctggaccagtcttgtgggagcctgtacttcggctgctccttcttctaccccggctggaaggtgcttgtgttttag

SEQ ID NO: 17986 - DNA, 2436 bp, Artificial Sequence
  Description of Artificial Sequence: Synthetic coding sequence
atggtatctgaggaagaggaagaggaagacggcgacgctgaggagacccaggatagcgaggatgatgaggaagacgaaatggaggaagacgacgatgacagtgactaccctgaggaaatggaggatgacgacgatgatgcctcatactgtaccgagtctagtttccggtcccacagcacctactcgtctacccctggccgaagaaagccccgcgtgcatagacctcggtcacccattttggaggaaaaggacatccccccccttgaatttccaaagagcagtgaggacctcatggtgcccaacgagcatatcatgaatgtgattgctatttacgaggtcctcagaaactttggaaccgtgctgcggctgagccctttccgcttcgaggacttttgcgccgcgcttgtttctcaggaacagtgtacattaatggctgagatgcatgtggtgcttctgaaagccgtgctccgggaggaggatacatccaatactacctttgggcccgcggacctcaaggatagtgtgaactctactctgtattttatcgatggcatgacatggcctgaagtactgcgagtgtattgcgaaagtgataaggagtatcaccatgtcctgccctaccaggaggccgaggattatccctacggacctgtggagaataaaattaaggtgttacagttcttggtggaccagttccttacaaccaatatcgccagggaggagctgatgagtgagggtgtgattcagtatgatgatcattgcagggtctgccacaagttaggtgacctcctgtgttgtgagacttgctctgcagtttaccacttagagtgtgtgaaaccccctcttgaagaagttccagaagatgagtggcagtgcgaagtctgtgtggcgcataaggtccctggcgtaactgattgcgtcgctgagatacagaaaaataagccatacatccggcacgagcctataggttacgaccgcagtcgtcgtaagtattggttcctcaaccgcagactgataatcgaagaggataccgaaaacgagaatgagaagaagatttggtactactccacaaaggtgcagctggccgaactaatcgattgcctggataaggactactgggaggccgaactgtgtaaaatacttgaagaaatgcgtgaggaaatccatcgtcatatggatataacggaagacctgacaaataaagcgaggggttcaaataagagcttccttgccgccgccaatgaggaaatcctggaatctattcgcgccaagaagggtgacatcgacaatgttaagtcccctgaggaaacagaaaaagataagaacgaaaccgagaacgactctaaagacgctgagaaaaatcgggaggaattcgaggatcaatctttagagaaagacagcgacgataagacacccgacgacgaccctgagcagggcaagagtgaggagcctaccgaggttggcgacaaggggaactctgtatctgccaacctgggcgataatacaaccaatgcaacaagcgaggagactagcccctccgaagggcggtccccagtgggttgtctgtcggaaactcctgattcatcaaatatggctgaaaagaaggtagcctccgagcttcctcaggacgtgcccgtgggggatttcaagagcgagaagtccaatggggaactgtcagaatcgccaggtgcaggaaaaggggctagcgggtccacgcgtatcatcacccgactgaggaatccggattcaaaactctcccaactcaagtctcagcaggtcgctgcagccgctcatgaggccaacaagctgttcaaagaaggaaaggaggtcctcgtggtgaactcccagggtgaaataagtcgcctgtcaaccaaaaaggaggttatcatgaaaggcaatatcaacaattattttaagctcggtcaagagggcaaataccgggtctatcacaatcagtacagcactaactccttcgccctgaacaagcaccagcacagggaggaccatgataagagacgacacctggctcacaagttttgtttgactcccgctggggagttcaagtggaatggttccgtgcacggctctaaagtgctgacgatatcaaccttgaggctcactattacacagctagagaataatattcccagtagtttcttacacccgaattgggcatcccaccgggcaaactggattaaggccgtgcagatgtgtagtaaaccgagggagtttgccttagccctcgccatcctggaatgcgcagtgaagcccgtcgtgatgctgcccatatggcgcgagtcactcggccatacgcgcttgcaccgtatgaccagtatcgaacgtgaggaaaaggagaaagtgaagaaaagggaagagacgggccggcgccgcaatgatgccgcttcagacatgggcaagattcacatttccagctag

SEQ ID NO: 17987 - DNA, 1752 bp, Artificial Sequence
  Description of Artificial Sequence: Synthetic coding sequence
atggcacccgaattgacccccgaagaagagcaggccaccaaacagtttctcgaggagattaacaagtggactgtacagtacaacgtctcccctctgagttggaacgtggccgtgaaattcttaatggctcgcaaatttgatgtgctgcgggctatagagctgttccacagctatcgggagactaggcgcaaggaggggatcgttaagctgaaacctcatgaagagcctctgcgcagcgaaatcctcagtggtaaatttacaattctgaacgtaagagatccaacaggggcgagcatcgcattgtttaccgcccggttgcaccaccctcacaagtcagttcagcatgtggtactccaggccctattttacctgctcgaccgcgccgtggactcattcgagacccagcgcaacggacttgtgtttatttatgacatgtgcggttcaaattacgcgaatttcgaactggacttaggaaaaaaagtactcaacctcctgaaaggggcttttcccgcgaggttgaaaaaggtactcatagtcggagcgcccatttggttccgagtgccctactccatcatctccctgctgctgaaggataaagtgagggaacgtatccagatacttaaaactagtgaagttactcagcacctgccacgggagtgcctgccggagaatttggggggctatgtgaagatcgacctggccacctggaactttcagttcctgccgcaggttaacggccatccagatccattcgacgaaattatcctgttttctcttcccccggccctggattgggactcggttcatgttcctggtccccatgctatgactattcaggagttagtggattacgtgaacgccaggcaaaagcagggcatctatgaagaatacgaagacatacgacgcgagaatcctgtgggcacctttcactgctcgatgagcccaggaaatctcgagaagaaccgctacggtgacgtgccatgtctcgaccagacccgggtaaaattaacaaaacggagtggccacactcaaacagactacattaacgcttcgttcatggatggatacaaacagaagaatgcatatataggcacacagggaccactcgagaacacttatcgcgacttttggctcatggtatgggagcagaaggtgctcgtgattgtcatgactacgcggttcgaggagggggggcgaagaaagtgtggacagtattggccgttggagaaagatagcagaattcgtttcggtttcctgacagtgacaaatcttggagtcgagaacatgaaccactacaaaaagacgaccctggagattcataacacggaagagaggcagaagcgacaggtgactcacttccaattcctgtcctggccagactacggtgtgccctcgtccgcagcatcactaatagatttcctgagagtcgttcggaaccagcagagcctggcagtgtctaatatgggggcgcgaagtaaaggtcagtgcccagagcctcccatagtggtccattgttctgcagggatcggacgcaccggcactttttgttcccttgacatctgcctggcccagttagaggagctgggcactcttaacgtgttccagacagtcagccgcatgaggacccagagggctttttcaatacagactcccgagcaatactatttctgttacaaagcgattctggaatttgctgaaaaagaagggatggtgtcttccgggcagaaccttttagccgtggaatctcagtag

SEQ ID NO: 17988 - DNA, 396 bp, Artificial Sequence
  Description of Artificial Sequence: Synthetic coding sequence
atggctatgaccgcgggaaccacgacaaccttccccatgagtaatcacacccgagagagggtgaccgttgcgaagctgacactcgagaacttttattctaacctcattttgcagcatgaggaaagagaaacaaggcagaaaaaattggaggtggccatggaagaggagggtctcgccgacgaggagaaaaagttacggaggagccaacacgctagaaaagaaaccgagttcttacggttaaaacgcactcggctaggacttgatgatttcgagtccttgaaggttattggtaggggagccttcggggaagtgaggcttgtccaaaaaaaggacaccggtcacatctacgccatgaagatccttcgcaagtccgatatgcttgaaaaagaacagtag

SEQ ID NO: 17989 - DNA, 435 bp, Artificial Sequence
  Description of Artificial Sequence: Synthetic coding sequence
atggcgtcagttgcggccgcaagggctgtacccgtgggaagcggactcagaggcttgcagcgcaccttgccccttgtggtaattctaggtgcgactggtacaggcaagtccaccctggccctgcagctaggacagcgcctgggcggagagattgtctccgctgatagtatgcaggtctatgagggcctcgacatcattaccaacaaggtctcggcccaagagcagaggatctgtagacaccacatgatcagttttgtcgacccactggtcaccaattatacggttgtcgattttaggaaccgcgccacggctctgatcgaagatatcttcgcccgcgataaaattccaatcgtggtcggaggaactaactattatattgaatctctgctgtggaaagttcttgtgaacaccaaggtgtctctcgttcacagctag

SEQ ID NO: 17990 - DNA, 1386 bp, Artificial Sequence
  Description of Artificial Sequence: Synthetic coding sequence
atggcggcctccagtcttgagcaaaagctcagccggctggaagccaaactgaaacaagagaacagggaagcccggaggaggatcgacctaaatctggacataagtccacagcgcccccgccctaccctgcagcttcctcttgcaaacgatggggggtcgcggtctcccagctcggaatcgtcgcctcagcatcctaccccccctgctaggcctaggcacatgctgggcctccccagcactctattcaccccgcgaagcatggaaagtattgagatagaccaaaaactacaagagattatgaaacagactggctatcttactatcggtggccaggtacctccttcactgtggcggggggaaggaggcgggccagcgcggctggatccttcctgggagcgccagtggggggctgggggcggtggtcggcctgggactctgcagccctcacttagcagccagagatatcaggctgagatcaatgacctggaaaatctgggagaaatgggctctggaacctgcggccaggtgtggaaaatgagatttcggaaaactggccacgtgatcgccgtgaagcagatgcggcgttccggaaataaagaggaaaataagcgaattctcatggatcttgatgtggttttaaaatcacacgattgcccatacattgtccagtgcttcgggacttttatcaccaacaccgatgtgttcatcgccatggagctgatgggaacctgtgcagaaaaactgaaaaaacgcatgcaggggcctatccctgagagaatcctggggaagatgacagtggccatcgttaaagcgctctactacctcaaggaaaagcacggcgttatccaccgagatgtaaaacccagcaatatcctgttagacgaaagagggcagataaagttatgtgacttcgggatttcaggccggcttgtagatagtaaggccaaaaccaggtcggccggatgtgccgcctatatggcgccggagcgaatcgatccccccgacccgactaaaccagattacgacatacgggccgacgtctggtccctgggcatctctctggttgagctggctacaggacagttcccatataagaattgtaagactgattttgaggtccttactaaggtcctccaggaggaacctccactgttacctggacatatggggttttccggggattttcaatccttcgtcaaggattgtctgaccaaggatcatcgtaaaagaccgaaatacaacaagttattggagcattccttcattaagagatacgagacacttgaggtcgatgtggccagttggttcaaggatgtgatggcgaagaccgaaagtccaaggacatccggggtgctgtcgcaaccccacctgccgttctttaggtag

SEQ ID NO: 17991 - DNA, 1611 bp, Artificial Sequence
  Description of Artificial Sequence: Synthetic coding sequence
atggagacttcagatattcaaatcttctatcaagaggatcctgaatgtcagaatctgagtgaaaactcctgccccccaagtgaggtgtccgatacaaacctgtactcgccttttaaacccaggaactaccagctggagttggcgcttcctgctatgaagggaaagaacactatcatctgcgccccaacaggctgcgggaaaactttcgtaagtcttttaatatgtgagcatcatctcaagaaattcccgcaaggacaaaaaggcaaagtggtcttctttgcaaaccagatccccgtgtatgagcaacaaaagtcagttttcagtaagtactttgagcggcacggttaccgcgtgacagggatttccggggctacagcagagaacgtgccagtggaacagattgttgaaaataacgacattatcatactcacaccgcagattttggtgaataatcttaaaaaaggcaccattccgtcgctttcaatctttactctgatgatttttgatgaatgtcacaatacatctaagcagcacccctacaatatgattatgttcaattatctcgatcaaaaattaggtggtagctctggtccgctcccgcaagtaataggcctgacagcgagtgttggggtgggagatgctaagaatacggacgaagcccttgactatatttgcaaactgtgtgcctccttagacgcctcagttatcgccactgtaaagcacaacctggaggagcttgaacaggtcgtgtataaaccacaaaagttctttaggaaggtggagtcccgaatctcagacaaattcaagtacatcatcgcccaactgatgcgtgacacagaatctctggccaaaaggatctgtaaagatttggaaaacctatctcaaatacagaatcgcgagttcggtacccagaagtacgagcaatggatcgtaacagtacagaaagcatgcatggtgttccagatgccagacaaggacgaggagtcaaggatctgtaaagcgctctttctttacacctctcatttacgtaaatacaacgacgccctgatcattagcgaacatgcccggatgaaggacgctttggactatctgaaagattttttctctaatgtccgggccgccggttttgacgaaatcgagcaagacctaacgcagcgctttgaagaaaaactgcaggaactggagagtgtcagcagagacccttcaaatgaaaatccaaagctggaagacttatgtttcatactgcaggaggagtaccacctaaacccagagactataactattctcttcgtgaaaacacgcgctctggtcgatgcgctcaagaattggattgaaggaaaccccaagctgtctttcttgaagcccggaatcctgactggaaggggcaaaacgaatcagaatacagggatgacattaccagcccagaagtgtattcttgacgcctttaaggcctctggagaccacaatattttgatcgcaacatctgtagccgatgaaggcatcgacatagcacagtgtaacctcgtcattctgtatgagtacgtcggcaacgtaattaagatgattcaaactcgcgaagaggagcaggaagtggcatcagcctcattctag

SEQ ID NO: 17992 - DNA, 2883 bp, Artificial Sequence
  Description of Artificial Sequence: Synthetic coding sequence
atgtcaagattgatcgtcaaaaacctcccgaacggaatgaaggaagaacgatttaggcagctattcgctgcttttggcacgttgaccgactgcagcctcaagttcacaaaggacggcaaattccggaagttcggtttcataggtttcaagtctgaggaagaagcacagaaggcccaaaaacattttaataaaagcttcattgacaccagccgtattacagttgagttttgtaaatcttttggagatcctgccaaaccaagggcctggtcaaaacacgctcagaagcctagtcagccaaagcagcccccaaaggactccacgacacccgagattaagaaagatgaaaaaaagaagaaggtcgcaggtcagctggagaaactgaaagaggacacagagtttcaagaatttctgagcgtacaccagagaagagctcaggcagccacatgggcgaatgacggattggatgcagaaccatcaaagggtaaatctaaacctgccagcgactacctgaatttcgactcagatagtgggcaagagtctgaagaagagggagcaggggaggacctggaagaagaggcctcgcttgagcccaaggccgccgtgcagaaggaactttccgacatggactaccttaaatctaagatggtgaaggcaggatcctcttcgagctctgaagaggaggaatccgaggatgaagcagtgcattgcgatgaaggctcagaagccgaagaagaagacagcagcgctacacctgtgctgcaggaaagggacagtaaaggagccggccaggaacaaggcatgccagctggcaagaaaagacctcccgaggcacgggcagaaacggagaaacctgcaaaccagaaggaacctactacatgtcatacggtgaagttgcgcggcgcaccctttaacgtgactgagaagaacgttatggagtttctcgctcccctgaaacctgttgctattcggattgtccggaatgcgcatggtaacaaaaccggctacatctttgtggatttcagcaatgaagaggaagttaaacaggcattgaaatgcaatcgcgagtacatgggcggcagatatatcgaggtctttcgcgagaagaatgtgcctactacaaaaggcgcccccaagaataccactaagtcatggcagggacggatcctgggtgaaaatgaggaggaagaggacctcgccgaatctggacgtttgttcgtgcgcaacctgccttacacctctaccgaagaagatcttgaaaaactattctccaagtatggccccctgagtgaactgcattaccccattgactccctgacaaagaaacctaaaggcttcgcctttattacatttatgttccccgaacacgccgtcaaagcatatagcgaggtggacggccaggtgtttcaaggcagaatgctccatgtgctgcccagcacaataaaaaaggaggcttccgaggacgctagcgcgctggggagtagcagctataaaaagaagaaggaagcccaggataaggccaatagtgcgtcctcacacaattggaatacgctgttcatgggccccaacgccgtcgccgacgctatagctcagaaatataacgctactaagtcgcaagtgtttgatcacgagaccaaggggtccgtggctgtgcgcgtagccctgggggaaactcagcttgtacaggaggtgcgtcggttcctgatagataacggagtctccctggacagtttcagccaagctgctgccgagagaagcaagacagtgatcttagtaaagaatctgcctgcaggaactctcgccgcacaactgcaggagacttttggccattttggttccctggggcgcgtcctgctgccagagggtggaattaccgccatcgtggaatttctggaacctctggaggctaggaaagctttccgccacctcgcatacagcaagtttcaccatgtacctctttatctagagtgggccccggtgggagtgttctcctcaactgctccacaaaagaaaaagctgcaggacaccccaagcgagccaatggaaaaggatcccgcagagcccgagaccgtacccgatggcgagaccccagaggacgagaacccaacagaggagggcgcagacaactcaagcgccaaaatggaagaggaggaggaggaagaagaggaggaggaagaatcattacccggatgtactttatttattaagaatctgaacttcgacacgacagaagagaagttgaaagaggtgttttcgaaggtgggaactgtgaagagctgcagcatctccaaaaagaaaaacaaggctggggttctgctttcaatgggtttcggttttgtggagtaccgtaaacccgagcaagcccagaaggctctcaaacagctgcagggacacgtagtggatggccacaagttggaagttagaatttccgaaagggcgacaaaacctgccgtaacactggccagaaaaaagcaggtaccccggaaacagaccacttccaagattcttgtgagaaatattccattccaagcacacagccgcgagattcgcgaactctttagtacctttggcgagctcaagacagtgcgattgcctaagaaaatgaccgggactgggacacaccggggattcggatttgtcgatttccttaccaaacaggacgctaagcgtgcgttcaacgccttatgccattctacccacctgtatggcagaaggcttgtcctggaatgggccgacagtgaagtaactctgcaagcgctccgaagaaagacggctgcccacttccatgaaccacctaagaagaaacgctccgtcgtgcttgatgagattcttgaacagctggaagggtcagattctgatagtgaggagcaaacactccagttgtag

SEQ ID NO: 17993 - DNA, 666 bp, Artificial Sequence
  Description of Artificial Sequence: Synthetic coding sequence
atgctcgccgccgggctcctggaagaactccgggacttccaccgcagatataaccaaaagaatgttagcgaaaactcccaagattatcagcatggtatctttcaatcaatagggttcaaagaattccacgagtaccttatcacagagggaaagtgtacgttggagacaagcaaccagctccttaaaaaaggaattgaggctctcaaacaggtaaccaagcgctacgctcggaaacagaacaggtgggtgaagaataggttcctgtcacgccctggaccaatagtcccccccgtatatgggctcgaggtgagcgacgtgtccaaatgggaggagagcgtgttggaaccagccctggaaatagtccaaagtttcatccagggacacaaacccacagctactcccatcaagatgccttacaatgaagcagagaacaaaaggagctaccacctctgcgatctgtgcgacaggatcatcattggcgatcgcgaatgggccgcccacatcaaatccaaatcccatctgaaccagctgaagaagaggagacgcttggacagcgatgcggtgaatactatagagagtcagtcagtgagcccggaccacaataaagagcccaaggaaaaagggtccccaggacaaaatgatcaagagttaaaatgcagtgtgtag

SEQ ID NO: 17994 - DNA, 2649 bp, Artificial Sequence
  Description of Artificial Sequence: Synthetic coding sequence
atgcccagagtgaagcccaaactcgagaagcagctgcagaaggataaagaaaaggtggaggaatttaagagtatcccggctaagagtaacaacatcattaacgagactaccaccaggaataacgcactggaaaaggagaaagagaaagaggagaaaaagctcaaagaagtaatggatagcctcaagcaagaaacacagggcctacagaaagagaaagaaagcagggagaaggagctgatgggattttctaagagtgttaacgaggcccgatccaaaatggatgtggcccagagcgaactggacatctatctgtcacggcataacacagcggtatcccagctaacaaaggccaaagaggcccttatagctgctagtgagacactgaaagagcggaaggctgcaatcagagatattgagggcaagctccctcaaacggagcaagaactgaaagaaaaggaaaaagagctccagaaactaactcaggaggagaccaatttcaagtcgctggtccatgatctgtttcagaaagtcgaggaagccaaatcttcgctggccatgaatcggtccagaggcaaagtgctagatgcaatcatccaggagaaaaaatcggggaggatacctggcatctacggtcgcctcggtgacctaggagccatcgatgaaaaatatgacgtggccatatcctcttgctgccacgccctcgattacatcgttgtcgactctatcgacatcgcacaggagtgcgtgaactttctaaagagacagaacatcggagtggcaacgtttataggtctcgacaagatggccgtatgggcaaagaaaatgaccgagattcagacacccgagaatacaccacgactgttcgatttggttaaagtgaaggatgagaagattcgacaggccttctatttcgcactgcgagataccctcgtcgcggataatctggaccaagccactcgcgtcgcctaccagaaagaccggcgttggagagtggtgactctgcaggggcaaattatcgagcagtccggtacaatgaccggcggcggctccaaggtgatgaagggcaggatggggtccagtttagtgatagagatcagtgaggaggaagtgaataagatggagtcacagttgcaaaatgattccaagaaggccatgcagattcaagaacagaaggtacaactggaagagagagttgtgaaactgaggcatagcgaaagggaaatgcgtaatactctggaaaaatttaccgctagcatccagaggttgatcgaacaagaagaatacctcaatgtccaagtcaaagagctggaggcaaatgtccttgcaacagcaccggataagaagaagcagaagctactggaggagaacgtgtcagcctttaaaaccgaatatgacgccgtcgctgaaaaagctggtaaagttgaggctgaggtgaagcgactgcataacactattgttgagatcaataaccataagctcaaggcccaacaggacaaactagacaagattaataaacaactggacgagtgcgccagcgccataactaaggcccaagtagctatcaagactgccgatcggaaccttcagaaggctcaggactccgtgctgagaaccgagaaagaaatcaaggacacagagaaggaagtggatgacctaacagcggagctgaagtccctggaagataaggcagccgaggttgtcaaaaacactaacgcagccgaggagagccttcctgaaatacagaaggaacaccgcaacctattgcaggagttaaaggttatccaggaaaatgaacatgctttacagaaagatgcactgtcgattaagttaaaactcgaacaaatcgatggacacattgccgagcacaactcaaaaataaaatactggcataaggaaatctctaagatctccttacacccgattgaagacaacccaattgaagaaatttctgttctgtccccagaggaccttgaggcaataaaaaatccagattctatcacaaatcagatcgccctgttggaggctaggtgccatgagatgaaacccaacctcggcgctatagctgagtataagaagaaagaggagctctacctacaacgcgtcgcagagctggacaagatcacctacgaaagggacagcttccgacaggcctacgaggaccttcggaaacagaggctcaatgagttcatggcaggattttatatcataacgaacaagctgaaagaaaactaccagatgcttaccctaggcggagacgcagagctcgaactggtcgatagcctggatcccttttctgagggaatcatgttcagcgtgcgcccacctaaaaagtcttggaaaaaaatttttaacctgtctggcggggaaaagactctgtccagcctcgcccttgtgttcgcactccatcactacaagcctactccattgtactttatggatgagattgatgccgcactggatttcaagaacgtctcgatcgtcgcgttctatatttacgaacagacaaagaatgctcaattcataatcataagcttacggaacaacatgttcgagatatctgaccgtcttatcggaatctacaagacttacaacatcaccaagtctgtagccgttaaccctaaagagatagcatccaagggcttatgctag

SEQ ID NO: 17995 - DNA, 1038 bp, Artificial Sequence
  Description of Artificial Sequence: Synthetic coding sequence
atgttcttgactcgccccaaggtgtgcgttgatcttaaccgtagggtcactctttacggagtcttcacaattcacttctctccgaatgtaccaagtcggtgtctgcttctagaactcttggacgtgtcggtctctgagcttttgctttacagctcccatcaggggtgcagcatgtggatgatacagcactgtgccagagatgtgctggaggcccttgctttcctgcaccatgaaggatatgtgcatgccgacttaaaaccacgcaacatattgtggagtgctgaaaatgagtgctttaagttgatcgactttgggttgtcttttaaggaagggaaccaagatgtgaagtacattcagaccgatgggtacagagcgcccgaggctgagctgcagaactgtctggcacaggccgggctacagtccgatactgaatgtacgagcgcagtggatctgtggtctcttgggatcattctgttagagatgttctccggtatgaagctgaaacatactgtgaggtctcaagaatggaaggcaaatagtagcgcaatcattgaccatatatttgcatctaaggctgttgtgaatgccgccatccctgcataccacctgagggatctgatcaagtcaatgcttcacgatgatccgagccgtcgtattccagccgaaatggctctgtgctccccattctttagcatcccattcgcaccccacatagaagacttggtcatgctacctactccggtgctgcgactcctaaatgtgctcgatgatgactacttggaaaatgaggaggaatacgaggacgtggtggaggatgttaaagaagaatgccagaaatatgggccagtggtttcgcttctagttcctaaagagaatcccgggcgtggtcaggtgtttgtggagtacgcaaacgctggagattctaaagccgcgcaaaagttacttaccggacggatgttcgacggcaagttcgtcgttgctactttttaccccctgagtgcctataagcggggttacctgtaccagaccctgctatag

SEQ ID NO: 17996 - DNA, 954 bp, Artificial Sequence
  Description of Artificial Sequence: Synthetic coding sequence
atgtggctcgcgcgcgaggggattgtcgccccactgccaggtgagtggaagccttgtcaggatattaccggggacatctactattttaacttcgccaatgggcagtctatgtgggaccacccgtgcgatgagcactatcgcagcctcgtaatccaggagagagctaagttaagtacatcgggcgcaatcaagaagaaaaagaaaaagaaagaaaagaaggataagaaggatcgagatccacccaaatctagtctggagacacagcccgaggaagggctgttgccaccctctagcttcctttgctccttatcaccccctagtgcccccggcctggcagacctcgaccttgaccaggagatgcaggccatcagcgaaggtagctataacaagggtaaatctcctggcatgttaggggacactccatggcggtttatgggagccctgccacgaaaattgcagccactgtcaaagggacaaccatctcagatccaccaagtgtttgcagatatggaaaaaatcctcgggcgagcaccagctcaatgcaggcgcgagctaggcgatcagcaaggtttggaaaagcttcagaaggcaaccgagaagatataccttggcttttccgatcccgagacagaagagctggagatgcggtctaggcagcagaaactaggcacccctgctccccagaacacgggcctcctgcagaacatgcaggatgtagttgagtcccgcaaccaagcttccgtccattcgaaactttccgaggccatcaagggactgcctctgaaaggagagcagcactcgcactctttggctaaactcagtcctacaggacccggtggcgataaaggccagagtccaattccaatgtggatttgctgtcgactgcgggcatcaaactgtcgcaacacatccgctgcatggcggcttaaactgaagagatcctcaacgtgttag

SEQ ID NO: 17997 - DNA, 162 bp, Artificial Sequence
  Description of Artificial Sequence: Synthetic coding sequence
atggggaattctgactcacagtacaccctgcagggcagcaagaaccacagcaatacaatcacaggcgccaaacagattccctgttcgctgaaaattaggggcatccacgccaaggaggagaaatccttacacggttggggacatgggagcaacggcgcttag

SEQ ID NO: 17998 - DNA, 1203 bp, Artificial Sequence
  Description of Artificial Sequence: Synthetic coding sequence
gcttggctgcagtctgcaggcgagctcccctcggatgggggctgtagccggcttcgctggcaggcccatctcgaatttactcacaaccacgatgtcggggatctcacatgggataagatcgcagtttctctgcctcggagcgaaaagctgcggtccctggtcctagcaggaatcccacatggaatgaggccacagctgtggatgcggctgagcggtgctctgcagaagaagcgaaatagtgagctgtcttacagggagattgtgaaaaactcatcaaacgatgaaaccatcgcagccaaacagatcgaaaaggatctgctgaggactatgcctagcaacgcttgcttcgccagtatgggttctatcggtgtgccccgtttgcgccgggttcttagggccctcgcatggctttatcctgagataggctattgccagggaactggcatggtcgccgcttgtctgttgctattcttagaagaagaagatgctttctggatgatgtcagccatcatcgaggatttattacccgccagctatttctctaccacactgttaggcgtgcaaacagatcagcgtgtgcttcggcatttgatcgttcaatatctccccagactagacaaactgttacaggaacacgatattgagctgtctcttatcactcttcattggttcctaaccgccttcgctagcgtggtggacataaaactgcttctgcgaatatgggatctcttcttctacgagggctctagagttctttttcagttaacactagggatgctgcacctaaaagaagaagaactgattcaaagcgagaactccgcatccatctttaataccctgtcagatatcccttcacagatggaagacgccgaactgctgctcggtgtcgccatgagactggccggcagccttactgatgtcgcagttgagactcagaggagaaaacatctcgcttatctcatcgctgatcaaggccaactgttaggagccggtacactgactaacctgagccaggtggcacaggatggcgggcctcatcttgatcctcagcacacgggccgccgcggacacctggaagtgcagtccgccggcgcagctgagaataaacctgcactgcccgctctgcctccctctctggcccaaagtgatcactcatgcggggttatccaggccagcagcggtttcgtccatcttcggttttag

SEQ ID NO: 17999 - DNA, 294 bp, Artificial Sequence
  Description of Artificial Sequence: Synthetic coding sequence
atgctgcgaggcaccaaggaaatggacaacatgtcccccaggctgcgcgcttttctatctgagcctattggtgaaaaagacgtttgctgggtggacggaatctcccatgagttagccatcaacctggtaaccaagggaattaacaaagcttatatcctgttaggacaattcctgctcatgcataagaacgaggccgaattccaacggtggttgatctgctgtttcggagctaccgagtgcgaggcccagcagacctctcactgcttaaaggaatggtgcgcttgttttctgtag

SEQ ID NO: 18000 - DNA, 1011 bp, Artificial Sequence
  Description of Artificial Sequence: Synthetic coding sequence
atggagtaccttggcggtggatctgcacttgacctcttaaagcccggtcctcttgaagaaacatatatcgccacaattcttagagaaatcctgaaggggctagattatctgcatagcgaacgcaaaatccatcgagatatcaaggcagccaatgtgctgttatcagaacagggagacgtcaagctggcggattttggagttgccggccagctcactgatactcagatcaaacgcaacacatttgtcggaacgcccttttggatggctcctgaggtcatcaaacagagtgcttatgacttcaaggctgacatttggagcctgggcattaccgcaatcgaactggccaagggcgaaccccctaatagcgatttgcatcctatgcgagtgttatttctaattccgaaaaattccccaccaacactggaaggacagcactccaagccattcaaggaatttgtggaagcctgcctgaacaaggatccccggtttagacccaccgcgaaggaactactgaagcataagtttatcactcgctacacaaagaagacctcattcctcacggaacttatcgaccgctataaaagatggaagtccgagggtcacggagaggagtcaagtagcgaggactctgatatcgacggggaagctgaagatggggaacagggccctatctggacattcccacctacaatcagacctagcccccattcaaagctgcacaagggcactgccttgcactccagtcagaagcctgccgagcctgtaaagcgtcaaccaaggtctcagtgcctcagcaccctcgtgcggccagtgttcggcgaggtgttttcgcagctgaaggagaagcacaagcagtctggcggcagcgtaggggcactggaagagctggagaatgcattcagtctcgcggaggaatcctgtcctggcatcagcgacaaattgatggtgcacctagtagaacgtgtacagcgcttttcgcacaatagaaaccatcttacaagtacacgttag

SEQ ID NO: 18001 - DNA, 1455 bp, Artificial Sequence
  Description of Artificial Sequence: Synthetic coding sequence
atggtgcatgaaacaagttactccgcacagtttaaaggagaggcaagcaaacccactaccgccgataataaagtgattgaccggagacgaataaggtctctctactcagaaccattcaaggagccacctaaggtcgagaagccgtcagtccagtcctccaaacctaagaagacctctgcctcacataagcccacaaggaaagccaaagacaagcaggcagtgtcgggccaggccgcgaagaagaagagcgctgagggccccagtaccaccaaacctgacgataaagagcagagcaaagaaatgaacaataaactagccgaggccaaagaaagcctggctcaaccagtctcggactctagcaaaacccagggacctgtggctaccgagccagataaagaccaaggatcagtggtacccggcctcctgaagggccaggggcccatggtacaagaacccctcaagaaacagggatccgtcgttccaggtccccccaaggacctggggccgatgatccccttacccgtcaaagaccaggatcatactgtgcctgagcctctcaagaacgagagtcctgtgatttctgcacctgtgaaagaccaggggccttctgtgcctgtaccacctaagaaccagtctccaatggtccccgccaaggtgaaagatcagggatccgtggtcccagaatccctgaaggaccagggcccgagaattccagaacccgttaaaaatcaggcccccatggtgcccgctccggtgaaagacgagggtcccatggtttctgctagcgtgaaggatcagggccccatggtgagcgccccggtcaaggaccagggtcccattgtgccagctcccgtcaagggggaaggccctattgttcccgctcctgtgaaggacgaggggcccatggtgagcgctccaatcaaagaccaggatcctatggtgccggaacatccaaaagacgaatcagccatggctacagcacccatcaagaatcaaggctctatggtgtccgagcccgtaaaaaaccaaggtctggtagtcagtggcccggtgaaagatcaggacgttgtcgtgcccgaacacgccaaagtccacgatagcgcagttgtggccccggtgaagaatcaggggccagtggttccagaaagtgtcaaaaatcaggacccaattcttcccgtcttggtcaaggatcagggcccaactgtcttgcagcctcctaaaaatcaaggcagaattgtacccgaacccctgaaaaaccaggtgcctattgtcccagtgcccctcaaagaccaagacccactcgtgcccgtgcccgcgaaagatcagggaccggccgtgcctgagcccctaaaaactcaaggccctcgcgacccacagttgcctacggtttctccccttccaagggtcatgattcctacagcaccgcacacggagtatatcgagtcatccccttag

SEQ ID NO: 18002 - DNA, 2103 bp, Artificial Sequence
  Description of Artificial Sequence: Synthetic coding sequence
atggctctgggagaggagaaggcggaggctgaggcttccgaagatacaaaggcgcaatcctacggtagggggagttgcagggaacaaccccctcggctagaggcagaaggagggcttatctcacctgtctggggcgcggaaggaatacctgctcctacctgctggatcggcaccgatcccggcggcccctcgagagctcatcagcctcaggcgagtgatgcgaacagggagccagtcgcagaacggagcgaaccagcactgtccggccttcccccagctactatgggttctggtgatctgcttctgtctggagaaagccaagtggagaaaactaagctgagctcgagcgaggaattcccccagaccttgagtctcccccgcacaactacgatttgttccggtcacgatgccgacactgaggatgacccttccctcgcagatctcccccaggccctggacctgtcacaacagcctcactcaagcggcctgtcttgcctgagtcagtggaagtccgtgctcagccctggcagtgcggcgcagcccagcagctgttctatcagtgcctctagtaccggaagcagcctgcaggggcatcaggaacgagcagaaccacgcggcgggtcccttgctaaggtttcttcaagtttagaacctgtggtgccacaggaaccgtcgtccgttgttgggctgggtccaagaccccaatggagcccacagccagtgttctccggcggggatgcatctggtctaggccgaaggagactctcctttcaagcggagtattgggcttgtgtcctgccagactccttaccccctagccctgacagacactcaccactctggaatcctaataaggagtacgaagacttgctagattacacataccctttgaggcccggaccacagttacctaaacacctcgatagtcgtgtcccagccgatcccgtgctgcaggatagcggggtcgatctggatagtttttctgtatctcctgccagcacactcaaatccccaactaatgtcagccctaactgcccgcctgccgaggctaccgcactgccgttttctggccctcgggaacccagcctaaagcagtggccatcgagggtgccgcaaaagcagggaggcatgggactcgcttcttggtcacagctggcaagcacgccacgcgcacccggaagccgagatgccagatgggagcgcagagaaccagccttgcgcggagccaaggaccgtctgacaatcggaaaacacctcgacatgggcagcccccaactccgcacccgtgaccgcggctggccatctccaaggcctgagagggagaagaggacttcccagtctgcaaggagaccaacgtgtactgaaagcagatggaaaagtgaggaagaagtggagtcggatgacgagtaccttgccctccctgcccggttaacgcaagtaagctcccttgtcagttacctggggtctattagtaccctcgtcaccttgccgaccggagacatcaaggggcagagccccctggaggtatcggatagcgatgggcctgcgtcatttccatctagctcaagccagagtcagctgcccccgggcgcggctctgcagggctctggcgaccctgagggacagaatccctgctttctccggagcttcgtgagggcccatgactccgcgggagaaggaagtttgggttcaagtcaagcgctcggagtgtcttctggactcttaaagactagaccgtcgttaccagcccggctcgacaggtggcccttctcagacccggatgtcgagggccaactgccaaggaaaggcggcgaacagggaaaagaaagcctggtgcagtgtgtgaaaacattctgttgtcaactagaagaacttatttgttggctgtataacgtagccgacgtgaccgaccatggcaccgctgctaggtcgaacctgacttcattaaagtccagcctgcagctatatagggtcatatgtggccccggcagcgggctgtttccgcacaaatccgtcgcaaagctgttggactacaaggtcaagtctcaaataactaacgtgtggtatgtgatcgcacagctgacgataatccccgagatttag

SEQ ID NO: 18003 - DNA, 1626 bp, Artificial Sequence
  Description of Artificial Sequence: Synthetic coding sequence
atgaaaagctatgttagtgaaaccatggcttctcccggcaaagataattatcgcatgaagagctataagaataatgccttaaatccagaagaaatgcggcgacgtagggaggaggaaggcatccaacttagaaagcagaagcgagagcaacagctcttcaagaggcgcaatgtagaactcatcaacgaggaggccgcaatgttcgactccctgcttatggattcatacgtcagttccacaactggagaaagtgtgatcactagggaaatggtagagatgctgttttcagacgattcagatctccaactagccaccacccagaaatttaggaaactgcttagtaaagagccgtccccaccaatcgatgaggtaataaatacccctagagtggtggacaggtttgtcgaatttctcaagcgaaatgagaactgcactctacaattcgaagctgcctgggcactcactaacattgcatccggaacgtcacaacaaacaaagattgtaatcgaggcaggagccgtgcctatcttcatcgaacttcttaatagcgactttgaagatgtgcaggaacaagccgtctgggcactaggcaatatcgccggcgattcttcagtctgcagagattatgttctgaattgctctattctgaacccccttctcaccctgctgaccaaatctacaaggcttacaatgacacggaacgctgtgtgggcactctccaatctgtgtcggggtaaaaatcctccgcctgaattcgcgaaggtgtccccctgtctacccgttctctcaaggctcttgttttcgtctgattcagatcttctcgccgatgcttgctgggccctttcttacctcagtgatggccccaacgaaaagattcaggcagtcattgattcaggcgtctgccggagacttgtggaacttctgatgcacaacgattataaggtagcgagtcccgccctaagggctgtgggcaacatagttacgggcgatgacatacagacacaggtaattttaaattgtagcgccctcccatgtctgctccacctgctcagtagccccaaggaaagtatcaggaaagaagcctgctggacgatttctaacatcaccgccggcaatagggcacagatccaggctgtcatcgatgccaatattttccctgtcctcattgagatactgcaaaaggccgaattcaggacccggaaggaggccgcttgggcaatcactaatgcaacttctggggggaccccggagcagattcggtacctggtgtcactcggttgtataaaacccctatgtgacctcctgaccgtgatggacagcaaaattgtgcaagtggctctcaacggtctcgaaaacatacttagactcggtgaacaggaaggaaagagatctggctctggagtaaacccatactgcggccttattgaggaggcatacggtttggataagattgagttcctgcagtctcatgaaaatcaagaaatctaccagaaggccttcgatctcattgagcattacttcggagtggaagacgacgatagctccctcgccccacaggttgacgagacccagcaacagtttatttttcagcagccggaggcccccatggaagggttccagctctag

SEQ ID NO: 18004 - DNA, 1716 bp, Artificial Sequence
  Description of Artificial Sequence: Synthetic coding sequence
atgctcgattgcggaatgcacatggggttcaatgacgatcgcaggtttcctgatttcagctatattacacagaatggcaggctgacagatttcctggactgcgttatcattagccatttccatcttgaccattgtggggctttgccatacttttcggagatggttggctatgacggaccgatctatatgacacatcctacccaagccatctgcccaatcctgctcgaggactaccgtaagatcgctgttgataagaagggggaggctaacttttttacctcccagatgataaaagattgtatgaaaaaggtggtggccgtgcacctccatcaaaccgtgcaagtcgacgacgagttggaaattaaggcctactacgcgggacacgtgctgggagctgccatgttccagatcaaggtggggtcagagtctgtggtctatacaggtgattacaatatgaccccagaccggcacttgggggcagcctggattgacaaatgcagacccaacttattgataactgaatccacatatgcgaccactattagagattctaagcgctgtagggagcgggatttcctgaagaaggtgcatgagaccgttgagagaggaggaaaggtcctcattccggtgtttgctctagggcgagcacaggagctgtgcatcctgttggagacgttctgggaaagaatgaatctcaaagtgcctatatatttctccacggggctcacagaaaaagccaatcattattacaaactgtttattccgtggacgaatcagaagattcgaaagacctttgtgcagaggaatatgttcgaatttaaacacatcaaagcatttgatcgcgccttcgccgataaccctggtcctatggtcgtgtttgcgactcctgggatgctccacgcagggcaatcattacaaatttttaggaaatgggcaggaaatgagaagaatatggtgatcatgcctggttattgtgtacaggggaccgttgggcataagatactttctgggcaaaggaaactcgaaatggaagggcggcaggttcttgaagtaaagatgcaggtcgagtacatgtctttcagcgcccacgctgatgccaaaggaatcatgcagctcgtgggccaggcagagcctgagtcggttctgcttgtgcacggggaagcaaaaaaaatggaattcctgaaacagaagatcgagcaagaattaagagtcaattgttatatgcccgctaacggcgaaacagtgacattgcctacctcgccaagcatccctgtcgggatcagtttgggcctgctcaaacgggagatggcccaggggctcctgcccgaggccaagaagcctcgcctgctacacggaaccctgatcatgaaagatagtaatttccgtcttgtgtcatccgagcaggcattaaaggagttgggtctggcagaacaccagctgagattcacttgtcgggtccatttgcacgataccagaaaggagcaggagacagcgcttagggtctatagccacctcaagtccgttctgaaggaccactgcgtgcaacatctgccagacggtagcgtaacagtggagagtgtgctgctgcaagctgcagcccccagcgaagatcccggtaccaaagtgctcttagtgtcttggacataccaagatgaagagcttggaagctttctgacttccctactgaagaaaggattgccccaagcaccttcctag

SEQ ID NO: 18005 - DNA, 2232 bp, Artificial Sequence
  Description of Artificial Sequence: Synthetic coding sequence
atggaggccgccgctgtgactgtcacgaggagtgccactaggaggagaagacgccaactgcagggtctggccgctccagaagctggcactcaggaagaacaagaagaccaggaaccacgcccaaggcgcaggcgacctggacggagtatcaaagacgaggaggaggagacggtcttccgggaagtagtgtctttttctcccgatcctctgcccgtccgttattatgacaaggatacaaccaagcctatatccttttacctgtcgagtctggaagaattgctcgcctggaaaccccggctcgaagatggttttaatgtggccctagaacctctcgcatgcaggcagccccccctgagtagtcagcggccaagaacacttttatgccatgacatgatgggcggatacctggacgacagattcattcagggcagcgtcgttcagaccccttatgcgttctaccattggcagtgcattgatgtcttcgtttacttcagccatcacactgtgaccatccccccagtcggctggaccaataccgctcaccgtcacggggtttgtgtgttaggtacattcattacagagtggaacgaggggggaagattatgtgaggctttcctggctggtgatgaaagatcctaccaggcggtggctgacagattagtccagattacacagtttttccgttttgacgggtggctgatcaatatcgaaaattcactctctctggcagccgtaggaaacatgccacccttcctgaggtatctgacaacacagctacatcgccaggtgcctggtgggctcgtgttatggtacgactccgtggtccagtctgggcagcttaagtggcaggacgaattgaatcagcataatagggtcttctttgactcctgtgatggatttttcactaactacaattggcgggaagaacatttagaacggatgttaggccaggcaggtgagcggcgagctgacgtgtacgtgggtgtggacgtcttcgctagaggtaacgtcgttggcgggcgcttcgataccgataaaagcctcgaactgatccgaaaacacggattcagcgtagcactgtttgcacccgggtgggtctatgagtgcctggagaagaaagatttcttccagaatcaggacaagttctgggggaggctggaacgttacctgcctacccactccatctgcagtctgcccttcgtgacttcattctgtctgggcatgggcgcccggagggtctgctatggacaagaggaagccgtcggcccctggtatcatctatccgctcaggaaatacaaccgctattcggcgagcataggcttggcggggacgggagggggtgggttcgaactcattgctgtctggaagatgcgtggcatgggggttcttctcttctagtgcgcggtgtgataccacccgaggtgggcaatgtcgcagtgaggttgtttagcctgcaggcaccggtcccgcccaagatttacctgtccatggtatacaaattggagggtcctactgacgtcacggtggcactcgagcttaccacaggtgacgccgggtcatgccatatcggtgggatctcagttctgaacgcagagactagtagccgacactccctgagacctctccgcgtcccccctacaaaactggcccgctgggtggggcgctgcgggaggcagctctccggcgggtgggtacagcactgctacgaggtgagccttcggggctgcttgctattggatttgctggtctgcttctcccgtcccccgggaagcagagaagaggaatccttcacttgtaggctgggcgagatccaggttgtagacgccgcgtctctgctcgccccactgccacaggtccaagccgtgacaatcagccacatacgctggcagccctcagcatcagagagagagggaccaccagctctgctgcagttgtcctgcacattgcactggagctttctcttgtcccaggtgcgctgttttaggatccattgctggggcggtatgagtgacgacagccccgggcgcgagctgcctcgaccagagatgcctatgttccttggactcgccttcgcgacccagtaccgaatcgtcgatttgttggttgaagcagccggacccggtcaggatagacggatggagtttttagttgaaccagtgcccaaggaagggtttagagtgccacaggcggagtggggacgggccgtgctcttatattcagccccggcatag

SEQ ID NO: 18006 - DNA, 396 bp, Artificial Sequence
  Description of Artificial Sequence: Synthetic coding sequence
atggaactgcgggtccatatggtgagccacaccggggagatgccctacaaagtgaggctgggcctctcaccagggccaggactggggggcccgagaattctaccagctgaaccttttacatggggcgcggttcggcatctacctcactccagctgtcagggagcttgcctcccttgcttgccttgcttgagcagtgctcccttgtctaggcagggtctctccgccgcctctcccccccggagcttgttagggccttgctttttcccttggagaaccgggctggctagttccgggcagcttagcccagaggctctgctgtgcactatcctgcacacacgttccggagtgctccctgagagctcccacagaggtctgccactggtgccagccttgtag

SEQ ID NO: 18007 - DNA, 909 bp, Artificial Sequence
  Description of Artificial Sequence: Synthetic coding sequence
atggagcatggtattgtcaaagattggaatgatatggagaggatctggcaatacgtatactccaaagaccagttacagaccttctctgaggagcaccctgtgctcctcacagaagccccgttaaatccacgtaagaaccgcgagcgtgctgcagaggtgttcttcgagactttcaatgttccggcccttttcatatcaatgcaggcggttttgtccctctatgcgactgggcgcactactggcgtggtgcttgacagcggagatggagtgacccacgccgtgcccatttacgaaggcttcgcaatgccgcactctatcatgcggattgacatcgccggccgtgatgtttcaagatttttacgcctctacctcaggaaagagggctacgatttccacagctctagcgagtttgagatcgtgaaggcaatcaaagagcgggcttgttatctctccattaatccacagaaagacgagaccctggaaactgagaaagcgcagtattaccttcctgacgggagcacaatagagatagggcccagcagattcagagccccagagttgttgttccggcctgacttgatcggagaagaatccgagggaattcatgaggtcctggtgttcgcaatccaaaagagcgatatggatctgcgacggactcttttctccaacattgtgctctccggtgggtctaccctgttcaaggggttcggcgaccgcctgctgagcgaggtaaaaaagcttgcccccaaggacgtgaagatccgtatctcagctccccaggaaaggctctattccacatggattggcggatccatcctcgctagtctggataccttcaaaaaaatgtgggtgagtaagaaagagtatgaggaagacggagcacgaagcatccaccggaagactttttag

SEQ ID NO: 18008 - DNA, 780 bp, Artificial Sequence
  Description of Artificial Sequence: Synthetic coding sequence
atgcttcgatgcgggcagatgatgctggcacaggctctcatctgccggcatctgggacgggattggtcatgggaaaagcagaaagagcagcccaaggaataccagagaattctgcagtgtttcttggaccggaaagattgctgttattcgatccaccaaatggctcagatgggagtgggcgaaggaaagagcattggcgaatggttcgggcccaatacggtggcccaggtcctcaaaaagctggccctatttgacgagtggaactcactggcagtctacgtgtctatggataataccgtcgtcatcgaagacattaagaagatgtgccgtgtgctgccattgtcagccgacacagccggcgacagacctccagacagtcttacagcttctaaccagtccgacgaactgatctttctggacccacatactactcagacatttgtggacacggaggagaacggcaccgtgaatgaccaaacattccactgcctgcagtctccccagcgtatgaacattctaaacctggacccaagtgtagcattgggcttcttctgtaaagaagagaaagatttcgataattggtgcagtttggtacagaaagagattctcaaggagaacctacgcatgtttgaactggtgcaaaagcacccgagccattggcctcctttcgtgccccctgccaagcccgaagtgacaacaacgggagcagaatttatcgatagcacagagcaactagaggaatttgacctcgaagaggatttcgagattctatcagtgtag

SEQ ID NO: 18009 - DNA, 957 bp, Artificial Sequence
  Description of Artificial Sequence: Synthetic coding sequence
atgcgagcccagagcgatgagttggagaagatcgagaaacatggccgctcttccaaagataaagaaaacgcaaagagtctcgataagccggagcaattcttatatgagctttccctgattccgaacttttccgagagggttttctgcatcctcttccagagcacattctctgaaagcatatgttccattcgacggaagcttgagcttctgcaaaagctatgtgagacattgaaaaatgggcccggggtgatgcaggtgcttggcctggtgctagcttttgggaactacatgaacggaggtaacaagactcgggggcaggccgacgggtttggactggacatcctcccaaaactgaaggatgtgaagagcagtgacaactcccgcagtttgctgtcatacatcgtgagctactatctccgcaattttgatgaagacgcaggcaaggagcagtgcctgttccctttaccagagcctcaggacctgtttcaggctagtcagatgaaatttgaggactttcaaaaggatctgagaaagctcaaaaaagacctgaaggcctgcgaggtggaagctggtaaggtataccaggtgtcttccaaagaacacatgcagcctttcaaggaaaatatggaacagtttatcatccaggccaagatcgaccaggaagccgaggagaactcattgaccgagacccacaagtgtttcctcgagaccacagcctacttcttcatgaagcctaagttaggcgagaaagaggtcagcccaaacgcattcttcagcatctggcatgagttttcatccgacttcaaagacttctggaagaaagaaaataagcttctgctgcaggagagggtaaaagaggccgaagaagtgtgtaggcagaaaaagggaaaaagcttgtacaagatcaaacccagacacgattcaggcattaaagccaagatcagtatgaagacctag

SEQ ID NO: 18010 - DNA, 345 bp, Artificial Sequence
  Description of Artificial Sequence: Synthetic coding sequence
atgagttcctcaatgtggtatataatgcagtccattcagtccaagtactctttgtctgaacggcttatacgaactattgctgccattagatcatttcctcacgacaatgttgaggacctgatacgcggaggagcagacgttaattgtacccacggaactctgaagcccctgcattgcgcctgtatggtttcagatgctgattgtgtggaattgcttctggagaagggggccgaggtgaacgcactcgatggctataaccgcacagcccttcactacgcagccgagaaagacgaggcctgtgtggaagtactgctagagtatggcgccaatcccaatgccctctag

SEQ ID NO: 18011 - DNA, 1365 bp, Artificial Sequence
  Description of Artificial Sequence: Synthetic coding sequence
atgtcaacattcaggcaggaggatgtggaggatcactatgaaatgggcgaggaactaggcagcggccagtttgccattgtcaggaagtgtcgtcagaaggggaccggcaaggagtacgcggcgaagttcatcaaaaagagaagattgtcgagtagccggaggggcgtgtctcgagaggaaatcgagcgcgaagtgaatatcctgcgagagatcaggcaccctaatatcatcaccctccacgatattttcgagaacaagacagatgtggtactgatcttagagctagtcagcggcggcgagctgttcgactttttggcagaaaaggaatcactcactgaagacgaagccacccagtttctcaaacagattctggacggtgtccactacctccactccaagcggatcgctcacttcgatctcaagcccgagaacattatgctcctggacaagaacgttccaaatccacgtattaagctcatcgattttgggatagctcacaagattgaggccggaaatgaattcaaaaacatctttgggaccccagagtttgtggcaccggaaatagtaaactatgaacccttgggcctggaggcagatatgtggagtatcggggttataacatatatattacttagcggtgctagcccattcctgggagaaacgaagcaggaaaccctaacaaacatcagcgcagtgaattatgacttcgacgaggagtatttttccaacacaagcgagctggcgaaggatttcataagaaggcttctcgtgaaggaccctaagaggagaatgacaatagcacaaagtctggaacatagctggatcaaagccatccgtcggagaaacgtaagaggtgaggacagcggtagaaagccagaacggagaaggctcaagacaactcgcttgaaggagtacaccatcaagtctcattccagcctgccaccaaataattcctatgccgacttcgagcgtttctccaaggtgctcgaagaagccgcagccgccgaagagggcctgagggagctgcaaaggagtaggcgcttatgtcatgaggatgtggaggctctggcagctatatatgaggaaaaagaagcttggtacagggaggaatccgactctctggggcaggatctgcgacgactccgccaggagctgctgaaaacggaggcccttaagagacaggcacaggaagaagccaagggggctcttcttgggaccagtgggttgaagaggcgtttctcccgactcgagaatcgatacgaggcactcgccaagcaagtggccagtgagatgcgattcgtgcaggatcttgtgcgcgcactggagcaagagaagttgcagggtgtcgagtgcgggctcagatag

SEQ ID NO: 18012 - DNA, 1047 bp, Artificial Sequence
  Description of Artificial Sequence: Synthetic coding sequence
atgggcaaagattactacaagattctgggcatcccatcaggcgccaacgaagatgaaatcaaaaaagcttatcggaagatggccctaaagtaccatccagataaaaataaagagccaaacgccgaagagaaatttaaggaaatcgcggaagcctatgatgtcctgagtgatccaaaaaaacgtgggctgtatgaccagtacggcgaagagggtttgaagaccggggggggcacatcagggggttcttctggttcgttccactacacctttcacggggatccccacgcaacattcgcctcttttttcggcggctccaatcccttcgatatcttttttgcctcatcacgctccacgcgtcccttcagtgggtttgatcctgacgatatggacgtagatgaggacgaggatcctttcggagcattcggcagatttggttttaatggactgtcccgaggtccccgtcgtgccccggagcctttatacccgaggaggaaagtgcaggacccacctgtcgtccacgaactaagagtctccctcgaagagatctatcacgggagcacaaagcgcatgaagatcactcgcaggcggctgaaccctgacgggaggacggttcgaacggaagataaaattcttcacatcgtaattaagagaggatggaaagagggcacgaaaataacctttcccaaggagggcgatgcaactccagacaatatacctgctgacattgtcttcgtgctgaaggataaaccgcacgctcattttcggagagacggcaccaatgtcctatacagcgccctaatctctctgaaggaagctttatgtggctgtaccgtaaacatccctacaatagacggtagggtaatcccattaccgtgtaatgatgtcatcaaacccggtacagtgaagagattgaggggggaaggccttcctttccccaaagtccccacacaacgcggcgatctgatcgtggagttcaaggtgcggtttcctgaccgacttacgccccagacccggcagatcctcaaacaacatctgccatgctcctag

SEQ ID NO: 18013 - DNA, 2163 bp, Artificial Sequence
  Description of Artificial Sequence: Synthetic coding sequence
atgtatggctcagcacggagtgttggtaaagtcgaacccagctcacagagccccggtcggtctccaaggctaccgaggagcccaagattggggcatagacggacgaatagcaccggcggttcaagtggcagctcagtgggaggcgggtctggcaagaccctgagtatggagaatatacagtctctgaatgccgcttacgcaacttcagggccaatgtacttgtctgatcacgaaaacgtcggctccgaaactcccaaatcaacgatgacgttgggcaggtccggcgggcgcctcccatacggcgtgcggatgacagctatgggctcctctcccaatatagcttcgtccggcgtcgcctcagatactattgccttcggcgaacatcacctgccgcctgtttcaatggcttcaacagtcccacatagcctcagacaggcacgcgataataccatcatggacctccaaacccagctaaaggaagtgctcagagaaaatgacctgctgcggaaagatgtggaagtcaaggagagcaagctaagctctagtatgaattctatcaagactttctggagccctgagcttaaaaaagaacgcgcactgaggaaggacgaggcttctaagattacgatttggaaagaacaataccgggtggtgcaggaagagaatcaggtcgacgcattgcggctccgcttggaagaaaaggagacgatgctcaacaagaagacaaagcagatacaggacatggccgaggaaaagggaacacaggccggagaaatccatgacctgaaagatatgcttgatgtgaaggagagaaaggtcaacgtgctgcagaagaaaattgaaaacctgcaagagcaactccgcgataaagaaaagcaaatgtctagcctcaaagagagggtaaaatctcttcaggcggataccaccaacactgataccgctctcactacgctggaggaagcactggctgaaaaagagaggacaattgagagacttaaggaacagagagaccgcgatgaacgcgaaaagcaggaagaaattgacaattataaaaaggacctgaaagacctaaaggaaaaggtgtccctgctgcagggagatctgagcgagaaggaggcctccctgttggacctgaaagagcacgcttcgtccttagcatcgtccgggttgaagaaagactctcgattgaagacactggaaattgctttggaacagaaaaaagaagagtgcttgaaaatggaatcccagttaaagaaagctcacgaggcagcactggaggctcgggcaagccctgagatgtcagaccggattcagcacctcgaacgtgaaatcacgcggtataaggacgagagcagtaaagcccaggcggaggtggatcggctgctggaaatcctgaaagaggtggaaaatgaaaagaatgacaaagataagaaaatcgctgaactcgagtccctcacgtcacggcaagtcaaggaccagaataagaaggttgccaaccttaagcacaaggagcaggttgagaaaaagaagtcagcccagatgctcgaagaggctagacgccgtgaggacaatctgaatgattctagccagcaactgcaggactcactgaggaagaaggatgatcgaatcgaggagttagaggaggccttgcgcgaatcagtgcagataacagcagagcgcgagatggtcctcgcccaggaagaatccgcccgtacaaacgccgagaaacaggtggaagagctgctgatggccatggagaaggtcaagcaagaactcgaatcaatgaaggcaaagctcagcagtacccaacaaagtctggccgaaaaagagacccatcttacaaatttacgagctgagcgccggaagcatcttgaggaggtcctagagatgaagcaagaagccctcctggcggcaatctcagagaaagacgccaacattgcacttttagaacttagcagtagtaaaaagaagacacaagaggaagttgctgcccttaagcgggagaaggaccggctcgttcagcaacttaagcagcagacgcagaacagaatgaaattgatggctgacaattacgaggacgatcattttaagagcagccactctaaccagactaatcacaagccaagcccagaccaagacgaagaggaaggcatctgggcctag

SEQ ID NO: 18014 - DNA, 768 bp, Artificial Sequence
  Description of Artificial Sequence: Synthetic coding sequence
atggcagcgagtactatgtctgtatgcagttccgcttgctcagacagctggcaggtcgatgcttgtcctgaatcctgctgcgagccacattgttgcgctctgagttgctgcgctcccgccccctgcctcactctagtctgcacaccagtttcacgagtctccagtccttgctgccaggccgcatgtgaaccgagtccatgtcagagcgggtgtactagctcttgcactccctcctgttgtcagcagagcagctgtcagcctgcatgctgtacttcgagtccatgccagcaggcctgttgcgtgcctgtctgctgtaagccggtatgttgtctgcccacatgtagtaaggattcatcgtcatgctgccaacagagcagctgtcaacctacttgttgcgctagctcgagtagtcaacagtcctgctgtgttcccgtgtgctgcaaacctgtttgttacgtgcctacctgcagcgaggactccagctcttgttgtcagcagtcctcctgccatcccgcctgttgcacatcatcaccatgtcaacaggcctgttgcgtgcctgttaggtgtaaacccgtgtgctgcaaacccatttgctgcgtgcccgtgtgctccggagcctccactagctgctgtcagcaatcatcttgtcagccagcctgttgtactactagttgctgtaggccctcttcatctgtctcactgctgtgtcgccctgtgtgtaggccggcatgttgtagtctgtgtagcggccaggaatcatcttgttag

SEQ ID NO: 18015 - DNA, 2562 bp, Artificial Sequence
  Description of Artificial Sequence: Synthetic coding sequence
atgagcgaaaaggtggattggctacagtcacagaacggcgtatgtaaggtagatgtttacagtcctggggacaaccaagcgcaggattggaaaatggacacctctaccgaccccgtgcgagtgctgagctggttgaggcgagatctggaaaaatcgacagctgagttccaggacgttcgctttaaaccaggagagtccttcggaggcgagacctccaactcaggtgatccgcacaagggtttctccgtggattactacaatacaacaacaaagggaacacccgaaaggttacacttcgagatgactcacaaggagatcccctgtcaagggccgagggctcagctgggtaacggtagcagcgtcgatgaagttagcttctatgccaaccggctgacaaatctggtgatcgctatggcccgcaaagagattaacgagaaaatcgatggttcggaaaataaatgcgtctaccaaagcctatatatgggcaatgaaccaactccgacaaaaagcctgagcaaaattgctagtgagctggtgaatgagaccgtgtctgcctgttcaagaaatgctgcacctgacaaagctcctggtagcggggacagagtgagtgggtcctcccaaagccctcctaacctgaagtacaagtccaccctgaagattaaggagtccactaaggaaagacagggtccagacgacaagcccccttctaaaaaaagctttttttacaaagaggtctttgaaagtagaaacggtgactacgcgagggagggcggaaggttctttccgcgtgagagaaagagatttcgcggacaggagcggcctgatgacttcactgcttccgtgtccgaaggcattatgacgtatgctaattctgtggtgagtgatatgatggtatctatcatgaagactctgaaaatccaagtcaaagatactaccattgctaccatcctcctgaaaaaggtcctcttgaaacatgccaaagaagtggtaagcgatctcattgactcatttctacgaaaccttcacagcgtgacaggtaccctgatgacagacacccagttcgttagcgcggtcaagcgcacggtgttctcccatgggtcccagaaggcaaccgatatcatggacgctatgttaagaaaactctacaatgttatgttcgccaaaaaagtgccggagcatgtgcggaaagcccaggacaaagcggagagttacagcttgatatcaatgaagggtatgggggatccaaaaaaccgaaatgtgaactttgctatgaagtcagaaacaaagttaagagagaagatgtactctgagcctaagtctgaagaggagacgtgtgcaaagactctgggcgaacatattataaaagaggggctgactctctggcataaaacccagcagaaagagtgtaagagcctgggattccagcacgccgctttcgaagcacccaacacacaacggaagccggcatctgatataagttttgaataccctgaggacatcggcaatctgtctctacctccgtatcctccagaaaaaccagagaactttatgtatgattccgattcctgggccgaggacctcattgtgagcgccctgctgcttatccagtatcacctggcccagggggggaggcgtgatgctcgaagcttcgtagaggctgccggcaccacgaatttcccagctaatgagccccctgtggcccccgacgagtcttgccttaagagcgcgccaattgtgggtgaccaggaacaagccgagaagaaggacctgaggtctgtgtttttcaatttcattagaaacctactgtctgagaccatttttaagagagatcagagtcctgagccgaaagttcctgaacagccggtgaaagaggatagaaagctatgtgaaaggccactcgcttctagcccaccgcggctgtatgaggatgacgagactcccggagcattaagcgggttgactaagatggctgtgagccagatcgacggtcatatgtctggtcaaatggtcgagcacctgatgaattccgtaatgaaactgtgcgtaataatcgcaaaaagctgcgacgcctctctcgccgagttgggagacgacaagtcaggggatgccagccgcctcactagcgcctttccggattcgctgtatgagtgtctgcccgctaagggcacaggctctgcggaagcagtgctgcaaaatgcatatcaggccatccacaatgaaatgaggggcacctccggacagccacccgaaggttgcgcagctcctaccgtgatagtttcaaaccacaatctgaccgataccgtccagaacaaacagctccaggcggtgttacagtgggtggctgcgtccgaactgaacgtccctattctctattttgccggcgacgatgaaggaatccaggagaagcttctgcagctgagtgctgcggctgttgacaaaggttgttctgttggcgaagtcctccaatccgtcttgcggtatgaaaaggagcggcagctgaatgaggccgtcggtaacgtcaccccactacaattgctggactggttgatggtgaatctgtag

SEQ ID NO: 18016 - DNA, 1263 bp, Artificial Sequence
  Description of Artificial Sequence: Synthetic coding sequence
atggtgcacgggcgcaaggctaacgctcaggtcatggaatcagaggagttcatgctcctgccagccaatcagctaattgacatcatcagtagcgatgagctgaacgtgcggtcagaagagcaagtgttcaatgccgtgatggcctgggttaagtacagcatacaggaaaggcgcccccagcttcctcaggtactgcaacacgtcagactgcccttgttgtctcctaaatttctggtaggtaccgtgggaagcgatccactgataaagagcgatgaggagtgtagagatctcgttgatgaagccaaaaactacttattgctgccccaggagcgacctctgatgcagggcccgcgtactcggccacgcaagccaattaggtgtggcgaagtgcttttcgcagtgggcggatggtgctcaggagatgccatctcttcggtggagcggtatgatcctcagaccaatgaatggcgcatggtggcttcaatgtctaaaaggaggtgcggcgtgggtgtctccgtcctggatgaccttttgtatgctgtgggagggcatgatgggagctcctatctgaactccgtggagagatacgatccaaaaacaaaccaatggtcttccgatgtcgctcctacctcaacttgccgaacttccgtgggtgttgccgtgctgggggggtttttgtacgccgtggggggacaggatggggtgtcctgcttgaacatcgtggagcggtatgatcctaaagagaataaatggacccgcgtagcctccatgtccacaagacggctgggagtagcggtggcggtgctgggcgggttcttatatgccgtcggggggtcagatggtactagtcctcttaacaccgtcgaaaggtacaatccacaagagaacaggtggcacacaatcgccccaatgggaacccggcgcaagcatctgggctgcgcggtgtaccaggatatgatatatgccgttggtggacgcgacgatactacagagctcagttcagcagaacgttataaccctcgaacaaaccagtggagccccgtggtagcgatgacctcacgcaggagtggagttggactggccgttgtcaacggccagcttatggcagtcggcgggtttgatggcacaacgtacctgaagaccattgaagtatttgacccagatgccaacacatggagactgtatggtggtatgaactatcgaagactgggtggcggagtaggcgtgattaagatgacccattgcgaatctcatatttggtag

SEQ ID NO: 18017 - DNA, 519 bp, Artificial Sequence
  Description of Artificial Sequence: Synthetic coding sequence
atgagctgtaccatcgagaaggctctggccgacgccaaagctcttgtggaacggttaagggaccatgatgacgcagcagaatctctgatcgaacagacaacggccctgaacaagagggtggaggcaatgaaacagtatcaagaggagatccaggaactaaatgaagtcgccagacaccgcccgcgatctactctggtgatgggaatccagcaggagaaccgtcagatacgcgagcttcagcaagagaacaaggagcttagaacatccctggaggagcatcagtccgccttagaacttatcatgagtaagtacagagagcagatgttccgcctgctcatggcatctaaaaaagacgaccctggaatcataatgaaactgaaagaacaacacagcaaaattgacatggtgcaccgtaacaaaagcgaaggattctttctggacgcatctaggcacatcctggaagcgccccagcacggactagaaaggagacacctagaagccaatcagaacgtgcactag

SEQ ID NO: 18018 - DNA, 813 bp, Artificial Sequence
  Description of Artificial Sequence: Synthetic coding sequence
atgctgtttatcttcccactgagcctgccttggaggccatcttgctggaaggaatcatgctcgacggggcaaagacaggctggtcgttcgagagaggactcggtgacccctccccctagcagtccttggcctaccccaccagccggcgccatgagtacaaagcaagaggcccgcagggacgagggtgaggcccggaccagggggcaagaggcgcagcttcgtgatcgcgcgcacttgtctctccacaaggactccgctgatctcttgccactggactccctcaaacgcctcggtaccagcaaggatctgcagcccaggtctgtgattcagagacgcttggtagagggaaatcctaactggctgcagggggagcctccacgcatgcaggacctgattcacggacaggaatcccggcgcaagaccagccgcactgaaattcccgcattgttagtcaactgtaagtgccaggaccaactgctgcgggtcgcggtggatactggcacgcagtataacaggatcagcgcggggtgtctctcaagactggggctggaaaaaagggtcctgaaagcgagcgccggagacctggcccccgggccacctactcaggttgaacaacttgagctccagctcgggcaagagacagtagtatgcagcgcccaggtggtggatgcagaatccccggagttttgcctcggcctgcaaactctgctgagcctcaaatgttgcatagaccttgaacatggggttctgaggctcaaggcccctttttctgaactaccttttctgcccctgtaccaggagccaggacaatag

SEQ ID NO: 18019 - DNA, 243 bp, Artificial Sequence
  Description of Artificial Sequence: Synthetic coding sequence
acaagttgctgtcgtccttcgagctctgtgtcacttctctgccacccggtttgtagctgtagccccgcctgccagccaacgtgctgtatccattctccatgccaggcctcgtgctatgtgcccgtcagctgccagccgattatttacgtgacgccgagttgtcagtccagcggctgttgccaacccccttgtacgaccgctctgtgtcggcctatcagttgctctacgccaagctgctgctag

SEQ ID NO: 18020 - DNA, 2013 bp, Artificial Sequence
  Description of Artificial Sequence: Synthetic coding sequence
atggcgctcggcgaagagaaggccgaggccgaggcatccgaggatacaaaagcgcagagttatgggcgggggtcttgtcgtgaacgcgaactcgacatcccaggacctatgagcggtgaacaaccaccaagattagaggctgaaggagggctgatcagcccagtttggggcgctgaggggatacctgccccaacatgctggatcggaaccgatccaggaggaccttcccgggcacatcagccccaagcaagcgacgcgaaccgtgagcctgtagctgaacgctccgagcccgctttaagtggactcccaccggctactatgggaagcggcgacctgttactaagcggtgagagccaggtggaaaagaccaagcttagctcttcggaagagttcccgcagactttatctctgcctcgtacgacaacaatctgtagtggtcacgacgccgacaccgaggatgacccgtccctcgccgacctcccgcaagccttggacctgagccagcagccccactcaagtggacttagctgcctgtcccaatggaaaagcgtactgtctcccggctctgctgcccaaccaagttcatgctctattagcgcgagtagtaccggctcctctcttcaggggcaccaggagcgagccgagcccagggggggaagcctggccaaggtcagctcctctttagaaccagttgttccgcaggagccgtcctcagtagtgggcttgggtcccagaccccaatggtcaccgcaacccgtatttagcgggggcgacgcctctggccttgggaggcggcggcttagctttcaggctgagtattgggcctgcgtgctgcccgatagcctgccaccaagcccagatcgccacagcccactttggaatcccaataaggaatatgaggatctactcgattatacttatcctctcaggcctgggccacagttgccaaaacatctggacagtagggtgccagcagatcccgtgctgcaagattcgggggtggacctagatagtttttcagtctctcctgcgagcactcttaaatcgcctaccaacgtgtcgccaaactgccccccagccgaggctacagccctccccttctccgggcctagagaacccagccttaagcagtggccctctagggtgcctcaaaagcagggtggcatgggactggcttcatggagtcagctcgcttctacacctagagcaccgggaagccgcgacgccagatgggaaagacgcgaaccggccttgcgaggcgccaaggaccgcctgactattggcaagcatctggatatggggagcccccagctgagaacacgcgatcgtgggtggccctcccccagaccggaacgtgagaagaggacttcccagagtgcccgaaggcctacgtgcaccgaaagtagatggaaatcggaagaagaagtggaaagcgatgacgagtacctggctctgcccgcaaggctaactcaggtgagtagcctggtcagctacctcggcagcatctctaccctggtgacattgcccacaggggacatcaagggccagagtccactggaggtgagcgattcggacggaccagccagtttccccagttcatcaagtcagtcacagctgccgccaggagcagcacttcaggggtctggcgacccagaaggtcaaaacccctgttttttacgctcattcgtccgggcccacgattccgcaggagagggctcgctcggctcttcccaagccctgggggtttctagtggcttgttaaaaacccgcccttctctcccagctcggctggacaggtggcctttcagtgatccagacgttgaaggtcagttgccaaggaaaggtggagaacagggtaaggagtccctcgtacagtgcgtcaaaaccttttgttgtcagctggaggagcttatctgctggctttacaacgttgccgacgtgaccgaccacgggaccgcagcacggtcgaatcttactagcctcaaatcttcgctccaactttacaggttctag

SEQ ID NO: 18021 - DNA, 702 bp, Artificial Sequence
  Description of Artificial Sequence: Synthetic coding sequence
atgaaacaactgatcgaagatacggaaaagaacaaggtttacgtagctatggttactgattacggagccttcatcaaaattccagggtgtagaaagcagggactggtgcaccgaacacatatgagttcttgccgcgtggacaagccaagcgaaatcgtcgatgtgggggacaaggtatgggtgaaacttattggcagggagatgaaaaatgaccgcataaaagtcagcttaagcatgaaggtggtcaaccaagggacaggaaaagatctggacccaaataacgtgattattgaacaggaagaacggcgacggcggtccttccaagactatacagggcaaaaaattaccctggaagcagtcctgaatacaacatgtaagaaatgcggctgtaaaggccattttgctaaggattgcttcatgcaaccaggcggtacgaaatactcactgattccagacgaagaggaggagaaagaagaggctaaaagtgcggagtttgagaagcctgacccaaccagaaatccgtctaggaagagaaaaaaggagaaaaagaagaaaaagcatagagataggaagtcatcagactccgacagctccgactcagaaagcgatactgggaaaagagcccgccacacgtctaaggactctaaggctgcgaagaagaaaaaaaagaagaagaagcacaagaagaagcacaaggaatag

SEQ ID NO: 18022 - DNA, 492 bp, Artificial Sequence
  Description of Artificial Sequence: Synthetic coding sequence
atgggttggcgcctccttacgcaagacgaggggccagcattggtgccaggtggtcgcctgggcgacctgtgggactaccaccagcaccggtacctgcagggggtgcctgagggcgtcagggatctgcctccaggtgttgctttgcctcttgaaagcaatctggcgttcatgaacggagtttcctttaccaagggatgttacatcggtcaggaacttacggctaggacacaccatatgggagttatccggaagcggttgtttcccgtgcggttcttagaccctctgccaacatccggcatcacccccggcgccaccgtgctgacagcctctggccagacagtgggcaagttccgagccggccaaggtaatgtaggactggcgctgctctggagtgagaaaatcaagggaccgctgcacattcgggcttctgagggagcacaggtggcgctggccgcctccgtaccagactggtggccaaccgttagcaagtag

SEQ ID NO: 18023 - DNA, 804 bp, Artificial Sequence
  Description of Artificial Sequence: Synthetic coding sequence
atggctatggaaatgcgcctgcctgttgcaagaaaacccttatctgagagattaggcagggacaccaaaaagcacctcgtggtgcccggcgatactatcacaaccgataccggttttatgagaggtcatggcacttacatgggggaagagaagctcatcgcaagcgtcgccggatctgtggaacgcgtaaacaaacttatctgtgtaaaagctttaaaaacccggtatattggtgaggtcggtgatatcgtggtcggtcggattaccgaagtgcagcaaaagagatggaaagtcgaaactaactcccgcctcgactctgtgctactgttaagttccatgaatcttcccggtggcgaactgagaagaaggtccgctgaggacgaactggccatgagggggtttctccaagagggcgatctgatctcaggcgtgttagtgcaggtctctccaagcttggtcaaaagacagaagactcattttcacgatctgccatgtggggcgtccgtgatactcgggaataatggttttatctggatttacccaactcctgagcacaaggaggaagaggcgggaggtttcatagctaatcttgaaccagtgtcactggctgaccgggaggtgatatccaggctgcggaactgcatcatctcgctcgtgactcagaggatgatgctgtatgacacctcgatcctgtactgctatgaggcgtctttaccccatcagatcaaggacattctcaaaccagagatcatggaagaaatcgttatggagactcgacagagactcttggagcaggaaggatag

SEQ ID NO: 18024 - DNA, 3111 bp, Artificial Sequence
  Description of Artificial Sequence: Synthetic coding sequence
atgccagtcttcaaggaagtgaaggtgcatctattagaggatgctggcatcgagaaagacgccgtgacccaggagacaagaatatccccttcggggatagactcggccactacggtggctgctgccactgcagcggccatagcgacagcagcacccctcatcaaagtgcaatcagatctggaagccaaagtcaactccgtgaccgagctcctgtccaagctgcaggaaacggacaagcatctacagagggtaaccgagcagcaaacaagcatccagaggaaacaggagaaactgcactgccacgatcacgaaaaacagatgaacgtctttatggaacagcacattagacatctggagaagctccagcagcagcagatcgacattcagacacacttcatctctgccgcactaaaaaccagttcattccagcctgtgtctatgccatcttctcgcgcggttgagaaatattccgttaaaccggaacacccaaacctggggtcttgtaatccctcgctctacaatacttttgcatctaagcaggcccccctgaaagaggtagaggatacttctttcgataaacagaagtctcccctagaaacacccgctccaaggagatttgcccctgttccagtgtctcgggacgacgagctgtccaagagagaaaatctgctggaggaaaaagagaatatggaggtgagctgccatagaggcaatgttaggctcctggagcagatcctgaataacaatgacagcctaacccggaagtcagaatcctcaaatactacctccctgactcgctctaagattgggtggactcccgaaaaaactaaccgatttccctcttgtgaagaacttgagactaccaaggtcaccatgcagaaatctgacgacgttttgcacgacttgggccagaaggaaaaagaaaccaacagcatggtccaaccaaaagagtctctgtccatgcttaagttacccgatctgccccagaatagcgtgaagctccaaactaccaacactactagatcagttctgaaggatgcggagaaaatccttcgcggggtacagaataacaagaaggttttagaggagaatctcgaggccattatccgggcaaaggacggcgctgccatgtactctttaatcaatgcactcagcacgaacagggaaatgagtgagaaaatccgcatccggaagaccgtagacgaatggattaagactatctccgctgagatccaggacgaactatcacgcaccgattacgagcagaaaaggttcgatcagaaaaaccagaggacgaagaaaggacagaatatgaccaaggatattagaactaacacccaggacaaaaccgtgaataaatcagtcatccctcgtaaacatagtcaaaagcagatcgaggagcacttcaggaacctgcccatgaggggcatgccagcttccagtctgcagaaagagcgaaaggagggactcctcaaagcaaccacagtgatccaggacgaggactacatgctgcaagtctacgggaagccggtgtaccaggggcatcgatccactttgaagaaaggaccgtatctccgattcaattcacccagtcccaagtcccggcctcagaggccgaaggtgatcgaacgggtcaagggaacaaaagtgaagagcatccgcacacagaccgacttctacgccacaaaacccaaaaaaatggactccaagatgaagcactccgtgcctgtactgcctcacggcgatcagcaatatctgttctctccttcccgggagatgcctactttttcgggcactctagaagggcatttgatccccatggccattctgctaggacagacacagtcgaattctgatacgatgccacctgccggggtgattgtctccaaacctcacccagtcaccgtaactacatctatccctccatccagtagaaaagttgaaaccggggtgaagaaacccaatattgcaatcgtcgagatgaaatctgagaaaaaagatccccctcaactgaccgtgcaggttttgccctccgtggacatcgatagcatcagcaacagcagtgccgacgtcctgtcgccactgtcctcacctaaggaggctagcttgcccccggtgcagacttggatcaaaaccccagagatcatgaaggtagacgaggaggaagtcaagtttcctggcaccaactttgacgaaattattgacgtcatccaggaagaggagaagtgtgacgagatcccagacagcgaaccaattctggagtttaacagatctgtaaaggcagattctaccaagtacaatggcccaccattccccccagtcgcctccaccttccaacctacggcagacatcctggataaagtcatagaaagaaaagagacacttgaaaatagtctgattcagtgggtggaacaggaaatcatgtcgaggattattagcggtctcttcccggtgcaacagcagatcgccccgagtatcagtgtctcagtgagcgagacgtcagagcctctgacatctgacatcgtggaaggtacaagctctggagccctgcagttgtttgtggacgctggcgtgcccgtcaattcgaatgtgatcaagcacttcgtcaacgaggccctggcagaaaccatcgccgttatgctaggcgatagagaagccaaaaaacagggtcccgtggccacaggggtgtctggagatgccagcacgaatgagacatacttacctgcccgcgtgtgcacgccattacccactccccagcccacaccaccttgctcgccaagctcacctgctaaagaatgcgtcttagtgaaaaccccggattcatcaccatgcgacagtgatcacgacatggccttccccgttaaggaaatctgcgccgaaaagggggacgatatgcccgctatcatgctggtcaacactccgactgttactcccacgaccacaccgccaccagccgctgctgtgtttacacccacactgtccgacatatcgatagacaaactgaaagtctctagcccagagcttcccaagccgtggggcgatggtgacttgccactagaagaagagaatccaaatagcccacaggaagagcttcaccctcgagccatgtag

SEQ ID NO: 18025 - DNA, 3351 bp, Artificial Sequence
  Description of Artificial Sequence: Synthetic coding sequence
atgtatggcagtgccagaagtgtgggcaaagtagaaccctcttcacagtcccctggtcggtcgcccaggctgccacgctcaccacgccttggtcatcgtaggaccaacagcaccggtggatcaagtggaagcagcgtgggaggggggtcgggcaagaccctttctatggaaaacatacagtcacttaatgccgcctacgcgacgtcaggtcccatgtatctatccgatcatgagaacgtgggcagtgagactcccaagtctacaatgacattggggcggagcggcggccgcctgccatacggcgtaaggatgactgctatgggatcatctccgaacattgcctcaagcggcgttgcaagcgacacaattgcctttggcgagcaccatttgccccctgtaagcatggcatcaacagttccccacagtctaaggcaggccagggacaatactattatggacctgcagacacagttgaaggaggtcctccgcgaaaacgatcttttgagaaaggacgtggaggttaaagaaagtaagttgtccagttcaatgaattctataaaaactttttggtcccctgaactcaaaaaggagcgagctctgcgcaaggatgaagcttcaaagatcaccatttggaaggaacaataccgcgtcgtccaggaggaaaaccaacatatgcagatgactatccaagcgttgcaagacgaactgaggatccagcgggacctgaaccagctctttcagcaggatagctcgtctcgtacaggcgaaccctgtgtggctgaactcaccgaagagaattttcagcggcttcacgcagagcacgaaagacaggcaaaggagctgttccttctgcggaaaactcttgaagagatggagctgcgaattgaaacccagaagcagactttgaacgcccgcgacgagtcaattaaaaagcttctggaaatgctgcagtcgaaaggactgtctgccaaggcaactgaggaagatcatgagaggaccagacggctggccgaggcggagatgcatgtgcaccatttagagagcctgctggaacagaaggaaaaagagaacagtatgctccgcgaggagatgcacagacgcttcgaaaacgctccggattcagcaaaaacaaaggctcttcagaccgtcatcgaaatgaaggatagcaagatctcatccatggagcgcgggctgagggaccttgaggaagaaattcaaatgttgaaatcaaatggcgccctaagcactgaggaaagagaagaggagatgaaacaaatggaggtgtaccggtctcactctaaatttatgaaaaacaaggtagaacagcttaaggaggagctctcctcaaaggaggctcagtgggaggaacttaaaaaaaaagctgcaggcctgcaggccgaaataggccaggtcaagcaggagttaagccgcaaagataccgagttgctggccttgcagaccaagctggagacactgacaaatcagttcagcgactccaaacaacatatcgaagtcctaaaggaatctctcacggccaaggagcagcgtgctgctatactgcagacagaggtcgatgccctgaggctccggctggaagaaaaggagaccatgctgaataagaagacaaagcagattcaggacatggcggaagagaagggaacccaggcgggggaaatccacgacttgaaggatatgctagacgtgaaggaacgaaaagtcaatgtgttgcaaaaaaaaatcgagaatcttcaagaacaactccgggataaggaaaagcagatgtccagtctgaaagaacgagtgaaatctttacaggctgatacgaccaatacagacactgctctcacaaccctggaggaggccctggccgagaaagagagaaccattgaaagacttaaagaacagcgcgatagggacgaacgcgagaaacaagaggagatcgacaactataagaaggatctgaaggacctgaaggagaaggttagccttctgcagggggatctttccgagaaggaagcgtccctcctcgatctgaaagagcacgccagctccctggcgtcttcaggcctcaagaaggattctagattaaaaaccctagagattgcactagagcaaaagaaagaagagtgtctcaagatggagtcccagcttaaaaaggcccacgaagctgcattagaagcccgggcctcacccgagatgtccgaccggatccaacatctggagcgggaaatcacaaggtataaggatgagtcttcaaaggcgcaggcggaagtcgatagactgctggaaatcctaaaggaggtggagaacgagaagaacgataaagacaaaaagatcgcggaattagagagacaggtcaaggaccagaataaaaaggtggctaatcttaaacacaaggaacaggtagaaaagaagaagtctgctcagatgttggaggaagccagaagacgggaagacaatctcaatgactcctctcagcagctgcaggactcactgaggaagaaggatgacagaatcgaggagcttgaggaggccctcagggaatctgtgcagatcacagctgaacgggagatggtgctcgctcaggaagaatccgcaaggacaaacgctgagaaacaggtggaggaacttctgatggctatggagaaggtcaagcaagaattagagtccatgaaggcaaaattatctagtacgcagcagtcccttgcagaaaaagagacacacctaaccaatttgcgtgcggaaagacgaaagcatctggaagaggttctggaaatgaagcaggaggctctgctcgccgccattagcgagaaggacgcaaacatcgctctcctggagctttcatccagcaaaaagaagacgcaggaggaggtagcggccttgaagagagagaaagaccgcctcgtccagcagctcaagcagcagactcagaaccgcatgaaactcatggctgacaattatgaagacgatcactttaagagctcgcacagcaatcagacaaatcataagccctctcccgatcagatcattcaacctctgctggagctggatcagaacaggagcaaactgaagctgtatattggtcatctcaccacactctgccacgatagggatcctctaatcttgcgtggcctcactccacctgccagttacaatcttgatgacgaccaggcagcctgggagaacgaactgcagaagatgacccgcggtcagcttcaggatgagctggagaaaggcgagagggacaacgccgaattgcaggagttcgcgaatgccatcctccaacagatcgccgaccattgtcctgatattctggagcaggtggtaaatgcattggaagaaagtagctag

SEQ ID NO: 18026 - DNA, 816 bp, Artificial Sequence
  Description of Artificial Sequence: Synthetic coding sequence
atgcgccagctccacccagaagccatcgcggctatacagtctaaggctctattttccaaagccgaggagcagttgctcagcaaggttggatcaacttcacagccaaccctggaaacttttcaggatcttctgcatcgtcaccccgacgccttttatctggcgcgaactgctaaggctcttcaggcccattggcagttgatgaagcagtactatctgcttgaggatcagactgtacagccattgccgaagggtgatcaggttttgaatttttctgatgcagaggacctcatcgacgattcaaagctgaaggacatgagagatgaagtacttgagcacgaattgatggtagccgacagaagacagaagcgcgagattcgacagttggagcaggagctgcataaatggcaggtcctggtggattccatcactgggatgagtagtcctgactttgacaaccagaccctcgccgtcctcagagggcggatggtccgttatttaatgcgatcgagagagattactctgggccgcgccactaaagacaaccagattgatgtagatctgtcactcgagggccctgcatggaagatttcacggaagcagggagtcatcaagctcaagaacaacggtgacttttttatcgctaacgagggacgccgacctatttatattgacggcaggcctgtgctctgtggctccaagtggcggttgagtaataattccgtggttgagattgccagtttaaggttcgtgtttctgatcaatcaggacctgatcgccctcatccgcgcggaagctgctaaaattacaccccagtag

SEQ ID NO: 18027 - DNA, 2751 bp, Artificial Sequence
  Description of Artificial Sequence: Synthetic coding sequence
atggaaatgccactgcctcccgatgaccaggagctgcgcaacgttatcgacaagcttgcccagttcgtggcccgtaacgggcccgagttcgaaaaaatgacaatggagaagcagaaagacaatccaaagttctccttcctgtttggcggagagttctattcgtattacaaatgtaaactcgctctggaacagcagcaactgatttgtaagcagcaaactccagagctggaacctgctgcaacaatgccacccttgcctcagcccccactggcacctgccgctccgatccctcccgcccagggggcgcctagtatggatgaactcatccagcagtctcagtggaatctccagcagcaagaacaacacctccttgcactccgccaggagcaagtgaccgcagcggtggcccacgccgtcgagcagcagatgcagaagctgctcgaggagacccagctggacatgaacgagttcgataaccttctccaaccaattattgacacatgtactaaagacgcaatcagcgccggcaagaactggatgttcagtaacgcaaagtcccccccccattgcgaattgatggccggccacctccggaatagaattactgccgacggtgctcacttcgagctccgtttgcaccttatatatctaatcaatgacgtcttgcatcactgccagcggaagcaggcccgggaactgctggccgcactccagaaggttgttgtgcctatatattgcacttcattcctcgcggtggaggaggacaagcagcagaagatagcccggctgctgcagttgtgggagaaaaacggatacttcgatgatagcatcatccaacagttacagtcccctgctctggggctgggacagtatcaggccactctgattaacgagtattcctctgtcgtgcaacctgtgcagctcgccttccagcagcagattcagaccctgaaaacccagcacgaggagttcgtgacatcgcttgcccaacagcaacagcagcagcagcagcagcaacagcaacttcagatgcctcagatggaagcagaggtaaaggccacaccacccccaccagcaccaccccctgcccccgccccagctccagccatccccccaacaactcaacccgatgactcaaagcccccgatacagatgcctgggtcctcagagtatgaggccccaggcggcgtgcaggaccctgctgctgctggcccccgtggccccggtccacacgatcagatcccacctaataaacccccctggttcgatcagccccatcccgtggcaccctggggtcagcaacagccccctgagcaacccccttatccccatcaccaaggaggtcctccccactgccccccatggaacaatagtcatgagggcatgtggggtgagcaaaggggcgatccaggctggaatggtcaacgggatgccccttggaataaccaacccgatgctgcatggaactcacagttcgagggaccgtggaattcccagcatgagcagcccccctggggagggggtcagcgtgaaccaccatttcggatgcaacgaccacctcactttcgtggcccttttcccccccaccaacagcatccacaattcaatcagcccccccatccgcacaattttaatcggtttcctccaaggttcatgcaagatgattttccaccccgccacccgtttgagagacctccttatcctcatcgctttgactatcctcagggcgacttcccagcagagatgggcccgccacatcatcacccgggccacagaatgccccatccagggattaacgaacaccctccttgggctgggccccagcacccagactttgggcctccgccacacggcttcaatggacagcctcctcacatgagacggcaggggcctccccatataaatcatgacgacccatctttggtgccgaacgtcccatattttgaccttcctgccggcctcatggcaccacttgttaaactcgaggatcatgagtacaagccgctggacccgaaagacattcgcctgccgccaccaatgcctccctcggaacggctcctggcagctgtggaggcattctattcgccaccaagtcatgatcggccccgaaattctgagggctgggaacagaacggcctctacgagtttttccgagccaagatgagggctaggagaagaaaggggcaggaaaagagaaacagcggcccctcgcggtccagatctcgctcgaaatcccgcggtcggtctagctcgcgttccaacagtcgcagcagtaaatctagcggaagttattctcgatccagatcaagaagctgcagtcggagttattcccgcagccgttctcgaagccgaagcaggtctcggtcatcacggagccggagccggtcacagagcaggagcagatcaaagagctactcgccaggaaggagacggcgctctaggagccgcagccccactccccctagctctgctgggctcgggtccaatagtgcccctccaattcccgactcacgtttaggagaagagaacaagggacaccagatgctggtgaaaatggggtggtctgggagcggcggcctcggtgccaaagagcagggtatccaagacccaataaagggcggggatgtccgggacaaatgggatcaatacaagggcgtaggagtggccctcgacgacccctacgagaactatcgccgaaataagtcatactcattcatcgccaggatgaaagcacgcgatgagtgtaagtag

SEQ ID NO: 18028 - DNA, 963 bp, Artificial Sequence
  Description of Artificial Sequence: Synthetic coding sequence
atgtctaagtcggagtccccaaaagagcccgaacagttaaggaagctgttcatcggaggcctgagtttcgaaaccacagatgaatccttaaggtctcacttcgagcaatggggcacccttacggattgcgtggtaatgagagaccccaacactaaacgtagccggggctttggcttcgtgacttacgctactgtagaagaggtggatgctgcgatgaatgcacgccctcacaaggtggacggacgggtggtcgagcctaagcgggcagtgagccgcgaggacagccagaggccgggtgcacacttgactgtgaagaagattttcgttggaggcatcaaggaagataccgaggagcaccatcttagagactacttcgaacagtatggtaagattgaggtgatcgagatcatgactgatagggggtcaggaaaaaaacggggatttgcctttgtgacgtttgatgaccatgatagcgtcgataagatcgtaattcagaagtatcacaccgtaaatggacacaattgcgaggtgcgtaaggctctcagcaaacaggagatggcctctgcgtcctccagccagcgcggtaggtctggtagcggcaacttcgggggcggcagaggtggaggttttgggggaaacgacaacttcggaagaggtggaaattttagtgggcggggagggttcggtggatcccggggaggcggtggatatgggggatctggggacggatataatggcttcgggaacgacggtagcaattttggaggaggaggcagttacaatgattttggcaattacaataatcagagctcaaactttggccctatgaagggagggaacttcggagggagatcaagcggaccatacggcgggggtggacagtactttgccaagcctaggaatcagggtgggtacggaggcagctcctcgagctcatcctatggttcaggacgtagattctag

SEQ ID NO: 18029 - DNA, 735 bp, Artificial Sequence
  Description of Artificial Sequence: Synthetic coding sequence
atggaactgaccatcttcatactcaggctcgctatatatatactgactttcccgctatacctgctaaacttcctgggactctggtcatggatttgtaagaagtggttcccctacttcctcgttcggttcacggtcatttataatgagcagatggcctcaaagaaacgagaactgttttcgaacctgcaagagtttgccggtccatccgggaagctgagtctacttgaagttggttgcggaaccggagcaaactttaaattttatccaccgggttgccgagttacttgtattgacccaaacccaaattttgaaaagttcctgattaaatctattgctgaaaaccggcacttgcagtttgagcggttcgtcgttgccgctggggagaatatgcaccaggtcgccgacggaagcgtggatgtggtggtttgcacacttgtcctgtgctctgtgaagaatcaggagcgaatccttcgggaggtctgtagggtgctcaggcctggcggcgcgttttactttatggagcatgttgcggccgagtgcagcacatggaactacttttggcaacaggtgttagaccctgcctggcatcttttgtttgatgggtgcaacctaaccagggaaagttggaaagccctagagcgggctagcttttcaaagcttaaactgcagcatattcaggcgcctcttagctgggaactggtgcgcccacatatttacgggtatgctgtcaagtag

SEQ ID NO: 18030 - DNA, 4125 bp, Artificial Sequence
  Description of Artificial Sequence: Synthetic coding sequence
atgacgtctgccgcagagatcaagaagcctccagtagcccccaagcccaaattcgtcgtcgccaataataaacccgctcctccacctatcgctccaaagcctgacatagtgatctcatccgtaccacaatccactaaaaaaatgaagcccgctatagcacccaaacccaaggtgttgaagaccagccctgtccgggagatcggacagagcccctctaggaaaattatgttaaatttagagggccataaacaggagctggccgagagcaccgataacttcaactgcaaatatgaaggtaatcagagtaatgattacattagccctatgtgcagctgctcatcagaatgtattcataaactggggcatagagaaaacttgtgcgtgaaacagctcgtactcgaaccgctggagatgaacgaaaacttggagaattctaagattgatgagacactcaccatcaaaacgcgatcgaagtgcgacttatacggcgaaaaagccaagaaccagggaggcgtcgtcctcaaagcaagcgtattagaggaggaattaaaagacgcgttaatccatcagatgccccccttcatcagtgcacaaaaacacaggcctaccgacagccccgagatgaatggtggttgtaattccaatggccagtttcggattgagtttgcggaccttagcccttctccgagtagctttgagaaggtgcctgaccaccattcttgccacctacaactgccctcagatgagtgcgaacattttgaaacatgtcaagatgacagcgaaaagagcaacaactgtttccagtcatcagagctggaagcacttgagaatggcaagagatctaccctaatttcaagcgatggtgtgtcgaagaagagcgaagtgaaagacctggggccgctcgaaatacatctggtgccctatacccctaaatttccaacacctaagccgaggaagacacgaactgcccggctcctgcgacagaagtgtgtggataccccctctgagagcactgaagagccaggcaatagcgacagcagcagtagttgtctgacagaaaactccttgaagatcaataagatcagcgtactgcatcaaaacgtcctttgtaagcaggagcaggtggacaaaatgaaattaggcaacaaaagtgagctcaatatggagtctaactcagacgctcaggacctggtgaactctcagaaggctatgtgcaacgagactacgagttttgaaaagatggcgccaagcttcgacaaggactcaaacttatccagcgattccaccactgtagatggaagctccatgagtctggccgtggatgaggggacgggttttattagatgtaccgtgtccatgtcgttacccaagcaactgaaactcacctgtaacgaacaccttcaaagtgggcgtaacctcggagtttctgcccctcaaatgcaaaaggaaagcgttattaaagaggaaaattcactaaggattgtacctaaaaaaccgcagaggcattcccttcccgccacaggcgttcttaagaaggcagcctctgaggagctgcttgaaaagagcagctatccttcctccgaagagaagtcttccgagaagtccttagaacggaaccacctgcagcatctgtgcgcccagaatcgcggagtgtcctccagcttcgatatgccgaagcgcgcctccgagaagccggtgtggaagctccctcatcccattctccctttctcggggaatccggagtttctgaaatctgttaccgtgtccagcaatagcgagccctctaccgcactgactaagcccagggcaaagagcctctctgctatggatgtggaaaagtgtaccaagccatgcaaggattccacaaaaaagaatagctttaaaaagctactttccatgaagctttccatctgttttatgaaatcggactttcagaagttctggagtaagtcctcccaattgggagataccaccacagggcacctgagctcaggagagcagaaagggatcgaaagtgactggcagggacttctcgttggggaggagaagcgcagcaaacccatcaaggcatactccactgagaattatagtcttgagtcccagaaaaagcgcaaaaagagccgggggcagacgagtgctgccaacggactgcgcgctgaatctctggacgaccagatgctgtcccgagaaagctccagtcaggctccctataagtctgtgacatctttgtgtgcgcctgagtacgagaacattaggcattacgaagagatacctgagtacgagaacctgcccttcatcatggctattcgtaaaactcaagagttagaatggcagaactccagtagtatggaagacgctgacgccaacgtttacgaggtggaagagccttacgaggccccggatgggcaactgcaactggggccgagacaccagcattcctcatctggagcaagtcaagaggagcagaatgacttgggtctgggagatctccccagcgatgaagaggagattatcaattcatcagatgaagacgacgtgtcatctgagtcatctaagggagaacctgaccccctcgaggataaacaggatgaggataacggtatgaaaagcaaggtgcatcacattgccaaggagataatgtccagcgagaaggttttcgtggacgtgctcaagttgttacatatcgactttagagacgctgtggcccacgcctcccgtcagttaggtaagccagttattgaagaccggatcctaaatcagattctgtattatcttccccaactgtatgagttgaaccgtgatcttttgaaggaactggaagaaaggatgctgcactggacagaacagcaacgcatcgcagacattttcgtgaaaaagggtccttatctgaagatgtatagcacctatatcaaggagtttgacaaaaatattgccctgctcgatgaacagtgcaaaaagaacccaggatttgcggctgtggtgcgggaatttgagatgagtccaagatgtgccaacctcgctctaaaacactatcttttgaagccggtacagaggattccccagtataggctcctcctgactgactatctcaaaaacctcattgaagacgctggtgactatagggacactcaagacgctctggcagttgtgatcgaggtggctaatcacgccaatgataccatgaaacaaggagacaatttccaaaaattgatgcaaatacagtatagtttgaatggtcaccatgaaatcgtccagcccggcagagtgttcctcaaggagggtattcttatgaagttgtctaggaaagtcatgcagccccgcatgttctttctgttcaacgatgctctcctgtacaccacgccagtccagagcggcatgtataagctcaataacatgctgtctttagccgggatgaaggtgcgcaagccaactcaggaggcttatcaaaatgaactgaaaatagagagcgtggagcgcagcttcatcctctcagcttcaagcgcaaccgagagggatgaatggctcgaggctatcagcagagccatcgaggagtatgctaagaagagaattacattctgtccttccagaagcttggatgaggccgactctgaaaacaaagaagaggtgagcccactgggctctaaggctcccatttggattccggatacccgggctaccatgtgtatgatttgtacgagcgaattcaccctcacctggcgacgccaccactgcagagcctgtggtaagatcgtgtgccaggcctgcagttcaaacaaatatggtctggactaccttaagaaccagcccgccagggtgtgcgaacattgctttcaggaactgcagaaactggatcaccagcactctccaaggatcggatcccccgggaatcataagagtccaagttcagcgctgagctcagtgttacattctatcccttcagggcgcaagcagaagaaaatccccgccgcgttgaaagaggtcagtgcgaacactgaagattccagtatgtctggttacctgtatcggtccaaggggaataaaaagccctggaagcacttctggttcgtcattaagaataaggtcttgtatacgtatgccgcatcagaggtcagatccgagatctag

SEQ ID NO: 18031 - DNA, 1446 bp, Artificial Sequence
  Description of Artificial Sequence: Synthetic coding sequence
atggcttcggctgccagcgtcaccagcctagccgatgaagttaattgcccgatatgtcagggtacgctgagagagccagtgacaatagactgtggacataatttttgcagagcctgtttgaccaggtactgcgaaattcctgggcccgacctcgaagaaagcccaacttgccccctgtgcaaagagccctttaggcctggctcctttcgtcccaactggcagcttgctaatgttgtggagaacatcgagcgtctgcagctagtgagcacactggggctcggcgaggaggatgtctgtcaagaacacggcgagaaaatatacttcttttgtgaagacgacgagatgcaattatgcgtagtatgccgtgaggctggcgaacatgccacccacactatgagattcctggaggatgccgcagctccctaccgagagcagattcacaaatgtctgaagtgtttaagaaaggagcgcgaagagatccaagagattcagtcaagggagaacaaacgcatgcaggtccttcttacacaggtgagcaccaagcgacaacaggtcatcagcgagttcgcccacctccgaaaattcctggaagaacagcagtctattcttctggctcagcttgaaagtcaagacggggacatcctcaggcaaagggatgaattcgatcttctcgtggcaggcgagatatgcaggtttagcgcactaatcgaagagcttgaggagaaaaatgagcgccccgcaagagaactgttgactgatatccgatccaccctaatccgctgcgagaccagaaagtgcaggaaacctgtcgccgtttctcccgaacttggtcagcgcattcgcgacttcccccagcaggcgctgcctctccagcgagaaatgaagatgtttctggaaaaccttcccaatcatctagtcattcctaccgcccacatctccctggacccccagaccagtcaccctaaactgttgttgtcagaggaccaccagcgggcgcagttctcttacaaatggcaaaattcccccgacaatccccagagattcgacagggccacctgtgtccttgcgcacactgggattacaggtggccgacatacctgggtagtctccatcgacttggcccacgggggttcttgtaccgtgggggtcgtgtccgaggatgtccaacggaagggagagctcagactgcgaccagaggagggcgtatgggctgttcgcctagcttggggctttgtatccgctctgggatcgtttcccacccgtctgactcttaaggagcagccccgccaggtgcgggtgtcattggattacgaggtcgggtgggtgaccttcacaaacgcggtaaccagggagcctatttatacgttcaccgcaagtttcacgcgcaaggtgatcccattctttggactgtggggcagaggctcgtccttcagtttaagctcctag

SEQ ID NO: 18032 - DNA, 468 bp, Artificial Sequence
  Description of Artificial Sequence: Synthetic coding sequence
atggacacaatgatgctaaatgtccggaacctcttcgagcaactagtaagaagagtagagatactcagcgaaggcaacgaggtacagttcattcagctagccaaagactttgaggactttaggaagaagtggcagcggacagaccacgagctgggcaaatacaaggacctgctgatgaaggccgaaaccgagcggagtgcactagatgtcaaactgaagcacgcacggaatcaagtggatgttgaaatcaaacgtaggcagagagcagaagctgattgcgagaagctggagcggcagatccaactgattagggaaatgttaatgtgtgatacttccggatccatacagctctccgaagagcagaaaagcgcactggcgttcctcaatcggggccagcctagtagctccaatgccggcaataaaagactgtctaccattgatgagtccgggagcatcctctccgactag

SEQ ID NO: 18033 - DNA, 420 bp, Artificial Sequence
  Description of Artificial Sequence: Synthetic coding sequence
atggacaccatgatgctcaatgtgaggaacttgtttgaacagctggtgaggcgagtggaaattttgagtgagggaaatgaggtgcagttcatccagcttgctaaggatttcgaggattttcgcaagaaatggcagagaactgaccatgagctggggaagtataaggatctccttatgaaagcggagactgaaaggtctgcacttgacgtgaagctgaaacatgctaggaatcaggtcgatgtggaaataaaacgtcggcaacgtgccgaagctgactgcgagaagctcgaaagacagattcagctgattcgagagatgctgatgtgcgatacaagtggctcaatacagttatccgaggagcaaaagagcgcccttgccttcctaaaccggggccaaccctctagctccaatgccggatag

SEQ ID NO: 18034 - DNA, 3282 bp, Artificial Sequence
  Description of Artificial Sequence: Synthetic coding sequence
atgggcggcaaggcctggcccagacgcgctgtggggaccgccggtggtccctgtgccgaacagatcagtgcgccattccagactctgttaatgccacatctgcctttggcatcctttcgtcccccgttttggggcctcaggcattctagaggcctgcctcgattccacagcgtctccacccagtctgaaccacatggatcaccaatctcccgccggaatcgggaggctaaacagaagagactgcgagagaagcaggccacactggaggctgagattgccggcgaatctaaatctccagcagagtccatcaaggcctggcgtcctaaagagctagtgctttatgagattcccaccaaacctggagaaaagaaagacgtgtccgggcctctgccaccagcctacagtcctcgctacgtggaggctgcctggtacccatggtgggtgagagagggctttttcaagccagagtatcaggctcgccttccgcaggcaacaggggagaccttcagtatgtgtattccacctccaaacgttactggctcattgcacataggccacgctctcacagtggccatccaagatgcactggtccgttggcaccgcatgaggggagaccaggtcctgtgggtaccgggctctgaccacgccggtattgcaactcaggccgtggtcgagaagcaattgtggaaggagagaggggtccgccggcacgagcttagccgcgaggcgttcttgcgcgaggtatggcagtggaaggaagccaaaggaggcgaaatatgcgaacagctcagagccctaggcgcttcgttggattgggaccgggagtgcttcaccatggatgttggtagtagtgttgcagtgaccgaggcttttgtgcgcttgtataaggccggattactgtataggaaccaccaattggtgaattggtcctgtgccttgagaagcgctatttcagacatcgaagtcgagaacagaccactgccaggccatacccagttaaggctccctggatgccccacaccagtcagtttcggcctgctattcagcgtggcttttcctgtagacggggagccagacgccgaggtggtggtgggcaccacacgaccggaaactctcccaggcgatgtcgccgtggcagtgcatccagatgactcaaggtatacacacctacatggaagacaactgcgccatccccttatgggccaacccctgcctctgatcacggattatgccgtacagccgcacgtcggtacaggagcagtgaaggtgacacccgctcactcccccgctgatgctgagatgggcgcaaggcacggacttagccccctcaatgttatagctgaagatggcaccatgactagcctatgtggagattggctccagggcctgcaccgatttgtagcacgtgagaaaatcatgtctgtgctctctgagtggggactttttagaggcctgcaaaaccaccccatggtgctgcctatttgcagtagaagtggtgatgtgattgaatatctgcttaagaatcagtggttcgtcaggtgccaggagatgggcgccagggccgctaaggccgttgaatccggtgctctggaactttcaccatcatttcatcagaaaaattggcagcactggttcagtcatattggagattggtgcgtctcccgccagttgtggtggggccaccagatccccgcatatctagtcgtggaagaccatgcccaaggtgaagaagactgttgggtggttgggcgttctgaggccgaagctagggaagttgcagcggagcttaccggcaggccaggagccgagctgacactagagcgcgatccggacgtgctggacacatggtttagcagcgctctgtttcctttttctgccctcggttggccccaagagacaccagatctggcccgattttatccactgtcgcttctggaaaccgggtctgacctactgctgttctgggtagggcggatggtaatgctgggtacccagttaacgggacaactaccatttagtaaagtgctccttcacccaatggttagagatcgacagggcaggaagatgtctaagtctctcggcaacgtactggatcccagggacatcataagtggtgttgaaatgcaagtattgcaggagaaattaagaagtggcaacctcgaccccgccgagttagcaattgtggccgctgcccagaaaaaagatttcccccacggaatccccgaatgcggaacagacgccctgcgcttcacgttatgcagccacggggtgcaggctggcgatctccatctttcagtgagcgaagttcagagctgccgccacttttgcaataagatctggaatgcacttcgctttattcttaatgccttgggcgagaagtttgtgccccagcctgcagaggaactgagcccttcttctcctatggatgcgtggatactctcacggctagcattggccgctcaggagtgtgagcgaggcttcctaacaagagaactgagcctagtgacacatgcactgcatcatttttggcttcataacttgtgtgacgtctacctggaagccgtgaagccagttttgtggcacagcccgcgtccattgggtcccccacaggttctcttcagttgcgcagatctcggactgcgcctcctggcaccactgatgccgtttctggccgaggagctgtggcagcggttgccacccaggccaggctgcccaccagccccaagcatctctgtggcaccatacccatccgcctgttccctggagcattggaggcagccggaactggaaaggaggttcagccgtgtccaggaggtcgtacaggtgttgcgggccctgcgagccacttatcagctgactaaagcacgccccagggtcctgctgcagagcagcgagcctggagatcagggacttttcgaagcctttttggaacctctgggaacacttggttattgcggggctgtgggcctcctgcctccaggggcagcagctccatcagggtgggcccaagcacccctgagcgatacagctcaggtgtatatggaattgcagggtctcgtagacccccagatccagttaccacttctcgcggcgcggcgttataaattgcagaaacaacttgattccctgacagccaggactccatcagagggcgaggctggaactcagaggcaacagaaactttcaagcctgcagcttgagctctctaagttggacaaagcagccagccatttaagacaactcatggatgagccccctgcccccgggagccctgaactctag

SEQ ID NO: 18035 - DNA, 231 bp, Artificial Sequence
  Description of Artificial Sequence: Synthetic coding sequence
atgaatagtgtcggcgaagcatgcaccgatatgaaaagagagtatgaccagtgtttcaatcgatggtttgctgaaaagtttctgaaaggcgatagtagtggagatccctgtaccgacctatttaaacgctaccaacaatgcgtgcagaaagctattaaggagaaagaaatcccaatcgagggcctggagtttatggggcatggcaaggaaaaacctgagaactcctcatag

SEQ ID NO: 18036 - DNA, 735 bp, Artificial Sequence
  Description of Artificial Sequence: Synthetic coding sequence
atggaactcaccatctttatcctgaggttggccatctacatcctcaccttcccactgtatctcctaaactttctcgggttgtggtcttggatctgcaagaagtggttcccatatttccttgtacgctttaccgtcatctataacgaacagatggcctctaaaaaaagggagctcttttctaatctgcaagagttcgctggaccatctggcaaactgtcgcttctcgaagtgggatgcggtaccggcgccaacttcaagttttaccctccaggttgtagggtgacatgtattgacccgaaccctaactttgagaagtttctgatcaaaagcattgcagaaaataggcacctccagttcgaacggtttgtggtcgcggctggggagaatatgcaccaggtggcggacggatcagtcgacgttgtggtctgcaccctggtgttatgttccgtgaagaaccaggagaggattctgagggaggtgtgccgtgtgttgcgtcctggcggagcgttctatttcatggaacacgttgccgcagaatgtagtacttggaactatttctggcagcaggtgctggatcctgcttggcacctcctttttgacggctgtaacttgacgcgggagagctggaaggccctggagagggcatcattctccaaattgaagttgcaacatatacaggctcctctgtcctgggaacttgtacgcccccatatttacggttatgcagtcaagtag

SEQ ID NO: 18037 - DNA, 774 bp, Artificial Sequence
  Description of Artificial Sequence: Synthetic coding sequence
atgccccaccttcctctggcaagctttaggccgccgttttggggcttaaggcattcaaggggattaccacggtttcactccgtgtccacgcaatctgagccccacggatcccctatttctcgtcgcaaccgtgaggccaagcaaaaacggctaagggagaagcaggccacattagaagccgagatagcaggggagagcaaatccccagctgaatccattaaggcctggcgtcctaaggaacttgtgctttacgaaataccaacaaagcctggtgaaaagaaggacgtgtctggcccgctgcctccggcatattctcctcgatacgtcgaggcagcatggtacccttggtgggttcgcgaggggttttttaagccggaataccaggccaggctgccacaggctaccggtgagacattctctatgtgtatacctccccccaacgtcacaggatcactgcacatcggccatgccctcaccgtggctattcaggatgctctcgtaaggtggcataggatgagaggcgatcaagtgctatgggtgcccgggagcgaccacgccggaattgcgacacaagctgtcgttgaaaagcagctgtggaaagagcggggcgtgcggaggcacgaactgagtcgggaagcttttctccgggaggtgtggcagtggaaggaagctaaggggggcgagatttgtgagcaattacgagccctcggcgcatctctggactgggaccgggtcttttaccacggctgttggctgctatctggatgcgattag

SEQ ID NO: 18038 - DNA, 804 bp, Artificial Sequence
  Description of Artificial Sequence: Synthetic coding sequence
atgagtaaatccgaaagcccaaaggagcccgagcagctaaggaaactgttcattggcggattgtcttttgaaaccactgatgagtcactcagatctcacttcgagcagtggggcacgttgacggactgcgtggtgatgcgcgatcccaacaccaagagatcaagaggtttcggattcgtgacatacgccactgtcgaggaagttgatgcagccatgaatgctcgtccgcacaaggtcgatgggcgcgtggtggagccaaagcgcgccgtctcccgtgaggatagccagagacctggggcccatctgactgtgaagaagatctttgttgggggaatcaaggaggacaccgaggagcaccacctgcgtgactattttgagcagtatgggaagatcgaggtaattgagataatgacggatcgtggatctggcaagaagcggggctttgcgttcgttaccttcgatgaccacgacagcgtggacaagatagtcattcagaagtaccacaccgtcaatgggcataattgtgaggtgcggaaagccctgagcaaacaagagatggcgtctgcatcatcatctcaaagaggccgatccggctccggcaattttggagggggcagctataacgattttggtaattataataatcagagctctaatttcggcccgatgaaaggtggcaacttcggcggcaggtcgagcggaccatatggtggcgggggtcagtacttcgccaaaccaaggaatcagggaggctatggaggctcctcttcttcttcctcttatggcagcgggaggcgattctag

SEQ ID NO: 18039 - DNA, 531 bp, Artificial Sequence
  Description of Artificial Sequence: Synthetic coding sequence
atgaatgaatccaaacctggcgatagtcagaacctggcttgcgtgttctgccggaagcacgacgactgcccaaataagtatggggaaaaaaaaactaaagaaaaatggaacctgacggtgcactactactgtctgctcatgtctagcggaatctggcagagggggaaagaagaagagggagtctacggctttctgatcgaagacattcggaaagaggtcaaccgcgcctccaaactgaagtgttgcgtttgtaagaagaacggtgcgagtataggatgtgtcgctcccagatgtaaacggtcataccatttcccatgcggactacaacgtgagtgcatttttcaatttactggtaactttgccagtttctgctgggatcatagacctgtgcagattatcacctccaataattaccgagagagtttgccatgtacaatctgcctggagtttatagagcccataccatcttataacatcctcaggtccccatgctgtaaaaacgcttggtttcaccgggactgcctacagtag

SEQ ID NO: 18040 - DNA, 3171 bp, Artificial Sequence
  Description of Artificial Sequence: Synthetic coding sequence
atgctcagtgttgtggagaacggccttgacccccaagccgctatacctgtcattaagaaaaagttggtcggctcagtaaaagccctgcagaagcaatacgtctcacttgacaccgtagtaacttctgaggatggcgacgcaaacactatgtgttcagcacttgaggctgtctttattcacgggctgcatgccaagcacattcgcgctgaggcgggaggcaagcgaaaaaaatcagcacatcagaagcccttaccacagcccgttttctggcccctgctcaaggcagtcactcacaagcacattatctccgagttagagcatttaacctttgttaacaccgacgttggaaggtgcagggcttggcttcggcttgcgcttaacgatgggctgatggagtgctaccttaaactccttcttcaagaacaggccagattgcatgagtattatcagcctacagcattgttacgggacgctgaagagggagaatttctgctcagttttctgcagggccttacatcactctcctttgagctttcatataagtctgcgattctaaacgaatggactctgacacccttggcactaagcggtctatgtcccctgagtgagctggacccactctcaacctcaggtgccgagctccagcgcaaggagtccctcgatagtatctcccactcttctggctctgaagatatcgaggtacaccattccggacacaaaattaggcgcaatcaaaaactgaccgcttcctctcttagtcttgacaccgccagttcttcacagctgtcttgctccttgaacagtgactcgtgccttcttcaagaaaacgggtccaaaagtcctgaccactgcgaagaacctatgtcctgtgactctgaccttggaactgctaacgctgaggattccgatcggtctctgcaggaagtgctgttagaatttagcaaagcgcaggtgaactccgtcccgaccaatggcttatctcaagaaaccgagattccaacgcctcaagcgagtctgagcctgcatggtctgaacacaagtacctatctgcattgtgaagcccccgcagagccacttcccgcccaagccgcttcaggaacccaggacggcgtccacgtccaggagccaaggccacaggctccgtcccccctggacctccagcagcctgtggaaagcacctctggacagcagccttcatctaccgtgagcgagacagcacgggaggtggggcagggcaatggtcttcagaaagcacaggctcacgacggcgcagggcttaagttggtggtgtcgtctcctacctcgccgaagaacaagtcctggatttccgaggacgatttctatcgccccagtagagagcagccacttgaatctgcatccgaccatccgatagccagctacaggggtacacctggtagccgcccaggcctgcatcgccacttcagccaggagcccaggaaaaattgttcacttggtgccctggatcaggcatgcgtgcctagccccgggcggcgtcaggcccaggcggctccgagtcagggccacaagagtttccgggtggtgcaccgccgacagatggggctgtccaaccccttcagaggacttatgaagttgggtaccgtggagagacgcggcgccatgggcatctggaaggagctgttctgtgaactctcccccctggagtttcggttgtatctgagtaacgaggagcacacctgcgtcgagaactgcagcctgctgcgttgcgagtctgtaggccctgcccattccgacgggagattcgaactggtgttcagtggaaagaagttagcacttcgcgccagttcccaggatgaggcagaagattggctagatagggtcagagaagcgctgcagaaggttcgacctcagcaagaagatgaatgggtgaatgtgcaataccccgatcaaccagaggagccaccagaggctccgcaagggtgcctgtcaccctctgacctgctctcggaaccagctgcgctccaaggaacacagtttgactggtccagtgctcaggtaccagagcccgatgcaatcaaggagagtctcctttacctgtacatggaccgaacatggatgccttatatcttcagcctcagtcttgaggctttgaaatgttttcgtatccgcaacaatgaaaagatgctgagtgattcacacggtgtggaaaccatacgagacatcctccctgatacatccctgggaggcccttctttcttcaaaatcatcaccgccaaagccgtgctgaaactgcaggccgggaatgccgaagaggcagctttgtggagagatcttgtgcggaaagtcctggcttcctacttggagaccgcagaggaggccgtaacactcggtgggagtctggacgagaattgtcaagaggtactgaaattcgcaacaagagagaacggtttcttgcttcagtatctggtcgcaatccctatggaaaagggattggattcacagggttgtttctgtgctggctgcagcaggcagattggcttctctttcgtgagacccaaactttgtgccttttccggactatactattgcgatatttgccaccaggatgacgcttctgtaatccctgctcgaataatacataactgggatctgacaaaacggccaatttgccgacaggcactaaaatttctgacccagatccgggcccagcccctgatcaaccttcagatggtgaacgcctccttatacgagcatgtagagcgtatgcatctgatcggccgccggcgggaacagctcaaactactgggggactatctgggactgtgcaggtccggcgctttgaaggagttaagcaagcgcctcaaccaccggaattatctcctcgagtccccccacagattttctgtggcggacctacagcagattgctgatggtgtgtatgagggctttctgaaagccttgatagagttcgccagccagcacgtgtaccactgcgatttgtgcactcaacgtgggttcatttgccagatatgccagcaccacgatatcatctttcctttcgagttcgacactacagtgcgatgcgctgaatgcaaaacagtattccatcaaagctgtcaggccgttgtcaagaaggggtgtcccagatgcgctcgccgacggaagtatcaagaacaaaatattttcgcctag

SEQ ID NO: 18041 - DNA, 390 bp, Artificial Sequence
  Description of Artificial Sequence: Synthetic coding sequence
atggcagagctgattcagaaaaaattgcagggtgaggtggaaaaatatcaacagcttcaaaaagatttgagcaagtcaatgagtggacggcaaaagctggaagcccagctcacagaaaataatatcgtgaaggaggagttagccctactagatggcagcaacgttgtcttcaaactccttggtccagtgctggtgaaacaagagttgggggaggcccgtgcaactgttggcaaacgtctcgactacataaccgctgagataaagagatatgagagccagctccgagatctggaacgtcagtcagaacagcagagggagacgctggcccagctacaacaagaatttcagagggctcaggccgccaaagcaggggctccgggcaaagcgtag

SEQ ID NO: 18042 - DNA, 348 bp, Artificial Sequence
  Description of Artificial Sequence: Synthetic coding sequence
atgacaaaaaagagacgcaataatggtcgcgccaagaagggacgaggccacgttcagcccattagatgtaccaattgtgcaaggtgcgtgccgaaggacaaagcgatcaagaaattcgtcatccggaacatcgtcgaagccgcagccgtacgcgacattagcgaggtgagtgtcttcgatgcctacgttctgcccaaactctacgtcaaactgcattactgtgtgtcttgtgcgatccactccaaggttgttcgtaatcgcagccgcgaggcacggaaggatcgcacacctccccccagattccggcccgctggcgccgccccagggcctccacctaagcccatgtag

SEQ ID NO: 18043 - DNA, 1899 bp, Artificial Sequence
  Description of Artificial Sequence: Synthetic coding sequence
atggacactatgatgctgaacgtccgcaatctgttcgaacagctagtgagaagggttgagatcctctccgaaggcaatgaagtgcagtttattcagctggccaaggactttgaagattttaggaaaaagtggcagcggaccgatcatgaactgggaaagtataaagatcttcttatgaaagctgagacggagagatccgcactggatgtgaagttgaagcatgccaggaaccaggtggacgtcgagattaaacgacggcagagggctgaggctgactgcgaaaagctcgagcgacagatccaattgataagagaaatgttgatgtgcgacacttccggaagcattcagctttcagaggagcagaagtcagctttggccttcctcaacagaggacagcccagttcaagcaatgccggtaacaaaaggctgagcacgattgacgagtctggcagcattttgagtgatatctccttcgacaagacagacgagtctctggactgggatagtagtctggtgaagacctttaagcttaagaagcgtgaaaaaaggcgctctacctccagacagtttgtagacggacctccaggccctgtgaagaagacacgctcgattgggtccgccgtcgaccaaggtaatgaatccattgtagcaaaaaccaccgttaccgttcccaatgatggggggccaatcgaagccgtgtctaccattgaaaccgtgccttattggacacgcagccgacggaagactggtactttgcaaccatggaactccgacagtaccctgaacagccggcagttggagccacgcacagagacagactccgtaggaactccccagtccaacggaggcatgcggctgcacgacttcgtcagtaagaccgtcatcaagcccgagtcctgcgtgccatgcggtaagcgcattaagtttgggaaactgtctctgaaatgccgagattgcagggtcgtgtcgcaccccgaatgtagagataggtgtccactgccttgcattccaactctgatcgggacacctgtgaagataggagaaggaatgctcgctgattttgtgagccagaccagcccaatgataccttcaattgtagtgcattgtgtcaatgaaattgaacagcgggggctgacagaaacgggcctctacaggatctcaggatgcgaccggaccgtcaaggaacttaaggaaaagttcctgagagtgaagactgtccccctcctgagcaaggtcgatgacatacatgcgatatgtagcctgttgaaagacttcttgaggaacctaaaagagccactcctgacctttcgcctgaatagagcttttatggaggcagccgaaattaccgacgaggacaactccatcgccgctatgtatcaagctgtgggggagctgccgcaggctaatcgagatacattggcctttcttatgatccacctccaacgagtggcacagtcaccccacacaaaaatggatgttgccaacctcgcaaaggtgtttggccctactattgtcgctcacgcggttccgaacccggaccctgtcactatgctgcaggatataaaaagacagcctaaagtcgtagagagactcctctcactgccactggaatactggagccagtttatgatggttgagcaagaaaacattgaccctttgcacgtgatagagaactccaacgcgttctccaccccccagacacccgatattaaggttagcttattaggacccgtcactacgccggagcatcaactgttaaagacgccctcaagctcaagcctgtcacagcgtgttcgttctactttaacaaagaacaccccgcggtttggctctaaaagcaagtccgccacgaacttaggtagacaggggaactttttcgcatcccctatgctgaagtag

SEQ ID NO: 18044 - DNA, 390 bp, Artificial Sequence
  Description of Artificial Sequence: Synthetic coding sequence
atggccgagttaattcagaagaagctccagggagaggttgagaagtaccaacaactgcaaaaggaccttagcaaaagcatgtccggtagacaaaaattagaagcccaattaaccgagaacaatattgtaaaggaggaacttgccctcctcgatggtagtaatgtggtttttaagctcctggggcccgtgctcgttaaacaggaactgggggaagccagagccacagtaggtaaacgcctcgactacattaccgctgagatcaagaggtatgaaagtcaactgagggacttagagcgtcagtcagagcaacagagggaaaccctggcccagctgcagcaggagttccaaagggcgcaggctgcaaaggctggggcacctggaaaagcctag

SEQ ID NO: 18045 - DNA, 5220 bp, Artificial Sequence
  Description of Artificial Sequence: Synthetic coding sequence
atgatggaggggaacgggacagagaattcatgctcccggaccagggggtggctgcagcaggacaatgatgctaaaccctggctttggaagttctcgaactgtttctcccgcccagagcagacattgccccattcaccccagactaaggagtacatggagaacaagaaggtcgctgtcgagctgaaggatgtgccttcaccgctccacgctgggtccaagctgtttcctgcagtccctctacctgacatccgttcactacagcagcctaagattcagctctcgtcagtgcccaaggtcagttgctgcgcccactgtccaaatgaacctagcaccagtccaatgcgttttggcggaggtggaggcggcagcgggggcacttcgagcctgatccatccaggagcattgttggactcacagagcacgcgcacaatcacttgccaagtcggaagcggatttgcatttcagtcagcctcaagccttcagaatgcatccgctcgaaacaacctggcagggatcgcctctgatttcccctccatgtgtctggaaagcaatctttcctcctgcaagcatttaccgtgctgtggaaagctgcattttcagagctgtcacgggaacgtccataagctgcaccagttcccttccttacagggatgcacgagcgctgggtattttccttgctcagattttacctccggagccccgggacacctggaagagcatatctctcagtccgagctgacaccacacctctgcaccaattcgctgcatctgaacgtggttccccctgtctgtctgaagggcagcctctactgcgaagactgcctgaataaacctgccagaaacagtatcatagacgctgccaaggtctggcccaatattcccccacccaacacacaacccgcaccccttgccgtgccactgtgcaacggttgtgggaccaaaggaactggaaaagaaaccacactgctactagccacaagcctgggaaaagccgcttccaaattcgaggtggctgtggctggccaggtgttggagaatctgccccctatcggagtattttgggacatcgagaactgctcagttccttccggccggagtgcgaccgccgttgtgcagcgcatccgcgaaaagttttttaagggccaccgggaagctgaatttatatgcgtctgcgatatttcaaaggaaaataaagaggttatacaggaactcaataactgccaggttacagtggcccacatcaacgctactgcaaagaatgccgccgacgacaaattgcgtcaatcacttcggcgcttcgctaatacacacactgctcccgccaccgtagtgctggtcagcactgatgtaaacttcgccctggagctatccgatctgcgacatagacatggttttcacataatcctcgtgcataaaaaccaggccagcgaagcgctgctgcatcatgctaatgagctcatcagatttgaagagtttatctccgatttgcctccaagactgccacttaaaatgccacaatgtcatacattgctgtacgtgtataacctccctgcaaacaaagatggaaaatccgtgtctaaccggctgcgccggctaagcgacaactgcggcgggaaagtgttaagcattacagggtgcagcgccatcctcagattcattaatcaggactctgccgaaagggctcaaaagcggatggaaaatgaggacgtgtttggcaaccggattatcgtctccttcactcccaagaatagagagctgtgcgaaactaaaagcagcaatgctatcgccgacaaagtcaagtcgcctaaaaaattaaagaaccccaaactttgcctcatcaaagatgctagcgagcagtcctccagcgccaaagcaactccaggtaagggcagtcaggctaatagcggctcagccacgaaaaataccaacgtaaagtctttgcaggaactctgcagaatggagtcaaaaacaggccaccggaactccgaacaccagcagggacatctccgtctggtagtccccacccatggaaattccagcgctgctgtgagtacacccaaaaattccggtgttgccgagcccgtctataagacttcccagaaaaaagaaaatctctccgcccgatccgtgacctcctctcccgttgaaaagaaagataaggaagagaccgtgtttcaagtttcatatccctctgctttctcaaaactggtggcttcacgccaggtcagcccattgctggcttcacagtcatggtcatctcggtccatgtctcccaatctgctcaatagggcctccccacttgcttttaatatcgcaaacagttctagcgaggcggattgtcccgacccattcgctaacggcgctgacgtgcaggtctccaatatcgattacagattgtcgcgaaaagagctccagcagttgttgcaggaggcctttgctcgtcacggaaaggtcaaatccgtagaactctctccacatactgattaccagcttaaagcagtggtacagatggagaatctgcaggatgctattggtgcagttaatagtctacataggtacaagataggttctaagaagattttggtgtctctggcaaccggtgccgcctcaaagagcttgtctctcttatccgccgagacaatgagtgtgcttcaggacgcacctgcttgttgcctcccactgtttaaatttaccgatatttatgagaaaaaatttggacataagctgaacgtatccgatctctacaaactcaccgatacagtcgcgatacgcgagcagggtaatggcagactggtgtgcctgctgccctcttcccaggcaaggcagagccccttaggatccagccaatcccacgacggctctagcactaattgctcaccaatcatcttcgaagagctggagtaccacgagcctgtgtgcagacagcactgctccaataaagatttttccgagcacgagtttgatccagattcttataaaatcccattcgtaatcttgagtttaaaaacatttgcaccccaggtgcactcgttattgcagacccatgagggaaccgttcccctactgtcattccctgactgctacatcgccgagttcggagacctggaagtggtgcaagagaatcagggaggggtgccactggaacatttcattacatgcgtcccaggtgtgaacatcgccacggcccagaacggcataaaggtggtgaagtggatccacaacaagccccctcctcccaataccgatccatggctgctgcgatctaagagccccgtggggaatccacaactgatccagttctctcgggaggtgatcgatctgctgaagtcgcagccatcttgtgtcattcccatcagtcacttcatcccctcttatcaccaccacttcgccaagcagtgccgcgtgtctgactacggatacagcaagctgattgagcttttggaggccgttccacacgttcttcagattctggggatgggtagcaaacggctcctgacactaacacacagagcccaggtgaaaagatttacccaggatcttctcaagctcctgaaaagccaggcttccaagcaggtgattgtgcgagaattcagccaagcatatcactggtgtttttccaaagattgggacgttactgagtatggcgtctgcgaacttatcgatatcgtatcggagatccccgataccacaatttgcttgtcccagcaagataacgaaatggtgatatgtatcccgaaacgcgagcgcactcaagatgaaattgagcgcactaagcagttttcaaaagatgttgtggatctgctgcggcatcaaccgcactttagaatgccttttaacaaattcatcccatcgtatcatcatcatttcggccgacagtgcaaacttgcatactacggctttaccaagctactcgaactgtttgaggcgattccagatactctgcaggttctagagtgcggagaagaaaaaatcctgacattaacggaagttgaacggtttaaggccctggccgcccagttcgtaaagctactgagaagccagaaggataattgtctgatgatgacagacctcttaaccgaatacgccaagacatttggctacactttcaggttacaggattatgacgtaagctccatcagcgctctgacgcagaagttatgccacgttgtgaaagtggccgacatagagagcggccggcagatccagctgatcaaccgaaagtccctgcgaagtttgacagcacagttgcttgtcctgcttatgtcttgggagggcaccactcacctgagtgtggaggaactcaagcgacactacgaatctacccataacacacccctgaatccctgtgaatatggattcatgactctgaccgagttgctcaaatcgctcccatacctggtcgaggtgttcactaatgataaaatggaagagtgcgtcaagctaacgtcactgtacctgtttgcaaagaacgttcggagcctgctccatacttaccactaccaacaaatattcctccatgagttttctatggcttatacaaaatatgtgggcgaaactctacagcctaagacctacggacatagcagcgtcgaggagttgctgggtgctatccctcaggttgtgtggatcaaaggccacggccacaagcgcatagtggtattaaaaaatgatatgaagagccgactaagttccctgagtctgtcccctgccaaccatgagaatcaaccatcagaaggagagcgcatactggaggtaccagagtctcacacagcaagcgagcttaagctaggggcagatggctctggtcccagccataccgaacaggagttgctaagactgactgatgactcacctgtcgacctgctttgcgcccccgtgccttcctgcctcccatctcctcagctgcggcctgaccccgtgatcctacaaagcgccgacttgatccagttcgaggagaggccacaggagccttcagagatcatgatactaaatcaggaagaaaaaatggagatccccatccctgggaagtccaagaccctaactagcgactcttctagctcatgtatcagtgctgccgtcccagttcccccatgtccatcctccgagacaagtgagtccctgttaagcaaagatccagtcgaatcccccgcaaagaagcagccaaagaatcgcgtgaagctagcagccaatttctccctggcacctatcactaaactgtag

SEQ ID NO: 18046 - DNA, 390 bp, Artificial Sequence
  Description of Artificial Sequence: Synthetic coding sequence
atggctgaactcattcagaagaagctccagggggaggtcgaaaagtatcagcaactccagaaggacctctctaaatctatgagtgggagacagaagctagaagcccagctcaccgagaacaacattgtgaaagaagagcttgccctgctggacggatctaatgtcgtctttaagctgttaggtccagttttagtgaaacaggagcttggcgaggccagggccacagtggggaagcggctggactacattacagccgaaatcaaaagatatgaatcccagctccgagacctggagagacagtctgagcagcagcgcgaaacactggcccagttgcagcaggaattccaacgtgcccaagccgctaaggcaggcgcccctggaaaagcctag

SEQ ID NO: 18047 - DNA, 432 bp, Artificial Sequence
  Description of Artificial Sequence: Synthetic coding sequence
atgacgctgcgttgtctggagccgtctggaaacggcggcgagggcacacgctcccaatggggcactgccgggagcgccgaagaaccttccccccaggcagctcgcttagctaaagcactgagggagctgggccaaaccggctggtattggggctcgatgaccgtaaatgaggcaaaggagaagcttaaggaagccccggagggaacgtttctgatccgggactcgtcccacagcgactatctgttaacaatttccgtcaagacatccgcaggaccaactaatctccgtattgagtaccaggacgggaaattccgactggacagcattatctgtgtcaagagtaaacttaagcagtttgactctgtggtccacctcattgactactacgttcaaatgtgcaaagataaaaggacggggcccgaggccccgtag

SEQ ID NO: 18048 - DNA, 156 bp, Artificial Sequence
  Description of Artificial Sequence: Synthetic coding sequence
atgtcctcgagcatgtggtatattatgcagagcatccagtcaaaatattcactgtctgaacgcctgattaggacgatagccgcaattcgaagcttccctcatgataacgtggaagacttgatccgaggtggggctgacgtcaactgtactcattag

SEQ ID NO: 18049 - DNA, 1902 bp, Artificial Sequence
  Description of Artificial Sequence: Synthetic coding sequence
atggaggaaagccctctgtcacgcgccccaagccgggggggagtaaattttctgaacgtggcacggacttacataccgaatacaaaggtggagtgccattacaccctccccccaggaactatgccatccgcaagcgactggatcgggatcttcaaggtcgaggccgcgtgcgtccgcgactaccatacatttgtatggtcctccgtgccagagagcacaacggacggtagccccatccacacttcggtgcagtttcaggcatcctacctgccaaaacccggagcccaactgtaccaatttaggtatgtgaatcggcaggggcaggtctgcggacagtccccaccctttcagttccgggaaccacgaccaatggatgaattggtcactttagaagaggccgacggaggttccgatatcctcctagtcgtcccaaaggcaaccgtgcttcagaatcaactggacgagtcacagcaggagaggaacgacctcatgcagcttaagttgcagctcgaggggcaagttactgaactacgctcgcgggttcaagaacttgagcgagctctggcaacagcacgccaggaacacaccgagctcatggagcaatacaaaggaatttcacggagccatggcgagatcaccgaagagcgggacattctgtcgagacagcagggtgaccatgttgcccgcatccttgagctcgaggacgatattcagaccatcagtgaaaaggttctgaccaaagaagtggagctggatcgtcttagggacacggtcaaagcgctgacacgcgagcaagagaagctgctgggacaactgaaagaggtccaggccgataaagagcaaagcgaagctgagctgcaagtcgcccagcaggaaaaccatcacctcaatctggatctcaaggaagcgaagagctggcaggaagagcagtccgcccaggcccagcggcttaaggacaaagttgcgcagatgaaggacacgttgggccaagcccaacagagagtggccgaactagagcccctgaaggagcagctgagaggcgctcaagaattggccgccagcagtcaacagaaggccacacttcttggcgaggagctggcttctgccgccgcagcacgcgaccgcacgattgcggagcttcatcgatcacgcctggaagtcgctgaggtaaatggtaggctcgctgaactgggcctgcatttgaaggaagaaaagtgtcagtggagtaaggagcgagccgggctactgcagagcgtagaggccgagaaagacaagatcctgaaactgagcgcagaaattctgagactggagaaagcagtgcaggaggaaaggacccagaatcaggtatttaagaccgagctggccagagaaaaagactcttccttagtgcagctttccgagagcaaacgtgagctgaccgagctccgctccgcgttgagagtcctgcagaaggaaaaggaacagctgcaggaggaaaagcaagagctccttgaatatatgaggaaactagaggccagactggagaaagtcgcagacgagaagtggaatgaggacgccaccaccgaggatgaggaagccgccgtggggctcagttgtcccgcagccttgaccgatagcgaagatgagagtcctgaggacatgaggctacccccttatggattatgcgaacgcggcgacccaggaagctctcctgctggacctagagaagcctcccccttagtagtgattagccagcctgcccccataagcccacacctttctgggcccgcagaggacagtagcagtgatagtgaagctgaagacgaaaagagtgtcctgatggccgccgtgcaatccggcggagaggaggccaatctgttgcttcctgagctgggatccgcgttttacgacatggctaggtag

SEQ ID NO: 18050 - DNA, 810 bp, Artificial Sequence
  Description of Artificial Sequence: Synthetic coding sequence
atgaaaactcctgttgagctggccgtttctggtatgcaaacactgggacttcaacataggtgtcgcggaggttatagggttaaagctcgcacttcgtacgtggatgaaacattgttcgggtcacccgcgggcaccagacccacccctcccgactttgatcctccatgggttgagaaggcaaatcggactagaggagttggcaaggaagctagcaaagccctgggcgccaagggatcatgcgaaacaacgccttccagagggtctacacccacattaaccccgaggaagaagaacaagtacagacctatctcccacacaccatcttattgcgatgagtctctatttggtagtcgctccgaaggcgcctcattcggcgctcccagaatggcaaagggggatgcagcaaagctgcgcgccctgttgtggacacccccccctaccccccgtggaagccacagccccagacctcgtgaggcccccctcagagctattcaccccgctggaccctcaaaaacagaacccggacctgccgcggactcccagaagctctccatgggaggtttacatagttcacggccgctgaaacggggcctgtctcatagcttaacccacctcaacgtgccgagcacgggccacccagccacttctgccccacacactaatggtccgcaagatctgcgaccctcaaccagtggggtcaccttccgcagccccttagttacttcacgcgcacgatcggtcagcatctccgtccccagcaccccccgcaggggaggcgccactcagaaaccaaaacctccttggaagtag

SEQ ID NO: 18051 - DNA, 618 bp, Artificial Sequence
  Description of Artificial Sequence: Synthetic coding sequence
atggacaaggatagccagggcctacttgactcctctctcatggcctcagggaccgcctctaggtctgaggatgaagaatcgttagccggccagaaacgagcaagcagccaggccttgggcaccatccccaaacggaggagttcgtctcggttcatcaagcggaagaagtttgatgacgaactcgttgagagtagcctggcaaagagtagtacacgagcaaaaggcgcctccggggtcgaacctggtagatgctctgggtcagaaccatccagctctgagaagaagaaagtttcgaaggcgccgtccacccccgttccaccttcaccagctcccgcccctggactcactaagcgagtcaaaaaaagcaaacagccattgcaggtgactaaggatctgggccgttggaaaccagctgacgatctgttacttattaacgccgtgctgcagaccaacgatctgacgagtgtgcatctcggagtgaaattcagttgcagattcaccctgagggaggtacaagaacgctggtacgccctgctgtacgaccccgtgatttctaaattggcatgccaggctatgagacagttacacccagaagccatcgctgctatccaaagttag

SEQ ID NO: 18052 - DNA, 540 bp, Artificial Sequence
  Description of Artificial Sequence: Synthetic coding sequence
atggactggacaccccggttaccgtcacggcatattatcagcgaactcgagcatttgacgtttgttaacaccgacgtgggccggtgtcgggcctggttgcgcctggccctgaatgacggactgatggagtgctacctgaaattgttattacaggaacaggctcgcctccagttgcaacgaaaagaaagtctcgattctatcagtcacagtagcgggtccgaagacattgaggttcatcattctggacacaagatccgccgcaatcagaaattaacagccagctctctgtctcttgataccgcatcctcttcccagctcagttgctcactgaactccgattcctgcttactgcaggagaatggaagcaaatcaccagaccactgtgaggagccaatgtcctgtgactccgatttgggaacagctaacgctgaggactcagaccggtctcttcaagaaaaaacaagagcgggctctcaacgtatgacaagtactggactgccaggttcgaatccctggcgcgtgctgcagactacccagtag

SEQ ID NO: 18053 - DNA, 735 bp, Artificial Sequence
  Description of Artificial Sequence: Synthetic coding sequence
atggagctgaccatcttcatcctgcggttggctatttacatcctgacatttcccctctatctgctaaattttttaggcctctggtcctggatttgcaaaaagtggtttccttactttctggtcaggtttaccgtcatctataacgagcagatggcctctaagaagcgggagttgttctccaatctgcaagagtttgcaggacccagcggaaaactctccttgctggaggtcggctgcggcaccggagcaaacttcaaattctacccccccggctgccgagttacttgcatcgaccctaatcctaattttgaaaagttcctgatcaagtccattgcagaaaataggcacctccagtttgaaaggtttgtcgtggcagcaggcgaaaacatgcaccaagtagccgatggatcagtggacgttgtcgtttgtactctcgtgctgtgtagtgtaaagaaccaggagagaatcctaagggaggtgtgtcgagtgctcagacccggcggggctttttacttcatggaacacgtggccgccgaatgctcgacatggaactatttctggcaacaggtgctagatcctgcctggcatctactttttgacggttgtaatttaacccgggaatcttggaaggctctcgaaagggcatcctttagcaaactgaagctgcagcatattcaggcaccattatcctgggagctggtgcgaccacatatttacggctacgccgtcaaatag

SEQ ID NO: 18054 - DNA, 558 bp, Artificial Sequence
  Description of Artificial Sequence: Synthetic coding sequence
atggataaggactctcagggcttgcttgatagtagccttatggccagcggaacagcctctcggtcagaggatgaagagtccctagccgggcagaagcgggcttcctctcaggcgcttggcactattccaaagcgccggtcctcaagcagattcatcaaacggaagaagttcgacgacgaactcgtggagtcttccctggccaagagttctacccgggctaagggcgcttctggcgtggagcctggccgctgctcaggctctgagccatccagctccgaaaaaaaaaaggtttcaaaagccccatccacgcccgtgccacccagtccggcccccgcccccgggctgactaagagagtgaaaaagagcaagcaaccgttgcaggtgaccaaggacctggggagatggaaacccgcagatgacctcttacttattaatgctgtgttacagacgaatgacctgacaagcgtacacttgggagttaagttttcttgccgctttactctcagagaggtacaggagcgatggtacgctctgctctatgatccagtaatcagctag

SEQ ID NO: 18055 - DNA, 3003 bp, Artificial Sequence
  Description of Artificial Sequence: Synthetic coding sequence
atggtggagtgcttcgagtccggcggcactcgactaagcctcagcagcttcaatgtctcctgtgacagtctccgtgaacaattgcgagagtggcggtgctttcaatggtggcggatggattggacccccagactgccttcccgccatatcatttccgagctagaacacctcacatttgtcaatactgatgtgggtagatgtagggcctggctgcggctggcgctcaatgatggtttgatggagtgttacctcaaattgctgcttcaggagcaggcacggctccacgaatactatcagccaacagccctcctccgcgacgctgaggagggcgagtttctgctctccttcctgcagggtctgacatctctatcttttgagctgtcttacaagtccgccatactcaatgagtggacccttactccattagctctgtccgggttgtgcccgctgagcgaactggaccccctctcaacaagtggggccgaactacagcgcaaagaatccctagatagcataagccacagcagcgggtccgaagacattgaagtgcatcatagtggacataaaatcagaaggaatcaaaaattaactgccagctcactctcccttgacaccgcgtcctcatcacagttgtcctgttcactaaacagcgatagctgtctgctgcaggagaacggatccaagagcccggatcattgtgaggaacctatgagttgcgacagcgatttaggaactgcgaatgcggaagacagcgaccgcagccttcaggaagtgctgcttgagttttcgaaagctcaggtgaactctgtgcccaccaatgggctctctcaggagactgaaatcccaacccctcaggcaagtctgagtcttcatggcctaaacacatccacatacttgcattgcgaggcgcccgccgaacctttgcctgcgcaggccgcatcaggaacccaggatggtgtgcatgtgcaggagcctaggcctcaggctccctcccctctggatttacagcagccggtggagtccacgagtggccagcagccatcaagcaccgtgagcgaaacagcacgcgaagtaggccagggcaacggtctgcagaaggcccaggctcacgacggcgcgggcctgaaattggttgtgtctagtcccaccagccccaagaacaagtcatggatcagtgaagacgatttctatcgaccgagcagagaacaacctctggaaagcgcttccgaccaccctatcgcaagctataggggaacgccaggtagccgcccgggccttcacagacacttttcacaggagccccgtaaaaactgtagcctgggcgcccttgaccaggcctgcgtaccttctcccggccgcaggcaagcccaggcggcaccaagccaaggtcataaatccttccgggttgtgcaccggaggcagatgggactttctaatccctttaggggtctcatgaagcttgggactgtggaacgcaggggagccatgggtatatggaaggagttattttgcgagttgtcacccctcgagtttaggttgtacctatccaacgaagagcacacatgcgtagaaaattgtagtctgttacgttgtgagtctgtcggacctgcccatagcgacggccgttttgagctcgtcttttcaggcaagaaactagcgttgagggctagctctcaggatgaggctgaagactggttagatagggtgagggaggctctccagaaggttcggccgcaacaggaagacgaatgggtgaatgtgcagtacccagatcaaccggaggagcctcccgaagctcctcagggatgcctcagtccttccgacctgttaagtgaacccgcagctctgcaaggaacccagttcgactggagcagcgctcaggtgcctgagcccgacgcaataaaagagagtctgctttatctgtacatggataggacttggatgccttacattttctccctctccctcgaggctctgaaatgctttagaatccggaataacgaaaagatgctttccgattcgcacggcgttgaaaccatccgcgatattctccccgataccagtctggggggccccagcttctttaagatcatcacggcaaaagcagtgttaaagctgcaggcagggaacgcagaagaggccgcattgtggcgtgacttggtcaggaaggtgttagcctcctacctcgaaaccgccgaggaggcagtgacactgggcggctccctggacgaaaattgccaggaagtcctaaaattcgcaacacgagagaacgggttcctgctgcagtacctcgtcgctatccctatggaaaaaggactagatagccagggatgtttctgcgctggctgttcccgccaaataggattcagctttgtgcggccgaaactctgtgccttcagcgggctctactattgcgacatttgccaccaggacgacgcctcggtcatacctgccagaatcatacataattgggacctgactaagcggcctatatgccggcaggcacttaagtttttgacacagataagagcccagcctcttatcaatttgcagatggtaaacgctagcctttacgagcacgtagagcgaatgcacctaattggcagacgtagggaacagctcaagcttttaggtgattacctgggactgtgccgatctggtgccctgaaagaactctccaagaggctcaaccaccgcaattacctcttggaatccccacacagatttagtgtggccgatctacaacagatagccgacggggtgtacgagggctttagtcccaaagtgccatccgaggcggctggactgcgcccatggggcgcaaggtcccctgaggccgcctccgcttttcggtgtatcgacagtagccacctcccaagtctgcggaaggtcgtcccaaccctgttcttaaaatgttacttcatgcagtataccgtcccctctgagcaaggaagtgggccggaggaatccctgcagtgtatagaaggcatcgccgctgtgtag

SEQ ID NO: 18056 - DNA, 525 bp, Artificial Sequence
  Description of Artificial Sequence: Synthetic coding sequence
atggacactatgatgctcaatgtgaggaaccttttcgagcagcttgtaaggcgggtggaaattctgtccgaaggcaacgaagtgcagtttattcagctggctaaagatttcgaagacttccgaaaaaagtggcagaggacagaccatgaattgggaaaatacaaagacctactgatgaaggccgaaaccgaaagatctgcactggatgtgaagttaaaacatgctcgcaaccaggtagatgtagaaataaagaggagacaacgcgccgaggcagactgtgagaagctcgaacgccaaatacagctgatccgcgaaatgctgatgtgcgatacctcggggagcatccaactatccgaagaacaaaagtcagctctggctttcctgaaccgtggacagcctagcagcagtaacgcaggtaataagcggctgagtacaatcgacgaatctggcagtatcctgagcgatatcagcttcgataaaacagacgagtccctcgattgggacagttcgctggtgaagacatag

SEQ ID NO: 18057 - DNA, 2904 bp, Artificial Sequence
  Description of Artificial Sequence: Synthetic coding sequence
atggactggaccccaaggctgcccagtcgccacatcatttcagaattggaacacctgacattcgtgaacactgacgtggggaggtgccgcgcttggctaaggctggcactgaatgatggcctgatggagtgttacttgaagcttctgctgcaggagcaggcccgactgcatgaatactaccagccgacggccctcctgagggacgctgaagagggagaatttctgctgagtttcctgcagggcctgacctctctgtcctttgagctctcctataagtcagccatactgaacgagtggactcttacacccctggctctctccggcctttgtccattaagcgaactcgaccctttgtctacaagtggcgctgagttacaacgaaaggagtccttggacagtatcagccattcatccgggtctgaggatatagaggtccaccattctggccacaagattagaagaaatcagaaactcacagccagttctctgagcctggacactgccagcagcagccagctgtcatgctcattaaactccgattcctgcctgctccaggaaaatggttcaaagtcaccggatcattgtgaagagcccatgtcttgtgatagtgacctcggcaccgccaacgcagaagattctgaccgttcactgcaggaggtgttactggagttctctaaggcacaggtaaatagtgtgcccaccaatggcttatcgcaggagacggaaattcctactccacaggcctcgttatcattgcacgggctgaacacctccacctaccttcactgcgaggctcccgccgaacccctgccagcacaagccgctagtggcacccaggacggggttcacgtgcaggaaccccgcccccaggccccttcaccgctggatctgcagcaacccgtggagtcgacaagcggccagcagccgtcatccactgtgtcagaaaccgctcgggaagtggggcagggaaacggcttgcagaaagctcaggctcatgatggagccggactcaaactggtagtgtcctcaccaaccagccccaaaaacaagagttggatcagtgaagatgatttttatcgccctagccgcgagcagcccctcgaatcggcgagtgaccaccccatcgcgtcttatcgtggtactcctggctcccgccccggcctccaccgccacttctcccaggaacctcgaaaaaattgctcgctgggggcgttagatcaagcctgcgtgccctccccggggcggagacaggcacaggcagccccgtctcagggacacaagtccttccgtgtagtgcatcggcgccagatgggtctctctaaccctttccgcggccttatgaaactgggtacagttgagcggagaggtgctatgggaatctggaaggagttgttttgcgagcttagccccctcgagtttcgtttgtacttgtccaacgaagagcacacctgtgtggaaaactgtagcttactaagatgtgagtccgttggcccagcgcacagtgacgggcgttttgagctagtgttctccggcaagaagcttgccctcagggcaagtagtcaggacgaggcggaagactggctcgacagggtaagagaagctctccaaaaggtgcgcccgcaacaggaggacgaatgggtgaacgtccaataccccgatcagccagaggagccccccgaggctcctcaaggctgtcttagcccaagcgatctgctctctgagcccgctgcattacagggcacccagtttgactggagttccgctcaggtaccagagccagacgccatcaaggaatcattgctatatctctacatggaccgcacctggatgccatacatctttagtcttagcttggaagccctgaagtgtttccgtataagaaacaacgagaaaatgcttagcgactcccacggcgtcgaaaccatcagggacatcctgcccgataccagtctgggagggccatcctttttcaagattatcactgcaaaggcggttctgaagctgcaggccggaaatgctgaagaggccgctctgtggcgcgacctggtgagaaaggtcctcgctagctatctggagactgcagaggaggcagtgaccctggggggatcacttgatgagaactgtcaggaggtgcttaaattcgccacacgggagaacgggttcctactgcagtatctggtcgccattcccatggaaaagggcctcgacagtcagggctgcttctgtgcgggatgtagccggcagatcggcttcagcttcgtacggcccaaattgtgcgccttctccggcctgtactactgcgacatatgtcaccaggacgatgcttccgtgatacccgcccgtattatccataattgggaccttacaaaacggccaatctgccggcaagctctcaagtttctaacacagattcgcgctcagccactcattaaccttcagatggtcaatgcttccttgtatgagcacgtggagcgcatgcacttaatcggtaggcgcagagaacagcttaaactgttaggtgattaccttgggctatgcagaagtggagcgctgaaagaactgagcaagagactcaatcatcggaactacctccttgaatccccccacagattcagcgtggcagacttgcaacagatcgcggatggggtgtacgaaggatttctaaaagctctgatcgaattcgccagccaacatgtgtaccactgtgatctctgtacccagcgcggcttcatctgccaaatctgccaacaccatgatattatctttccttttgagtttgatactactgtcaggtgcgcagagtgcaagactgtttttcaccagagctgccaggctgttgtgaaaaagggatgtcccagatgcgccaggcggaggaagtatcaagagcagaacatctttgcctag

SEQ ID NO: 18058 - DNA, 1446 bp, Artificial Sequence
  Description of Artificial Sequence: Synthetic coding sequence
atggcttcagcggcatccgtgaccagtctagcagacgaagtgaactgccctatttgccagggcaccttgcgtgagcccgtgaccatcgactgtggccacaacttttgtcgagcatgcttaacccgctactgcgagattcccggccccgacttagaggagtcccctacctgtcccttgtgcaaggagccctttaggccaggaagtttccgccccaactggcagcttgccaacgtggtggagaatatcgagcggcttcaactggtcagcactctgggcctcggagaagaggacgtgtgccaggagcatggcgaaaagatctacttcttttgtgaggatgatgaaatgcagctgtgcgtggtttgccgggaagcgggtgaacacgccactcatacaatgcggttcctcgaggatgcagccgcaccgtacagagagcagatccataagtgtctgaagtgcctgaggaaggagcgtgaagaaattcaagagatccagagccgggagaacaaaagaatgcaagtgctactcacacaagtcagtactaagagacagcaggtcatcagtgagtttgcgcacctgcgaaaatttctggaggagcagcagtcgattctcttggcccagcttgagtcccaggatggagacattctcagacagcgtgatgaatttgacctcctggtggcgggggagatttgtaggttctccgctctgattgaagagctagaggagaagaatgagaggcctgcccgagaattgctgactgacatcaggagcactctgatccggtgcgaaacacggaagtgccgaaagcctgttgccgtttctcccgagctgggtcaaagaatccgggactttccgcagcaggcgctacctttgcagcgggagatgaagatgtttctcgagaatctgccaaatcacctcgtgattcctaccgctcatattagccttgatccccagactagccaccctaagctgctattgagtgaagatcatcagcgggcccagttctcatataagtggcagaactccccggataatccacaacgcttcgatcgggcgacctgtgttcttgcacatacagggattaccgggggtaggcacacatgggttgttagtatagatctcgcacacggcggatcctgcacggtcggagtggtcagtgaggacgttcaacgcaaaggggagttgcggttgcgtcctgaagaaggcgtgtgggccgtgcgactagcctggggatttgtgtctgccctagggtcatttcctacccggcttactctgaaagaacaaccccgccaggtgcgggtgtcattggactacgaagtaggatgggtgactttcaccaacgccgttacccgggagcctatctacacgttcaccgcctcctttactaggaaagtgattcccttttttggactttggggaaggggttcttccttttccctgtcctcttag

SEQ ID NO: 18059 - DNA, 462 bp, Artificial Sequence
  Description of Artificial Sequence: Synthetic coding sequence
atggctcctggaagtcggggcgagcggtcctccttcaggtcccggaggggacctggggtgccatctccacagcccgacgtaactatgttatcccgactccttaaggagcatcaagctaagcagaacgagcgaaaagagcttcaggaaaagcgcaggagagaggctattactgctgctacatgcttgaccgaggccctcgtcgaccacctcaacgtcggagttgcacaggcttacatgaatcagaggaagcttgaccatgaggtgaagactctgcaggtgcaggctgcacaatttgcaaaacagacaggtcagtggataggtatggtggaaaacttcaatcaagctttaaaggagatcggggacgtggagaattgggcccgcagcattgaattggatatgaggactatcgctacggcgctggaatatgtgtacaaaggccaactgcagagtgctcccagctag

SEQ ID NO: 18060 - DNA, 1311 bp, Artificial Sequence
  Description of Artificial Sequence: Synthetic coding sequence
atgttgtggaactttaaacctcatgctcgggcgtaccgttacgttggccataaggacgttgtcacatctgtccaattttcaccccacggcaacctgcttgctagcgcctctagagatcgcacggttcgactatggatacccgacaagagaggtaagttcagtgagtttaaggcccatacggcacccgtccgatcagtggatttctctgctgatgggcagtttttagcaactgctagcgaggacaagtctattaaggtatggtctatgtaccgacagagatttctgtactcgctgtaccgccacactcattgggtgcggtgtgcaaagttttctcctgatgggagattaatcgtaagctgctctgaagataaaaccatcaaaatatgggacacaactaacaagcagtgcgtgaacaacttctcagacagcgtgggtttcgccaactttgtggattttaacccgagcgggacttgcatcgccagtgctggctccgaccagaccgttaaggtgtgggatgtcagagtgaataaactgctgcaacactaccaggtgcattctggaggcgtgaattgcatcagttttcacccgtccggcaactatctgatcactgcttcttcagatgggacgctgaagatactggacctgctggaaggccggctcatctacacattacaagggcatacagggcccgtcttcacagtgagtttttcaaagggcggcgagctttttgcctctggtggcgcagatactcaggtcctgctttggaggaccaatttcgacgaactgcactgcaaaggccttaccaagagaaacctgaaacgtctccacttcgatagccccccccatcttctagatatttacccgcgtacccctcatccgcacgaggagaaagttgagaccgtggagataaatccgaaacttgaggtcattgacttgcaaatttctaccccacccgttatggacatccttagcttcgattctacaaccaccaccgaaacaagcggacgaacgcttcctgacaagggtgaagaagcctgcgggtacttcctgaacccaagcctgatgtccccagagtgcctacccacgacgacaaaaaaaaagaccgaagatatgagcgatctgccctgtgagtcacaaagaagcattccacttgccgtcacagatgccctggagcacattatggagcaacttaacgtgttaacccaaacagtgtctatccttgaacaacggctcacattgaccgaggataagctcaaggactgtctggaaaaccagcagaaactcttctctgcagttcaacagaaatcttag

SEQ ID NO: 18061 - DNA, 597 bp, Artificial Sequence
  Description of Artificial Sequence: Synthetic coding sequence
atgaccctgcgatgcctggagccatctggaaatggaggggaggggacccggagccaatgggggaccgccggttccgccgaggagccgagtccccaggccgcccgacttgctaaggctctgcgtgaactggggcagaccgggtggtattggggatccatgactgtgaacgaagctaaagaaaaactgaaagaggccccagagggaacattcctgattcgggacagcagtcatagcgactacctgctcacaatctccgtcaaaacgtctgcaggtcccacaaatcttagaatagagtatcaagatggcaaattcagactcgatagcatcatctgcgttaaaagcaagctgaaacagtttgactccgtggtccacctgattgactactacgtgcagatgtgcaaagacaagcgcacaggtcccgaagccccaaggaatggaaccgtgcatctctatctgacaaaacctctgtatacctctgcaccaagtctccagcacctctgtcgcctgaccattaacaagtgcactggtgccatatggggcctgcccctgccgacccggttgaaagattatctcgaagaatacaagttccaggtatag

SEQ ID NO: 18062 - DNA, 597 bp, Artificial Sequence
  Description of Artificial Sequence: Synthetic coding sequence
atgacactccgctgcctcgaaccttctgggaatgggggcgaaggcactagaagtcagtggggcacggcaggatcagccgaagagccttcaccacaggccgccagactggcaaaggccctgcgtgagctaggccagactgggtggtattggggatctatgactgtgaatgaggccaaggaaaagctgaaggaagcccccgaggggaccttcttgattagggacagctcccattccgactacctcctgaccatctctgttaaaacaagcgcagggccaaccaacctgagaatcgagtaccaggatggcaagttccgtttagactcgatcatatgtgtgaaatccaagcttaagcagtttgattctgtcgtccatttgatcgattattacgtccagatgtgcaaggataagcgaaccggacccgaggccccccgcaatggtacggttcacctttatcttacaaaacctctgtacacttctgccccatccttacaacacctgtgtaggctgacgattaataaatgcaccggagcgatttggggtcttcccctccccacaaggctcaaagactacttagaagagtataagtttcaggtatag

SEQ ID NO: 18063 - DNA, 495 bp, Artificial Sequence
  Description of Artificial Sequence: Synthetic coding sequence
atgatggaaggcaatggtaccgagaattcttgttcccgcacacgtggctggcttcagcaggacaatgacgccaaaccatggttgtggaaattctcaaattgttttagcagaccagagcagacgttgcctcattccccacagacgaaagagtacatggagaataagaaggttgccgtcgagttaaaagatgttcctagccctctccacgcaggaagtaagctttttccggctgtcccactgcctgacattcggtcactgcagcagccgaagatacagctcagtagtgtcccaaaggtcagctgttgtgctcactgtcccaacgagccatcaacgagtcccatgcgattcggcggagggggaggcggctcaggtggcaccagtagcttaatccatccaggcgctctgctggacagtcagagtacacgcactattacatgtcaggttgggagcggctttgctttccagagtgcatcctctctccagaacgcttcatag

SEQ ID NO: 18064 - DNA, 855 bp, Artificial Sequence
  Description of Artificial Sequence: Synthetic coding sequence
atgctcagcgtagtcgagaatggactcgacccacaggcggcaatcccggtgatcaagaagaagctcgtcgggtctgtaaaggccctccagaagcaatacgtgagcctcgatactgtcgttactagtgaagacggggacgctaacacaatgtgtagtgcactggaggccgtcttcatccacggtctgcacgccaaacacattcgggccgaggcaggcggaaagcgcaaaaaatccgcccaccagaagcccttaccccagcccgtcttttggccactgctcaaggctgtgacacataagcatatcatttctgagctggagcacctaacttttgtgaatacagacgtcggtcggtgcagggcttggctccgcctagccctgaacgacgggctcatggagtgctatcttaagttgcttttgcaggaacaggcccgcctccagctccagaggaaggaatcccttgactctatctctcatagttcggggagtgaggacattgaggttcaccactccggccacaagatacgccgcaaccagaaactgaccgcgtctagtttgtccctcgacaccgctagtagttctcagctgagctgctcccttaacagcgactcatgtttactgcaagagaatgggtctaaatctccagatcattgcgaggaaccgatgtcctgcgattcagaccttggcacagccaatgccgaggattcggaccggagtctacaggacataaaaattttttcctgggcacagtggctgaccccggtgataccagccctatgggaggccgaggctgggggcagccagcgccagcagattgaaacctttctcgcaaatacagttaagccacatctttattag

SEQ ID NO: 18065 - DNA, 3282 bp, Artificial Sequence
  Description of Artificial Sequence: Synthetic coding sequence
atgggtggcaaggcgtggcctcgcagggcagtcggtactgcaggcgggccgtgcgccgaacagatttctgccccatttcagacccttttaatgcctcaccttcctctggctagttttaggcccccgttctggggtctgcgtcactcccgggggctgcctaggtttcatagtgtgtctacacaatcagagccccatggatctcccattagccgacgcaatagggaggcgaagcagaaacggcttagagaaaaacaggcaacactagaggctgaaattgccggcgagagcaagtccccagccgaaagcattaaagcctggcgcccaaaggagcttgtgctgtacgagatcccgactaagcccggcgaaaaaaaagacgtgagcgggccacttccacctgcatacagtccccgctatgtagaagccgcttggtacccctggtgggtcagagagggcttttttaagccagagtaccaagcgcgactcccacaagccaccggcgagaccttcagtatgtgtatccctcctccgaacgttactggttcgctccacataggccatgccctgaccgtggctatccaagacgcactggtgaggtggcacaggatgaggggcgatcaggtgctatgggttcccggctctgatcacgcgggtatcgcaactcaggcagtggttgaaaagcagttatggaaggagaggggggttcgcagacatgagttatccagggaagccttcctgcgtgaagtgtggcaatggaaggaggctaaaggcggggagatctgtgaacaactgcgagccctgggcgcaagcttagattgggatcgcgagtgtttcacgatggatgttggctcaagcgtggctgtcaccgaggcattcgtgcggctgtacaaggccggcctgctgtatcgaaaccaccagctggtcaattggtcatgtgctctgcgaagtgccatcagcgatattgaagttgagaaccgcccactgcccggacacactcaactgcgcctgcccgggtgtcccactccagttagttttggccttctgtttagtgttgcatttccggtggacggcgagccagatgcagaagtggtggtgggcacaacccggcccgaaaccttgccaggagacgttgctgttgccgtccacccagatgatagcagatatacccatttacacggcaggcaactgagacacccactgatggggcagcccttgccgctgataactgactatgccgtgcagcctcacgtcggaactggtgcagtcaaggtaactcccgcacacagcccggccgacgcagagatgggggccaggcacggcctttctccacttaacgtgattgccgaagatgggacgatgacaagcctttgcggtgactggctgcaaggattgcatcgcttcgtggctagagagaagataatgagcgtcctcagcgagcggggcctattcaggggactgcagaaccaccccatggtcctgcccatctgttccaggtcaggcgatgttatcgagtacctgttgaaaaatcagtggttcgtgcggtgtcaggagatgggggctagagccgctaaagccgtggagtcaggagccctggagctgtccccgtccttccaccagaagaattggcagcactggttctcccacatcggagattggtgcgtttcacgacaactgtggtggggacaccagatccctgcctatctagtggtggaagaccacgcccagggcgaggaggactgttgggtggtgggacgctctgaggcagaagcaagagaagtggccgctgagttaacagggcggccaggagccgagctgaccctcgagcgtgacccggacgtacttgacacatggtttagtagcgctctattcccattctccgccttaggctggccacaggagaccccggacctggcccgattctatcctctgagtctgcttgagaccggctcagacctgctgctgttctgggtcggacgcatggttatgctggggacccaattgactgggcagctgccattttctaaagtcttactgcatcccatggttagggatcgccagggccggaagatgagcaaaagtcttggaaacgtgctcgacccgcgggacattatcagcggcgtggaaatgcaactgctgcaagaaaagctgcgatctggcaatctggatcccgcagagctggccatcgtggcagccgcacagaaaaaagattttccacatggcatccctgagtgcggaacagacgccctgcgcttcacattgtgctcccatggcgttcaggcaggcgacttacacctgtccgtcagtgaagtccagtcgtgtaggcatttttgcaataaaatatggaatgccctgcgcttcatattgaatgcactgggcgaaaaatttgtccctcagcccgcagaagaattgtctccaagcagtccaatggatgcttggatcctgtctaggttggccttagctgcccaggaatgtgagaggggctttttaactagggaactctccttagtcactcacgcattacaccacttttggctccataacctatgtgatgtttatttagaggcagtcaagccggtgctatggcattcacctcgaccgcttggccccccccaggttctgttttcctgcgcagacttgggccttagactactcgcgccgctcatgcccttcctcgcagaggaattatggcaacggctgccgccccgccctggatgccctccagcacctagtatctccgtggccccttatccttctgcttgcagcctcgaacactggcgccaaccggagctagaacggcggttctccagggtgcaggaggtggtgcaggtgctccgcgcccttcgggccacataccagttgacgaaggcacggccgcgggttttgctacagtcatctgaaccaggagatcagggtctcttcgaggcttttctggagcctttggggacactcgggtattgcggggccgtcgggctgctgcccccgggaaccgccgctccatccggctgggctcaagccccacttagcgacactgctcaggtgtatatggaactgcagggtttggtcgacccacaaatccagcttccactgctggctgccagacgatataagctgcagaagcagcttgacagtctgactgccagaacgccttccgagggggaggccggcacccaacgtcaacagaagctaagctccctgcaactggagttatccaaattagataaggccgctagccatctccggcagctgatggacgaaccgcctgcacccggaagccccgaattgtag

SEQ ID NO: 18066 - DNA, 3621 bp, Artificial Sequence
  Description of Artificial Sequence: Synthetic coding sequence
atgacttccgcagccgagattaaaaaaccgcccgtggcccctaagcctaagttcgtggtggccaataataaacccgctccccctcctatcgcccccaaaccagacatagtaatctcttcagtgccccaaagcacaaagaaaatgaaaccggccatcgctcccaagcctaaagtactgaaaacctcacctgtccgggaaatcgggcagtcgccttcacggaagatcatgcttaacctggagggtcacaagcaggagttggcggaatcaacggacaactttaattgcaagtacgagggcaaccaaagcaacgattacatcagccctatgtgttcttgcagttccgagtgcatccataagctggggcatcgggaaaacttgtgcgtcaaacagctggtgttagagcctctagagatgaacgagaacctagaaaattctaagatcgatgaaacactaacaatcaaaacgaggtctaagtgtgacctttacggggagaaggctaagaaccagggaggcgttgtcctgaaagcctcggttctagaagaagagctgaaggatgcattaatccatcaaatgcctcccttcatcagcgctcaaaagcatagacccaccgatagtcctgagatgaacggaggctgtaactccaacggacaatttaggatcgagtttgctgatctctcgccgagcccatcgagcttcgaaaaagttcctgaccatcattcgtgtcatcttcaactgccttccgatgagtgcgaacactttgagacttgccaggacgactccgagaaatcaaataactgctttcagagttcagagcttgaagccctagagaatggcaagagatccacattgatcagctccgacggggttagcaagaaaagcgaggtgaaggatttgggtcccttagagatccacctggtcccttatacgcccaaatttccaacgccgaaacctcggaagacaaggactgctaggctgctcaggcagaaatgcgtcgacacaccttctgagtccaccgaagaacccgggaactctgactcaagcagtagctgtctcactgagaatagcctcaagattaacaaaataagcgttttacaccagaatgttctgtgcaagcaggaacaggtggataagatgaagttaggcaacaaaagcgagctgaacatggaaagtaactctgacgcacaggatttggttaactctcagaaggccatgtgcaatgagaccacgtccttcgaaaaaatggctccatccttcgataaggactcaaatttaagctcagactccaccactgttgatggaagctctatgagcctggcagtagatgaggggaccggctttatcagatgtacagtgagcatgtctctgcctaaacaactgaagctcacctgcaacgagcacttacaatctggaaggaatctgggggtatcggcgccacagatgcaaaaagaatcagtgataaaagaagagaactccctgaggattgtgccaaagaagccacagcgacactccctccctgcgactggagtgcttaagaaggccgccagcgaggaacttttggaaaagagtagctatccaagttcagaggagaagtcttcagaaaagagccttgagcgcaaccatctgcagcacttatgcgctcagaataggggcgtgagcagctcattcgacatgccaaagagagcatcggagaagcccgtgtggaaacttcctcacccaatcctgcctttctcgggcaatcctgagttcctaaagtccgtcacagtctctagcaatagtgagccctctacagccctgacgaaacctagggcaaagtctctatccgctatggatgttgagaagtgcaccaagccttgcaaagatagcaccaaaaaaaattcgtttaaaaaactgctatccatgaagctttccatctgctttatgaaatccgacttccaaaaattctggagtaaatccagccagctcggagacaccacaacaggccatctgagctccggggaacagaaagggatcgaaagcgattggcaaggtttattggtgggcgaagagaaaagatccaagcctattaaggcttactccaccgagaattacagtctggagtcccaaaaaaaacggaaaaaaagccggggtcagacctcagctgccaacggtctgagagccgaatcacttgacgaccaaatgctgtcacgcgagtcctccagccaggctccgtataagagcgttacatctttatgcgctccagaatatgagaacatacgccattatgaggagatcccagaatacgaaaatcttccatttattatggctatccgaaaaactcaggaactcgagtggcagaattcctctagcatggaagatgccgacgctaatgtgtacgaagtcgaagaaccatatgaagccccggatggacaactgcaactggggccaagacaccagcacagttctagcggcgccagccaggaagagcagaacgatctaggcctcggagacttaccctctgacgaagaggagatcatcaactcttccgacgaagacgatgtgagctctgaaagctccaagggtgaacctgatccactcgaggacaagcaggacgaggataatgggatgaagtctaaagtgcaccatatcgccaaggaaataatgtcatcagaaaaggtgtttgtggacgtgctgaaactactgcacattgacttcagagacgccgtagcccacgccagtaggcaactcggcaaacctgttattgaggatcggattctgaatcagattctatactacctgccccagctgtacgaactgaatagagacctgctgaaggaactggaagagcggatgctccattggacagagcaacagagaatcgcagacatatttgtcaagaaaggcccctacctgaagatgtactctacctatataaaggaatttgataagaatatcgccctactggatgaacagtgtaagaaaaatccgggctttgccgccgtggttcgagagtttgagatgtcgcctaggtgcgccaatctggccctcaaacactatctcttgaaaccagtgcagaggattcctcagtatagactactgctcacagactacctgaagaacttgattgaggacgcaggcgattacagagatacccaggacgctctggcagttgtcattgaagttgccaaccatgcaaatgatacaatgaagcagggagacaacttccaaaaactgatgcaaattcaatactcactcaacggtcatcatgaaatcgttcagcccgggcgggtgttcctgaaggaggggatcctgatgaaactgagccgaaaagtgatgcagccccgtatgtttttcctgttcaacgacgctttgctctacacgactccggtgcagagcggaatgtacaagctgaataatatgttgtctctcgcgggcatgaaggtgcgaaaaccaacacaggaggcctaccagaacgagcttaaaattgaaagcgttgagagaagcttcattttgtccgccagcagtgccacagaacgagacgagtggctggaggccatttccagggctatcgaggagtacgctaaaaagcgcatcacgttttgtccaagcaggagcctcgacgaggccgatagcgagaataagtag

SEQ ID NO: 18067 - DNA, 435 bp, Artificial Sequence
  Description of Artificial Sequence: Synthetic coding sequence
atggataaagattcccagggcttgctggactccagtctgatggctagcggaacagcttctcgatcagaagatgaggagagcttggccggacagaagcgggcgtcgtcccaggcacttggcaccatccctaaaagacgcagtagcagtagaacactctataggttcatcaagcggaagaagttcgacgacgaactggtggagtcctcactggctaagagcagtaccagagcaaaaggagcaagcggcgtggaacctggtaggtgttcgggaagtgagcccagcagctccgaaaagaagaaggtgagcaaggccccttcgactcctgttccaccaagtccagctccagccccagggctcaccaagcgggtgaaaaaatcaaaacaacccctgcaagttactaaggatctcggtcgctggaaacccgccgatgactag

SEQ ID NO: 18068 - DNA, 810 bp, Artificial Sequence
  Description of Artificial Sequence: Synthetic coding sequence
atgaaaacccctgtcgagctcgcggtctcagggatgcaaacactcggactccagcaccgatgtcgaggggggtaccgtgtgaaggctcgcacctcctatgtagatgaaactctctttggtagtcccgccggcaccaggccgacacctcctgattttgacccgccctgggtcgaaaaagcaaatagaacacggggcgtggggaaggaggctagtaaggcactgggcgccaaaggatcatgcgaaacaactccaagtcgcggatcaacaccaactctcactcctcgtaagaaaaataagtacagacctatatcacacacaccctcatattgcgacgaatctctcttcggcagcagatcagagggggccagcttcggagcccccaggatggcgaaaggtgacgctgccaaactcagagcattgctgtggacacccccccctacccccaggggttcgcactcacccaggccccgagaggcaccgctgagagctattcaccccgctgggccttcaaaaaccgagccaggccccgctgcggatagccagaaactgagtatgggcggcctgcatagttcacggcccctgaagcgtggccttagccatagtctgactcatctgaatgtgccgtctacaggacacccggccacatccgcgccacatactaatgggccccaggaccttagacctagtacctcgggagtaacttttcgaagccctctggtcacgtctcgcgctaggagtgtgtcgatcagcgtgcctagtacaccgcgaaggggaggagctacacagaaacctaagccaccctggaaatag

SEQ ID NO: 18069 - DNA, 501 bp, Artificial Sequence
  Description of Artificial Sequence: Synthetic coding sequence
atggctaacgaccccctggaaggcttccatgaagttaacctcgcctcccccacgtctcctgaccttctgggtgtctacgagtccggtactcaagaacagacaacctctccttccgtgatataccggccccacccatccgccctatcctcagtgcccattcaagcaaacgccctagacgtgtcagagctccctacgcagcctgtctattcttctccccgaagactcaactgtgccgaaataagctctatcagttttcacgtgacagacccagccccttgctctaccagcggggtgacggcaggacttactaaacttaccacgagaaaggataactacaacgccgaacgtgaatttctgcaaggtgcgacaatcacagaggcgtgtgacgggtctgacgacatattcggattaagtaccgattccctctctcgtctaaggtcgccatcggttcttgaggtgcgggagaagggatacgagaggctgaaggaggagcttgcctag

SEQ ID NO: 18070 - DNA, 390 bp, Artificial Sequence
  Description of Artificial Sequence: Synthetic coding sequence
atggacaccatgatgttgaatgtgcggaacctgtttgagcagctggtgagaagggtcgaaatcttgtccgaagggaacgaggtgcagttcatccagctggccaaggactttgaggattttcggaagaaatggcagcgcacagaccatgagctcggaaaatacaaagacttgctgatgaaggcggaaaccgagcgctctgcactggacgtgaagctgaaacacgcacgcaaccaggtggatgtcgaaatcaaaagaagacagagggccgaggcagattgcgagaaactcgagcgacagattcagcttatcagagaaatgctgatgtgtgatacttccggatccatccagttaagcgaagaacagaagtctgccctggcctttcttaactag

SEQ ID NO: 18071 - DNA, 486 bp, Artificial Sequence
  Description of Artificial Sequence: Synthetic coding sequence
atgacattacggtgcctggagcctagcgggaatgggggcgaaggtacccgtagtcagtgggggacggctggatcggccgaggaacccagtccccaggccgcacgcctggccaaggcattgagggaattgggccagactgggtggtattggggaagcatgacggtaaacgaagcgaaagagaagttaaaagaggcccccgaagggacattcctcatccgagatagttcgcactctgattatcttctgactattagcgtgaaaacttcagccgggcctaccaatctgaggatagaatatcaagacggcaaattccggctggactctatcatctgcgtgaaatccaagcttaaacagtttgactctgttgttcatcttatcgattactacgtgcagatgtgcaaggacaaaagaacaggtcccgaggccccgagaaatggaaccgtacatctgtaccttacaaaacccctatacactagcgccccatag

SEQ ID NO: 18072 - DNA, 1389 bp, Artificial Sequence
  Description of Artificial Sequence: Synthetic coding sequence
atggacaaggactcacagggcttactggacagtagtctgatggcaagcggtaccgcatctcgaagcgaagatgaagagagcttagctggccaaaagagggccagcagtcaagcgctcggcaccattccaaagagacggagctcttcacgattcattaaacggaaaaagtttgatgacgagctcgtggaatcgagtctggcaaaatcgtcaacccgggcaaaaggcgcttccggtgtggaaccaggtaggtgctccggtagcgaaccaagttccagcgagaaaaagaaagtttcaaaggcaccaagtacaccggtgccaccatctccagctccagcgcccggtctaactaaacgcgtcaaaaaaagtaagcagcctctccaggtgaccaaggatctggggaggtggaagccagcagacgacctgctactgataaacgcggtgctgcagactaacgacctcacctcagttcacctgggtgtaaaattttcctgtcggttcacccttagggaagtgcaggaaaggtggtacgcgctcctatacgacccagtgattagcaaacttgcttgtcaggccatgaggcagctacatcctgaggccatcgccgccattcagagtaaggcactattcagcaaggctgaggagcaacttctatcaaaggtaggcagtaccagtcaacctaccctggagacattccaggacctgctacaccggcatccagatgccttttatctggccagaacagcaaaggccctccaggcccattggcagcttatgaaacaatactacttactggaggaccagacagtgcagcccctgcccaagggtgaccaggtacttaatttcagcgatgcggaagacctgatcgacgattctaagcttaaagacatgcgcgatgaggtgttggagcatgaactgatggtggctgaccgacgccagaagagagagatcaggcagctcgagcaggagcttcataaatggcaggtgttagtggattcaatcaccggcatgagctctcccgattttgataaccagacgctggccgtcctaagagggaggatggtgcgttatctcatgagaagtcgcgagatcaccctggggcgggctactaaggataatcagatcgacgtggatctcagcctggaaggcccggcttggaagatatcacggaaacagggcgtaatcaagcttaagaacaacggagatttttttatcgcgaatgagggaaggagaccaatatacatcgatggccgtccggtgctctgcggctccaagtggaggctaagcaacaattccgtggtcgaaattgcctcactgaggttcgtgttcctcatcaaccaggaccttatcgctctcataagagctgaagctgctaaaattactccacagtag

SEQ ID NO: 18073 - DNA, 576 bp, Artificial Sequence
  Description of Artificial Sequence: Synthetic coding sequence
atgggtaaaaagacaaaacggacagctgatagctcgagctctgaagacgaagaggaatacgtggtcgaaaaggtcctggaccggagagttgtgaaggggcaggtggaatatcttctgaagtggaaaggtttctcagaagagcataatacatgggagccagagaagaacctggattgccccgagctcatcagcgaattcatgaagaagtataaaaaaatgaaggagggcgagaataacaaacctagggaaaagagcgagtcaaacaagcgtaagtctaacttttctaacagtgcggatgacatcaagagtaagaagaagcgggaacagagcaatgatatcgcaagaggtttcgagcgcggtttggaaccagagaagattatcggcgccacagattcctgtggtgatctcatgttcctgatgaaatggaaggataccgacgaggcggacttagtgcttgcaaaagaggccaacgtgaaatgcccccagatcgtgatcgccttctatgaagagcgtctcacctggcatgcttacccggaggatgctgaaaacaaggaaaaagaaacagccaaatcctag

SEQ ID NO: 18074 - DNA, 1212 bp, Artificial Sequence
  Description of Artificial Sequence: Synthetic coding sequence
atggccagttcgagcgtccctcccgccacagttagcgcagccaccgcgggaccaggacctgggtttggatttgcctctaagaccaaaaagaagcatttcgtgcaacaaaaggtgaaggtctttcgtgcagcagaccctctggtgggagtgttcctgtggggagtcgctcattcaatcaacgaactttcccaggtaccaccccctgtgatgttactgccggacgattttaaggcgtcatccaagatcaaagaatattgcccccaagtttttcggaacctcagagacaggttcgggattgacgaccaagactatttggtgtccctgaccagaaaccccccctcagagagtgaggggagcgacggacgctttctcatatcctacgaccggactttagttataaaggaagtatcctctgaggacatcgcagacatgcacagtaatctctccaactatcaccagtatatcgtgaagtgccatgggaacactcttctgccccagttcctggggatgtatcgagttagcgttgacaacgaagactcatacatgctggtcatgagaaatatgttttctcaccgcttgcccgtccacagaaagtatgaccttaagggctcattggtgtccagggaagccagcgataaagagaaagtgaaggagctacccaccctgaaggatatggacttcttaaataagaatcagaaagtgtacatcggagaagaagagaaaaagatatttcttgaaaagctgaagcgcgatgtggagttcctagttcaactgaagataatggattatagtctgttgctgggcatacatgatattatccgaggctctgagcccgaggaggaggcccctgtgcgggaggacgaatccgaagtagacggagactgcagtctgactggtccccccgcactcgtaggatcttacggcaccagtcccgaaggaatcggcggttatatccactcacataggcctttgggcccaggagagtttgaatcctttatagacgtgtacgccattcggtcagccgaaggagctccccagaaggaagtgtacttcatgggcctcatagatatcctgacccagtacgatgccaagaagaaagccgcccatgcagctaaaacagttaagcacggtgccggtgcggaaatcagtaccgtacatccggagcagtatgcaaagaggttcctagatttcatcaccaacatattcgcttag

SEQ ID NO: 18075 - DNA, 576 bp, Artificial Sequence
  Description of Artificial Sequence: Synthetic coding sequence
aagatagaagtaattgaaatcatgactgacagaggaagcgggaaaaagagaggcttcgccttcgtgacctttgacgaccatgacagtgtcgataagattgtgatccagaaatatcataccgtgaatggccataattgtgaggtccgcaaggcactctccaaacaggaaatggcctcggcatcatcctcccagcggggtcggagcgggagcgggaattttggcggggggcggggaggtggcttcggaggcaacgataactttggccggggaggaaacttttccggccgcggggggtttggaggtagccggggtgggggcggatatggcggttccggagatggatacaatggcttcggaaatgacggtagcaacttcggaggcggagggtcttacaatgacttcgggaattacaataaccagtcgtccaatttcgggcctatgaagggcggcaactttggtggacgaagttctggtccgtatggcggcggaggccagtatttcgccaagcccagaaaccaggggggctacggcgggtcatccagcagctcaagttacggatccggaagacgcttctag

SEQ ID NO: 18076 - DNA, 543 bp, Artificial Sequence
  Description of Artificial Sequence: Synthetic coding sequence
atggaattgaccatctttatcttgcggctagcgatttatatcctgacttttcctttgtacctgctgaattttctcggactttggagctggatctgcaagaaatggtttccctatttcttggtccgattcacagtgatttacaacgaacagatggcttccaagaagagagagctgttcagcaacctgcaagaattcgccggcccgagtgggaagctaagcctgttggaggtgggttgcggtaccggcgcaaattttaagttctatcccccaggatgccgagtcacatgtatcgacccaaatccaaatttcgaaaagttcctgattaaatctattgctgaaaacaggcatctccagttcgaacgctttgttgtagctgcgggcgagaatatgcaccaggtagcggacggctcggtggatgtggtcgtttgcactctggttctgtgtagcgtgaagaatcaggaacgcatactacgcgaagtgtgccgggtcctccgtcccggaggggccttttattttatggagcacgtggctgctgaatgttag

SEQ ID NO: 18077 - DNA, 1431 bp, Artificial Sequence
  Description of Artificial Sequence: Synthetic coding sequence
atgggactcaaaaaaatgaaggggctatcttatgatgaggcattcgccatggctaatgatcctctggaaggatttcatgaggtaaacttagcatctcccacaagtcccgacctacttggagtctatgaaagcggcacccaggaacaaacgacctccccatctgtgatttacaggccacacccatctgctctcagttctgtccctattcaggccaacgcgctggacgtgagcgagctccccacccaacccgtgtattcatctccacgcaggctgaactgtgcggaaatatcatctatctccttccatgtgactgaccccgccccttgcagcacctcgggagtcactgccggactgacaaagctaacaacacgaaaggataactataatgccgagcgggaatttctgcagggcgcaaccatcacagaggcttgcgacgggtctgatgatattttcgggttatcgactgactccctgtctaggctgaggtcaccctcagtgctggaggtgagagagaagggatatgagcggctgaaggaggaactcgcaaaggctcagcgggaattgaagctgaaggacgaggaatgtgagcgcctgagtaaggtgagagaccagctgggtcaggaactggaagaacttactgcatcccttttcgaagaagcccataaaatggtgagggaagctaacattaagcaggcgacagctgagaaacaattgaaggaggcgcagggaaagatcgatgttctgcaagcagaagtggcggcactgaagactctggtgctgagctcttcaccaacgagccccacccaggagcccttgcctggcggaaagacaccgttcaaaaaaggacataccagaaacaaaagtacatccagtgccatgtcaggttcccatcaggacctgtccgtcatccagcctatagtgaaagactgtaaggaggctgacctgagtctgtataatgaatttcgtctctggaaagatgaacccacgatggatcgtacttgcccatttctggacaagatctaccaggaagatattttcccatgtctgacgttttccaagagtgaactggcatcagctgttctcgaggccgtggagaataacaccctcagcatcgaaccagtgggtttgcagcccattcgattcgtcaaggctagcgcagttgagtgcggtggcccgaaaaaatgcgctctgacaggccaaagcaagagctgtaagcatcggattaagctgggtgactcctccaactattactacatctcccctttttgccgctatagaatcaccagtgtctgcaattttttcacatatatcagatatatccagcaggggcttgtaaaacaacaggatgtggatcagatgttttgggaggtcatgcaacttagaaaagagatgtcactcgcaaagttagggtattttaaagaagagctctag

SEQ ID NO: 18078 - DNA, 336 bp, Artificial Sequence
  Description of Artificial Sequence: Synthetic coding sequence
atggacacaatgatgttgaacgtgcggaacctgttcgaacaactcgttcggagggttgagatattgagcgaggggaacgaggtgcagtttattcagctggctaaggacttcgaggactttcgaaaaaagtggcagagaacagaccatgagctcggaaagtacaaggatctgctgatgaaggcagagactgagcggtccgcgctggatgtgaagcttaagcatgcccggaatcaggttgatgtggagataaaacggagacagcgtgctgaggccgactgcgagaagctcgagaggcagatccaacttatccgcgagatgttgatgtgcgacacatag

SEQ ID NO: 18079 - DNA, 324 bp, Artificial Sequence
  Description of Artificial Sequence: Synthetic coding sequence
atgatcaaaaatctggaagtgcagctaaggcgggccactgatgaaatgaaggcctatatttcatctgatcagcaggagaagcggaaagccatcagagagcagtacacaaagaacactgccgagcaggagaatcttggcaaaaagctgagagagaaacagaaggtgatacgcgagtcacacggccccaacatgaagcaggccaaaatgtggcgtgacttggaacagctgatggaatgtaagaaacagtgctttttgaaacaacaatcccagactagtatcgggcaggtgatccaagaaggaggtgaggacaggctgattctgtag

SEQ ID NO: 18080 - DNA, 2772 bp, Artificial Sequence
  Description of Artificial Sequence: Synthetic coding sequence
atgtgcattccccccccaaacgtcaccggatctctgcacattgggcatgcccttaccgttgctattcaggacgccctggtgcggtggcaccggatgcggggtgaccaggtgttatgggtgcccgggtcagatcatgccggaatcgcaactcaagctgtcgttgagaaacagttatggaaggaaagaggcgtgagaaggcatgagctcagccgagaagcctttctccgcgaagtgtggcagtggaaggaggctaagggaggcgagatctgtgagcaactcagagccctgggcgcttcactcgactgggaccgagagtgctttactatggacgttggaagcagtgtggccgtgaccgaggccttcgtgcggctgtataaggcaggcttattgtatcgcaatcatcaactcgttaactggtcttgtgcactcagaagcgccatctccgatatcgaagtcgagaatagacccctccctgggcatacccaacttagacttccaggctgccccacaccggtgtccttcggattgctgttcagtgtggctttccccgttgacggcgaaccagacgctgaggtcgtggtgggaactacacgccccgagacactgcctggtgacgtcgccgttgctgttcaccctgacgattcacgctacacacatctgcacggaaggcaactgaggcacccactgatgggacagccattgcccctgatcaccgactacgccgttcagcctcatgttgggacaggcgccgtcaaagtgacccctgcgcacagtcccgcggacgctgaaatgggtgccagacacggactaagtcctttgaatgtgatagccgaggacggaacgatgacctccctgtgcggggattggcttcagggattacacaggtttgtggcacgagagaaaattatgagcgtgctgtctgagagagggttgtttaggggcctacaaaaccatcctatggtccttcctatctgcagccgcagcggagacgtcattgagtatcttctcaagaatcagtggtttgttaggtgccaggagatgggcgcacgcgccgctaaggccgttgaatctggtgcgctggagctatcgccatccttccaccagaagaattggcagcattggttttcacacattggcgactggtgcgtgtccaggcaactctggtgggggcaccaaattcccgcttacctggtagtcgaggaccacgcacagggagaagaagattgctgggtggtgggccggtctgaggccgaagccagagaggtggccgccgaactgactggtcgccctggagctgagttgactctcgagcgggaccccgacgtcctggatacatggttcagtagtgccctttttccttttagcgcattaggttggccccaagagacacctgacctggctagattctaccctctgtcccttcttgagaccgggtccgatttgctacttttctgggtaggtaggatggtgatgctggggactcagctgacaggccagctgcctttttccaaggtactcctgcatccaatggtgagggaccggcagggacggaaaatgtccaaatcattggggaatgtgctggacccccgagacatcataagcggagtagagatgcagctgctacaggagaaactgcgatcaggtaacctcgaccctgccgaacttgccatcgtggctgccgcgcagaagaaagattttccccacggcattcctgagtgcggcactgatgccttacgattcactctgtgttctcacggggtacaggccggagacctccatttgtctgtctccgaggtccagagctgtcgacacttctgcaataaaatttggaacgccctgcgatttatcttgaatgctttaggagagaaattcgtgccgcaacccgctgaagagctctccccttcatcccctatggacgcatggattctgtcccgactggcgctagcggcccaagaatgcgagaggggatttttaacccgagagctttccctggttacgcacgcccttcaccatttttggttgcataacctctgcgacgtgtacttggaagcagtaaagccagtcttatggcacagtccccgacctctgggtcctccacaagtactgttttcctgcgctgatctaggactgcggctgcttgccccactgatgccgttcctggccgaggaattgtggcaacggcttcccccccgccctggctgccctcctgctccatcaatttccgtggccccctacccatccgcttgctccctggagcactggcgtcagccagaactggaacgtcgcttttcgagggttcaggaggtggtgcaggttctccgggcgctgcgcgctacataccaactgaccaaggctcgcccccgagtccttttacagtcctctgagcccggtgatcagggactgtttgaagcctttctggagcctctcggcaccttgggatactgtggagcagttggcctcttgcccccgggaaccgcggcccccagtggctgggcacaggcaccactgtctgacactgcccaagtttatatggaactgcaggggctcgtggacccccagattcagttgcccctgctcgctgccagacggtacaaactgcagaaacagctggattcactgactgcaagaacgccatcagaaggagaggcaggcactcagcggcaacagaaactctcatcgctgcagttggagctgagcaagttagacaaagccgcttcccacctgcggcagctgatggatgagccccctgctcctggttcacccgagctgtag

SEQ ID NO: 18081 - DNA, 2076 bp, Artificial Sequence
  Description of Artificial Sequence: Synthetic coding sequence
atggaggaatctccactgtcaagggctccatcccgaggcggagtgaactttctcaacgtggccaggacttatattccaaacacgaaggtggagtgccactatacgctacccccgggcacaatgccatctgcctccgactggatcggcattttcaaagtggaagctgcttgcgtgcgtgactatcacacctttgtctggtctagtgttcctgagtccactactgacggctcaccgattcatacttccgtccagttccaggcaagctatctgccgaagccgggggcccagttgtaccaatttcggtacgtaaacaggcaaggacaggtatgcgggcagagcccgccgttccagttcagggaacccagacctatggacgaactagttactctggaggaggctgacggcgggagtgacatacttctggttgtgcctaaagcaactgtcctgcagaaccagcttgatgagagtcagcaagaacggaacgacctgatgcagctgaagctgcagctagagggacaagtgaccgagctgcggtctagagtgcaggagctcgagcgagccctggcaacggcaaggcaggaacatacagaattgatggaacagtacaagggtatttcgcggtctcatggagagatcacggaagagcgtgatatcctgtctagacagcaaggagatcatgtcgcgcgaatcctcgagctggaagatgatatccagaccatctctgagaaggtgctgacgaaggaagttgaattagatcggcttcgagacaccgtgaaagcgctgactcgggaacaggagaaactgctcgggcagttgaaggaagttcaagctgacaaagagcaatctgaagcggagctccaggtggcccaacaggagaaccaccatcttaatcttgatctgaaggaagccaagtcatggcaggaagaacagagcgcccaggctcaaaggctgaaggacaaagtggcacagatgaaagacacactggggcaggcgcagcaacgggttgctgagcttgagccgttaaaagaacagcttcggggagcacaggagctggcagcctcttcccagcaaaaagcaacactgctgggcgaagagctggcatctgccgctgctgcacgcgatcgcacgatcgctgaattacataggtctcgactcgaggtcgccgaggtgaatgggagactggcggaactgggtctgcaccttaaggaagagaagtgtcaatggtccaaggagagggccggcttgctgcaatccgttgaagccgagaaggacaaaatactgaaacttagcgcagaaatcctgcggctggagaaggccgtgcaagaagagaggacacagaatcaggtatttaagacggagttagcgagggagaaagactcctcactggtccagctctcagagtcaaagagggaactgacagaactgcggtctgctctgagagtgctccaaaaagagaaagagcagctccaggaggaaaagcaggaactcttggagtatatgcggaaactggaggctcgcctcgagaaagtcgccgacgaaaaatggaatgaggatgctacaaccgaagatgaagaagccgcagtcgggctgtcctgccccgcagccctgacagactccgaggacgaatcacctgaagacatgcgactgcctccttatggcttgtgcgagcggggtgacccaggttcgagtcctgccggaccccgcgaggcctccccactcgttgtgatctcccagccagcgcccatctcaccgcacctatctggacccgccgaggattcttctagcgacagcgaagcagaagacgaaaaaagcgtgctgatggcagccgtacagagcggcggggaggaagctaacctccttctgccagagctcggctccgctttctacgacatggcctccggctttacagtgggcacattgtccgaaacatccaccggcggcccagctacccccacctggaaagagtgtcctatttgcaaagaacgattcccagcagaaagcgacaaggacgccttagaggaccatatggacgggcatttttttttttctacccaagacccgtttaccttcgaatag

SEQ ID NO: 18082 - DNA, 366 bp, Artificial Sequence
  Description of Artificial Sequence: Synthetic coding sequence
atgaatgagagcaagccgggtgactcccagaatctcgcatgtgtgttctgtagaaagcatgacgactgccctaacaagtatggagagaaaaagacaaaagagaagtggaatctcactgtgcattattactgcctgctcatgagctcgggcatttggcagcgggggaaagaagaggagggcgtgtacggcttcctgatcgaggatatccgaaaagaggtgaaccgcgccagtaaactcaaatgttgtgtgtgtaaaaaaaatggcgcatccatcgggtgtgtggccccacgctgcaagaggagctatcactttccgtgcggtcttcagagggagtgcatctttcaatttacagggaattttgcttag

SEQ ID NO: 18083 - DNA, 657 bp, Artificial Sequence
  Description of Artificial Sequence: Synthetic coding sequence
atgaactgccgctccgaggtcttggaggtttcggtagagggaagacaagtcgaggaagctatgctggccgtgctccatactgtgctgctccacaggagtactggaaagttccactacaagaaagaggggacctactctattgggactgtggggacccaggatgtagattgtgattttattgacttcacatacgtgcgggtttcgtccgaggagctggaccgggcactcaggaaggtggtcggcgagtttaaggatgcccttagaaactctggaggcgatggtcttgggcagatgagtctcgaattctaccaaaagaaaaaaagccggtggcctttttcagacgaatgtatcccatgggaggtgtggacagtcaaggttcatgtggtggctttggctaccgagcaggaacggcagatttgccgggagaaagtcggagaaaaactgtgcgaaaagatcatcaacatcgttgaggtgatgaaccggcacgagtacttgccaaagatgcctactcagtctgaggtcgataacgttttcgacacagggcttcgagacgtgcagccatatctgtacaagatttcatttcaaattaccgatgctctgggcacttctgttaccacaacaatgaggaggcttatcaaggataccctcgccctgtag

SEQ ID NO: 18084 - DNA, 1899 bp, Artificial Sequence
  Description of Artificial Sequence: Synthetic coding sequence
atggatactatgatgcttaacgtccgaaatctgtttgaacagctggtaaggagagtggaaattttatctgaggggaacgaggtgcaattcatccagctcgcaaaggatttcgaggactttagaaaaaaatggcagcgaaccgatcatgagctggggaaatataaagacctactaatgaaggcagagacagagcgcagcgctcttgacgtcaagctgaagcatgctcgaaaccaggtcgatgtggagattaagcgtcggcaaagggcggaagccgactgtgagaagctagagcgccagatccagttgatcagagagatgctaatgtgcgacacctcgggaagtatccagctttccgaagagcagaaatcagctcttgctttccttaataggggccagccttcttcttccaatgctgggaacaaacgtctgtctacaatcgatgaatctggcagcattttgtccgacataagcttcgacaagacagacgagagtctggactgggacagtagtcttgttaagactttcaagctcaaaaaacgggagaagcgaaggtctacctcaagacagtttgttgacggaccgcccggtcctgtcaaaaagactaggagcatcggttctgctgttgatcagggaaacgaatcaattgtggccaagaccacggtcacggtccctaacgacggcggccccatcgaggcggtctcaaccatcgagaccgtaccttattggacccgttctcggcggaaaaccgggacactgcagccatggaatagcgactcgacccttaactcccgccagctcgaaccacgcacggaaacagactcagtaggtacgccgcagtcgaatgggggcatgcgcctgcacgactttgtttctaagacggtgatcaaacctgagtcctgtgtgccatgtggaaagaggatcaagttcggaaagctatctctcaaatgtagggactgcagggtagtcagccaccctgagtgtagagatcgatgtccactgccctgtataccgactctgattggcactcctgtgaagatcggcgagggcatgctggccgactttgtgagtcagactagcccaatgatacccagcatcgtggtgcactgcgtaaacgaaatcgagcaacggggcttaacggaaactggcttgtaccggattagcgggtgcgaccgtacggtcaaagaacttaaagagaagtttctgcgtgttaagaccgtgccgctcctgtccaaggtcgacgatatccacgcaatctgctccctactgaaagattttctccgaaacttaaaagaacccctcctaaccttccggctcaacagggcattcatggaggcagctgagattacagatgaagacaactccatcgctgccatgtaccaggccgttggggaattacctcaggcgaaccgggacacactcgccttcttaatgatccacctgcagagagtggcgcagtccccccatacaaagatggacgtggcaaaccttgccaaggttttcggaccaacaatcgtcgcccatgctgtaccgaacccggaccccgtgactatgctccaggatatcaagcggcagcctaaagtcgttgagcggctgctctcgctcccattggaatattggtcacagtttatgatggttgaacaggagaatattgatcccctgcatgtgatcgagaattcaaacgctttttctactcctcagactcccgacatcaaggttagccttctgggaccagtgacaactccagagcaccagctgctcaaaacgccatcgagttcttccctgagccagagggtgaggtcaaccttgaccaaaaacacaccacggttcggtagtaagagcaagagtgcaacaaacctggggaggcagggcaatttcttcgctagcccgatgctgaaatag

SEQ ID NO: 18085 - DNA, 1134 bp, Artificial Sequence
  Description of Artificial Sequence: Synthetic coding sequence
atggccactatccccgactggaagctgcagctactagccagacgacgccaggaggaagcttcagttcgagggcgagagaaggccgaaagggaaagattgagccagatgcccgcctggaaaagagggctgctggagcgccgaagagccaagttgggcctctctccgggcgagcctagcccagtgctaggaacggtagaggcgggcccccccgatcccgacgaatctgccgtgctgctggaggcaatcggccccgtgcatcaaaatagattcatccggcaggagcgccaacagcagcaacaacagcagcagcggtcagaagaactactggcggagaggaagcctggacctttggaagctagagaaagacgcccctccccaggagaaatgagggatcagagccccaaggggagagaaagtcgggaggagagattatcaccaagagaaactcgcgaacgaaggctggggattggaggggcccaggaactgtcattgcgccctctggaggccagggactggaggcagtcacccggcgaggtgggtgatcgctcttctagactgagcgaggcatggaagtggcggctgtcacccggggagacgccagaacgttccttgagactcgctgaatcgcgggaacagtctccacggcggaaggaggttgagagtcgcctctctcctggagagagcgcttaccaaaaacttggtttgactgaggctcacaaatggcgtcctgactcccgagagagccaagagcagagcctagtgcaactggaggcaaccgagtggcgattgcggtccggggaggaacgtcaggattacagcgaagaatgtggccggaaggaggagtggcctgttccgggggttgccccaaaagagacggctgagctaagcgagaccctcacccgggaagctcagggaaattcctctgccggcgtagaagcagccgaacagagacccgttgaagacggggaacgagggatgaaacccacagaaggctggaagtggactctgattatgtccctagctggcaagggaaatcagcacttagtgacgtgctttccccatcctgtgagtggcggtcgagcaaattgccccattagtaccctgatccaatcaccttggtgtgggtgggggtag

SEQ ID NO: 18086 - DNA, 1134 bp, Artificial Sequence
  Description of Artificial Sequence: Synthetic coding sequence
atggcgacaatacccgactggaaattgcagctcttagcgcgacgacggcaggaggaggctagcgtaaggggacgcgagaaagccgagagggagagactcagccagatgcccgcctggaagcggggactgttagaacggagacgagctaaacttggtttaagccccggcgaaccatccccggtcctgggtactgtcgaggctggcccgccagaccctgatgagagcgccgttctcctcgaagctattggacccgtacaccagaataggtttatcagacaggagcgccaacaacaacagcagcagcagcagcgttcagaggaacttctggccgagaggaaacccggtccactcgaggctagagaaagacggcctagccctggagagatgagagaccagagtccaaaaggaagggaaagtcgcgaggagaggttgtctcctagagaaactcgggaaaggcggctgggaatcggcggcgctcaggaactgagccttcgccccctggaagctagggattggcggcagagcccaggggaggtgggagatcggagcagcagattgagcgaggcctggaaatggcgcctatctccaggcgagacccctgagagaagcctacgcctcgccgagtcacgggagcaatctcctaggcgaaaagaggtggagagtcgattgagtccaggcgaaagtgcctatcagaagctaggattaaccgaggcacataaatggagaccagacagccgtgaatcccaggaacagtcactcgttcagcttgaagccaccgagtggcggcttcgatccggcgaggaaaggcaggattactctgaggaatgtggccgcaaggaggagtggccggtccccggagttgcacctaaagagactgctgagctgagcgagaccttgacccgtgaggcacagggcaacagcagcgcaggcgtagaggcagcagaacagcgtcctgtcgaggatggagaacggggtatgaaaccgaccgaaggctggaagtggacactgattatgtccctggcagggaaaggcaaccagcatctggttacttgcttcccccacccagtgtcaggtgggcgggctaattgtcctattagtacactgatccagtccccttggtgcggctggggatag

SEQ ID NO: 18087 - DNA, 774 bp, Artificial Sequence
  Description of Artificial Sequence: Synthetic coding sequence
atgccacacctgccccttgcctcctttcgccctcctttctggggcctccggcattccaggggactgccgaggtttcatagcgtttcaacacagtccgagccacatgggtccccaatctcgcggaggaatagggaggccaagcagaagagactgagagaaaaacaggccactttggaggcggaaatcgctggagagtccaagagcccagctgagagtatcaaagcatggcgccccaaagagctggtgctgtatgagatccctaccaaaccaggcgaaaagaaggatgtatccggaccgctgccacccgcttactctccgcggtacgtcgaggccgcatggtacccatggtgggtaagggaagggttctttaagcccgaataccaggcaaggctcccacaggccaccggcgagacattctctatgtgcatcccacctccaaatgtaactggctctctgcatatcggacatgcgctaaccgtggccattcaggacgcccttgtgcgttggcatcgaatgcggggcgaccaagtattgtgggttcccgggagcgaccacgccggaattgccactcaggctgttgtggaaaagcagctgtggaaggaacggggagtacgacgccacgagctctcccgggaagcctttcttagagaggtctggcagtggaaagaggcgaaagggggcgaaatctgtgaacaactgcgagccctcggagcgtctctggactgggatagggtcttttaccatggctgttggctgctttcgggatgtgattag

SEQ ID NO: 18088 - DNA, 1446 bp, Artificial Sequence
  Description of Artificial Sequence: Synthetic coding sequence
atggcgtccgccgcctcagttacctcactggccgacgaagtcaactgtccaatctgccaggggacactgcgcgagccagttaccattgattgcgggcacaacttttgtcgtgcatgtttgacacggtactgtgagattcccggacccgaccttgaggagtctcctacctgtcctctgtgcaaggaaccttttcggccaggctcattccgacccaattggcagctggccaatgtcgtggagaacatagagcgcctgcagctggtttctactctgggcctgggggaagaggatgtatgtcaagagcacggagagaagatctatttcttctgtgaggacgatgaaatgcaactgtgtgtagtgtgccgggaagctggagaacacgcaacccacactatgcgcttcctggaggacgccgcggccccatacagagaacaaatacacaaatgccttaaatgtctgaggaaggaacgggaggaaattcaggaaattcagtcccgggagaacaagcgaatgcaggtgttgctcacccaggtgagcacaaaacgacaacaggtgatcagcgaattcgctcatttacggaagttcctggaggagcagcagtccattctgcttgctcagctcgagtctcaagatggcgatattctcaggcagcgcgatgagtttgacctcttggtggctggagaaatttgccgttttagtgccctgattgaagagttggaagagaaaaatgaacgaccagctcgagagctcttaactgacatacggtccactctcattaggtgtgaaacgaggaagtgccggaagcctgtcgcagtctcacctgagttgggccagcggatccgcgattttcctcagcaggccctgccgttacagcgagagatgaaaatgttcctcgagaatcttcccaaccacctggtgatccctacagcccatataagccttgacccacagacatcccacccaaagcttctgctgagtgaggatcaccagcgggcgcagttcagttataagtggcagaacagtcccgacaaccctcagcggtttgacagagctacctgcgtcctggcccacaccgggatcacaggaggacgacacacgtgggtcgtgtccatcgacctggcacatgggggatcttgtactgtcggggtggttagcgaagacgtgcagcgaaagggagaattacggctcaggccagaagaaggcgtgtgggccgtgcgcctggcctgggggttcgtatctgccctggggtcatttccaactcgcctaacactgaaagagcagccaaggcaggtccgcgtctctttagactacgaagtgggctgggtgacgttcacaaacgcggtaaccagggaacccatctacacatttaccgcaagcttcaccaggaaggtgattcccttctttggcctttggggaagaggcagtagcttctcacttagcagctag

SEQ ID NO: 18089 - DNA, 597 bp, Artificial Sequence
  Description of Artificial Sequence: Synthetic coding sequence
atgacgctgaggtgtttagaacctagtggtaacggaggcgaaggcacccgctcccaatgggggacagcgggaagtgccgaggaaccatcgccacaggccgcccggcttgctaaggctttacgtgagttagggcagactgggtggtattggggtagcatgacggttaacgaggccaaggagaagcttaaagaagccccagagggtaccttccttatccgtgatagttcacactctgattacctacttacaatttctgtgaaaacaagcgcagggcctaccaacctacgtatcgaataccaagacgggaagttcagattggactctattatatgcgtgaagtctaagctgaagcaatttgattcagttgtgcacctgatcgattattacgtgcagatgtgcaaggataagcgtactggcccagaggcgcccaggaatgggacagtgcatctgtatctgaccaagccgctgtatacttccgctccatctctccagcacctgtgccggctgaccattaataaatgtacaggtgcaatttggggccttcccctcccaactaggcttaaagactatctggaagagtacaagtttcaggtgtag

SEQ ID NO: 18090 - DNA, 345 bp, Artificial Sequence
  Description of Artificial Sequence: Synthetic coding sequence
atgaccactcgacaagctactaaggacccccttctgaggggcgtatctccaactccgtccaaaattccagtgcggagtcagaaaaggacgccatttcccactgtaacctcgtgcgccgtggatcaggaaaaccaggatccacgccggtgggttcagaagccacctcttaacatccaacgccccttagtggattctgcgggacctcgcccaaaggcccgccaccaggcagagacatctcagcggcttgtcggaatatctcaacctcggaaccctctggaggagctgcgaccgtctccgagaggccagaacgtggggccaggtcccccggcccaaacagaggcctag

SEQ ID NO: 18091 - DNA, 1446 bp, Artificial Sequence
  Description of Artificial Sequence: Synthetic coding sequence
atggcgtccgccgcctccgtcacctctctggctgacgaggttaactgtccaatttgtcaggggacactccgggaacccgtgaccattgattgcggccacaacttctgtcgtgcttgtctgacacgatattgcgaaatcccgggtcctgacctcgaagaatccccaacttgccccctgtgtaaagaacctttcaggcctgggtcttttaggcccaattggcagttggctaatgtagtggaaaacattgagcgcctgcagctggtgtccacgctgggtctgggagaagaagacgtctgccaagaacatggcgagaagatttactttttttgtgaggacgatgaaatgcagctctgcgtggtctgcagagaggcaggcgaacacgccacacataccatgagatttttagaggacgccgctgccccctaccgggagcaaatacataaatgtctgaaatgccttaggaaagagcgggaggagatccaagagatccagagccgcgagaacaagaggatgcaggtgctgctcacacaggtgtctacaaagaggcagcaggtcatttcagagtttgcgcacctgaggaagtttctggaggagcaacagagcatcctgcttgcgcagctggagagtcaggatggtgatattcttcggcagcgcgatgagttcgacctgctggttgcaggcgaaatctgcagatttagcgcactcatcgaagaactggaggagaagaacgagaggcctgccagagagcttctcactgatattaggagtactctgatcaggtgcgagactcggaagtgtcgaaaaccagttgcagtgtccccagagctgggtcagagaattagggattttcctcagcaagctctgcccctacagcgggaaatgaagatgttcctcgagaacctgcccaatcacctcgtcatccccaccgcccacatctccctggatccccaaaccagccaccccaagttgctcctgtcagaggatcatcagagagctcaatttagctacaaatggcagaactctcccgataatcctcaacggttcgaccgcgcgacatgtgtactagctcataccggaattactggaggccggcatacttgggtcgtcagcatagatcttgcacatggaggctcctgtactgtgggggtggtgtccgaggacgtgcagcgcaagggcgaactgcgtcttcgaccagaggaaggcgtttgggcagtgcgactggcttggggcttcgtgtccgctttgggatctttccctactcgactgacgctaaaagaacaacccaggcaggtgagggtgagcctggattacgaggttggctgggtgacatttaccaatgcagtaacccgggagcctatctacacattcacagcttcttttacaaggaaagttattcctttttttggattgtggggtagaggctcctccttctcactttcttcctag

SEQ ID NO: 18092 - DNA, 396 bp, Artificial Sequence
  Description of Artificial Sequence: Synthetic coding sequence
atgtctaagagatacctacagaaagccactaagggcaagctgttaattatcatcttcatcgtcaccctctggggaaaggtagtgagcagcgctaaccaccacaaagcacatcacgtgaaaacagggacttgcgaagtggttgctctgcataggtgttgcaacaaaaacaagatcgaagaaagaagccagacagtgaagtgctcttgtttccccggccaggtggcaggaaccacacgtgctgccccctcctgcgttgacgctagtattgttgaacaaaagtggtggtgccacatgcaaccctgcctggaaggtgaggaatgcaaagtgctcccggacagaaagggctggtcgtgtagctcaggtaataaagtgaagaccacacgggtaacacattag

SEQ ID NO: 18093 - DNA, 765 bp, Artificial Sequence
  Description of Artificial Sequence: Synthetic coding sequence
atggtacgagaggccaacattaagcaagccacagcagagaaacagttgaaggaggctcaaggcaaaattgacgtgctgcaggcagaggtcgccgctctgaaaacattagtccttagctcctcccccacgtcccccacacaggagcctttgccaggcggtaagactcctttcaagaaaggtcatactagaaataaaagcacgtcctccgccatgagtgggtcccatcaagatctgagcgtcatccagcctatagtgaaagattgcaaggaagctgatttgtcattgtacaacgagtttagactctggaaggacgaaccaacgatggatcggacctgtccttttctggacaagatttaccaggaggacatctttccgtgtctgacatttagcaaatctgagttggcttctgccgtgctggaggcggttgaaaacaatactctgagtatcgagcccgttggcctgcagcctatccgctttgtgaaggccagcgcagtagaatgtggaggtcctaagaagtgcgccctgaccgggcagtctaagagctgcaagcacagaattaaactcggtgatagctctaattactactatatttctccattttgtcgatatcggattacctccgtgtgtaacttcttcacttacatcaggtacatccagcaaggcctggttaaacagcaggatgtggaccagatgttttgggaggtgatgcaactacgtaaggagatgagcttggccaaactcggatacttcaaggaggagctgtag

SEQ ID NO: 18094 - DNA, 2772 bp, Artificial Sequence
  Description of Artificial Sequence: Synthetic coding sequence
atgtgcattccgccccccaatgtcaccggctcgctccacattggtcatgccctgacagtggccattcaagatgcgttggtgcggtggcaccgcatgcgcggcgaccaggttctgtgggtgccagggagcgatcacgccggtatagccacgcaggccgtggtcgagaagcagctttggaaggaacggggcgtaaggaggcacgaactgagtagggaagcttttctgagggaggtgtggcagtggaaggaggcaaagggaggagagatctgtgagcaactgagggccctgggcgcatcccttgattgggatcgagagtgctttacaatggacgtgggtagctccgtcgcagtgaccgaggctttcgtgagattgtacaaggctggtttgctgtatcgcaaccaccagctagtgaattggagttgtgccctgcgatctgctatctcagacatagaggtggagaatagacctctaccaggccacacacagctcagattgcccgggtgtcccacgcccgtctcctttggcctgctcttttccgttgcatttcctgtggacggagagcccgacgctgaagtggtcgtgggtaccacccggccggaaactctgccaggcgacgttgctgtagcagtgcatcctgacgacagtagatatacccatctgcacggccggcagctcaggcatccattaatggggcagccacttccacttatcactgactatgctgtgcagcctcatgttggtaccggcgcggtgaaggtgacgccggcacatagtccagcagacgcagagatgggagccaggcacggcctctccccgctgaacgtcatcgcagaagacgggaccatgacgagcctttgcggtgactggcttcagggcctgcacaggttcgtggctcgtgagaaaatcatgtcagtccttagtgagtggggcttgtttcgaggcctgcagaaccatcccatggtcctgcctatttgttctagatctggcgatgtgattgaatatctgctcaagaatcagtggtttgtaagatgccaggagatgggagcccgcgcagctaaagccgtggaaagcggcgctctggagctttctcccagcttccaccagaagaactggcagcactggttttcccacataggggattggtgcgtgtctaggcaactctggtggggacatcagattcccgcctatctcgtcgtggaggaccacgcccaaggggaggaagattgttgggttgtggggcgatccgaagcagaggctagggaagtggccgccgagctcacaggcaggcctggagccgaattaaccctggaacgtgaccccgatgtactggacacatggtttagtagtgcattattcccattcagcgccctcggctggccacaggaaacccctgatctcgccaggttctacccactgagcctgctggagacaggaagcgaccttttgctgttctgggtaggccggatggttatgctggggacccaactcacgggccagctgcccttttccaaagtgctcctgcatcctatggttagagacaggcagggaaggaagatgtctaaaagcctcggcaacgtattagatcctcgcgacatcataagtggcgtggagatgcaagtgctccaggagaaactcagatcggggaacctcgaccccgctgagttagcgatagtggccgcagcccagaagaaggacttcccccacggcattcctgagtgtggcacggacgccctgaggttcacattgtgcagccatggagtccaagctggagatctccatctctcagttagcgaagttcaatcatgccggcacttttgcaacaagatctggaacgcactgcgctttattctgaatgccctgggcgaaaaattcgtccctcagccagccgaggaactgtccccctccagccctatggatgcctggatcctgtccagactcgccctagctgcacaggaatgtgaacgcggcttcttaacccgggagctcagcctggtcacgcatgcgctccaccacttctggcttcacaacctgtgcgatgtgtaccttgaagctgtgaagcccgtcctttggcattcgccaaggccgctaggcccaccgcaagtgctcttttcttgtgcagacctcgggctgcgcctgctcgcccccctcatgccttttctggccgaagaactgtggcagcgccttccccctcggcccggatgccctcctgctccttctatatcagtggctccttacccaagcgcatgctctcttgagcactggcgacaacctgagcttgagcgccgattttctagggttcaggaggtcgttcaagtgcttcgcgctttaagggccacatatcagctgactaaggccagacctcgcgtccttctgcagagcagcgagcccggggaccagggtttgttcgaggcatttctcgagcctttgggcacacttggatactgtggagctgtcggccttctgccccctggcgccgctgctccatccggctgggcgcaggctcccttaagtgatactgctcaggtgtacatggaactgcagggattggtggacccccagattcagctgcctttgttagccgctcgccgctacaagttgcagaagcagctcgatagcctgaccgcacgcacgccatcagaaggcgaagcaggaacgcaacggcagcagaagctgagtagcctccagctcgaactgagcaaattagataaagctgcttcacacctgcggcagctgatggatgagcccccagcgccaggcagccccgagctttag

SEQ ID NO: 18095 - DNA, 5229 bp, Artificial Sequence
  Description of Artificial Sequence: Synthetic coding sequence
atgatggagggcaatggtacggagaacagttgtagccgtaccagagggtggctccaacaggacaacgacgcaaagccttggctgtggaagtttagcaattgcttctcacgccccgaacagaccctccctcacagtccccagacgaaggaatacatggagaacaagaaggtggcagtggagttgaaggatgtgccatcacctctgcacgcagggagcaagctcttccccgcagtgcctctgccggacatcagatctctgcagcaacctaagatccagctttcaagtgttccaaaagtatcttgctgcgctcactgcccaaatgagccgtccacaagtccaatgcggttcggagggggtggaggagggtccggcggcacctcaagccttatacaccccggggccctcctggacagtcagtccactaggacaatcacctgtcaagttgggagcggtttcgcgtttcagtccgcgtcatctttgcagaatgcatctgctcgcaataacctggcaggcatcgctagcgacttcccctccatgtgcctggagagcaacctaagctcttgtaaacatttaccctgctgtgggaagcttcactttcagtcctgccacgggaacgtacataagctgcaccaattcccgagtctccagggatgtacttccgccggttactttccttgctctgactttacgtccggcgcccccgggcacctggaggaacacatctctcagagcgaactcaccccccacctttgcaccaattccctgcacctgaatgtggtgccgcctgtgtgtctgaaaggctcgctgtactgtgaggactgtctgaataagccggctagaaactcgataattgacgctgcaaaggtctggccgaatattccacccccaaatactcaacccgctcccctcgccgtgcctctgtgcaacgggtgtggaactaagggcaccggaaaagaaaccactctgctgctcgccacatccttggggaaagctgcctctaaattcggatcccccgaggttgctgtggcggggcaggtcctggaaaacctgccacccattggcgtgttctgggacatagagaactgttccgttccatcaggccgttcggccacggctgtggtccagcgcatcagggagaagttttttaagggccatagagaggcagagttcatttgtgtttgtgatatcagcaaagaaaacaaagaagtcatccaggaactgaataattgtcaggtgactgtcgcacatatcaatgctacagccaagaacgcggctgatgataaactgcgccaatctctgagacggttcgcaaacacgcatactgccccagccaccgtcgtgctcgtgtccacggatgtgaatttcgcactcgagttatccgatctgaggcataggcacggtttccacatcattctagtgcataaaaatcaggcgtccgaagctttactgcaccacgctaacgagctgattcgatttgaggagttcatttctgacctgccaccaagactgcctctgaaaatgccatgccatacactgctttatgtatacaacctgcctgccaataaagatggcaaaagtgtaagtaacaggctgcgccgcctgtctgacaattgcggggggaaggtcttgtcaataaccgggtgttccgccatactgcgcttcataaaccaggactctgctgagagggcccagaagagaatggaaaatgaggatgtcttcgggaatagaattattgtctcttttacccccaagaatagagagttgtgtgagactaagtcaagcaatgctatcgctgacaaggtgaagtcacccaaaaagctgaagaatccaaaactatgcctaatcaaggatgcctctgaacagtcgagttcagccaaggcgacgccagggaagggcagccaggcaaacagtggctcggctacaaagaatacgaacgtgaaaagcctgcaggaactgtgcagaatggagagtaaaactggccatcgcaactcagagcaccagcaaggccatcttcgcttagtggttcccacccatgggaattcatctgccgcggtcagcacacctaaaaacagcggggtggctgagccagtctacaagacatcacaaaagaaggagaacctcagtgctagaagtgttacaagcagccccgtcgaaaagaaggataaagaggaaacggtatttcaggtgtcttacccatcagccttttccaagcttgtagcatctcgccaggtatcccctctgctggcatcgcagagttggagtagctcccggagcatgtcacccaatctgttgaacagagccagccccctggcttttaacatcgctaacagtagttccgaggccgattgtccagaccccttcgccaatggggctgacgttcaggtgtccaacatcgactatcggctgtcccgtaaagagttgcaacagttgctccaggaagcttttgcccgtcacggcaaggttaagtcagtagagctgagccctcataccgattaccaactgaaggccgtcgtacagatggaaaacctgcaggatgccattggagcagtcaattctctgcaccgctacaagatagggagtaagaagatcctggtctctttagccaccggtgcggcatcgaaatctctgagcctgctgagcgccgagaccatgagtgtgctgcaagacgctcctgcctgctgcttgcccctgttcaaatttactgatatttatgaaaaaaagttcgggcacaaattaaatgtttctgacctatacaagctgacggataccgtcgctatccgtgaacagggaaatggcagacttgtgtgcctgctgccttctagccaggctcggcagtctccgctgggatcatctcaatcccatgatgggtcctctaccaactgttcacctataatctttgaggaactggagtatcacgagccggtgtgccggcagcattgttctaataaagacttcagtgaacatgagttcgaccccgatagctataagataccattcgttattctatctttgaagacattcgcacctcaggtccattccctgctgcaaacccatgaagggactgtcccgctcctatctttcccagactgctatatagccgaattcggcgatctcgaagtagtgcaggaaaatcagggtggcgttccccttgaacattttattacatgtgtccctggagttaacatagcgactgcacagaatgggattaaggtcgttaagtggatccacaataaaccccccccccctaacaccgatccatggctcttgcgcagtaaatcgcctgttgggaacccccagctcattcaattctctagggaggtcatcgacctactaaaaagccagccctcttgcgtgatcccaatctcacacttcattccttcttatcatcaccatttcgctaagcagtgccgggtgagcgattatggatactcaaaattaatcgagctgctggaggcagtgccccatgtgctgcagattctcgggatgggatctaagcgcctgcttacactgacgcatcgcgcccaggttaagagatttactcaagatttacttaaactccttaagagccaagcatcaaaacaggttattgtgcgcgagttttcccaggcctatcactggtgtttctcgaaggactgggacgtcaccgagtacggggtctgcgagctgatcgacatcgtctccgaaatccctgacacaaccatctgcttgtcacagcaggacaatgagatggtcatttgtatccccaagagggagagaacccaggacgagatcgagagaaccaaacagttcagcaaggatgtggtggacttgctgagacatcagccacattttagaatgcctttcaataaattcatccccagttaccaccatcacttcgggcgtcagtgtaagttagcgtattacggattcacgaaactcctggagctgtttgaagcaattcccgatacgttgcaggtgctggagtgtggggaggaaaagatccttaccctgaccgaggtcgagagatttaaagccctagcggcccaatttgtaaaactgcttcggtcccagaaagacaactgccttatgatgacagatctcctgaccgagtacgctaaaaccttcggctacacgttcaggctccaggattatgacgtgtcgtccatcagcgctttaacgcagaaactctgccatgtagttaaagttgctgacatcgagtcagggagacaaatccagttgatcaaccggaaaagtctgcggtccctcacagcccagctgttggttctgctcatgagctgggagggtaccactcacctttccgtcgaggaactcaagcggcactacgagtctacacacaacacgccactgaacccctgtgagtacgggtttatgaccctgaccgagctccttaaaagcctcccataccttgtagaggtcttcaccaatgacaaaatggaggaatgtgtaaaactaacaagcctgtacctgtttgcaaaaaacgtaagaagtcttttgcacacgtaccattaccagcagattttcctgcatgagttctctatggcatacacgaagtacgtgggtgagacgctccaacccaagacatacggtcacagcagcgtggaggagctccttggagctattccacaggtggtctggataaagggtcacggccataagaggatcgtcgtactcaagaatgatatgaaaagccgccttagctccctctcgctgagccctgccaatcatgagaatcagccaagcgaaggcgaaagaatccttgaggtgcccgagtctcacaccgcctctgagttgaaactcggagccgatggttcaggcccctcacacactgagcaggagctgttgaggttaaccgatgactcaccagtggacttgttgtgcgctccggtcccgtcttgcctgccctccccccagttgaggcccgatcctgtgattctacagtccgctgaccttatccagtttgaagagaggcctcaagagccgtccgagatcatgattctcaatcaggaggagaaaatggaaataccgatccccggaaagtccaaaacactcacaagcgacagcagctcttcatgcattagtgctgcggtccccgtgcctccctgcccatccagcgagaccagtgaatctctgctgtccaaagatccagtggagtcgccagcaaagaaacagcctaaaaacagagtgaaactcgccgcaaattttagcttggctccgattacaaaactgtag

SEQ ID NO: 18096 - DNA, 774 bp, Artificial Sequence
  Description of Artificial Sequence: Synthetic coding sequence
atgccgcacttgcccttggcctctttccgcccacctttctggggactgagacatagtcgcggtcttccccgcttccacagtgtgagcacccagtccgagcctcacgggtcaccgatcagcaggcggaatcgggaggccaagcagaaacgccttagggaaaagcaggctactctagaagctgaaatcgcaggggagagcaagtcccccgccgagagcatcaaagcttggcggcctaaagaactggtcttatatgagattcccacgaaacctggggaaaaaaaagacgtgagcggacccctgccccccgcgtattctccccgttacgttgaggccgcctggtatccgtggtgggttagggaaggatttttcaagcctgagtaccaggcccgcttgccccaggcaaccggcgagactttttccatgtgtatccctccacccaatgttactggctctctccatattggtcatgctctaacagtcgccatccaggatgctttggtgcggtggcatagaatgagaggtgaccaggttttatgggtccctggctcagaccatgccggaatcgccacacaggcagttgtagagaagcaattatggaaagagaggggcgtgagaagacacgagttaagccgagaggcctttttacgagaagtgtggcaatggaaggaggccaagggcggagagatctgcgaacagctcagggcacttggcgccagcttggattgggatcgggtgttttatcacggatgctggctgctgtcgggttgtgattag

SEQ ID NO: 18097 - DNA, 1134 bp, Artificial Sequence
  Description of Artificial Sequence: Synthetic coding sequence
atggcaacgattcctgactggaagctgcaacttctggcccgcagacgacaggaggaggcttcggttcgcgggagagaaaaagcagagcgagaaaggctgtctcagatgcctgcatggaaacgcggacttttggagagacgccgcgccaagctcgggcttagtcccggcgagccttccccggtgttgggtaccgtggaggctgggccgccagaccctgacgaatcagccgtgctgctggaagccatcggccccgtacaccaaaatcgctttatccggcaggagagacagcagcagcagcagcaacaacagagaagtgaagaacttctggccgagcgaaagccaggtccgctggaagcacgcgaaagaagacccagtccgggtgagatgcgggaccagtcccccaaaggaagagaatcaagagaggaaaggctttcacctagagaaaccagggaaaggcgtctgggaattggaggcgctcaagagttgtctctgaggccgttggaggctcgcgactggcggcagtcaccgggcgaagtcggggatagatctagtcgactgagcgaagcctggaaatggcgcctgagtccaggggagacacccgaacgatctctgcgacttgccgagtctcgcgagcagtccccaagacggaaggaagtcgagagtcgtctgtcaccaggcgagtcagcatatcagaaacttggcttaactgaggctcataagtggaggcctgactctcgcgaaagccaggagcagagtttggtccagctggaagccaccgagtggagactgagaagtggggaggagcgccaagactatagcgaggaatgtggacgaaaagaagagtggccagtccctggggtggccccaaaggagaccgccgaactgtctgaaaccttaacccgagaggcacagggcaattcttctgcaggggtggaggccgctgaacagcgaccagttgaggacggagaaagggggatgaaacccaccgaaggctggaagtggactttaattatgtctctcgcaggcaaggggaaccagcatctggttacgtgcttcccccaccccgtttccggtgggcgcgctaattgtcctattagtactttaatccagagcccatggtgcgggtggggctag

SEQ ID NO: 18098 - DNA, 495 bp, Artificial Sequence
  Description of Artificial Sequence: Synthetic coding sequence
atgcggatattaatacttggattggatggagcaggaaaaaccactatactgtacaggttgcaggtgggggaggtggtcaccacaatacccaccattgggttcaacgtagagacagtgacatataagaatcttaagttccaggtgtgggacctgggtggtcaaacgagcatccggccctactggagatgttactatagcaatacagacgctgtgatttatgttgtggacagctgcgatagagacaggatcggtatatccaagagcgaattggtggcaatgttagaggaggaagaactcaggaaggccatcttggtagtgtttgccaacaaacaggatatggagcaggccatgacatcttccgagatggccaattcccttggccttccagccctgaaggatagaaaatggcaaatttttaaaacatctgcgaccaagggcacagggctggacgaagccatggagtggctggttgagaccctgaagtccaggcagtag

SEQ ID NO: 18099 - DNA, 393 bp, Artificial Sequence
  Description of Artificial Sequence: Synthetic coding sequence
atggatacgatgatgctgaatgttagaaacctcttcgagcagctggtgaggagagtcgagattctgagtgagggcaacgaggtgcaattcattcagctggccaaggacttcgaagacttcagaaagaaatggcaaaggacggaccacgagctgggcaagtacaaagacctcttgatgaaggccgaaacggaaaggtccgcattggacgtgaagcttaagcacgcgcggaaccaagtggatgtggagattaaacgacggcagcgcgcagaggcggattgtgaaaagctggagagacaaatccagctcattcgtgaaatgttgatgtgcgacacctctgggtccattcaactgagcgaggagcagaaaagtgccctggcattcctgaataggtag

SEQ ID NO: 18100 - DNA, 324 bp, Artificial Sequence
  Description of Artificial Sequence: Synthetic coding sequence
atggataccatgatgttgaatgttcgaaacttgtttgagcagctggttaggcgtgtcgaaatcttgtcggaggggaacgaggtgcagtttattcagctcgcgaaagacttcgaagactttagaaaaaaatggcagcgtaccgatcatgagctaggcaaatataaggacttactcatgaaggccgagaccgagagatcagccctggatgtcaagcttaaacatgcacgaaatcaggtcgacgtggaaattaagcggcggcagcgggcagaagctgactgcgaaaagttagagaggcagatccagctaattcgcgagatgctgtag

SEQ ID NO: 18101 - DNA, 885 bp, Artificial Sequence
  Description of Artificial Sequence: Synthetic coding sequence
atggacacaatgatgcttaacgtgaggaacctcttcgaacaactggtcaggcgcgttgaaatcctcagcgaaggcaatgaagtccagttcatccagctggccaaggatttcgaagacttccgcaagaagtggcaaagaacagatcacgaactgggcaagtataaggacttactcatgaaagctgaaactgagcggtcagcactcgatgtaaaattgaaacatgctcgtaatcaagtggatgtcgagatcaagcgccgccagcgcgctgaagcggattgcgagaaattggagaggcagatacagctgatcagggagatgcttatgtgcgatacatctggatctatccaactgtcagaggagcaaaagtctgcgctggcttttctcaaccgaggtcaaccctcatctagcaacgctggaaataagaggttatccaccatagacgagtctggaagcatcctgtcggatatttcattcgacaagactgacgagagtctagactgggacagttccttagttaagacatttaagttaaaaaaaagggagaaaaggagatcgaccagtaggcaattcgtcgacggcccaccggggccggtcaagaagacgcgttctataggcagcgcagttgaccagggaaacgaatctattgtcgccaagactacagtgacagttcccaacgacggaggccccatagaggcagtgagtaccatcgagaccgtgccatactggacaaggagcagacggaagactggcacactgcaaccatggaattctgatagcacgttgaattcacgccagctggagccacggacagagaccgacagtgtgggcaccccccaaagcaacggggggatgcggctgcacgatttcgtgtctaaaacagtgtag

SEQ ID NO: 18102 - DNA, 504 bp, Artificial Sequence
  Description of Artificial Sequence: Synthetic coding sequence
atggaagaaacatacacagatagcttagaccctgaaaagctcttgcagtgtccctatgacaagaaccaccagattagagcctgtcgttttccctaccatctcattaagtgccggaagaaccaccctgatgtggccagcaagctggccacatgcccatttaacgctcgtcaccaggtcccccgcgccgagatttcccatcatatttcatcttgtgacgataggtcttgcattgagcaggacgtggtcaatcagacacgctctctgagacaggagaccttggctgagtctacctggcaatgccccccatgcgacgaagactgggacaaggatctttgggagcaaacctctacgccttttgtgtggggtaccacccactatagcgacaacaattccccggctagtaatattgttactgagcacaaaaataaccttgcctcgggaatgcgagtgcccaagtccttgccctacgtgctcccttggaagaataatggcaacgctcagtag

SEQ ID NO: 18103 - DNA, 882 bp, Artificial Sequence
  Description of Artificial Sequence: Synthetic coding sequence
atgctgagggaacctaggaagcaggggctggccggccgcgcccatctactgtcacctggaactacaggctctatgaaaacgcccgtggagctggcagtgagcgggatgcagacgctggggttacaacaccgttgcagggggggttatcgcgtgaaggcacggacttcttatgtggacgagacgttattcggaagtcccgctggaactcggcccactccgccggacttcgacccaccttgggttgagaaggccaatcgaacaagaggagtcgggaaagaagcatctaaagccctcggagccaaaggtagctgcgaaaccactccaagccgcgggagtaccccaactctcaccccgaggaaaaagaataaataccggccaatcagccacactccttcttactgcgatgaaagcttgttcgggtctcgctctgaaggggctagctttggcgcaccacgcatggccaagggtgacgcggctaaactgagggctctgctgtggacaccacccccaacaccacgaggtagccacagcccgcggcccagagaagcccccctgagagctattcacccggcaggcccatcaaaaacagaacccggaccagcagcagattcccagaaactatctatgggggggctccattccagtcgcccactcaagagagggttgagccattctctgacccatctaaatgtgccatctacaggacatcccgctaccagcgcgcctcacactaatggcccacaagaccttaggcccagcacttcaggagtaacatttcggagccctctggtcacgagcagggctcgatctgtgtccatctctgttccctccactccgcggagggggggagccacacaaaagcccaaacctccctggaagtag

SEQ ID NO: 18104 - DNA, 3282 bp, Artificial Sequence
  Description of Artificial Sequence: Synthetic coding sequence
atgggagggaaagcctggccaagacgagcagtcggaaccgcaggaggcccgtgtgccgagcaaatcagtgcacctttccaaacgttattaatgccccacttgccactggcctcctttcggccacctttttgggggctgaggcacagtagaggtttgcctagattccattcggtttccacacagagcgaaccgcacggctcaccaatatccagacgcaatcgggaagcaaaacagaagcgcctcagagagaaacaagcaacactggaggctgagatcgcgggcgaatctaagtcacccgcggagtccatcaaggcttggaggccaaaggagctggtgctgtacgagattccaactaaacctggcgagaaaaaggatgtctctgggcctctgccgccagcctattctcccaggtacgtcgaagccgcctggtacccatggtgggttagagagggatttttcaagcctgagtatcaagcccgcctccctcaggctactggcgaaactttcagcatgtgtatacccccaccaaacgtgaccgggtctctccacatcggtcatgctctgaccgtcgccattcaagacgccttggtacgctggcatcggatgaggggggaccaggtcctgtgggtgcccggaagcgaccatgcagggattgcgactcaggctgttgttgaaaagcagctgtggaaggagaggggggtccggcgccatgagctttctagagaagcttttttgagggaagtgtggcagtggaaggaagcaaaggggggggagatctgtgagcaacttagagcactgggcgccagcctcgattgggaccgggagtgtttcaccatggacgtcggctcttcggttgctgtgacagaagccttcgtcaggctgtacaaagcaggtctcctgtaccgcaatcatcagctggtgaattggagttgcgctttgcgctctgctatctcggacattgaggtcgaaaacaggccactccctggccacactcaactgcggcttcctggctgccccacacccgtgagctttgggctcctgttctcagttgcattcccagtggatggagagcccgacgccgaggtcgtggtcggaacaactcgtccagaaactctgccaggggacgtggccgtggcggtacaccccgatgactcacggtatacccacctccatggtcgtcagctgcgacaccccctgatgggccaacctctgccactgatcaccgattatgccgtccagccccatgtgggaactggagccgtgaaggtgactcccgctcactctccggctgatgccgaaatgggcgcgcggcacggcttgtctccacttaacgtcatcgcagaagatggcactatgacgagcttatgcggagactggctccagggcctccatcgatttgtcgcgagagaaaaaatcatgagtgttctcagcgagagaggtctttttagagggctacaaaatcatcctatggtcctgccaatctgcagtaggagtggcgacgtgatcgaataccttcttaagaatcagtggtttgtcagatgtcaggagatgggagcccgagcagccaaggctgtcgaaagcggtgcactggagctgtcgccgtcctttcatcaaaagaattggcagcactggttctcacacatcggagattggtgtgttagtcgacagctgtggtgggggcatcaaattccagcctatctggttgttgaagaccatgcacaaggggaagaagattgctgggtggtgggaaggtcagaggctgaggcgcgcgaagtcgccgcggaattgactggaaggcccggcgcagaactcacgctggaacgcgacccagacgtcctcgacacatggttctcaagtgctctcttccccttttccgccctgggatggccacaggagactcctgacttggcgaggttttatcccttatctttgttggagactggaagcgatctgctgctgttttgggtcggccgcatggttatgctgggtactcagctgacaggacagttgccgttttcgaaggtcttactccatcccatggttcgggacagacaaggcaggaaaatgagcaagagtctgggaaatgtcttggaccccagggatatcatatcaggggtggagatgcagctgctgcaagagaaactgcggtccggaaacctggatcctgcagaactcgcgatagttgccgccgctcagaagaaagactttccacatgggattcccgaatgtggcactgacgcgttgcggttcaccctctgttcccatggggtgcaagccggggatttacatctgagtgtgtcagaggtgcagtcatgccgccatttttgtaacaagatctggaacgctcttagatttatcctcaacgcactgggcgaaaagttcgtacctcagccggcagaagagttgagtccatcgtccccaatggacgcctggatcctgtctaggttggccctagccgcccaggaatgtgagcgtggcttcctgacccgcgaactgtccttggtgacacacgccctgcatcatttttggttgcacaacctttgcgacgtgtatctggaggcagtcaaacccgtgctttggcattcaccaaggccactggggcccccccaagttcttttctcatgcgcggacctcggtcttcgcctattggcgcctttaatgccattcctggctgaagaactgtggcagcgattaccgccacgtccgggctgcccaccagcaccaagtatttcagtcgcaccgtacccttcagcttgtagtctcgagcattggaggcaaccagaattggaacgtagattttcgcgcgtccaggaagttgttcaggtcctcagggcactcagggccacttaccaactgacgaaagctcgcccgagagttttactacagagctctgagcccggcgatcaggggctgttcgaagcttttttagagcccctggggaccctcgggtattgtggagcggtagggctgttgcccccaggtacagccgctcctagtggatgggcccaggcccctttgagcgataccgcccaggtctatatggaactccagggccttgtcgacccccagattcagcttcctctgctagccgccagacggtacaagctacagaagcagctggactctctgacagctaggaccccaagtgaaggagaggccggcactcagagacaacagaagttaagctccctgcagctggaactgagcaagctcgacaaagcggcctctcatctacgtcaactcatggatgagccaccagcccctgggtcccctgagttgtag

SEQ ID NO: 18105 - DNA, 276 bp, Artificial Sequence
  Description of Artificial Sequence: Synthetic coding sequence
atgggcaagaagacgaagaggaccgctgatagctcctctagcgaggacgaggaggaatacgttgtcgaaaaagtgctcgaccgccgggtggttaagggacaggtcgagtatctgttaaagtggaaggggtttagcgaggaacataacacctgggagccggaaaagaacctcgactgtcctgagctcatttccgagtttatgaaaaaatacaaaaagatgaaggaaggcgaaaataataagcctcgcgaaaagagtgagtctaacaaaaggaaatag

SEQ ID NO: 18106 - DNA, 390 bp, Artificial Sequence
  Description of Artificial Sequence: Synthetic coding sequence
atggcagaactcattcaaaaaaagttgcaaggagaagtggaaaaataccagcagctgcaaaaggatctctccaaatctatgtctggacgtcagaagctcgaagctcagctgaccgagaataacattgtcaaggaagaactagccctgcttgacgggagcaacgtcgtctttaaactgctcggccccgtcctggtgaaacaggagctaggtgaggcaagagccaccgtcgggaagcggctcgattacatcaccgcagagatcaagaggtacgaaagccagctgagggatctagagaggcaatccgaacagcagcgcgagacattggcccagttgcaacaggagtttcagagagcacaggctgccaaagccggggcaccaggcaaggcatag

SEQ ID NO: 18107 - DNA, 1134 bp, Artificial Sequence
  Description of Artificial Sequence: Synthetic coding sequence
atggccacaattccggattggaagctgcagctgctggccagaaggagacaagaggaggcctcagtccgcggccgcgagaaggccgagcgagagaggctttcgcagatgcccgcttggaaaagggggctccttgaacgaagacgtgcaaagctcggcctgagtcccggcgagccttcgccggtacttggcaccgtggaagccggtcctcctgacccggatgaaagtgccgtgctgctggaagcaattgggcccgtgcaccaaaatcggttcatccgccaagagagacagcagcagcagcagcagcaacagagatccgaagagctattggcagaaaggaaacccggtccactcgaagcaagagagaggcgaccaagccctggagagatgagagatcagtcgccgaaaggaagggagagcagagaagagagactgtctccaagagagaccagagaacggcggctgggcataggcggtgcccaggaactgagcttacggccactcgaagcccgcgattggcgacagtcccctggagaggtcggcgatcgaagcagccggctgtccgaggcttggaagtggcgcctcagtccaggcgaaacccctgaacgcagcctgcgattagctgagtctcgggaacagagcccacgccggaaggaggtggagagcaggctgagccccggagagtctgcatatcagaagctgggcctgactgaagctcataaatggcgacccgactcgagggaaagtcaggagcagagtttagtacagttagaggccaccgaatggcgccttcggtctggagaagaacggcaggattactccgaagagtgtggacggaaggaggaatggcccgtgcctggagtggcgccaaaagagactgcggagttgagcgaaacactcacacgggaagcccaggggaatagcagcgcaggcgtggaagcagcagagcagagaccggtggaggatggtgagcgtggaatgaagccaacggagggttggaagtggactctgataatgtccctggctggtaaggggaatcagcatttggtgacgtgcttccctcaccccgtttcaggaggcagagccaattgccccatcagcaccttgatccagtcaccatggtgcggctggggttag

SEQ ID NO: 18108 - DNA, 2031 bp, Artificial Sequence
  Description of Artificial Sequence: Synthetic coding sequence
atgtccgatcagattaaatttatcatggattctctcaacaaggagccttttaggaagaattataatctcatcacctttgacagtctcgagccaatgcagttgttacaggttctgagtgatgtgctggctgaaattgatcccaagcagcttgtggacattagggaagagatgcctgaacagacagcaaagaggatgctgtctctcctggggatcctaaagtacaagcccagcggaaacgcaaccgatatgagtacattccgccagggtctggttatcggttctaaacccgtaatttacccggttctccactggctgttacagcgcaccaacgagctgaagaaacgtgcataccttgctaggttcctgatcaaactggaggtgccaagcgaatttctgcaagatgagacggtggcggacacaaataagcagtacgaagagcttatggaggcgttcaaaacactccacaaggagtacgagcagttgaaaataagtggatttagcaccgccgaaattcgtaaggacatatcagccatggaagaggaaaaggaccagcttatcaagagggttgaacacctgaagaaaagagttgagaccgcccagaatcaccagtggatgttgaaaattgcacgccagctcagggtggagaaggagagagaagagtacctcgctcagcaaaagcaagaacagaagaaccagttgtttcacgctgttcagaggctgcagcgagtgcagaaccaattaaagagtatgaggcaagctgctgccgacgctaaaccagagtcactgatgaaacgactcgaggaagagatcaagttcaatctgtacatggtcaccgaaaagttcccgaaggaactggaaaataaaaaaaaagagctgcattttctgcagaaggtagttagcgagcccgctatgggccattcagatctactagaactagaaagtaagattaatgagattaatacagagatcaatcaactaatagaaaaaaagatgatgcggaacgagcctatagagggaaagctgagtttgtaccgccagcaagcttccattatctcaaggaagaaagaggccaaggcagaggagctccaggaagctaaagagaagctcgctagtttggaaagagaggcgagtgtgaaacggaatcaaactcgtgaattcgatggcactgaggtgctgaaaggagacgaattcaagaggtatgtgaataagctgaggagcaagagtacagtcttcaagaaaaagcatcagattatcgccgaactgaaagcggaattcggcctgctgcagaggaccgaagaactgcttaagcagaggcacgagaatatccaacagcagctacaaaccatggaagagaagaagggcatctcaggctactcctacactcaggaggagttggaacgcgtgagcgctctcaagtccgaggtggatgagatgaagggccgcactttggacgacatgtctgaaatggtcaagaagttgtacagcctggtgtccgagaagaaaagtgccctcgcctccgtaattaaggagttgagacaattgaggcagaaataccaggagttgacccaggagtgtgatgagaaaaaatcacaatacgatagttgtgccgcagggctggaaagtaataggagcaaacttgagcaggaggtgaggaggctgcgcgaggaatgcctccaggaggagagcaggtaccactacacgaattgtatgattaagaatttggaagtccagctccggcgggccaccgacgagatgaaggcctacatctctagtgatcaacaggagaagcgcaaggctatccgtgagcagtacacaaaaaataccgccgaacaggagaatttaggaaagaaactgagagaaaagcagaaggtgatcagggagagtcatgggccaaacatgaaacaggcaaaaatgtggagagacctggagcagctgatggagtgtaagaaacagtgctttctcaagcaacagtcccaaacctccattggtcaggtgattcaggaaggaggcgaggatcgcctcatcctctag

SEQ ID NO: 18109 - DNA, 456 bp, Artificial Sequence
  Description of Artificial Sequence: Synthetic coding sequence
atggacactatgatgctgaacgtgagaaacctgttcgagcaattagttagacgggtcgagattttatccgagggcaacgaagtgcagttcatccaactcgctaaagattttgaggacttcagaaagaagtggcagcggacggaccatgagctgggaaaatataaggacctcctcatgaaggccgaaaccgaaaggtccgcgctagacgtgaaattgaagcacgctcgcaaccaggttgatgttgaaattaaaagaagacagagggcagaggccgactgcgagaagctagagagacaaattcaactcatccgcgagatgctcatgtgcgacacctctggatccatccaactcagcgaggagcagaaatctgcattggcctttctaaatcgtggccaaccctcttcttccaacgcagggaataagcggctgtctaccatagatgaatccggatcatag

SEQ ID NO: 18110 - DNA, 1446 bp, Artificial Sequence
  Description of Artificial Sequence: Synthetic coding sequence
atggcctcggccgcttctgttacctcgcttgccgatgaggttaactgcccaatctgccagggaactctaagagaacctgttacgatagactgcggacataacttctgcagagcttgcctgactcggtactgtgagatcccgggaccagacctggaggagtcacctacctgcccactctgcaaagagcctttcaggccaggaagctttaggcccaactggcaactcgcgaacgtcgtcgagaacatagagaggctccagctggttagtaccctgggcttaggcgaagaagacgtctgtcaggaacatggtgaaaaaatctacttcttctgtgaagatgacgaaatgcagctgtgcgttgtgtgtcgggaggcaggtgaacatgccacacacacaatgagattcctggaagacgccgcagcgccttaccgcgaacagatacataaatgcctcaagtgtcttcggaaagagagagaagagattcaagaaatccaatcacgagaaaataagcggatgcaggttttgctcacccaagtaagcactaagagacagcaggtgatctctgaattcgctcatcttaggaagttcttggaggagcagcagtccatactcttagcacagcttgaatcacaagatggcgacattttgaggcagagggacgaatttgacttactggtagccggggaaatatgccgctttagcgcactcattgaagagctcgaagaaaagaatgaacgacctgctcgagagctcctgactgacatccgctccaccctcatccgctgcgagactcgtaagtgccgtaagccagtcgcggtgagtcccgaactgggtcagagaattcgcgactttccacaacaggccctgcctttacagcgtgaaatgaagatgtttctggaaaacctgcctaaccaccttgtgattccgactgcacacatcagccttgatcctcagactagccaccctaaattgctactgagcgaagatcatcagagggctcaatttagctacaagtggcagaattcccctgacaatccccagcggttcgacagggcaacctgcgtgctcgctcacaccggtatcactggaggtaggcacacctgggtggtgtcaatcgatctggcccacggaggcagctgcactgttggtgttgtgagcgaggatgtgcagcggaagggtgaactacggctgaggcccgaagaaggtgtttgggccgtgcgtctcgcctggggctttgtgtctgcgttaggaagcttcccaacaaggctgactttgaaagaacaacccagacaggtccgagtgtctctcgactacgaggtgggatgggtgacatttactaacgccgtgacgagagagcctatctatactttcactgcaagctttacacgcaaagttattccgttttttggcctttggggaaggggaagcagcttttccctgtccagctag

SEQ ID NO: 18111 - DNA, 765 bp, Artificial Sequence
  Description of Artificial Sequence: Synthetic coding sequence
atggtacgggaggctaacatcaaacaagccaccgctgagaaacagctcaaggaggcacaggggaagatcgatgtcctgcaggctgaagtcgcggcacttaaaaccctggttctaagcagtagccctacctccccaacacaggagccactaccgggcggaaagaccccgtttaaaaagggccacacacgaaataagtctaccagctcagctatgagcggatcgcaccaggacttgtctgtcatacagccgatagtcaaggactgtaaggaggctgatctgagcctgtacaatgaattcagactttggaaagacgagcctaccatggataggacatgcccgttccttgacaaaatttaccaggaggacatcttcccttgcctgacatttagcaaaagcgaactcgccagcgctgtgttggaggccgtggagaacaatacactgagtatagaacctgtaggcctgcagcctatacgcttcgtcaaggccagtgccgtggaatgtggtggccccaagaagtgcgcgctgaccggtcagtctaaaagttgcaagcacagaataaaacttggagattctagcaattactattacatctctccgttctgccgatataggatcacaagtgtgtgcaactttttcacatatatccgttacattcagcagggcttagtcaagcagcaggatgtcgatcaaatgttctgggaagttatgcaacttagaaaagaaatgagcctggctaaactggggtattttaaagaagaactctag

SEQ ID NO: 18112 - DNA, 1446 bp, Artificial Sequence
  Description of Artificial Sequence: Synthetic coding sequence
atggcttccgcagctagcgtgacgtccctcgctgacgaagttaattgtcccatctgtcagggcactctccgcgagcctgttactattgactgcggtcataatttttgcagagcatgtctgaccagatactgtgagattccggggccggatctggaggagagccctacatgtccgctgtgtaaagaaccatttcggcctgggtcatttcgacccaactggcaattagctaacgtggtcgagaacattgagaggctacaattagtatcaaccctgggcctgggcgaggaagatgtgtgtcaggagcatggcgagaaaatatatttcttttgcgaggacgacgaaatgcagctttgtgtcgtctgtcgcgaagctggagaacacgccacacacactatgaggttccttgaggacgctgcagctccttaccgagagcagattcacaagtgtttgaaatgtcttcgtaaagagcgagaggaaatccaggagattcaaagcagagagaacaaaaggatgcaggtgctcctcacccaggtgtcaaccaaacgccagcaggtcatctctgagttcgctcatctgcggaagtttctcgaggagcaacagtctatactgctggctcagcttgaatcccaagacggcgatatactaaggcagcgggatgagttcgacttgttagtggcgggtgagatttgccggttctctgccctgatcgaggaattggaagagaaaaacgagagaccagcccgcgaacttctaaccgacatccgcagcacactgattagatgcgagactcgaaaatgtcgcaagcccgtcgcggtgagtcccgagcttggacagcgaatccgcgatttcccccaacaggcacttcctctccaacgggagatgaagatgtttctggaaaaccttcccaaccaccttgtcattccaacagcccatatttccttggacccccaaactagccatccaaagctactgctgagcgaggatcatcagcgcgcccagttttcctacaaatggcaaaatagtcccgacaatcctcaacgttttgaccgtgctacctgtgtgctggcccacaccggaatcaccggcgggcgccatacctgggtggtgtccattgatctggctcacggggggtcctgcaccgtcggcgtggtgagtgaggacgtgcagaggaaaggtgagcttcgcttgaggcctgaggaaggcgtgtgggctgtcagactagcctgggggtttgtgagtgcacttgggagtttcccaacaagactgaccctgaaagagcagccgcgtcaggtccgagtgagcctggactacgaggtgggctgggtcacattcacaaacgctgtaactagagaacctatatatacttttacggcatctttcactcgaaaggtaattcccttctttggcctgtggggccggggttccagcttctctttgagttcatag

SEQ ID NO: 18113 - DNA, 1974 bp, Artificial Sequence
  Description of Artificial Sequence: Synthetic coding sequence
atgcttgggccttcttgggacggtgatgaggcagagtcaaccggtgaaattattagactcggagacactgctcatacattttccctgagatctaatggtgcacagtgcccaaacgagatgctgtccaagaaagctttggctagcccgagctccaaaagccacgaagacatgttgtacccccctagtgtcctgagtaaaagccgcacttccttcgtagaagacacagaaacccttagtgttagtggtatcccaaatgcacgaaagctgggtgaacccatacgcgcggcaatcccgctgcatccgccatatcaccctagcgagcctagagcaccctgtcctatcgggaaggaatacctccattcgtcccactgttccccagcagttaactcgacgggagagcataccgaattttctggtgatctcgatgatggattatttctgatttccaagctgccaaaagggtccaagtgggaggtgtacccggcccaggtccagggtcctcgaacacgaaagccaccgaaggggaagaggaacgagaatcgcgcaacagcctcatcctgcaattctccattcccgcagagaccaaggaagcggttaactgagcaggaattgcatgacgtctctgagaaactgagccagagactcagcgaactggattggatgttgaaatctgcccttggcgacaggatcaaggaaaaaactgatcacaaggaggagaatacagggaatgaagaggttgaggacggaacagaagagaccctgtcgcagcactcggatggaatcgttgagtatggtcctaagaaaagcagaccaggactttccatgagacgcaaacctccttacaggtctcacagcctgtcaccctcccccgtgaacaaacataaacagttccatctcgaacgcaaacggcagaggaagccaagagaaactgacgtccgccagtttcaggcccaggcctttactgaggccttcgaacgcgagcttcggcgccacaaagtgcaagagaacattggaccactgcgtatccatgagaaggaggaagaaactgagaagatttatcggggcgaggccgtcagaaaagggacaccggaatgtagccagccgtggaaaatttactcgcgtaagactaccacacagagtctcagggggggtctgcctaagcctaacaaggctgtaccaatgaaagttagtgagcattcccttctccctcttatgcttgagcagtttcctttcttgtatgtgtctggacctactctctctaagatgtggaagcaacagatagctcaggtggaacaactcaaaaaagaggcctgtcgagaaaaccgctctaagaagaagctccaggacgaaattgaagaagcgttgcgacggcatgatctcctgaccacactcgtcaaaaaggaatacgagcataataagcgacttcaggattttaaggactgtattcgacgtcagaggctaactcagtctaaaatcaaagaaaatagacagcagatcgtcagggcacgaaagtactacgacgattatcgcgttcaactctgtgcaaaaatgatgcggatgcgcactagggaagagatgatttttaaaaaactgtttgaggagggattaaatatacagaaacagcgactgagggacctgagaaattacgccaaagagaaaagagatgagcagcggagacgacaccaagatgaactggacagtatggagaactactacaaggatcagttctctctgctcgccgaggccataagtcaagagcatcaggagctgaaagccagagagaagtcccaggcacaaacattgcacaaggtgaagagagaactgcgtagcaagatggagaaggagattcaacagctgcaggacatgattacccagaacgatgacgacgttttttttagggaacttgaagcagagagattccgctccagacttcagctggctagcttccagtattccaaatctccgtccctttag

SEQ ID NO: 18114 - DNA, 507 bp, Artificial Sequence
  Description of Artificial Sequence: Synthetic coding sequence
atgcagactttcctaaaagggaaaagggtcgggtattggctgagcgagaagaaaattaaaaaactaaatttccaggctttcgccgagttatgcagaaagagaggaatggaggtcgtgcagttgaacctcagccgcccaatcgaggaacaggggccactcgatgtgattatacataagctaacggatgtgatcctcgaagcagaccagaatgattcccagtctcttgaattagtgcataggttccaggagtacattgacgctcacccagaaactattgtactggacccgctccccgccattcggacactgctagataggtccaaaagctatgaactcattagaaagattgaggcgtatatggaggatgaccgcatttgttcaccaccattcatggaactgacatccctgtgtggtgatgacaccatgagactgctcgagaaaaacggcttgacctttccttttatctgtaagacccgagtggcacatgggaccaatagtcatgaatag

SEQ ID NO: 18115 - DNA, 2211 bp, Artificial Sequence
  Description of Artificial Sequence: Synthetic coding sequence
atgctgattccggcactgcaaatttcggatagtgaatctgtgggtttggaggatggcattgagcaatccgcttacctgaccgagtctaaaatgaacgagagcaaaccaggtgatagtcaaaatctagcctgcgtgttctgccggaaacatgatgactgccctaacaaatatggggagaagaaaacaaaggaaaagtggaacctgacggtacattactattgcctcctgatgagcagcggcatctggcaaaggggaaaggaggaagagggagtctacggcttcttgattgaagatattaggaaagaggtgaaccgggcgtctaaactcaaatgttgtgtgtgcaagaagaatggagcctctattgggtgtgtggcccctaggtgcaagcgctcctatcattttccctgcggcttgcagcgcgagtgtatattccagtttactggcaacttcgcctcattttgttgggaccaccggcctgttcagattatcaccagcaataactatcgcgaatcccttccttgcaccatctgcctggagttcatcgagcccatccctagctacaatatacttcgaagtccctgctgcaagaacgcatggttccatcgagactgtcttcaagtgcaagctattaatgcgggtgtatttttctttcggtgtacgatctgtaataacagcgacatatttcagaaagaaatgctgagaatgggcatccacatccccgagaaggatgcctcctgggaacttgaggagaacgcttatcaagagttgttgcaacactatgagcggtgtgatgtgaggcggtgcagatgtaaagaaggtagggattacaatgcaccagactctaagtgggagatcaaacgctgccaatgttgtgggtctagcggaacccatctggcttgttccagtctgcggtcttgggagcagaattgggagtgcttggagtgtaggggaattatatataactccggtgaatttcagaaagctaagaagcacgtccttcccaacagtaataacgtcggaatcactgactgcttgttggaagaaagcagcccaaagctgccccggcaaagccctggttctcagagcaaggatctccttcggcaaggatcgaaatttaggaggaatgttagcaccctcttgatagagctgggatttcagattaaaaaaaagacgaagagactttatatcaacaaagcgaacatctggaatagcgctctcgacgcttttcgcaataggaattttaacccgtcctacgccatcgaggtggcctacgtgatcgagaacgacaatttcgggtccgagcacccaggctccaaacaggagttcctgtcccttcttatgcagcatctggaaaacagtagccttttcgaggggtcactgtctaagaatctaagcctgaacagccaggccctgaaagaaaacttgtattacgaagccggcaagatgctggcgattagcctcgtccatggaggaccttctccagggtttttctccaagaccctgttcaattgtttggtatatggccctgagaatacgcagcccatccttgacgacgtgtcagattttgacgtggctcaaattatcattaggattaacacggcaactacggtcgctgaccttaaatcaataattaacgaatgctataactatctggaactgataggctgtctgcgactcataactactctgagtgacaaatatatgctggtgaaagatatactcggctaccacgtaattcagcgggtccacaccccattcgaaagttttaaacagggacttaagaccctgggagtgctcgagaagatccaagcatatccggaagcattctgcagcatactctgtcacaagccagagagcctgtccgctaagatcctaagtgaactcttcaccgtgcatactctgcccgacgtgaaggccctgggcttctggaatagctaccttcaggccgtggaggacgggaaatccactaccaccatggaagacattcttatcttcgcaaccggttgtagctcaatccctccagccggctttaagcccaccccctccattgaatgcttgcacgtggattttcccgtcggtaacaaatgcaacaactgtctggcaattccaattacgaatacatataaggagtttcaggagaatatggactttactattagaaatacactacgactggagaaggaagagtcctcacactatatcgggcattag

SEQ ID NO: 18116 - DNA, 1131 bp, Artificial Sequence
  Description of Artificial Sequence: Synthetic coding sequence
atggccaatagcgcgaataccaataccgtgcccaagctttacagaagtgttatcgaggatgttataaacgacgtgagggacatctttctggacgatggagtggacgagcaggtgctcatggaactgaagacgctttgggagaacaaacttatgcagtccagggccgtggatgggtttcattccgaagaacagcaactcctccttcaggtgcagcagcagcaccagccacaacagcaacaacatcatcatcaccaccaccaccagcaggcacagcctcagcagaccgtaccgcagcaggcacagactcagcaagtactcattccagcctcacagcaagctacagcgcctcaggtcatcgtgccggacagcaaactcatacagcatatgaacgcctcaaatatgtctgccgcggcgaccgctgctacgctcgcacttcccgccggcgtaaccccagtccagcagattttgactaattctgggcagctgctgcaggtcgtgcgggcagccaacggggcccagtatattttccagccccagcagtccgtcgtgcttcaacaacaggtcattccacagatgcagcctggcggagtccaggctcctgtgattcagcaggtgctcgcaccattacccggaggcatctcccctcaaaccggagtcatcatccagccacagcagatactgtttacagggaataagacccaggtgatcccgacgactgtggccgcccctactcccgcgcaggctcagatcactgccacggggcaacaacagccacaggctcaacctgcccagactcaggccccactggttctccaggtcgacggcaccggggacacttccagcgaagaggacgaagacgaagaagaggactacgatgacgacgaggaggaggacaaggaaaaagacggagctgaggacgggcaggtcgaagaggagcccctgaattctgaagacgatgtatccgatgaagagggacaagaactgttcgacactgaaaacgtggtagtgtgccagtacgacaaaatacatcggagtaaaaataaatggaaatttcacctcaaagacgggattatgaatctgaatggtcgagattatatcttctcaaaagccattggcgacgccgagtggtag

SEQ ID NO: 18117 - DNA, 237 bp, Artificial Sequence
  Description of Artificial Sequence: Synthetic coding sequence
atggaaacggattgtaaccctatggagctctctagcatgtcaggattcgaggagggatctgagttgaacggcttcgagggcactgatatgaaggacatgcggctggaagctgaagctgttgtcaatgacgtgttattcgcagttaataatatgttcgtgtcgaaatctcttcggtgcgccgacgacgtggcctacatcaacgtggaaactaaagagcgtaacagatactgtctgtag

SEQ ID NO: 18118 - DNA, 747 bp, Artificial Sequence
  Description of Artificial Sequence: Synthetic coding sequence
atggcgtttagtggccgcgctagaccctgcatcataccagagaatgaagaaataccccgcgccgctctcaacactgtgcacgaagcaaacggtaccgaggacgagagagctgtctctaaattgcaacgtcgacactctgacgtaaaagtgtacaaagaattttgcgacttttacgcaaagttcaacatggccaatgcactggcttcggccacgtgcgagcgctgcaaaggaggctttgctccggctgagacgatagtgaattcgaatggagagctctaccacgagcaatgcttcgtgtgcgcacagtgcttccagcaattccccgagggccttttctacgagttcgagggaagaaagtattgcgagcatgatttccagatgctcttcgctccatgttgtcaccagtgtggcgagttcatcatcggccgagtaattaaagccatgaataatagctggcatccggagtgctttaggtgcgacctatgtcaagaggtgctggccgatattggattcgtcaagaacgccggcagacacctgtgtaggccttgtcataacagggaaaaagctcgcggtctgggaaaatacatctgccagaaatgccatgcaatcattgatgaacagcctctgatttttaaaaacgacccatatcatccagaccactttaattgtgccaattgcggacaagaaggaagcgattgtcgttgtacaggcgcagagcggggtgcaattctccctgccatgccttag

SEQ ID NO: 18119 - DNA, 2370 bp, Artificial Sequence
  Description of Artificial Sequence: Synthetic coding sequence
atgagcgctcagaccagtcccgcagagaaagggttgaatcccggcctcatgtgtcaggaatcgtacgcatgtagtggaacagacgaggctatcttcgaatgcgatgagtgctgctccctgcagtgcttaaggtgcgaagaggaactgcataggcaagaacgtctgcgaaatcacgaaaggatccggctgaagccggggcacgtgccctattgtgacctctgcaaaggactcagcggtcatctccccggcgttcgccagagggctattgtgagatgccagacttgcaagattaatctttgcctcgaatgtcagaagcgtacacattcgggtggcaataaacgcagacatccagtaacggtctacaacgtgtcaaacctccaagaaagtctggaggcagaggaaatggatgaggaaacaaagcggaaaaagatgaccgagaaagtggtatctttcctcctggtggacgagaacgaggaaatacaggtgaccaatgaggaggactttataaggaaactggactgcaaaccggatcagcaccttaaggtagtgtcgatcttcggcaacactggtgatggcaaatcccacactttgaaccacacattcttttacggcagggaggtctttaaaacatccccgacacaggaaagttgcacagtcggggtgtgggccgcatatgatccggttcataaggtggcagtgattgacacagagggcctcctgggcgctactgtgaatctgagccaacgtactcgccttcttctcaaggttttagcaatctcggacctggtgatataccgcacccatgcagatcggctacacaacgacttgttcaaatttctgggtgacgcttccgaggcttacctgaaacatttcaccaaagagctgaaggccacgactgcccgttgtgggctggacgtgcccttaagcaccctgggtcccgccgtgataatcttccatgagacagtgcacactcaattgttaggatccgatcacccatctgaggttcctgagaagctcatacaggatcgctttaggaaactcggacgctttcccgaggcgttttccagtattcattacaagggcactaggacatacaatcctccaacggatttcagcggcctgcgtcgtgcactggagcagttactggaaaataataccacgaggtcaccgcggcacccaggtgtcatttttaaagctctaaaagctctcagcgataggttttccggtgaaatccccgacgatcagatggcacactcatccttttttcccgacgagtattttacttgctcttccctgtgcctttcttgtggggtaggatgcaagaagagcatgaaccacggcaaggaaggcgttccccacgaggctaagtcccgctgtcggtactctcatcagtacgacaacagagtttacacctgtaaggcttgctacgaacgcggtgaggaggtgtccgtagtgcctaagacatcggcaagtacagatagtccctggatgggcctagctaaatacgcttggtccggctatgtgatcgaatgtcctaactgcggcgtggtgtatagaagccggcaatactggttcggaaatcaggatcctgtggacactgttgtcaggaccgaaatcgtccatgtctggcctggaacagacggatttttgaaagacaataacaacgctgctcaacggctgcttgatgggatgaactttatggcgcagtccgtctcagagctcagtctagggcctaccaaagctgtgacatcttggttgacagaccaaatcgcacccgcgtactggagaccaaacagtcagattttgtcctgtaataaatgtgcaacatccttcaaagacaacgacacaaagcaccattgcagagcctgcggagaggggttttgcgatagctgctccagcaaaacaaggcctgtccccgaacggggttggggccccgccccagtgcgcgtctgtgataactgctatgaggccagaaatgttcagttggcggtgaccgaggcacaggtcgatgatgagggtggcaccctgattgcgcgcaaagttggcgaggcagttcagaacaccctgggggctgtggtgacggccatcgacatcccccttggcctggtcaaagacgccgctagaccagcatattgggtccctgaccatgagatcttacactgtcataattgtcggaaggaattctccattaagctgagcaaacatcattgtagagcctgtggacagggtttctgcgatgaatgttcccatgacagacgggcagttccatctagaggttgggaccaccctgtgcgggtctgcttcaactgtaacaagaaacctgcctggacgtcgctgagtgtcatgactggaaaggggccactctgttag

SEQ ID NO: 18120 - DNA, 2271 bp, Artificial Sequence
  Description of Artificial Sequence: Synthetic coding sequence
ctggccgggaatgaaaccgaatgggtcacaatcgcgaataacctactgttcaaatgccacatacacctaagaatccacgagttgcaggattgtgatgcaaacgtgttcattgcactttaccagtctatcttaggcgagaaagtacctgatctgattgtgattccccgatcccaggaggatgatgcccacaacgtgcaggctgtgatcgattcactggccctagattatctccaagtcagccttagccacattacagccctctacagcgtttcgcgtcgtaagtattctgagcgtagaatgctgggaccgtcttgggacggagacgaggccgagtcaacaggagaaatcataagacttggtgataccgcacatacgttctcccttcgctctaacggcgcacaatgcccaaatgagatgttatccaagaaggctttggcaagtcccagttcaaagagccacgaggatatgctgtatccacctagcgtgctttccaagagccgcacttccttcgtggaagacaccgagactttgtcagtcagtggaatccccaacgcaagaaaactgggggagccgatcagagcggcaattccactccaccctccttaccatccaagtgaacctcgggccccctgcccaatcggcaaggaatatctgcatagcagtcattgttcacctgcagttaacagcaccggtgaacatacagaatttagtggagacctggacgacggactgtttctgatttctaagctgcctaagggatccaagtgggaagtttatcctgctcaggtacagggacctagaacccgcaaacctccgaagggtaagagaaacgaaaaccgtgccactgcgagcagctgcaatagtccttttccacagcgtccgaggaaacgccttactgagcaggagctccatgacgtatccgagaagctgtcccaaaggctgagtgaactggactggatgctcaagagcgcgctgggagatcgcattaaagagaagaccgatcataaagaggagaatactggcaatgaagaagtggaagacggcaccgaagagaccctatctcagcatagcgacggaatcgtcgaatacggacccaagaaatcaaggcccggtctctctatgcggcgaaagcctccatacagatcacactctctgagcccctcaccagttaataaacataaacagttccacttggagcggaagaggcagcggaaacctagggaaaccgacgtgagacagttccaggctcaggctttcaccgaggctttcgagagagaactgcgtcgccataaagttcaggagaatatcgggcccttgagaatccacgaaaaggaggaggagacggtgggaaaaaatatccaacggaggtccttcgttaaagagttacagaatgttgtttccccgggccggttcaccctggagaaaccccagcgaagagtgcggggcggattacccaaacccaacaaggcagtgcccatgaaagtcagtgagcattcccttctaccgctcatgcttgaacagtttccgttcctgtacgtgagtggccctacattaagcaagatgtggaagcaacaaatagcccaggtggaacaactgaagaaggaagcatgccgcgaaaacaggagtaagaagaaactgcaggatgaaatcgaagaagcgttgcgccgacacgaccttctcaccacacttgtgaaaaaagagtatgaacacaacaagaggctccaggatttcaaggactgcattcggagacagagacttacccagtccaagattaaggaaaatcggcaacagatcgtgagggctagaaaatactacgacgattaccgagtacaactgtgtgctaagatgatgcgaatgcggactcgggaggaaatgatctttaaaaaactctttgaggagggactcaacattcaaaaacagagactgagggatctgcggaattacgccaaagaaaagcgagacgagcaacgacggcgtcaccaggatgagctggactctatggagaactactataaggatcagttctcactgctcgcggaagccatatcccaagaacaccaagagttgaaggccagagagaagtcccaggctcagacacttcacaaggtcaaacgggagctgcggtcgaaaatggagaaagagatccaacaactgcaggacatgataacccaaaacgatgatgacgtgttcttccgagagctagaagcggaacgcttccgttcccgcctgcagttggccagctttcagtattccaaaagccccagcctgtag

SEQ ID NO: 18121 - DNA, 420 bp, Artificial Sequence
  Description of Artificial Sequence: Synthetic coding sequence
atggaaactgattgtaaccctatggaactcagctctatgtccggatttgaagagggcagtgagctcaatgggttcgagggcaccgatatgaaagatatgagattggaggcggaggccgtcgtaaacgatgtgctcttcgccgtgaacaatatgttcgtttctaagtcactcagatgcgctgatgacgtggcctatattaacgtggaaaccaaggagagaaataggtactgcttggagctgacggaggctggtctgaaggtggtcggatatgcttttgatcaggtggacgaccatctgcagaccccctaccatgaaaccgtgtactccctgctggatacattatcccccgcctatcgagaagccttcggtaacgccctgctgcagaggctggaagcactgaagcgggacggccagagctag

SEQ ID NO: 18122 - DNA, 300 bp, Artificial Sequence
  Description of Artificial Sequence: Synthetic coding sequence
atgaccgacactagacgtagggttaaagtctacacccttaatgaagatcgccagtgggacgatcgtggcactgggcacgtgagctcaggttacgtggagaggctaaagggtatgagcctgttggtgcgcgccgagtccgacggctctctgctgctggagtctaaaattaaccccaacacagcgtatcaaaagcagcaggacaccctcattgtgtggagtgaggcagaaaactacgacctcgccctctcttttcaagaaaaggccggatgcgatgaaatttgggaaaagatttgtcagtag

SEQ ID NO: 18123 - DNA, 2463 bp, Artificial Sequence
  Description of Artificial Sequence: Synthetic coding sequence
atgacagatactcggcgtcgcgtaaaggtttacactttgaatgaggaccggcaatgggatgatcggggtacaggtcacgtgagtagtggctacgtagagcgtctgaaggggatgagcctgctggtgcgggctgagagtgatggttctttgctacttgaaagcaagatcaaccctaacaccgcctatcagaagcaacaggacacgctcatcgtgtggtcagaggccgagaactatgatcttgcactaagtttccaggagaaggcagggtgcgatgagatctgggagaagatctgtcaagtacaggggaaagacccctccgtggacattacccaagatcttgtagacgagagcgaggaagaacgtttcgatgacatgtcgtcaccagggctggagctgccctcttgcgagctaagccgcttggaggagatcgctgaattggtggcctcctcactgccctcccctctgaggcgagagaaactggctctcgccctcgaaaatgagggttatattaagaaattgctggagttattccacgtttgtgaagatctggaaaacatcgaggggttgcatcacctgtacgaaatcatcaagggtatattccttcttaatcggacagctctgtttgaggttatgttctctgaagagtgcattatggatgtgatagggtgtttagagtatgacccagctttgtcacagccaaggaaacaccgcgaatttctgaccaaaaccgcaaagttcaaggaggtgatcccaatttctgatcctgaactgaagcagaaaatacaccagacatacagagtgcaatatatccaggacatggtcctgccaaccccgagcgtgttcgaagaaaatatgctgagcaccttgcactcctttattttctttaacaaagtggaaattgtgggaatgctgcaggaagatgagaagttcctgactgatctgttcgcccaactaacagatgaagccactgacgaagaaaagagacaagagcttgtgaattttctaaaagagttctgtgcattcagtcagacgctccaaccacagaaccgagatgcgttcttcaagaccctgtctaatatggggatcttacctgcattagaggtgattctcggcatggatgatactcaggtgaggtccgccgccactgatatcttttcatatctggtggaatacaatcccagtatggtgcgggagttcgttatgcaggaggcccagcagaacgatgacgatattctccttattaatctgattatcgaacatatgatctgcgacactgatccagaattaggaggggctgtccagctgatggggttgctccggactttggtggacccggagaacatgttggcgactgccaataagacggaaaaaaccgagttcttggggtttttctataaacactgcatgcacgtgctcacagcccccctgctggccaacaccaccgaggataagccaagtaaagatgactttcagactgcccagctcctggccttagtgttggaactgctcaccttttgcgtagagcaccacacgtatcacattaaaaattatattatcaacaaggatattctgcggagggtacttgtccttatggccagtaagcacgccttcctggcactgtgcgcacttagattcaaacgaaaaattataggcctgaaagatgaattttataacagatacatcatgaaaagtttcctgttcgaaccagtggtgaaggctttcctcaataacggctcacggtataatctgatgaatagcgcaatcatcgagatgttcgagtttattcgggtggaagatatcaaatccttgactgcacacgtgatcgaaaattactggaaggcacttgaagacgtcgattatgtccagaccttcaaaggactgaaactgagattcgaacaacagcgcgagagacaagacaatcctaagctagactcaatgcggagcattttgcgtaatcaccgatacagaagagacgcaaggaccctggaggatgaagaggaaatgtggtttaacaccgacgaggacgatatggaggatggtgaagcagtggtgtccccctcggacaagacaaagaatgatgatgacattatggaccccatcagcaagttcatggagcgaaagaaacttaaggagagcgaagagaaagaggttcttctgaaaaccaacctttctgggcgacagtccccaagctttaaactgtctctctccagcggaactaaaaccaatctcaccagccagtcctccactacgaaccttccaggctctcccggctctccgggatcacccggctccccgggctcaccaggatctgtgcccaagaatacatcacaaaccgctgcgatcaccacgaagggcggtctggttggcctagtggattacccagatgatgacgaggatgatgacgaagacgaggacaaggaagatacccttccgctgagcaagaaagccaaattcgatagctag

SEQ ID NO: 18124 - DNA, 396 bp, Artificial Sequence
  Description of Artificial Sequence: Synthetic coding sequence
atgaatgagtccaagcctggagacagccagaacttggcttgcgtcttttgtaggaaacacgatgattgtcctaacaagtatggagaaaaaaaaaccaaggagaagtggaacctgactgtgcattactattgtcttcttatgtccagtggaatttggcaacgggggaaggaagaggagggggtctacggctttctaattgaggacattagaaaagaagtgaaccgggcgagcaaactgaagtgctgtgtatgtaaaaagaacggcgcgagcattggctgcgtggctccccgatgcaagaggtcgtatcatttcccttgtgggctgcagcgggaatgtatattccagttcaccggcaattttgcatctttctgctgggatcatcgccctgtgcaatag

SEQ ID NO: 18125 - DNA, 5934 bp, Artificial Sequence
  Description of Artificial Sequence: Synthetic coding sequence
atggcggcaagatctgcaccctcttgccatctgagactggaatgggtttacggctacaggggtcatcaatgccgaaacaatttatactatactgccgccaaagagattgtgtactttgtggcgggcgtaggcgtcgtgtattcacctcgagagcaccgccagaagttttaccgtggccacagcgatgatatcatttctctagccctacatccggaaagagtgctcgtcgctaccggccaagtagggaaagagccttatatttgcatatgggatagttatacagtgcagactatttctgtcctgaaagacgtgcatacacacggtatcgcatgcctcgcatttgatctggacgggcagcgcttagtctccgtgggcctcgattccaagaacgcagtttgcgtctgggactggaaacgtggaaagatgttgtccatggcccctggccacactgatcgcatttttgacatttcttgggacctctaccagcctaacaagctggtttcgtgcggtgtgaaacacattaaattttggagcttatgtggtaatgctctgacccctaaacggggcgtttttggcaaaacgggggacttacagaccatcctgtgcctggcttgtgctcgagacgaattaacttactccggggcattgaatggcgatatctacgtttggaaagggatcaacctaattcgaaccattcagggggctcacgccgccggaatattctccatgaacgcctgtgaagagggcttcgcgaccggcggacgggacgggtgcattcgtctgtgggaccttacgttcaagcctattactgtcattgatctgagagaaaccgaccagggctataaaggtcttagcgtccgaagcgtctgttggaggggagaccatatcctggtcggtacgcaggactctgagatcttcgagattgtcgttcaggaaagaaacaaaccctttcttatcatgcagggtcactgcgagggggagctctgggcccttgccgtccacccaacaaagccccttgctgtgacggggagtgatgatcggtccgttcggatctggtctctggtggaccatgcgttgattgctcggtgtaatatggaggagcccattaggtgcgccgctgtaaatgccgatggaattcatctggccctgggcatgaaggacggatcgttcaccgtgctcagagtccgtgatatgacggaagtagtgcacatcaaggacaggaaggaggctatccacgagttgaaatattcacctgatggcacctatctggccgtcggctgcaatgattcatccgtggatatttatggggtggcgcagagatacaagaaagtgggtgaatgtcttggatctctcagcttcatcacacacttggactggtcttctgatagcagatatctgcagactaatgacgggaatggaaaacgcttattttaccgtatgcctggcggcaaggaggtaaccagcacggaagagatcaagggtgttcattgggccagctggacatgcgtctcaggactggaggttaatggcatctggcccaaatacagtgatatcaatgacatcaattctgtcgatggaaattacattggccaggtgctcgtgacagctgacgactacggtatcattaaactcttcagatatccttgcctgagaaaaggtgcaaagttcaggaagtacatcggtcacagtgcccacgtgacaaatgtaaggtggagtcacgactaccagtgggttatctccatcgggggtgccgatcatagtgtgttccagtggaagttcatcccagaacgaaaactaaaggacgctgtgcacatcgccccccaagagtccctggcagattcccatagcgacgagagcgattctgatctctcagatgtgcccgagctggacagcgagatagagcaggaaacccagctcacttacagacggcaggtgtataaagaagacctgccccaactaaaggagcagtgtaaggaaaaacaaaagtccgcgacatctaagagacgtgaaagagcgcccggcaactccatacgactgcattttgtgcacggttatcgaggctacgattgtagatcaaaccttttttacacccaaattggagaaatagtttatcatgtggcagccgtcggtgttatctataaccgccagcagaatactcagaggttctaccttgggcacgatgatgatatcctttgtctcaccatccatcccttaaaagactacgtggcaacgggacaggtaggcagggatccttctatccacatctgggataccgagaccatcaagcctctctctattctgaagggccatcatcagtatggagtcagcgcagttgattttagcgcagacggcaaaagacttgcctctgtgggcatagacgacagccatacagtggtgctgtgggactggaagaaaggggagaagctgtctattgcacgggggtctaaagataaaatttttgtagtgaagatgaatccgtatgtgcctgataaattaataaccgccggcataaaacacatgaaattttggcggaaagccggcggcgggcttatcgggagaaagggctacattgggaccttgggaaaaaacgataccatgatgtgtgctgtgtacgggtggaccgaggaaatggcctttagcggaaccagcacaggtgacgtgtgtatctggcgtgacatcttccttgtcaaaaccgtgaaagcccacgatgggcctgtgttttctatgcacgccctcgaaaagggctttgtgactggcggcaaagacggtatcgttgcattatgggatgattctttcgagaggtgcctgaagacttatgcgatcaagagagccgcgcttgctccaggaagcaagggactgctgctcgaggataacccgtccattcgggcaatctccctgggccatggacatatactcgtgggaaccaagaacggggagatactcgaagtggataagagcggacccattaccctgcttgtccagggtcacatggaaggcgaagtgtggggcctggcaactcatccatacctccccatatgcgccacagtgtccgatgataagaccttgcggatttgggatctttccccttctcactgcatgctggccgttcgcaagttaaaaaaaggtggacggtgctgttgtttctcccctgacgggaaggccctggctgtaggcctgaatgatggtagctttcttatggcgaatgctgacaccctcgaagatttagtgtcctttcaccatagaaaggacatgatcagtgacatcagattctcgcccggctcaggcaaatacttagccgtcgccagccatgactcctttatcgacatatataatgtgatgtctagcaagagagtcgggatttgtaagggtgctacctcttacatcacgcatattgactgggacattcgaggcaagctgcttcaagtcaatactggggccaaggagcaactgttctttgaggcgcctaggggtaagaaacagaccattcctagcgtcgaagtagaaaagatcgcctgggcgtcctggaccagtgtactcggcctgtgctgcgaaggtatttggcccgtcatcggtgaggtgaccgatgtcacagcgagttgcttgacctccgataagatggtgttggccactggcgatgaccttggctttgtcaagttatttcggtaccctaccaaagggaaattcggaaagttcaaacgctacgttgcacacagcacccacgtaacaaatgtccgctggacatatgacgattcaatgcttgtgacactgggcggcacagatatgtccctgatggtttggacaaacgagatggagggctatcgcgagaagcggccatgtgattcagaagaatccgacattgattctgaggaagatggcggatatgattcagatgtgactcgtgaaaatgagatctcgtatacaattcgggccctcagcacaaacatccggccaatgctggggattaaaccccatttacagcagaaagagcccagtatcgatgagcgccaaggcgtagtacgggggagccgaccccctgtctccagagctccacctcaaccagagaaactccagacaaacaacgtgggcaaaaaaaagagacccattgaagacctggtcctcgagctgatttttggctatagggggcgcgattgtaggaacaacgttcattatctgaatgacggagacgatatcatataccatacggcctcagtgggaatcctgcataatgtcgctaccggctcccagagcttctatcaggaacacaacgatgatatcctgtgtctgaccgtgaaccagcatccgaagtttattaacatcgtcgccacaggccaggtgggcgattccgccgacatgtcagcgaccgctccctccatccacatttgggacgctatgaataaacaaaccctcagcattctccgttgttaccatagtaagggggtctgctcggtgtccttcagtgcaaccggcaagttattattaagtgtcgggctggatccagaacatacaataacgatttggcgatggcaggagggagcaaaaatcgcctccagggccggtcacaaccagaggatctttgttgctgaattccgcccagactcggacacccaatttgttagcgtgggcgttaagcacgtgaagttttggacgcttgccggtcgcgctctgctaagtaaaaaggggctcctatccaccttagaggacgcccgtatgcagactatgctggccatcgcctttggcgccaacaatctcacctttactggcacaatctcaggggacgtctgtgtgtggaaagatcatatcctgtgccgcatcgtggcgcgggcccacaacggcccagtcttcgcaatgtacacaacgctgcgagatgggctgatcgtgactggtggcaaggagcggcccagtaaggagggaggcgcagtaaagctttgggaccaggagctgcgtagatgccgtgcatttagactcgaaactggccaggctacagactgcgttcggtctgtgtgtagggggaagggcaagattttagtggggacaaggaatgctgagatcatagaggtgggcgaaaagaacgcagcctgcaacattcttgtaaacgggcacgttgacgggccaatctggggactcgccacacacccatcaagggatttcttcctcagcgctgccgaagacggtaccgtgcggttgtgggatattgccgacaagaagatgcttaataaagtgaacttgggccacgccgcaagaacagtttgctattcacctgaaggggacatggttgctatcgggatgaagaatggggagtttattatcctgctggtctcttccctgaaaatttgggggaagaagcgggacagaaggtgtgcaattcatgacatcagattctccccagattcacgttacctagccgtgggatcgtcagaaaatagcgttgacttctacgatttaactcttggtcccactctgaatcggatctcctattgtaaagatattccgtcattcgtcatccaaatggacttcagtgcagacagtagctacctacaggtgtcttccggatgttacaaacgccacgtttacgaagtgccatccggtaagcacttgatggaccatgcagccattgataggattacctgggcaacatggacctcaatccttggtgacgaagtgcttgggatctggtccaggcacgccgagaaggccgatgtcaactgcgcgtgcgtatcccattctggtattagcctagtgactggcgatgattttggaatggttaagctgttcgactttccatgccccgagaagttcgccaaacataaacgcttcctgggccatagtccacatgtgacaaatattcggtttaccagtggcgatagacacgtggtgagcgctggcggtgacgattgtagcctcttcgtttggaagtgcgtgcacacaccacactag

SEQ ID NO: 18126 - DNA, 2502 bp, Artificial Sequence
  Description of Artificial Sequence: Synthetic coding sequence
atgacggatacacggcgacgcgtgaaagtatacacacttaacgaggataggcagtgggacgacagggggaccggccacgttagtagcgggtatgtggaacggttgaagggcatgtccctgctggtgcgggcagagtctgatggctcgttgctgttggagtccaagataaatcctaacactgcatatcagaagcagcaggatacactcatcgtctggagcgaagcagaaaattatgatttagcgctgtcgttccaggagaaggcagggtgtgatgagatctgggagaaaatctgccaagtgcaagggaaggacccaagcgtcgacattacacaggacctggtagacgaaagtgaggaagagagatttgacgacatgtcatcacctgggctggaattgccaagctgcgagctatctcggctcgaggagatcgccgagttagtcgcatcatcgctccctagccctcttcgccgggagaaactggcccttgccctggagaacgaaggctacattaaaaaactgctcgaactcttccatgtgtgcgaggatttagaaaatattgaggggctgcatcatctgtatgaaatcataaaaggaatatttctcctgaaccgcacggccctgtttgaagtgatgttctccgaagaatgtatcatggatgtcattgggtgtctggagtacgacccagctcttagccagccccgtaaacacagggaattcctgaccaagactgctaaatttaaggaggtgatacccattagcgatcctgaattgaaacagaagattcaccaaacctatcgggttcagtacatccaagatatggtactgccaacgccgagcgtttttgaggaaaacatgctttccactctccattcattcatttttttcaacaaggtagagattgtgggaatgctccaggaggacgagaagtttctgacagatctcttcgcacagctgaccgacgaggctacggacgaggaaaagcgccaggagttagttaatttcctcaaggaattttgtgccttcagccaaactttgcagcctcagaaccgagatgctttttttaaaaccctttccaacatgggcattctgccagcattggaagtgattctcgggatggacgacactcaggtgcggtcagcagcgaccgacatcttctcgtatctggttgaatacaacccatccatggtgcgagaattcgtgatgcaagaggcccagcagaatgacgatgtttcaaagaaactgacagagcagaaaattaccagcaaggatatcctcctcatcaaccttattatcgagcatatgatctgtgataccgatccggaactgggcggcgccgtgcaattgatgggtcttttgcggactctcgtcgaccctgagaacatgctcgcaacagctaataagactgaaaagacagagttcctcggatttttttacaagcactgcatgcacgtcctgactgcaccacttctggccaacaccactgaggataagcctagcaaggatgacttccagaccgcacagcttctcgcactggtcctcgaacttcttacattttgcgtggagcaccacacctatcatattaagaactacatcattaataaggacattcttcgccgtgtcttagtactcatggcgtcaaagcacgctttcctcgcgttatgcgcactgcggtttaaaaggaagataataggactcaaggacgagttctataatagatatatcatgaaatcctttctctttgaaccggttgtaaaagccttcttgaataacgggagccggtacaatcttatgaatagcgctatcattgagatgtttgagttcatcagggtggaggatatcaaatccttaacagctcatgtgattgaaaactattggaaggctttggaagatgttgactacgtgcagacatttaaagggctcaaactgcgttttgagcagcagcgtgagagacaggacaaccctaagctcgactccatgagatccatcctcaggaaccaccgatataggcgagatgctcggacactggaagacgaggaggagatgtggtttaatacagacgaggacgacatggaggatggcgaggctgttgtcagtccttcagacaagacaaagaacgacgacgacattatggatcccatctctaagtttatggagagaaaaaaacttaaggagagtgaagagaaagaggtgctgttgaagactaatcttagtggccgacagtcccccagcttcaagctcagcctctctagtggtaccaaaactaacctgactagccaatcttcaactaccaatttaccgggaagtccaggctcccccggctcccctggaagtccaggatcacctgggtccgtgcccaaaaatactagccagacggcagccataacaacaaagggggggttggttggcctcgtcgattatcccgacgatgatgaagacgacgatgaggatgaggacaaagaggacacattgccgctgtctaaaaaggctaaattcgacagctag

SEQ ID NO: 18127 - DNA, 3987 bp, Artificial Sequence
  Description of Artificial Sequence: Synthetic coding sequence
atgtggcgccggaagcatccaagaaccagcgggggaacgaggggcgtgctgtctggcaaccgcggagtggagtacggcagcggccggggacacctcggcactttcgagggccggtggcgaaagctgcctaaaatgcctgaggctgttggaacggatccctcaaccagccggaagatggccgagctggaagaagtgaccttggacggcaagcccctgcaagccttgcgcgtcactgacctgaaggctgcactggaacagcgagggcttgcaaagagcgggcagaaatcggccctcgtcaagaggttgaagggggcgctgatgctggaaaaccttcagaaacattcaacgccccatgctgcattccaaccgaacagccagataggcgaggaaatgagtcaaaatagttttattaagcagtatctcgagaaacagcaggagctgctccgacagcgactagagagggaggccagagaggccgccgagctcgaggaagccagcgcggagagtgaggatgaaatgattcatcctgaaggggtggcttccctgttgccgcccgatttccaaagctcactggagaggcccgaattggagttaagcaggcactcacctcggaagtcgtcaagcatttctgaggaaaaaggtgactcagacgacgaaaagcctaggaagggcgaacggcgtagcagtcgagtaaggcaggcacgggccgcaaagttgtcagagggatctcaacccgcagaagaggaggaagaccaggagacacccagccgaaacctgcgcgtgagagctgataggaaccttaagaccgaggaagaggaagaagaggaagaggaagaggaagaggatgatgaggaggaggagggtgatgatgagggccagaagtccagggaggccccaatcttaaaggagtttaaggaagagggagaggaaattccccgggtgaaacctgaggaaatgatggacgaaaggccgaagacacggagccaggaacaggaggtgttagagcgtgggggccgcttcacaagatcccaggaggaggctcgtaaaagccatctggcacggcaacaacaggaaaaagagatgaagaccactagccccttggaagaggaagagcgtgagatcaagagcagtcaaggattaaaggaaaaatccaaatctccctctcccccaagactgaccgaagatcggaaaaaggcgtctctggtagctctgccagagcagaccgctagcgaagaagagactccccccccccttctgacgaaggaggccagctcacctccccctcaccctcagctgcattcagaggaggaaattgaacctatggagggacctgcccccgctgttctgattcagctgtctccgccgaacaccgacgctgatactcgggagctcctggttagccaacacacagtccagcttgtcggaggtctgtctccactcagctccccgtctgacactaaagccgaaagcccggcagaaaaagtaccagaggagagcgtgctgcccttggtacagaagagcacactggcggattattctgcccagaaggatttagagcccgaatcagaccgctccgcgcaacctctaccactgaagattgaggagctggctcttgccaaagggataacggaggagtgtcttaagcagccaagcttggagcagaaggagggtcgtcgggcatctcacacccttttgccttcccaccgactaaagcaatcagcagattcaagcagttcccggtcaagtagcagttcatccagttcctcccgtagtcgctctagatctcctgattcctcaggatcacgatcccacagccctctgcggtctaaacagcgagacgtggcacaggccaggacccacgcgaaccctagggggaggcctaagatggggtcccgatcaacttcagagtcgcggtcgcgctctagaagcagatcccggtctgcctctagtaatagtcgaaagtctctgtcccctggcgtctccagggacagcagtacttcctatacggaaacaaaagatccctcatccggtcaagaagttgcaaccccacctgtcccccagctacaagtatgtgagcccaaagagcgtacgtccacatctagtagttctgtgcaagcacgacggctcagtcaacctgaaagtgccgagaaacacgtcacacagagacttcagccggagagggggtcacctaagaagtgtgaagccgaggaagcagaaccccctgccgctacacagccccaaacatccgagactcagaccagtcacctgccggagagcgaaagaatccaccacacagtggaagagaaggaggaggtcactatggatacttctgagaaccgacccgaaaacgacgtgcctgagccacctatgcccatcgcagatcaggtcagcaacgatgatcgccctgaagggtcagttgaagacgaggaaaagaaggaaagctctctccctaaatccttcaaacgcaagatctctgtggtttcaaccaaaggggtgcccgccggcaatagcgatacagaaggcggacagccaggtagaaagcggagatggggcgcttcgactgcgaccactcagaagaaacccagtatttcaattacaacagagtcattgaaagaagcggtggtggatttacacgctgatgatagtcgaatctctgaggacgagacagaacgcaatggcgacgacggcacacacgataagggactgaagatatgtcgcacggtcacccaggtcgtgcccgcggaaggacaggagaacggccaacgagaagaagaagaggaggagaaagagcccgaggcagaaccacctgtgccacctcaggtgagtgtggaggtggccctgcctcccccagcagagcacgaagtcaagaaagtcactcttggcgacactttaacacggcgcagcatcagtcaacaaaagagcggggtttctatcactatcgatgatcctgtacggacagcccaggtcccaagccctccgcgcggcaaaatcagcaacatcgtgcacattagtaacctggtacgcccattcaccctgggccagctaaaagagttgctcggcagaacaggcactctggtcgaggaggctttctggatcgataagataaaatctcactgctttgtcacctactcaacagtggaagaagccgtggccaccagaaccgccctgcacggagtgaagtggccccaaagtaatcccaagttcttatgtgccgactatgcggaacaggatgagttggactatcataggggactgctggtggatcgtccttctgaaaccaagaccgaggagcaggggatcccgcgccccctgcatccacccccaccaccccctgtgcaacccccccagcacccacgtgctgaacagcgcgagcaggagagagccgtgcgggaacagtgggccgaacgggaacgcgaaatggagaggcgcgagcgcacaagaagcgagcgcgaatgggatcgtgacaaggtaagagaggggcccagatccagatcccgaagtagagaccggagacggaaagagagggccaagtccaaggagaagaagtccgagaaaaaagagaaggcgcaggaagaacctcctgcaaaactcctggatgatctgtttagaaagaccaaggctgccccttgcatttactggctgcctttaaccgacagccaaattgtccagaaggaggccgaaagagccgaaagggccaaagaaagggagaagcggcgcaaggaacaggaggaagaggagcaaaaggagcgggagaaggaagctgagcgagaaagaaaccgacagcttgagcgtgagaagcgtcgcgagcactctcgggagcgggatcgggagcgcgaacgggagcgggagagggaccggggagatagggatcgggaccgcgaacgcgatcgtgagcgggggcgtgaaagagaccgtcgcgataccaaaaggcactcgaggtctcgctcccggtccacaccagtcagagaccgaggcggacggcgctag

SEQ ID NO: 18128 - DNA, 1089 bp, Artificial Sequence
  Description of Artificial Sequence: Synthetic coding sequence
atggcccatagctctttcttccctgacgagtacttcacatgctcgagcctctgcctttcatgtggagtgggttgtaagaaatccatgaatcacgggaaggagggagtgccgcacgaggccaaaagccgctgcagatactcccaccagtacgataaccgtgtttacacatgcaaagcgtgctacgaaagaggtgaagaagtctccgtggttcctaagacctcagccagcactgactctccatggatggggctcgcaaagtacgcctggtctggatatgtgatcgaatgtccaaattgcggcgtcgtgtataggtcacgtcaatattggttcggcaatcaggatcccgtagacaccgtggtgcggactgaaatcgtgcacgtctggccaggaactgacggttttttgaaggacaacaacaacgccgcccagcgtcttctggacggcatgaacttcatggcacagagtgtgagtgagttgagcctcggtcctacgaaagcggtgacctcgtggctcacggatcagatcgccccagcctactggcggccaaactcccaaattctcagttgtaacaagtgcgctacaagtttcaaagacaacgacaccaagcatcactgccgggcatgtggcgaagggttttgcgactcctgctcatcgaagaccaggccagtcccagagagaggatgggggccagcacccgttcgagtatgcgacaactgttacgaggccagaaatgtacaactcgcagtgacggaggcacaagtggacgatgagggcggcaccctcatcgccaggaaggtcggtgaagccgtccagaacaccctgggagcagttgttaccgctatcgatatcccattgggactggtgaaagacgccgctcggcccgcctattgggtgccggatcacgagattttacattgccacaattgcagaaaagagtttagcattaagctctccaagcaccattgtagggcgtgcggccagggattttgcgatgagtgctcgcacgataggagagccgtgccaagcagaggatgggatcaccctgtgcgggtgtgttttaattgtaataagaaaccaggcgatttgtag

SEQ ID NO: 18129 - DNA, 420 bp, Artificial Sequence
  Description of Artificial Sequence: Synthetic coding sequence
atggaaactgattgcaacccaatggagttaagctcaatgtccggattcgaggagggcagtgaactgaatgggttcgagggcacggacatgaaagatatgcgcctggaggccgaggcagtggtgaacgatgttttgttcgccgtcaataacatgttcgtgtcgaagtctctgcgttgcgccgatgatgtcgcctacatcaacgtagagactaaggaacgaaatcggtactgcctagagctgaccgaagccgggttaaaggtcgtaggatacgcttttgatcaggtggatgatcaccttcagaccccatatcacgagaccgtatactccctgctcgacaccctcagtcctgcctacagagaggcgttcggcaacgccttgttgcaacgcctcgaggctctgaagcgcgatgggcaatcttag

SEQ ID NO: 18130 - DNA, 2256 bp, Artificial Sequence
  Description of Artificial Sequence: Synthetic coding sequence
atgtccgaggaggaactcaccaaggccatggagggactcgggatggatgagggagatggagaaggtaacattctgcccatcatgcagtcaatcatgcagaacttactgtcaaaggatgtgctttatccaagtctcaaggagataacagagaagtatcctgaatggcttcagagtcacagagagtctctgcccccggagcagtttgaaaaatatcaggagcagcacagcgtgatgtgtaagatctgtgagcaatttgaagctgagactcccactgacagtgagactacacagaaagcccggtttgagatggtccttgacctcatgcagcagttacaagatctgggacatccaccaaaagaacttgccggggagatgttgacttggctgtttttctgcggctcacaatgggtctacggtccctggttgacttatgtcggttggctacaacagacctctttcaagatgagttccaaggggagcagcacggatggccgcactgatctggctaacggtagcctctcttctagccctgaagaaatgagcggggccgaggaggggagagaaaccagctccggaatcgaagtggaggcctcagatctgtcacttagtttgactggagatgacggcggccctaaccgcacctctactgagtctagaggaacagataccgagagctcaggggaggataaggattcagactccatggaggataccggacattatagtattaatgatgaaaacagagttcacgaccgatctgaggaagaggaggaggaggaggaagaggaggaagaggaacagccgcgcagacgagttcagagaaaacgagccaacagagaccaggacagctccgacgacgagcgggcgctggaggattgggtgtcaagcgagacatcagcactccccagaccccgatggcaggctctaccggcgctcagagagagggagctgggatcttctgcaagattcgtctatgaagcttgcggagcccgagtgttcgtgcagcgatttcgtctgcagcacggtcttgagggccacactgggtgcgtgaacaccctgcactttaatcagaggggtacctggttggcaagtgggagtgacgacctgaaggtggttgtctgggattgggtgcgtagacagcccgttctagacttcgagtccgggcataagagcaacgtgttccaggcaaagtttctccccaactctggcgactctacgctcgccatgtgcgcccgcgacggacaagtgcgggtggccgaactgagtgccacacagtgctgtaaaaacacaaaaagagtggcacagcacaagggtgcttctcacaagcttgctttggaacctgactctccttgcactttccttagtgccggcgaggatgccgtcgtgttcaccattgacctccgacaggacagaccagcatctaaattggtcgtgaccaaggagaaggagaaaaaagtcgggctctacactatctatgtgaatcccgcaaacacccaccagttcgcggtggggggcagagaccagtttgtgagaatctacgatcagcgcaagatcgacgaaaatgagaacaatggagttctcaagaaattctgtccacatcaccttgtgaactcagaaagtaaggctaatattacgtgtctcgtgtacagtcatgacggaactgaactgttggccagctacaacgatgaggacatatacctctttaacagctctcattccgatggagctcagtatgttaagagatacaaggggcatcgcaataatgctacggtgaaaggtgtcaacttctatgggcctaagagcgaattcgtcgtgtcaggttcagactgcgggcatatctttctttgggaaaaaagttcctgtcaaatcatccagttcatggagggggacaaagggggggtggtgaactgcctggagccgcatccccacctcccagtgttagccacatccggcctggatcacgacgtgaaaatctgggccccaacagccgaagccagtacagaactgactgggctgaaggatgtcattaagaaaaacaaaagggagcgtgatgaggatagcctccaccagacggacttatttgattcccatatgctctggtttttgatgcatcacttgcgccagagacggcaccatcggcgctggagggagccaggtgtcggcgccacagacgccgatagtgatgagagtccctcgagcagcgatactagcgatgaagaggagggccctgatcgtgtccaatgcatgccatcgtag

SEQ ID NO: 18131 - DNA, 1056 bp, Artificial Sequence
  Description of Artificial Sequence: Synthetic coding sequence
atgatcgttcagcgcgtcgtgctcaactcgcgcccaggaaagaatggaaacccagtggccgagaacttcagaatggaggaagtttatctcccagataacattaacgagggacaagtgcaagttaggacactgtatctgagcgtagacccatacatgaggtgccgaatgaacgaggacaccgggaccgattacatcactccctggcaactgagtcaggtagtggacggtggcggaattggaattatagaagaatcgaagcataccaaccttacgaagggcgatttcgtcacctctttctattggccttggcagaccaaggttatcctggatggcaactccctggagaaagtagatcctcaactcgttgacggacacctgtcgtactttcttggggccatcggcatgcccggtctgacatctctgatcggcattcaggaaaaaggccacattaccgcaggttcgaataagactatggtcgtttcgggagccgccggcgcttgtggatctgtagctggccaaattggacactttcttggttgctctcgcgtggtgggaatctgcggtacccacgagaaatgtatcctgctaaccagcgaacttgggttcgacgctgctataaattacaaaaaggataatgtggctgaacagctcagggagtcgtgtccagccggcgtcgatgtgtattttgataacgtcggggggaatataagtgacacggttatttctcagatgaacgagaacagccacatcatactgtgcggccaaataagtcagtacaacaaagatgtgccataccctcccccactcagtccagctatcgaagccatacagaaggagcgtaacatcactcgtgagagattccttgtgcttaattacaaggacaagttcgagcctggaatcctgcagttgagtcagtggtttaaggagggcaagcttaaaataaaagaaactgtgatcaacggattggagaacatgggcgcggcttttcagtcaatgatgaccgggggcaacatcggaaagcagatcgtgtgcatcagtgaggaaataagcctctag

SEQ ID NO: 18132 - DNA, 588 bp, Artificial Sequence
  Description of Artificial Sequence: Synthetic coding sequence
atgccgctgcccttcggattgaagctgaaaaggacacgccggtacacagtatcgagcaagtcctgtcttgtcgcacggatccagctcctgaacaacgaattcgtcgagtttaccctgtcggtagagtcgaccggacaggaaagtttagaggccgtggcccagcggctggaactgcgtgaagtcacatacttctcattatggtattacaacaagcagaaccagcgccgctgggtggacctcgagaaacccctgaaaaagcagttggataaatacgccctagagccaacagtgtacttcggcgtcgttttctacgtaccctcggttagtcaactccagcaggaaattacacgataccagtattacctgcagctcaaaaaagatattctcgagggcagcatcccatgcactttggaacaagcaatacagcttgccggcttggctgtccaagctgacttcggtgacttcgaccagtacgagagccaggactttttgcagaagtttgcactgtttcctgtcggctggctgcaggacgagaaagtgctcgaagaagcaacgcagaaagttgccttgttgcaccagaagtactag

SEQ ID NO: 18133 - DNA, 354 bp, Artificial Sequence
  Description of Artificial Sequence: Synthetic coding sequence
atgggagacaagaagagtcctacacgccccaagaggcagccaaaaccatcatccgacgaaggatactgggactgctcggtgtgcacctttaggaattccgccgaagcgttcaaatgcatgatgtgtgatgtgaggaagggcaccagtacccgagatagtaaggagggaggcaaattggtgtcctatagtaccgcttcactgggtgtaaggggaactttacgcaatcgagtcggggggggcagcagcgaagagaaaaaacaagcagagtacctcgctcctggacgacgcagaaatattgtccaccgcggcgttggcccaggccagcgttctggacctagccttaaagaggcctag

SEQ ID NO: 18134 - DNA, 3285 bp, Artificial Sequence
  Description of Artificial Sequence: Synthetic coding sequence
atggctgaatcctcttcggagtccgatcacttccggtgcagggatcggctgtccccttgggctgccaggtccacccaccgaggcactaggtcattacctactgtcgaggtaacagaaaaagtgaacacgataacctccactctccaggacacctcccgaaatctgcgacaggtggaccaaatgttgggccggtacagagaatactcaaatgggcaggcaggggctattgagcacctgaaagaaagtctcgagcagagcatcgatcagctccgctctcagcgcttactgagaaactccggaggacgcagtatttccgttacaagcctcagtgcttctgatctggacggcggaactgggtcagaactccaccacttcccccctacaagccccttgaaggattatggagatccacagggcatcaagcggatgcgatcaaggacaggggtccgcttcgtacaggaaacagatgacatgacacagctgcatggtttccaccagagtctgcgggatctgtctagcgagcagatacgccttggcgatgattttaaccgggagctgtcgcggcggtcgagatccgacgcagagaccaaaagggcccttgaggagctgacagagaagctgaatgaggcacaaaagcaggaggtggtttctgaccgagtagagcggcgtctgcaagagttagaacgcgaaatgaggacggaacgcgagctcgtggaacggagacaggatcagttgggcctaatgtcactccaactccaggaagctctgaagaagcaggaggctaaagctgacgagcacgagggtgcaatcaagaacaaactgaggcagactgagacagaaaaaaatcagctggagcaggagttggagttatcacgccgtcttctgaatcagtccgagggaagccgcgagacactattgcatcaggttgaagaactgaggacccaactgacgaaggcggaaggcgatagaaaaggactgcaacatcaggtctctcagatcagtaagcagcagtccaattaccaggacgagcaaggagaggactggcggttccggaggggagtagagcgcgagaaacaggacttggagaagcaaatgagtgatctacgagtgcagctaaacttcagtgctatggcgagcgagctggaggaagtgaagcgctgtatggagaggaaagacaaggagaaggctcacctggcctcccaagtggagaatctgacacgggagttggagaatggcgaaaaacagcagttacagatgctggatcggctgaaagagatacaaaaccactttgatacgtgtgaggccgagaggaaacacgctgacctgcagataagcgaactcactcggcacgctgaagacgcaacaaaacaggcagagagatacctgagtgaacttcagcagtccgaggcccttaaggaggaagcagaaaaacggagagaggatctgaaattgaaggcgcaggagtcaattcgccaatggaaactcaaacataaaaaactcgagcgggcacttgaaaaacagagcgagacggtcgatgaactgaccgggaagaataatcagattttgaaagagaaggacgagcttaagactcagctttacgcggcccttcagcagattgagaatcttcgaaaagaactgaatgacgttctgacaaagcgggcattgcaagaggaagagctgcatagcaaagaggaaaaattacgagatataaaatcacaccaggccgatctggagctcgaagttaagaattcactggacacaattcatcgtttagagtctgagctgaagaagcagagtaagattcagagtcagatgaaggttgagaaggcacatttagaggaagagatagctgagctgaagaagtctcaggctcaggacaaggctaagctgctggagatgcaagaatccattaaggacctctcagcaatccgcgcagatttagcgaacaagctggcggaggaggagcgcgctaaaaaagccgtactgaaagatctgtcggatctgacagcgcaggccaaatcacgggacgaggaaaccgccacaataattactcaacttaaactagagcgagacgtacatcaacgcgagctgaaagacctcaccagcagcctccagagcgtcaaaacgaagcacgagcagaatatccaggagctgatgaaacacttcaaaaaggagaaatctgaggctgagaaccacattagaaccctgaaagcggaatcactcgaggagaagaacatggcgaagatccatcgggggcaattagaaaagttaaagtctcaatgtgataggcttacggaggaactaacccagaacgagaatgagaacaaaaagcttaagctcaagtatcagtgcttaaaggaccagctggaagaaagagagaagcatatttcaattgaggaggagcacctgagaagaatggaggaggcacgcctccagctgaaggatcaactcctctgtctggagactgagcaggagtctatcctgggcgtgatcggaaaggagatcgacgccgcttgtaagaccttctctaaagacagtgtggagaaactcaaagtgttttccagcggccctgacatccactacgaccctcataggtggctggctgagtcaaagacaaaactccagtggttatgtgaagaactcaaagagcgagaaaatcgggagaaaaatctgagacatcaattaatgctgtgcaggcagcagctgcggaatctcactgagaataaggaatcagagctccagtgtctgttccaacagatagaacgccaagagcaactgctggacgagattcatcgagagaagagagacctcttagaggaaactcagaggaaggacgaggaaatgggaagtctgcaagatagagttatcgccctggagaccagtacccaggtggctctagatcaccttgagagtgttcccgagaaactgtccctcctggaggacttcaaggacttccgcgattcctgttcctctagcgaacgcacagacggcagatactccaaatatagggtccggcggaactcgttgcaacatcaccaggacgacactaaataccggacaaagtcgttcaagggagatcgaacctttttagagggttctcatacccggggtctggatcatagtagttcttggcaggatcacagcagatttttgtcctccccccgcttctcctatgtgaactcttttaccaagcggaccgtggcaccggactctgccagtaacaaggaagacgccacgatgaatggcacaagctctcagcctaagaaggaagagtatggatcttag

SEQ ID NO: 18135 - DNA, 1353 bp, Artificial Sequence
  Description of Artificial Sequence: Synthetic coding sequence
atgagagaaatcgtccacatccaggcaggccaatgtggcaatcaaatcggagcaaagttctgggaggtgatcagcgatgaacatggaatcgatccaagtggaaactatgtaggtgactcagatctccagctggaaagaattagtgtttactacaatgaagcttctagtcataagtatgtcccgagggcaattctcgtcgacctggaaccgggaactatggacagcgtgcggtctggcgcgttcggtcacctgtttcgccctgataacttcatttttgggcaatctggagctggcaacaattgggcgaagggccattacaccgagggggccgagttggttgactctgttcttgatgtggttcggaaggaatgcgagaattgcgactgtctgcagggatttcagctcacacactcactgggaggaggcactggatcgggaatggggaccctattgatcagcaaagttagggaggagtatccagatcggataatgaacactttctctgtggtgccctcacccaaggtgtcagatacagtggtggaaccctacaatgctaccctgagcattcaccaattagtggagaacactgatgaaacctattgtatcgacaatgaggcactttacgacatctgtttccgtaccctcaagctggcaacccccacgtacggcgatctaaaccatctagttagtgctactatgagcggggtgactaccagtctccggtttccggggcagctcaatgctgacctcaggaagctggcagttaatatggtgcccttccccagacttcacttcttcatgcccggctttgcccctctgactgcacggggttctcagcaataccgcgccctcaccgtgcccgaactcacccagcagatgttcgatgcaaagaatatgatggccgcctgcgaccctagacacgggagataccttaccgttgccactgtgtttagaggccgcatgtctatgaaagaggtggacgaacagatgctggctatacagtctaagaattccagctattttgtcgagtggatcccaaataacgtgaaggtagccgtatgcgatatcccaccccggggtcttaagatgtcatcaacatttatcgggaacagcaccgctatccaggaactgtttaagagaatttcagaacagtttacggcaatgtttcgtcgcaaagcttttctgcattggtatactggggagggcatggatgagatggaattcaccgaagcagagtcgaatatgaacgatctcgtgtcagagtaccaacagtatcaagatgcaaccgccgaggaggaaggcgaaatgtacgaggatgatgaagaagagagcgaggcgcaggggcccaagtag

SEQ ID NO: 18136 - DNA, 240 bp, Artificial Sequence
  Description of Artificial Sequence: Synthetic coding sequence
atgaacgagtctaagccaggcgacagtcagaatttggcatgcgtgttttgccgaaagcatgatgattgcccaaacaagtacggcgagaaaaaaaccaaagaaaaatggaacttaactgtacattattactgcctgctcatgagttctggtatttggcagcggggaaaggaagaagagggcgtctacggattcttaattgaggacatccggaaggaagtcaacagggcgtcgaagctgtag

SEQ ID NO: 18137 - DNA, 1785 bp, Artificial Sequence
  Description of Artificial Sequence: Synthetic coding sequence
atgaccgacacacgccgcagggtgaaggtctatactctgaacgaggatagacagtgggacgacagaggtactggacacgtgagtagcggctacgtcgaacgactgaaaggcatgtctctgcttgtgcgggcagagagcgatggctccctactactcgagtcaaaaattaatcccaatactgcttatcagaagcagcaggaggacgagaagttccttaccgaccttttcgcccagttgaccgacgaggccaccgacgaggaaaaacggcaagaactcgtcaattttctgaaggaattctgcgccttctcccagactttgcaaccccagaatagggacgcattctttaaaactctgtccaacatggggatcctgcccgcactggaggtcatccttggtatggatgatacccaggtcagatccgcagctaccgacatttttagttatttggtggagtataacccaagcatggtccgcgagtttgtgatgcaggaggctcagcaaaacgatgatgtgtccaaaaagctcactgagcaaaagattacaagtaaagatatcctgctaatcaacttgattatagagcatatgatatgtgataccgatccagaactcgggggcgcagtgcagttgatgggactactgcgtacccttgttgacccggagaatatgcttgccaccgccaataagacagagaaaacagagttcttgggattcttctacaagcattgtatgcacgtgctgaccgcaccgttgctggctaacacaactgaggacaagcctagcaaggatgactttcagaccgcacagcttctagctttagttttggaactactcactttttgtgtcgaacatcacacctatcatattaagaactatattatcaataaagacatcctgcgcagggtgctcgtgctcatggcctcaaaacatgcttttctcgcactctgcgccctccggttcaagcggaaaatcattggtttgaaggacgaattctataaccggtatattatgaagtcattcctgtttgagccagttgtcaaggctttccttaacaatggcagccggtacaacctcatgaatagcgctatcatagagatgttcgaattcatacgagtagaggatatcaagtctctgactgctcacgtgattgagaactactggaaggccttggaggacgtggattatgttcagacttttaaaggactgaagctgcgctttgagcagcagcgggagaggcaggacaaccccaagctggattccatgcgctctattctcaggaaccaccgctaccgccgagacgccaggaccttagaagacgaggaggagatgtggtttaacaccgacgaggacgacatggaggatggtgaggccgttgtcagcccatcagataaaacaaagaacgatgacgatatcatggacccgatcagcaagtttatggagcgtaaaaaattgaaagagagcgaggaaaaggaggtgttgcttaaaaccaacctctctgggcgccaaagcccgtcctttaaactctccctgtcaagcggtaccaagaccaacctcaccagtcagtcaagtaccaccaatctgcctggtagccctggttcccccggtagtccaggtagtccagggtcccctgggtccgtgcctaaaaatacctcacagaccgctgccatcaccaccaagggtggattggtaggcctcgtggactacccagacgatgatgaagatgacgatgaggacgaggacaaggaggatacccttccacttagcaagaaggcgaagttcgactcctag

SEQ ID NO: 18138 - DNA, 540 bp, Artificial Sequence
  Description of Artificial Sequence: Synthetic coding sequence
atggccgagtccagcagtgagtccgaccatttcagatgcagggaccgactgtctccctgggcagctcgatcaacccaccgtggaacgaggagtctcccaaccgtggaagtgaccgagaaggttaacacgattacaagcaccttgcaggacactagccgcaatctccggcaggttgaccaaatgctaggccggtatcgtgagtattccaacggtcaggctggtgccattgaacatctcaaggaatcattggagcagtcaatcgatcagctccgcagccagaggctcctgagaaacagcggcgggagatcaatctcggtcacaagcctcagtgccagcgacctcgatgggggcaccggctctgaactgcaccatttccccccaacatcgcctctcaaagattacggggacccccaagggatcaaacgtatgcggtctcgaacaggcgtgagattcgtgcaggagaccgacgatatgacccagttacacggcttccaccagtcccttcgagatctgagctctgagcaaatccgtctcggctag

SEQ ID NO: 18139 - DNA, 1056 bp, Artificial Sequence
  Description of Artificial Sequence: Synthetic coding sequence
atgattgttcagagggtggtgcttaacagtaggccaggaaagaatggcaaccccgtcgccgagaatttccgcatggaagaggtgtatcttccagataatatcaacgagggacaggtgcaagttcgaaccctctacctcagcgtcgacccgtatatgcgctgtagaatgaatgaagacacaggtactgactacatcactccttggcagctaagccaggtggtggacggcggaggcattggtattatcgaggagtcaaaacacaccaatctgactaaaggggacttcgtcacctcattctattggccttggcagaccaaagtgatcctggacggcaattcactcgagaaggtggatccacagctcgtcgatggccacttatcttactttctgggagcgatcggcatgcccggcttgaccagccttattgggatccaagagaaaggccacattactgcggggtccaacaagactatggttgtgtcaggcgccgctggcgcttgtggcagtgtggcgggccagatcgggcactttctgggctgtagccgagtggtggggatttgcggcacccacgagaaatgcattctgctgacatctgaactgggctttgatgcggcgatcaattataagaaagacaatgtcgccgaacagttgagagagtcgtgcccggccggcgtcgacgtctatttcgacaatgtcggtggcaatatttctgacactgtgatctcgcagatgaacgagaattcacacattattctatgtggtcagattagccagtataataaagacgtgccttatccacctcccttatcccctgccatagaagccatccagaaagaacgaaacatcacacgggaacgcttcctggtgcttaattacaaagacaaattcgagcctggaatcctgcagctctctcagtggttcaaagaaggtaaactgaagatcaaagaaactgtgattaatggcctggagaatatgggggccgccttccagtcaatgatgacaggggggaacatcggcaagcagattgtctgcatttctgaggaaatttcactgtag

SEQ ID NO: 18140 - DNA, 330 bp, Artificial Sequence
  Description of Artificial Sequence: Synthetic coding sequence
atggagactgattgcaacccaatggagctcagctctatgtcaggcttcgaagaagggagtgaactgaacggtttcgagggcaccgatatgaaagacatgcgcctcgaagccgaagctgtggtgaatgacgtcttgttcgccgtcaacaatatgtttgtgtctaaatcactgagatgtgccgacgacgttgcctatatcaacgtggagaccaaggagcgcaaccgctactgcctggagttaacggaggcaggactcaaggtggtgggatatgctttcgaccaggtggatgatcacctgcagacaccctatcacgaaaccgtgtattcgtag

SEQ ID NO: 18141 - DNA, 387 bp, Artificial Sequence
  Description of Artificial Sequence: Synthetic coding sequence
atggctgagtcctcttcagaaagtgatcacttccgatgccgagatagactgtctccttgggcagcgaggtcaacccatagggggacccggtcattacctaccgtggaagtgacagaaaaggttaacacgattactagcacattgcaggatacttctcgtaatttacggcaagtggaccagatgctaggcagatatcgcgagtactccaatggtcaagctggggccatcgagcacctgaaagagtcacttgaacaaagtatagatcagctgcgtagccaacgtctcctgcgaaacagtggaggtcggtcaatttctgtgacatctttaagcgcctccgacttggatggcgggaccgggtccgagcttcaccacttccctcctacgtag

SEQ ID NO: 18142 - DNA, 369 bp, Artificial Sequence
  Description of Artificial Sequence: Synthetic coding sequence
atgctgttcgctccttgttgtcatcagtgtggagagttcatcatcgggagagtgataaaagccatgaacaacagctggcaccctgagtgttttcgatgcgatctatgccaggaagtgctagctgacatcggattcgtgaagaacgcgggcagacacctgtgtcgaccctgccataaccgggaaaaggctaggggcctggggaaatacatctgccagaagtgccacgctattatcgatgagcaacccctcatctttaagaacgacccatatcatccagatcacttcaactgcgccaattgcggccaggagggtagcgattgtagatgtaccggagcagagagaggcgctatactcccagctatgccttag

SEQ ID NO: 18143 - DNA, 420 bp, Artificial Sequence
  Description of Artificial Sequence: Synthetic coding sequence
atggaaacagactgcaatccaatggagctgagcagcatgagtgggtttgaagaagggagcgaattaaatggattcgagggaacagacatgaaggatatgcgtctggaggccgaagctgtcgtaaatgatgtgcttttcgcagtcaataatatgtttgtgtcaaaatccctgcgctgcgctgacgatgtcgcatacataaatgtcgagacaaaggaaagaaatagatattgtcttgaattgacggaggctggacttaaggtcgtgggatacgcctttgaccaggtggacgaccatcttcagaccccatatcatgagacagtctactctctcctcgacacgctctctccagcctacagagaggcgtttgggaacgccctcctgcagagacttgaggccctgaaaagagatggtcagagctag

SEQ ID NO: 18144 - DNA, 4602 bp, Artificial Sequence
  Description of Artificial Sequence: Synthetic coding sequence
atgcctgtgaaaagactacgagaagtcgtctctcagaaccatggagatcatttggtccttctgaaggatgaactcccttgcgtgccccctgcactaagtgccaataaaaggctgccggtgggaacgggcacctcgctcaacggtacatcacgagggagttccgatctcacatcggccagaaactgctaccaacccttgttggagaacccaatggtcagtgagtctgatttttccaaggacgtggcagtgcaggttctgcctctggacaagatagaggagaacaataaacagaaggctaacgacatttttatctcacagtacaccatgggacaaaaagacgccctccgtaccgttttgaagcaaaaagcccaaagtatgcctgtgtttaaagaggttaaggtgcatctgctcgaggacgctggcattgaaaaggacgccgtgacacaagagacacgcattagcccctctggtatcgattcggctactaccgtggcagcggctactgcggctgctatagcgactgccgccccactaattaaggtccaatcagatttggaagcgaaggtaaatagcgtaacagagcttctgagcaagctccaggagaccgacaaacatcttcagcgggtgacagagcagcaaacctcaatacagcggaagcaggagaagctgcattgtcatgatcacgagaaacagatgaacgtgtttatggagcagcacatcaggcacctcgagaaactgcaacagcagcagatagacattcagacacatttcatcagcgccgctcttaagacttcttcctttcagcctgtgagcatgccaagttcccgggccgttgaaaaatattctgtgaaacccgaacatccaaacctgggatcctgtaacccgtccttatacaacacttttgcctcgaagcaggcccccctgaaagaagtcgaggatactagtttcgacaaacagaagtctccattggaaactcccgccccgcgaaggttcgctcctgtgcctgtctccagggatgacgaactctccaagagagagaatctcctggaggagaaggagaacatggaagtgagctgccaccgcggtaacgttcgcctcctcgagcagattcttaataacaacgacagcctcacacgcaagagtgaatctagtaacactacgagtctcaccagatccaagatcggttggacacccgaaaagaccaacagattcccaagttgtgaagaactggagaccacgaaagtcacaatgcagaagtctgacgacgtcctacacgacttagggcagaaggaaaaagagaccaactctatggtgcagccgaaggaatcgttgtctatgctcaaactccccgatctcccgcagaattcggtgaaattacagacaaccaacaccacacgctccgtgcttaaagacgccgaaaaaatcttgcgaggggtgcagaataacaaaaaggtgcttgaggagaatctggaagccattatccgcgctaaggatggggcagccatgtattccttgataaatgcgctctccaccaaccgcgagatgagtgagaagatcagaattcgaaaaaccgtggacgaatggatcaagactatttcggcggagattcaagacgagctcagccggaccgattacgagcagaagaggtttgaccaaaaaaaccaacgcacaaaaaagggccagaatatgacaaaggacatcaggacgaacacgcaggacaagaccgtcaataagtccgtcattccaagaaagcactcacaaaaacagattgaggaacactttaggaatctccctatgagaggaatgccagcgtccagcctgcagaaggaacgtaaggaaggactcctcaaggctactactgtgattcaggatgaggactacatgctccaagtgtatggaaagcctgtgtaccagggacatagaagcacattaaaaaaggggccgtatctgagatttaattcacctagcccaaaatcccgccctcagagaccgaaggtcatagagagggtgaaaggcactaaggtcaagtctatcaggactcagacagatttttacgccacaaaaccaaagaagatggactctaagatgaagcatagtgtgcctgtccttccccacggcgatcaacagtacttgttctcgccaagtagagagatgccgacattttccggtacgttggaaggccacttgattcctatggcaattctcctgggccaaacacagtcaaacagcgatacgatgccgccagctggcgtgatagttagtaagccacacccagtaaccgttacaacatctatccctccctcatcccgcaaggtagaaacaggcgttaaaaagcccaacatcgctattgttgaaatgaagtccgaaaaaaaagaccctcctcagctgaccgtacaagtcttaccttctgtagatattgacagcatctcaaactcaagcgcagacgtactgtcaccactctcctcgcctaaggaagccagcctcccaccggtgcaaacctggatcaagactccagagattatgaaagtggatgaggaggaagtaaaattcccaggaaccaattttgatgaaatcatcgatgttattcaggaggaggaaaagtgcgatgaaataccagacagcgagcccatcctcgagttcaatagatcagtcaaggcagactccactaagtacaatggcccccctttcccccctgtagccagtacttttcagcccactgccgacatcttggacaaggttattgagcgaaaagagaccctggaaaactcccttatccagtgggttgagcaggaaattatgagtcggattataagcggactttttcctgtccaacagcaaattgccccttcgatctctgtgtccgtgagtgagacctcagagcctctaactagcgacattgtggaaggaacgagtagcggagcacttcaattgtttgtggacgccggtgttccagtgaactctaacgttattaaacactttgtgaatgaggcgctggctgagaccatagctgttatgctgggggacagagaagccaagaagcagggcccagtggccactggtgtgtctggagatgcaagcacgaacgaaacctacctcccggcccgcgtctgcacaccactcccaacgccgcagccaactccaccatgcagtccttcttcacctgctaaggagtgcgtgctcgtaaaaactcctgacagcagcccctgcgattctgatcacgatatggcattccctgttaaagagatttgcgccgagaaaggcgatgacatgcctgcgattatgctggtcaatacgcccacagtgacaccaacaacaacgccgccaccagccgcagccgtatttaccccaacgctgtctgacatctcaatcgataaacttaaggtgtcttcacccgaacttcctaaaccatggggcgacggcgacttgcctcttgaggaagaaaatcctaactccccccaggaagagctccatcccagggccatcgtcatgtctgtggccaaggatgaggaaccagagtcaatggatttcccggctcagcctcctccacccgagcctgttccgtttatgccattccctgccggaacgaaagcacctagcccctctcagatgccaggttcagactcttctacgctggagagtactttatctgtgacagtcactgagacagaaacacttgacaaacccatatctgagggcgagatcttgttcagttgtggacaaaaactcgctccaaaaatcttagaagacatcgggctgtacctaacaaacctcaacgattcactgtcgtctacattgcatgatgccgttgagatggaagatgaccctccctctgagggacaggttattcggatgagtcacaaaaagtttcacgccgacgccatcttgagcttcgcaaagcagaaccaggagagcgccgtgtcgcaacaggctgtgtaccactctgaggatctggagaattctgtgggagagttaagcgaagggcaacggccacagctcaccgcagccgccgagaacattttaatggggcactcactgtatatgcaacctccagtaaccaacacacaaagcctggatcagcaatgcgaccctaaacctctgtcccggcagttcgataccgtatcaggcagcatttacgaagattcttgcgcatcccacggacctatgtcactgggggagctagaactggagccaaactccaaactggtcctcccaacaaccttgctaaccgcacaagagaatgatgtcaacctgcctgttgcagcagaagatttctcccagtaccaacttaagcaaaaccaggacgtgaagcaggtcgaacacaaacctagccagtcttaccttagagtcagaaataaatcggatatcgcaccttcccagcagcaggtttcgcccggggatatggatagaacacagatcgagttaaatccgtatctaacatgcgtcttctcggggggtaaagcggtgccgctgtccgcctcgcagatgccgccggcaaaaatgagtgtgatgctgccgagtgtcaacctggaagactgttctcagagcttatccctcagcacaatgcaagaggacatggagtctagcggagcggatacattctag

SEQ ID NO: 18145 - DNA, 2334 bp, Artificial Sequence
  Description of Artificial Sequence: Synthetic coding sequence
atgtctgcccaaaccagccctgccgaaaaaggcctgaatccagggctgatgtgccaggaatcctacgcctgttcagggactgacgaggctatatttgaatgcgacgagtgttgttccctgcagtgcctcaggtgcgaagaggagctgcatagacaggagcggctgcgcaatcacgagaggattcggctgaagccaggacacgttccctattgtgacctgtgtaagggactgagcggtcatctgcctggtgtgcgccagcgcgcaattgtgcgctgtcagacctgtaaaatcaatctgtgtctggaatgtcagaagcgaacgcactccggcggaaacaagaggaggcatcccgttacggtgtacaacgtgtccaacttgcaggaatccttggaggcggaagagatggacgaagaaaccaagagaaaaaagatgacagaaaaagtcgtgtcctttctgctcgtggacgaaaatgaggagattcaggtcaccaacgaagaagattttatccgcaaactcgattgcaaaccggaccagcacctaaaagtagtctctatcttcgggaatactggagatggaaaaagtcatactctcaatcacacttttttctatggtcgagaggtgtttaaaacctctccgacacaagagagctgcacagtcggcgtttgggctgcgtatgaccccgtccacaaggtggctgtcatcgatacagagggcctcttaggggccaccgtcaacctgtcccagagaacacggctcctgctgaaggtgcttgctatcagcgatttagtcatttaccggacacacgctgaccgactccataatgacctattcaagtttctgggggatgctagcgaggcttacttgaaacactttacgaaagaattaaaggctacaaccgctaggtgcgggttagatgtccctctaagcactcttggtccagctgttatcatcttccacgaaacagttcatacccaattgttgggcagcgatcacccctctgaggtgcccgagaaattgatccaggaccgcttccgaaagctcggacggtttccagaggccttcagctcaattcactataaggggacccggacttataatccacctacggatttcagcggccttaggcgcgccctggagcagctgctggaaaataatactacacgatcacctcgccacccgggtgtcatctttaaggctttaaaggccctgtccgataggttctccggggaaattccagacgatcagatggctcattcatcctttttcccagacgaatacttcacgtgcagcagcctctgtctctcctgcggggtaggttgcaagaagagcatgaaccacggaaaagagggcgtccctcatgaggcgaaatctcgttgtagatactcccatcagtatgacaaccgtgtgtatacatgtaaagcatgttacgagcggggagaggaagtcagcgttgttccaaagaccagcgcatcaactgactccccttggatgggactggcaaaatacgcctggtccggttatgtcattgagtgtcccaattgtggggtggtctatagatcccggcagtactggttcggcaaccaggatccagtagacaccgtcgtgagaacagagatcgtgcatgtatggcccggtacagatggatttctcaaggataacaacaacgcagcccagcgcctcctcgacgggatgaattttatggcccagagtgtgagcgagctgtccctagggcccaccaaggcagtgacgtcctggctaacagaccagatcgcacccgcttactggcgaccgaatagccagatactcagttgcaacaagtgtgcgacttcatttaaggataacgatacaaagcatcactgccgcgcttgtggagaaggcttttgtgattcctgcagttcaaagactcggcccgtgcctgaacgaggttggggccccgcccccgttagagtgtgtgataattgctacgaagcccggaacgtgcagttggctgtgactgaggcacaggtagatgacgagggcggaaccctgatcgccagaaaggttggggaggcagttcaaaataccctgggggcagttgtgacggccatagacattccattagggttggtcaaagatgcggcacgcccagcctactgggtccccgatcatgagattctgcactgccacaattgtaggaaggagtttagcattaaactcagcaaacatcattgtcgggcctgtggccaggggttctgcgacgagtgctcccacgatcgacgagctgtgccttccagaggatgggatcatcccgtaagggtgtgtttcaattgtaacaaaaagccgggagacctctag

SEQ ID NO: 18146 - DNA, 867 bp, Artificial Sequence
  Description of Artificial Sequence: Synthetic coding sequence
atggagaaactctctgccctgcaggaacagaaaggggagctgcggaagcggctaagctacactacccataagttggagaagctggagaccgagttcgacagcacccgtcattacctggagatcgagctccggagagcacaagaagagttggagaaggtgacagaaaagctgaggagaatccagagcaactatatggccttacagcgcattaatcaggaacttgaagacaaactctatcgaatgggacagcattacgaggaagagaagagagctctgtctcatgagatcgtcgccctgaatagtcatctcctggaagcaaaggtgacaattgataaactctccgaggacaacgagctctaccgcaaagactgtaatctggccgcccaacttctccaatgttcccagacctatggacgggtacacaaggtgtcggagctgccgagcgactttcaggagcgggtcagcctccacatggaaaaacacggatgttccctgccttctccactctgccatcccgcctatgcagatagcgtgccaacgtgcgttatcgctaaagtgctggaaaaaccagaccccgctagcttgagctccagactgtcagacgcctctgcgagggacttagctttctgcgacggcgtggaaaaaccaggaccaaggcccccttacaaaggagatatctactgttcagacacagctctgtactgtcccgaggaacgccgtagggacagaaggccttcagtcgacgcgcctgtcactgatgtgggcttcctgcgcgcacagaactctaccgattccgctgccgaggaagaagaagaagctgaggctgccgcttttcctgctgggtttcagcatgaggctttcccatag

SEQ ID NO: 18147 - DNA, 1263 bp, Artificial Sequence
  Description of Artificial Sequence: Synthetic coding sequence
tgaacccaagccatggctcttgagacccccacccccgggccccctcgggaagggcagtctcctgcctcccaggccggtacccaacatccccccgcacaagcaactgcacattctcagtcaagccccgagttcaagggctcacttgcgtccctgagcgacagcctaggcgtaagtgtcatggccacggaccaggactcctacagcacctcatcaactgaggaagagctggaacagttttcctctccttcagtgaaaaagaagccaagcatgattcttggcaaagctcggcataggctatccttcgcaagcttctcttctatgtttcatgcgttcctaagcaacaacaggaagttgtacaaaaaggtggtggagctcgcccaggacaaaggttcctattttggaagtctggtccaggattacaaggtgtattctcttgagatgatggccaggcagacctcatccacagagatgcttcaggaaattagaaccatgatgacccagctgaaatcttacctgctgcaaagcaccgaactgaaggccctagtggaccccgccctgcactccgaggaggagttagaggcaattgtggaatctgctctgtataagtgtgtgctcaagccactgaaagaggccatcaatagctgtctgcaccaaatccatagtaaagacggtagcttacaacagctcaaggaaaatcagctggtgattctggctaccacaaccaccgaccttggagtaaccacaagtgttcccgaggttcctatgatggaaaagatcctccagaagttcacttccatgcataaggcttacagccccgagaagaagatctctattctgctgaagacatgcaagcttatctatgattcgatggccctaggcaaccctgggaaaccctatggcgctgacgatttcttacccgttctgatgtacgtccttgcacggtcaaatcttaccgaaatgctcttaaacgtggagtacatgatggagcttatggatcctgcgctgcagctgggtgagggtagctactacttgaccactacgtacggagctctcgagcacattaagtcctacgacaaaatcactgtgaccaggcagttgagtgtggaggtgcaagattccattcataggtgggaacgacgtagaacgctcaacaaggcacgggccagtcggagttcagtgcaagtacggcccgaaagcggccgcgggcccgtcggaccctgtccccggcaccacccgtgctgcctgttggccaaggaaccttag

SEQ ID NO: 18148 - DNA, 2466 bp, Artificial Sequence
  Description of Artificial Sequence: Synthetic coding sequence
atggctggtagtgacgccgagtgggttaccatcgcgaacaacttgctgttcaaatgccatatccaccttcgtattcatgagctccaagattgcgatgccaatgtcttcatcgctctgtaccagtccatcctaggggagaaagttcccgacctgattgtgatcccccgtagtcaggaggacgacgctcacaatgtgcaggccgtcatcgactcattagctctcgactatttgcaagtttccctgtcgcatataaccggagagaatatagtcaaaggagataaggagtccatcaaaaatttgttggagattttcgatggtctcttggaatatctgactgaaaggatctctgaaaccagccacgagaagtctgagactgagcagtattttaaggagagtgaccgcggcgaacgcctcgaagagccagagtcaacaaaagaaagcaaatcctcatggaaacgcgtctctttcggtcggtgtagcctgtcttctgaaatgctggggccatcatgggatggcgacgaggcagagagtactggcgagattattaggctaggcgacacagctcacactttttccctgagaagtaatggcgcccagtgtccgaatgagatgctttcaaagaaagcccttgcttccccaagcagcaagtcccacgaagatatgctctacccaccttcagtattgtcaaagagccgtacttcattcgtggaggacaccgagaccttgtccgtttctggcattcccaacgcgcgaaagctgggcgaaccaatccgagccgccattccacttcacccaccttaccatccctcagagcctcgcgccccatgccctataggcaaggaatatctgcactcttctcattgttcacctgcagtgaattcgaccggggagcatacagaattttccggggatctggacgatggactgtttctgattagtaaactgcctaaaggctcaaagtgggaggtttacccggcccaggtgcagggtccccggacccggaagccccccaagggcaaacggaacgagaatagggcaacagcctcttcatgcaattcaccttttccccaacgccccaggaaaaggctgacagaacaggagctccatgatgtgtctgaaaaattgtctcagcgactctcagaacttgactggatgttaaagtcggcactgggagatcgaattaaagaaaagacagaccacaaggaagaaaataccggcaatgaggaggtggaggatgggacggaagagacactgtcccagcactccgacggcatcgtcgaatatggtcctaagaaaagcaggccgggcctttctatgagaagaaagcccccctacagatctcattctcttagtccgtcacccgtcaacaagcacaaacagtttcacctagagcgcaaacgacagcgaaagccaagagaaaccgacgtgagacagtttcaggcgcaggccttcactgaggcgttcgagagagagctgcggcggcacaaggtgcaggaaaacataggaccccttcgaatccacgagaaggaggaggagacagagaaaatataccggggcgaggctgttcggaagggcaccccggagtgctctcagccctggaagatctatagtagaaagaccacgacacagagcctgcggggcgggctccccaagcctaacaaggcagtccccatgaaggtatccgaacactccctgcttccccttatgctggagcagttcccctttttgtacgtcagtgggcctacgctttcaaagatgtggaaacagcagatagcccaggtggaacaactcaaaaaggaggcttgtcgcgagaaccgatccaaaaaaaagctccaggatgagatcgaagaagccctccggcgacacgatctgctcaccacactcgttaagaaggagtacgaacacaataagaggctgcaggactttaaggactgcatcaggagacagcgcttgacacaatctaagattaaagaaaatcggcagcagattgtgagggccagaaagtactatgatgattaccgggttcaattgtgcgccaaaatgatgcgcatgcggactcgggaagagatgattttcaagaagctcttcgaagaaggcctgaatattcaaaaacaaagacttcgcgatttacgaaactatgctaaagagaaacgcgacgagcagcgcagacggcaccaggatgagctggactctatggaaaactattacaaagaccagttttccttattagccgaagctatctctcaggagcaccaggagttgaaagcaagggaaaaatcccaggcccagaccctgcataaggtcaaaagggaattgcgatcaaagatggagaaagaaatccaacaactgcaggacatgatcacccagaatgatgatgatgtcttttttagagaactggaggctgaacgctttcggtctcgcctacagttggcttcttttcagtactccaaaagcccttcgctgtag

SEQ ID NO: 18149 - DNA, 4560 bp, Artificial Sequence
  Description of Artificial Sequence: Synthetic coding sequence
atgcgtatccccgaccaaaaatatgtgactttgaaactcaatgacgtcatcaggttcggatatgactcgaacatgtacgtgcttgagagggtgcagcaccgcgtacctgaggaggcgttgaagcatgagaagtatacatcccagctgcaagtaagtgtgaagggcctggctcctaagcgcagtgaggccttgcccgaacacaccccgtattgtgaagcctcaaatcctcgccccgaaaagggtgaccgaagaccgggaactgaggccgcttcttaccgtacccccttatacggccagccatcctggtggggagaggacgatggttcaaccctcccagatgcccagaggcaaggagaaccttacccagagaggcccaaaggacccgtgcagcaagatggggagctgcacggtttccgagctcctgccgagccgcaggggtgttcatttcgaagagaaccatcctatttcgaaattcctacaaaagaaacgccccagcctagccagccaccagaggtgcctgcccacgagatgcctactaaggacgcggaagccgggggggggggagctgctcctgtggtccagtctcacgccagtttcactatcgagtttgatgactgcagccccggcaaaatgaaaataaaagatcatattaccaagttctcacttcgccagcggcgcccccctggcaaagaggctacccccggagaaatggtctccgccgagaccaaagtcgcagattggcttgtgcagaatgatcctagtttacttcaccgcgtggggccgggcgatgaccgccattccaccaaatccgacctgcccgttcacacacgaacccttaagggacacaagcatgaggatgggactcagtccgacagcgaagaccctttggcgaaagccgcctcagccgccggagttccgctcgaagctagtggtgaacaagtccgccttcagagacagataaaaagggatccacaggaactcttgcacaaccaacaggctttcgttattgagtttttcgatgaggacaccccgaggaagaagagatcccaaagcttcacccactctcccagcggggatccaaaggccgataagcgtagaggcccgacacccgcagatagagatcggccttcagttcccgcccccgtgcaggcgggcggcagaagctcgggaccgcagagagcagggtcactgaagagagagaaaactgaggagagactgggatctccctcacccgcgtcgagaacgccagcccgcccctttggaagcgtcggcagaagaagcagactggcccaggacttcatggcccagtgtttgagagagtctagtccagcagcacggccgagccctgagaaggttcccccggtgctgcccgctccactcacaccgcacggcactagcccggtgggcccaccaacccctccccccgcgccaacagatccccagcttactaaggcaaggaaacaagaagaagatgatagtctaagtgatgcaggcacgtataccatcgagactgaagcacaagacaccgaagtagaggaggctcgtaaaatgattgatcaagtctttggtgttttagaatcaccggagctgtctcgtgctagtagcgccacgtttagaccagttattaggggagatagagatgaaagtgacgatggcggggtcgcacagagaatggcgttgctccaggagtttgcttcaagaccccttggggccgccccccaggccgagcaccaggggctgccggttccgggcagcccaggcggacagaagtgggtctcaaggtgggcctctctcgctgacagctattcggacccaggactgactgaggatggactgggccggaggggcggagaaccagagggaagtctgcctgtccgtatgagaaggcgccttccacagctgcctagcgagcgtgcagactcgcctgctggccctgagtcttcccgcaggtccggtccaggccccccggagctagattctgagcagccatcccgcttattcgggcaagaggagctggacccggatagcctcagtgatgcttctggctctgacggcgggcggggaccagagcccggagtagagccacaggacagtaggcggcgttcaccacaggagggccccacatggtccaggggacgtcggtctccgcgtgcacctggtgaaccaacaccagccagtttttttataggggaccagaacggtgatgctgtgctgtctaggaaacctttggctgctcccggcgatggggaaggcttagggcagactgcccaaccaagtcctccagctagagatggagtctatgtctccgccaacgggagaatggtaattcaactacgccctggcagatcacccgagcccgacggaccggctcctgcctttctgcgccaggaatcttttaccaaggaacccgcgtcaggaccgccagcaccaggcaaacccccacatatctcgagtcaccctttactgcaagatctggcagccacgcgtgccgctaggatggactttcattcccaggatacacacttaatactcaaagaaaccgaaaccgccttggccgcccttgaggcccgcttgctgagcaactctgtggacgccgagtgcgaaggcgggagtaccccccggccaccagaggacgccctgagcggcgactctgacgtagatactgcaagtactgtgagcctccgctccggaaaaagcggccctagccctaccacgccccaacccctgcgcgctcaaaaagagatgtcaccaagcccacccgccgcgcaggaccccggcgggaccgcacttgtgtcggcaagggagcagagttcggaacgacagcaccacccattgggccccactgacatggggcggggggagcccgtgaggagaagcgctatacgcaggggtcaccgacccagggggtccctggattggccatctgaggaacgcgggccagtgctagcacacctgcccagctccgatgttatggcttcgaaccatgagacacctgaggccacaggcgctggcaggttaggttcccggcggaaacccgccgcccctccgccctctcctgccgcaagggaagaacagtcccgctccagcgctagctctcagaaggggcctcaggccctcaccaggagtaactcactctcaacaccacgtccaacccgcgctagtcggctgaggagagcgagattgggagatgccagcgacacagaggccgccgacggcgaaagaggtagcttgggaaaccctgaacctgtaggaagacccgcagccgaacaagcaaagaaactgtcaaggctggacatattggccatgcccaggaagagggccggcagcttcaccggcacatctgatcccgaagcagcccccgctcgcacaagcttctcagggaggagtgttgagctgtgttgcgcaagccgtaaaccaacaatggcagaggctagagcagtcagcaggaaggcggccaacacagccacaacaacgggccccaggcagcctttcagtagggctcgctcaggatccgcccgatacacatccaacacccgccggaggcagcaaggatccgattacactagcacatctgaagaagagtacgggtccaggcatggttcacctaagcatacacgcagccacacttcaaccgccacgcagaccccacgggctggttcctcctcacgtgcgcggagccgcgctccagggccacgagacaccgatgatgacgaagaagaaccggatccctacggatttatcgtgcaaacggctgagattgcggaaattgcccgcttgtcccagacattggtaaaagatgtggccattttggctcaggagatccacgatgtggccggtgacggtgacactcttggctcatccgagcctgcccacagcgcttccctgtcaaatatgccctccacccccgcctccactatttccgcacgggaggagctggtgcagcgtatcccagaagcttcattgaattttcagaaagtgccaccgggatccctgaactcccgggacttcgaccaaaatatgaacgactcatgcgaagatgcgcttgcaaataagacgcggcctaggaaccgggaggaggtgatctttgacaacttgatgctgaacccagtgtcccagctgtcacaagcaatacgtgagaataccgaacacttggctgagaagatgaagattttgttccagaacaccggtcgagcttgggaggatttagaggcacggatcaatgcggaaaatgaagtacctatcctcaagacaagtaacaaagaaattagcagcattctgaaggaactgaggcgcgtgcagaaacagctagaggtcatcaacgctatcgttgacccttccgggtccctggacctcctcactggcaaccgaagcctggcgtcttctgcacagcctggactgggaaaggggagagtggccgcccagagcccacccagtcccgcatcagccgaagccctgttgcccgccctgccgctgcgcaactttccgcagcgagcatcgtgtgggccaccaagcctgcccgaccccaccttcctgccagacgctgagagattcctgatttag

SEQ ID NO: 18150 - DNA, 378 bp, Artificial Sequence
  Description of Artificial Sequence: Synthetic coding sequence
atgccctcagaaaaaaccttcaaacaacgtcgcacattcgagcaaagggtcgaagacgtgcgtctgataagggaacagcaccctacaaaaatacctgtcataatcgagaggtacaagggcgaaaaacaactgcccgtattggacaaaactaaatttctggtccccgaccacgtaaacatgtcagagctgatcaaaatcatccgccgacggctccaattgaacgcaaaccaggctttctttcttctggtgaatggccactccatggtgagcgtgagcaccccgatctctgaagtgtatgagagtgaaaaagacgaggatggtttcctgtatatggtgtgcgcatctcaggaaacttttggtatgaaactcagtgtatag

SEQ ID NO: 18151 - DNA, 3525 bp, Artificial Sequence
  Description of Artificial Sequence: Synthetic coding sequence
atgccactcccattcggcctcaaactgaagcggactaggcgctataccgtgtcctccaagagctgcctagttgccagaatacagctcttgaacaatgaattcgttgaatttacactgtcagtggaaagcaccgggcaggagagcctggaggctgtggctcagagactggaactgagagaggtgacttacttttccttatggtactacaataaacaaaaccagaggcgctgggtcgacctcgagaagccactcaagaagcagctggacaagtacgcactggaacccaccgtgtattttggagtggtgttttatgtcccttctgtgagccagcttcagcaggaaattacccgctatcagtactacctgcagctgaaaaaggacatcctcgaagggagcattccatgtacgctcgagcaagcaatccagctggccggattagcagttcaggccgactttggtgattttgatcagtacgaatctcaagacttcctgcagaagtttgctttgttccccgtgggatggctacaggatgaaaaagtcctggaagaggcaacacagaaagtggccctgctccaccagaagtacaggggtctgacagctccagatgcagaaatgctgtacatgcaggaagtggagagaatggatggatacggcgaggaaagttaccccgccaaagacagccagggtagcgacatctccatcggcgcttgcttggagggcattttcgtaaagcacaagaacggaagacaccctgttgtcttcaggtggcacgatatcgccaatatgtcccacaataagagctttttcgcattggaactcgcaaataaagaagaaactatccagttccagaccgaggatatggaaactgccaaatacatctggagactgtgtgttgctaggcataaattctaccggctcaatcaatgtaaccttcagacgcagactgtgactgtcaatcctattaggcgacgctcctcttcccggatgtcacttcctaaacctcagccttatgtcatgccaccaccaccccagttgcattacaacgggcactatacagagccatatgcttctagccaggataaccttttcgtgccaaaccagaatgggtattactgtcactcccagacctccttggacagagcccagatagatctgaacgggcggatacggaatgggtcagtatattcagcccattcaaccaatagtttaaacaatcctcagccttatctgcaaccgagcccaatgtccagcaacccctccattacaggatccgacgttatgcgccccgactaccttccatctcataggcattcagccgtcatccccccaagctacagaccaactccagattatgagactgtgatgaagcagttgaatcgcggattggtccatgcggaacgacagagccatagtctccgcaatctgaacattggttccagctatgcttactctcgccccgctgcactggtgtacagtcagcctgaaattcgtgagcacgcccagctgccaagtcccgctgccgcacattgtcctttcagtctgagctattcctttcacagtccttcaccctacccttatcccgctgagaggcgccccgtggttggcgctgtttccgtacccgaattgaccaatgcccagcttcaggcccaggactaccctagccccaatattatgaggacacaagtttaccggcccccccctccatatcctccgccacgccccgccaattctacacctgatctgagccggcatctgtatatcagctcttccaaccccgatctgatcacaagacgtgtccaccatagtgttcagaccttccaggaggattcacttccggtggcccattcacttcaggaagtctcagaaccgctgactgccgctagacacgcccagctgcataagcgcaattccatagaggtggctggactgtcacacggattggagggcttgaggctaaaggaacgcaccctcagtgcctccgcggcggaggtggccccgcgcgcagtttctgtggggagtcaacccagtgtgttcactgaaaggacacagcgcgaagggcctgaggaagcagagggactgcgatatgggcataagaagtcactgtcagatgccaccatgttaatccactctagcgaagaagaagaggacgaagatttcgaggaggaatctggtgccagagccccaccagctcgagctcgcgagccaaggcctggactagcacaggacccacccggctgtcccagagtgctgctggcgggtccacttcatatccttgaacccaaggcccacgtgccagacgcggagaagcgcatgatggactcctcaccagtgcggactaccgcagaagcgcagcggccttggcgagacggcctgttgatgcctagcatgagcgaaagcgacctcaccacctctggacggtaccgcgcaagacgcgattccctcaagaaaagaccagtttcagacctgttaagcggtaaaaaaaacattgtagagggattacctccactgggtgggatgaagaagacccgggtggacgcaaagaaaattggccctctcaaactcgccgctttgaatggcctgtctttgtcacgagtgccgctccctgacgaggggaaggaggttgccacgcgggctaccaacgatgagaggtgtaagatcctggagcaacgactagaacagggaatggtgtttaccgaatatgagagaattttaaaaaagcggttagtggacggggagtgttcaactgcccgtttgccagagaatgccgaacggaatcggttccaagatgtgctcccatacgatgacgtgcgtgtggagctggtgccgacaaaggagaacaataccggttacataaacgctagccacataaaagtgtctgtcagcggtatagagtgggactatattgccacccagggaccgctccagaatacatgtcaggacttttggcagatggtttgggagcagggaattgccattattgcaatggtgactgcagaggaggagggggggagagaaaagagcttcaggtattggcctcgactgggtagcaggcacaataccgtcacatatgggagatttaagattaccactagattcagaaccgatagtggctgttatgccactacagggcttaagatgaagcacttgttaacgggacaggagagaaccgtttggcatctacagtataccgattggcccgagcacggatgccctgaggatcttaagggtttcttatcatatctagaagaaattcagtccgtccgtaggcacaccaatagtaccagcgacccacagtctcccaaccctcccctgcttgttcattgttccgccggagtgggtcggaccggcgttgtcatcctgtctgagattatgattgcgtgcctcgagcacaatgaggtgctcgatattcctagagtgctcgatatgctgaggcagcagcgcatgatgctagtgcagaccctctgccagtatacttttgtctaccgtgtgctaattcagtttctgaagtcttctcggctgatctag

SEQ ID NO: 18152 - DNA, 1245 bp, Artificial Sequence
  Description of Artificial Sequence: Synthetic coding sequence
atgcaaactttcctgaaaggcaagcgggtgggatattggctgtccgagaagaaaatcaagaagttgaacttccaggctttcgcagaactgtgtagaaagcgcggaatggaggttgttcagctgaacctatctaggcccattgaggaacaaggacccttagatgttatcattcacaagctgacagacgtcatactggaagccgaccagaacgacagccagtccctcgaattggtccacaggtttcaagagtatattgacgcccaccccgagaccattgtgttggaccctttaccggccattaggacattgctggatcgctccaagtcttatgaactaatccgaaaaatagaggcgtacatggaggatgataggatctgctcccctccatttatggagctgacttctctttgcggcgatgacacaatgcgcctgttagagaaaaatggtctgacttttccatttatatgcaaaactcgggttgctcacggtacaaattctcacgagatggcaatcgtcttcaatcaggaggggctgaacgctattcagcctccctgcgtcgtgcagaatttcatcaaccacaatgcggtactgtacaaagttttcgtggtgggcgagtcatacacagttgtgcagaggccgagtctcaagaatttttcagcaggtacatctgatcgggaatccatcttctttaacagtcacaacgtctcgaagccggagtcaagtagcgtcctgacagagctggacaagatcgagggtgttttcgaacggccctcagacgaagtgatcagggagctcagccgggctctgcgccaggccctcggtgtgagcctgttcggaattgatattatcattaacaaccaaacaggacaacacgcagtgattgacattaacgccttccctgggtacgaaggggtttctgagttctttacagacctattaaatcacatcgccacagtgctccaaggccagagcaccgccatggcagctaccggcgacgtggcactgctgcgacattctaaactactggcggagccagcaggcggactggttggcgagagaacatgcagcgcttctcccggttgttgtggatctatgatgggacaggacgctccatggaaagccgaggccgacgctggcggaaccgccaagctaccccaccagagactgggctgtaatgctggtgtgagtcccagttttcagcagcactgtgtcgcatctctggccaccaaagcttctagccaatag

SEQ ID NO: 18153 - DNA, 2256 bp, Artificial Sequence
  Description of Artificial Sequence: Synthetic coding sequence
atgtcagaagaggagctaaccaaagccatggagggactgggaatggacgaaggtgatggtgagggtaacattcttcccattatgcagtccatcatgcaaaatctgctgtctaaggacgttctttacccatcccttaaagaaattactgagaagtatccagaatggctgcaatcgcaccgcgagtccctgcccccagagcagtttgagaaataccaggaacagcattcagttatgtgtaaaatctgtgagcaattcgaggccgaaacaccgaccgacagtgagaccacacagaaggctcggttcgagatggtattggatctcatgcagcaattacaggatctggggcaccctcccaaggagttggcaggagagatgctcacatggctgtttttctgcggctcacagtgggtgtatggtccttggttaacatacgttggctggctgcagcagaccagcttcaagatgagttccaaagggagttctaccgacggaaggacggacctggccaatggctcactgtccagctcccccgaagagatgagcggagcagaggagggccgagaaacctcgtccggtatagaggtcgaggcctctgacctgagcctaagccttactggggacgacggtgggccaaatcgaacctcaaccgagtcccgcggcacagacacggagtcctcgggagaggataaagactctgacagtatggaggacactggacactattccatcaatgacgagaatagggtgcacgaccgctccgaggaagaggaggaggaggaagaggaggaagaggaggagcagcctagaagaagggtccaacgcaagcgcgctaatcgggaccaggactcgagcgatgacgagagggcattagaggattgggtgtccagtgagacctccgctttgccgagaccacgctggcaggcactccccgccctgcgagagagggagttagggagttctgctcggtttgtgtacgaggcctgtggcgcacgcgtgtttgtccagaggttccgtctgcagcacgggttggagggtcataccggctgcgtgaacaccctgcattttaatcagcgggggacatggctcgcatccggctctgacgatctgaaagtggttgtttgggactgggtccgtcgtcagcccgtgctggacttcgaatcaggtcacaagtctaacgtgttccaggccaagttcctgccaaatagtggggattccacgctcgccatgtgtgcaagggacggccaggttcgcgtagctgaactgtccgcaacccaatgctgcaagaatacaaagagggtggcacagcacaagggggcctctcataaactggccctggagcccgactccccttgtaccttcctgagcgccggtgaggatgccgtggtgttcacaattgatctcagacaggatcgacccgcatccaagctggtagtgacaaaggaaaaggagaagaaggtaggtttgtacaccatctatgtgaatcctgccaatactcatcagtttgctgtgggcggccgagatcaattcgtcaggatctacgaccaacggaagatcgacgagaatgagaacaacggtgtgctcaaaaagttctgcccccatcacttggtcaacagtgagagcaaggccaatattacgtgtctggtgtactcccacgatgggaccgaactcctggcttcctacaacgatgaggacatttacctgttcaatagttcccacagcgacggagcccaatatgtgaaaaggtacaagggccacaggaataatgccaccgtcaaaggagtaaatttctacggacccaagtccgaattcgtcgtgagcggctccgactgcgggcacatctttctgtgggagaagtcttcttgtcagattatccagtttatggagggggacaaaggtggtgtcgtcaactgtctagaacctcacccacatttgccagttctggccacatcggggttggatcacgacgttaagatatgggcgcctacggcagaggctagtaccgaactaacaggcctgaaggacgtgattaagaagaacaagagggagcgagacgaggactccctacatcaaacagacctgttcgattctcatatgctctggtttcttatgcatcatctacggcagcgaaggcatcataggcgttggagagagccgggcgtaggagcaactgacgctgattctgacgaaagtccttctagctctgatacttccgacgaagaggaaggccctgaccgcgtccaatgcatgcctagttag

SEQ ID NO: 18154 - DNA, 1056 bp, Artificial Sequence
  Description of Artificial Sequence: Synthetic coding sequence
atgaccctgcgactcctcgaagattggtgtagaggaatggatatgaaccccagaaaagcactactaatcgccggtatcagccagtcttgtagtgtcgccgaaatcgaagaagctctgcaggccggattggctcctctgggggagtataggctcctgggccggatgtttaggcgggatgagaatcggaaagtggccctggtcggactaacagccgagacaagtcacgccctggttcctaaggaaattcccgggaagggcgggatttggcgcgtgatatttaaaccacctgacccggataacacattcctgagccggttaaacgaatttcttgccggagaggggatgacagtcggagaattaagcagagcccttggtcatgaaaatggatccctggacccagagcaaggcatgatccctgaaatgtgggcacccatgctcgctcaggcgctggaagcactgcagccggccctgcaatgcctgaaatataaaaagcttcgtgtgttttctggccgcgagagcccagaaccaggcgaagaagaattcggaaggtggatgtttcatactacacagatgatcaaagcctggcaggtgcccgatgtcgagaaaagaagacggctgctggaatctctgcggggtcctgccttggatgtgatccgggtgctaaaaatcaataatcccctgataaccgtggacgaatgcctgcaggcattagaagaggtgttcggcgtcactgacaaccctcgggaactacaggttaaatatttaacaacttaccaaaaggatgaggagaagctgagtgcttatgtactgcgtctggaacccctcctgcagaaactggtacaaaggggagccattgagcgggacgctgtgaatcaggctaggctcgatcaggtgatcgcgggggcagtgcataagaccatccgacgggaacttaacctgcccgaagatggccctgcacccgggttccttcaacttttggttcttattaaggactacgaggcagcagaagaagaagaggcattacttcaagccatactagaggggaacttcacatag

SEQ ID NO: 18155 - DNA, 2394 bp, Artificial Sequence
  Description of Artificial Sequence: Synthetic coding sequence
atggctgtgcagggaagccaacgcaggctcttgggctccctaaacagtacaccaaccgcgattcctcaacttggactggcggccaatcagaccggcgcacggtgcttggaggtgagcattagcgatggtctgtttctcagtctgggcctggtgagtctggtcgaaaacgctctggtggtggctactatcgctaagaacagaaatctgcatagcccaatgtattgcttcatctgctgtctggccctgtccgatctcttggtgtcagggtctaacgttctggagaccgctgtgattctgctgctggaggctggcgccctggtcgccagggcagccgtcttgcagcagttagataatgtgatcgatgttattacatgctcaagtatgttgagctcattgtgcttcctgggagccatcgccgtcgatcgctacattagcatattttacgccctgagataccatagtatcgttaccttgcccagagcaagacgagcagtggctgccatttgggtggcatctgttgtgtttagtaccttattcatcgcttattacgaccacgtggccgtgctgctttgcctggttgtttttttcctagccatgctggtcctgatggcagtcttgtacgtgcacatgctagcacgcgcttgccagcacgcccagggtattgcccggcttcacaagaggcagcgacctgtacatcaagggttcggattgaaaggagccgtgaccttgaccatactccttggcatcttcttcctctgttggggtccattctttttgcacctgaccctgatcgttctgtgcccagaacatcccacttgtggatgcatctttaaaaatttcaacttatttctcgctctgatcatctgcaatgctatcattgacccactgatatatgcatttcattctcaggagctgcggcgcaccctgaaagaggtgcttacttgctcctgcagccaagacagggccctggttagttgggacgttaaaagcttgggaggctcagtgtgtcaggagctgttgccacagcagccacaggagaagggactgtgtgaccagaaggcgtcctctacggccttacagaggctacttcagaaggaattttgggaggtgatctctgacgagcacgggatagatccttcaggaaattatgtgggcgactcggatcttcagctggagcgcatctccgtgtattacaatgaagcaagctcacacaagtacgtgcctagggcgatcctggtggacctagagccaggaacaatggacagtgtgcggagtggtgctttcgggcacctcttccgaccagataatttcatctttgggcagagcggagctggaaataattgggcaaagggccattacacagagggggctgagctggtggactccgtcctggacgtcgtcagaaaggagtgtgagaactgcgattgtctgcagggttttcagttgactcactccttggggggcggaactggcagtggaatgggaactctgctcatcagtaaggtgagggaggaatatccagatcggatcatgaacacgtttagtgtggtcccaagccccaaagtgtctgacacagttgtggagccctacaacgccaccctgtctatccaccagctcgtggaaaacactgacgaaacctattgcatcgataacgaggccctctacgacatatgttttcgaacactaaagctggccaccccaacctatggcgacctcaatcatctggtaagcgccaccatgtccggagtcacgaccagcctgaggtttcctgggcagcttaacgccgatctaaggaagctcgcagtcaatatggtgccattcccacggttacatttctttatgcccggatttgcccctctcaccgcccgcggttcacagcagtatcgcgccttgaccgtgccagagctgacccaacagatgttcgacgccaaaaacatgatggccgcatgtgacccccggcacggaagatatctgacggtcgccaccgtattcaggggccggatgtccatgaaggaagtggatgagcagatgctggctattcaaagcaaaaattccagctactttgtcgaatggataccaaataacgtgaaggtcgccgtgtgcgatattccacccagaggactgaaaatgagctcaacatttattggcaatagcaccgcgatccaggaactgttcaagcgaattagcgaacagtttacagccatgttccggaggaaggcattcctgcactggtacactggggaaggcatggatgaaatggagttcacagaagccgaaagcaatatgaatgacctggtctcagagtatcagcaatatcaggacgcaacagcagaggaggaaggagagatgtacgaggatgacgaagaggaaagcgaggcccagggaccaaaatag

SEQ ID NO: 18156 - DNA, 99 bp, Artificial Sequence
  Description of Artificial Sequence: Synthetic coding sequence
atggccgagtcctcctccgaatcagatcatttcaggtgccgagaccgtctttccccatgggctgcccgaagcacacataggggaactcggtctctgtag

SEQ ID NO: 18157 - DNA, 453 bp, Artificial Sequence
  Description of Artificial Sequence: Synthetic coding sequence
atgacagacaccagacgaagggtaaaagtgtacactctgaatgaggaccgccaatgggacgaccggggcaccggccacgttagctcaggttatgtcgaacgtctgaagggcatgtccctcttggtgagggccgaatccgacggatccctgctattagaatccaagatcaaccccaataccgcttaccagaagcagcaggacactttgattgtctggagcgaggccgaaaactacgacctggccctgtcctttcaagagaaggccggctgtgacgaaatctgggagaagatttgtcaggtacagggtaaggatccaagcgtggatattacccaggatttggttgacgagtctgaggaggaacgcttcgacgacatgtcttcaccaggtctggagctccctagctgtgaactgagccgactggaggagatcgctgagctcgtggcctccagctag

SEQ ID NO: 18158 - DNA, 504 bp, Artificial Sequence
  Description of Artificial Sequence: Synthetic coding sequence
atggactggaaggaagtgctcaggcgccgactggccacacctaacacctgccccaacaaaaagaagagcgagcaggaattaaaagatgaggaaatggacctgtttactaaatattactcagagtggaagggaggtcggaaaaatactaatgagttttataaaaccataccccgcttttattatcgcttaccagccgaagacgaggttctcttacagaagctaagagaggagagtcgggccgtgttcctgcagagaaagtcccgggaacttctggacaatgaggagcttcaaaatctatggttcttgctcgacaaacatcagaccccgcccatgatcggtgaggaggccatgatcaactatgaaaactttctgaaagtgggagagaaagctggggctaagtgtaaacaattcttcaccgccaaagtgtttgcaaaactgctccatacggattcctatgggcgcattagcataatgcagttctttaactatgtgatgcgaaagtag

SEQ ID NO: 18159 - DNA, 507 bp, Artificial Sequence
  Description of Artificial Sequence: Synthetic coding sequence
atgcagacctttcttaagggtaaacgtgtgggctattggctgagcgagaagaaaatcaaaaagctgaacttccaggctttcgcggaattgtgtaggaaacgaggaatggaagtagtacagctgaatctgtcccggcccatcgaggagcagggaccactggacgtaattattcataaacttaccgatgtaattttagaagccgatcagaatgactctcagtcactcgaactcgtacacaggttccaggagtatatcgatgcccacccagagaccatcgtacttgacccgttgccggcgatcagaactctgcttgacaggtcaaagagctacgagctgatacgcaaaatcgaggcgtatatggaggatgatagaatctgctctccacccttcatggagctcacctcgctatgcggtgatgatactatgagacttctagagaaaaacggacttaccttcccattcatatgcaaaactagggtggcccacggtaccaactcccacgagtag

SEQ ID NO: 18160 - DNA, 822 bp, Artificial Sequence
  Description of Artificial Sequence: Synthetic coding sequence
atgccggggctctcttgccgtttctatcaacacaagttcccagaggttgaagacgtggtgatggtgaacgtgaggtccattgctgaaatgggggcatacgtgagcctgctggaatataacaacatcgaaggtatgatacttctgagcgagcttagcaggagacgcatacggtcaatcaataaattaatccgcattggcaggaatgaatgtgtagttgtgatccgggtggacaaagaaaaagggtacatcgatctgtcaaagcgcagagtaagtccggaggaggctataaagtgtgaggataagttcactaaatcaaagactgtatactctatcctcaggcacgttgctgaggtgttggaatataccaaggacgaacaactggagagtctctttcagcgcacagcttgggtgtttgacgataagtacaagaggcccggctacggggcttatgacgccttcaaacacgctgtatcagatcctagcatccttgacagcctagaccttaacgaagacgagcgagaagtcctcataaataacattaacagacgtctgacccctcaagcagtgaagatccgggccgacattgaggtagcctgctacggctacgaaggaatcgacgcagtcaaagaagcgctaagagccggcctaaattgttctacagaaaacatgcccataaagatcaatcttattgctcctccaagatatgtgatgaccacaacaactctagaacgaaccgaggggctgtcagttttgtcacaggccatggctgtgatcaaggaaaaaatagaagagaagagaggagtttttaatgttcaaatgtag

SEQ ID NO: 18161 - DNA, 2757 bp, Artificial Sequence
  Description of Artificial Sequence: Synthetic coding sequence
tgacggactaattccagatttgtcaaggtggttctcatgagcgcaaccatcagttgcaaagagtttgcggattattttgctgttccagtccagaataagatgaacccagcctatatattcgaagtggagggaaaaccgcacagtgtggaggagtactatctgaacgacctggagcacattcaccactccaagctgagcccccatctgctggaggaacctgtaattaccaaggatatctatgaggtggccgtcagcttaatccagatgttcgacgatctggatatgaaggagtcaggaaacaaggcctggtcaggtgcacaattcgtactggagagaagttccgtgcttgtgtttctcccgggcctgggggagataaattatatgcacgagctcctgacctcacttgtgcacaagcgccttcaggtctaccccctccactctagcgtcgccctagaggaacagaataacgtgtttctgtcccccgtccctggttatagaaaaattatcctgagcacgaatattgcagaatcttccgttaccgttccagatgttaaatacgtgatagatttttgtctcacaaggacgcttgtatgcgacgaggacacaaactatcaaagcttacgactgagttgggcatctaagacgtcatgtaatcagaggaaaggcagggccggacgcgttagccgcggttactgttaccgattggtccacaaggatttctgggacaatagtatccctgaccatgttgtcccagaaatgctgaggtgcccgctcggtagcactatcttgaaggtgaaactcctggacatgggggaacctcgggcccttctcgccacagccctatctccacccggtttatctgatatagaaagaactatactactcctgaaggaagttggtgctctggctgtctccgggcagcgtgaggacgaaaacccacacgacggcgagcttacattcctcggaagagtgctggctcagctccccgtgaatcaacagttaggaaaactgatagttttgggccatgtttttggatgcttggatgaatgccttatcatcgctgcggccctctccctgaaaaacttctttgccatgcccttccgccagcacctcgatggataccgaaataaggtgaacttctctgggtctagcaaaagtgattgtatcgccctggtggaggcatttaagacatggaaggcgtgcaggcagaccggagagctgagataccccaaggacgaactgaattggggcagactcaactacatccagatcaaaaggattcgagaagtggcagagttatatgaggagctgaagactagaatttctcagtttaacatgcacgtggatagtcgacgcccagtgatggatcaggagtatatttacaagcaacgcttcatcttgcaggtggtgttagcaggcgccttctacccaaattactttacgtttggccaacccgacgaagaaatggccgtgcgcgaattagctggcaaggacccgaaaaccaccgtcgtactgaaacatatccccccatatggattcttatattataaacagctgcagagtctgttcagacagtgtggccaggttaagagcatcgtctttgacggggctaaagccttcgtggaatttagccgcaacccaactgagcgctttaagactctgccagcagtctacatggccatcaagatgtcacagctgaaagtctccctggagttgtctgtacactcagcggaggaaattgaggggaaggtgcagggcatgaacgtgtctaaactgcgaaatacccgagtgaatgtcgatttccagaaacaaactgttgatcccatgcaggtgtcatttaacacctccgaccgctcccagaccgtaacggaccttctgctcaccatagacgtgaccgaggtggtagaggtggggcacttttggggttacagaatcgatgagaacaacagcgagattctgaaaaaacttaccgcagaaatcaaccagctcacgctcgtgcctttacccacacaccctcaccctgacctcgtctgtctggccccctttgcagattttgacaaacagcggtacttccgagcgcaggtgctctatgtctcaggtaatagtgccgaagtgtttttcgtggactacggcaacaaatcccacgtggacttgcacctgttgatggagattccttgccaattcctggagctgccatttcaggcactggagttcaagatctgtaaaatgagaccttctgccaagtccctggtctgcggtaaacattggagtgacggtgcgtcccagtggttcgcttccctggtcagtggatgcacattgctggtcaaagtgtttagtgtggtacatagcgtcttacatgtcgatgtttaccagtatagtggtgtccaggacgcaattaatataagggacgttttgatccaacagggatacgcagagctcacagaagaatcttacgaaagcaaagtaaatatacttcgagcagcaataaacaagctggtgtgcgacgggccgaatgggtgtaaatgtctggggccagagcgagtggcgcagctgcaagacatcgcccgacagaagctactgggcctgttttgtcagagtaaacctcgggagaagatcgtccccaaatggcacgaaaaaccatacgaatggaaccaagtggatcctaaactcgttatggagcaggctgatagagaatcttcccgggggaagaacacctttctttaccaactgcacaaactggttgtattaggaacatag

SEQ ID NO: 18162 - DNA, 507 bp, Artificial Sequence
  Description of Artificial Sequence: Synthetic coding sequence
atggaaaagttgtctgcgctccaagaacaaaagggagagcttcgtaagaggttgagttacactactcataagctggagaaactggaaaccgaattcgatagcacaagacattatctggagatcgagctgcgtagggcacaagaagagcttgagaaggtcacagagaagctgcgccggatccagtcgaattacatggccctccaacgtattaaccaggaactcgaagacaagttgtacaggatgggacagcactacgaggaggaaaaacgcgccctctcccacgaaatcgttgccttgaattcccacctgcttgaagccaaggtaaccatcgacaagttgtcagaagacaatgagctgtataggaaggactgcaacctagccgcgcagctgttgcagtgttctcaaacctatggccgagttcacaaggtttcagaactgccgagcgacttccaagaaagggtgtcactgcacatggagaagcacggttgttctctccccagcccctag

SEQ ID NO: 18163 - DNA, 636 bp, Artificial Sequence
  Description of Artificial Sequence: Synthetic coding sequence
atggacatgggcaatcaacatccctctatttcacggcttcaggaaattcaaaaagaggtcaagagcgtcgagcagcaggttattggcttctccggcctgtccgacgataaaaactacaagaagctggagcggattctgacaaagcagttgttcgagatcgattccgtagatacagagggcaagggcgatattcagcaggccaggaaacgagcagcacaggagacggagcgcttgctgaaggaactggaacagaatgccaaccatccccatcgaattgaaatccagaacattttcgaggaagcccagtccctggtacgagagaagatcgttcccttctacaacggaggcaactgtgttactgatgagttcgaggaaggaatacaagacatcattctcagattgactcacgttaagactggaggcaagatttcactgaggaaggcaagatatcatacactcaccaaaatctgcgctgtccaggagataatcgaggactgtatgaagaaacagccgagcctcccactcagcgaagatgcgcatccaagcgttgccaagattaacttcgttatgtgtgaggttaacaaggcaaggggagtgctgatcgcgctgctgatgggagttaataataacgaatag

SEQ ID NO: 18164 - DNA, 2985 bp, Artificial Sequence
  Description of Artificial Sequence: Synthetic coding sequence
atgtcccagtggacccccgaatacaacgagctctacacattaaaggttgacatgaagtctgagatcccctcagatgctcccaagacacaggaatctttgaaaggtattctgttgcatcccgaacccattggggcagcgaaatcctttccagcaggagtggaaatgattaattccaaagtcggaaatgaattcagtcacctgtgcgacgatagtcagaaacaggagaaggaaatgaatgggaaccagcaggaacaggagaagtcattggttgtgagaaagaagaggaaatcccagcaggcagggcccagttacgtacagaattgcgtcaaagaaaaccaggggattctgggcctgcggcagcatctgggcactccaagtgatgaggacaatgatagttccttctctgactgcctatccagcccgagctccagtttgcattttggagactccgacactgtcacctccgatgaggacaaggaggtaagtgtgagacattcccagacaatccttaatgcgaaaagtagatcccatagtgcacggagtcataaatggccacgcaccgaaacggagagcgtgtcaggactgctgatgaaaagaccttgcctgcacggctcctcactgaggaggctgccatgtcgaaagcgtttcgtgaagaacaacagtagtcagcgcacccagaagcagaaggaacgaattctgatgcagcgcaaaaagcgggaagtgctggcccgccgtaaatatgccctcttacccagctcttcctcatcaagcgagaacgatctgagtagtgaatcttcctcgagcagcagcaccgaaggtgaagaagacctctttgtatctgctagcgaaaaccaccagaacaacccggcagttccgagtggatcgatcgatgaggacgtggtggtgatcgaggcttcctctactccacaagtgacggctaacgaggagattaatgtgacctctacagactctgaggttgaaattgtaactgtgggagagtcctaccggtcgagatccaccttaggtcatagccgcagccactggtcccagggctcctcctctcatgcatcacggccacaggagccacggaataggagccgaatctcaacggtgatacaacccttacggcagaatgccgccgaagtggtggatctgaccgtggatgaggacgagcccaccgtcgtgcctaccacctccgcaaggatggaatcccaagccacaagcgccagcattaataatagtaacccgtctacatcagaacaggcctccgataccgcgtccgcagtcacctcttctcagccgagtactgtcagtgaaacgagcgctacactcacatcaaattctaccactggtacatcaataggtgatgacagcaggcgaacaacgtcatctgccgtcaccgaaacagggccaccggccatgccaaggctgcctagttgttgccctcagcattcgccctgtggcggctctagccagaaccatcacgctcttggccacccccacacatcatgtttccagcagcacggtcatcactttcagcaccaccaccaccaccaccatacaccacatcctgccgtgccagtgtccccgtcttttagcgaccccgcgtgtccagtcgagaggcctccccaggtacaggccccgtgtggagccaatagttccagtgggacgagctaccatgagcagcaagccttgcctgtagacctttcaaactcaggtatccgttcccacggctcagggagcttccatggagcctccgccttcgatccctgttgcccagttagttcaagcagggcagcgatattcggacaccaggctgccgcagcagccccaagccagccactgtcgagtatcgatggctatggtagctctatggtggcacaaccccagccccagccacccccgcagcccagtttgagctcctgtaggcattacatgcccccaccttatgccagtctgactcggcccctccaccaccaagcctccgcctgccctcattcacacggcaacccacccccccaaacacagcctcctccacaagtggattacgtgattccgcatccagtccatgccttccatagccagatatccagtcatgccacttctcatcctgtggcaccccctcccccaacacacctagcttcgacagcagcacctatcccccagcatctgccgcctacccatcagccgatttctcatcacattccagccacagccccccccgctcagcgtctccatccccacgaagttatgcagagaatggaggtacagcggcgccgtatgatgcagcatcccacccgtgctcatgagcgccctcctcctcacccgcaccgcatgcaccctaactacggacacggccatcacattcacgtgccccagaccatgtcctcccatccacggcaggcacccgaacgatctgcctgggaactgggcattgaggcgggtgtgactgctgctacctacactcctggagccctccacccccacctggcacactatcacgccccacctcgactgcatcatctccagctgggcgcgctgccacttatggtgccagatatggcaggctacccgcatataagatacatttcatctggcttagacgggacctcatttaggggacctttccgtgggaacttcgaagaactaattcacctggaagagaggctgggcaacgtgaaccggggagcgtcccaggggaccatcgagaggtgcacctatccacataagtacaaaaaggttacgacagattggttttcacagagaaaactccactgcaagcaagatggagaggagggcaccgaggaagacacagaggaaaagtgtaccatttgcctgagcatcctggaggaaggggaggatgtccggcggctgccctgcatgcatctttttcatcaagtctgtgtggatcagtggctgattaccaacaaaaaatgccctatttgccgggtggacatcgaggcccaactcccaagtgagagctag

SEQ ID NO: 18165 - DNA, 1158 bp, Artificial Sequence
  Description of Artificial Sequence: Synthetic coding sequence
atggcattgccccacgacagcaatgaaacatcatatttactgccgcccaataacgaggattggggaagacagaccatcccagactttgtctatgggcagaaggatctgatggctgaagggatacagtggccaagaaatgctccaggaatacctgacgctctgccacagagcccttttgatgctgcactgtgtagtgcatggaaacagcgcgttgagttagggctgtttcgctaccggctgcgcgaacttcagactcagatacttcccggtgccgtcggattcgttgcacagctaaatgtcgagcggggggttcagaggcggcccccacaaactatcaagtccgtgcggcaagcttttgaccctgtgcagttcaattttaacaagatacgccctggggaagtgctctttaggcttcacagagaacccgatctccccgggactctccttcaggaggacatactggtggttatcaatgtcagccctttagagtggggccatgtgttattagttccagagcctgcgagacagcttccccagcggctgttgcctggggccttgcgagcgggaattgaagccgtcctgctgagtttgcatccaggctttagagtaggctttaattctctcggcgggctggccagcgtgaaccacctgcatctccatggctactacctagcacaccgccttccagtggagcaggctccttccgaaccactggatcccggcggacatcttcacctgctgcaggacctcccggctcctggcttccttttctacacgcggggtcccgggccagatttggaatcattgataagtcgggtctgcagggcaacagactatctgaccgatcacgaaattgcacataacctgttcgttaccagaggcgcaccgcctggtaaaacgtcaccgagcagcgcattgacaggggtgagggtgattctgtgggccaggaagtcctcctttggaatcaaggacggcgaggcctttaacgtggcactgtgtgagctcgccgggcacttaccagtgaaaacttcacaggacttcagctctctgaccgaggccgctgcagtggccttgatccaggactgccgcctgccacccagccaggcagaggacgtccaggcagcactggtggctcttatgagtcaagaggaacagtag

SEQ ID NO: 18166 - DNA, 7464 bp, Artificial Sequence
  Description of Artificial Sequence: Synthetic coding sequence
taagaggaggaggaagacgacgatgatgaagaggaggaagtttccgaagtcgaaagctttatattagaccaggatgatttggagaatcctatgcttgaaacagcctctaagttattattgtctggcactgcagacggcgcagacttgaggaccgttgatcctgaaacccaagcccggttggaggcactgttggaggcagctggaatcggaaaactctcaaccgccgatggcaaggcattcgccgatcccgaagtgctacgaaggctcaccagctccgtttcgtgtgctctagacgaagccgctgcagcattaacgaggatgagagcagagagtaccgccaacgccgggcagagcgacaatcggtccctggccgaagcctgcagcgaaggagatgtcaacgccgtccgtaagctgctcatagaaggcaggagcgttaatgagcataccgaagagggagagtcattgctctgcctggcatgtagcgccggatactatgagctggctcaggttcttcttgctatgcatgcaaacgtagaagatcgtggcatcaaaggcgacatcacaccactgatggccgccgcaaatggtggccacgtcaaaattgtcaagctgttactcgcgcataaggccgacgtgaacgcccagagcagtacgggcaataccgccttaacttacgcctgtgcggggggatacgtggatgtggttaaggttctgctggaaagcggagcttccatagaagaccacaacgaaaacggccacactcctctcatggaagccggatccgcgggccacgtggaggtggcgcgcctgctgctagagaacggagcaggaatcaacactcactccaatgagttcaaggaatccgcattaaccttggcctgctataagggacacctagaaatggtgagatttctacttgaggccggcgctgatcaggaacacaagacggacgaaatgcatactgctctgatggaagcttgtatggacgggcatgtggaggtggctcgcctccttctcgatagcggcgctcaggtcaatatgccagcggactctttcgaatcccccttgaccttagcagcttgcgggggccatgttgagctggctgcgttgttgatcgaacgaggcgcaagcctcgaggaggtgaacgatgaaggttatacacctctgatggaggcagcccgcgaaggacatgaggaaatggtggctctgctgctcgggcagggtgctaatattaatgcgcagactgaggaaacccaagaaaccgcactcacactcgcttgttgtggaggctttttggaggtggcagactttttaatcaaggctggcgctgacatcgagctaggctgttctactcccctgatggaggccgcccaggagggacacctggaactggttaagtaccttctcgcagcgggcgctaatgtgcacgcaacaaccgcgaccggggataccgccctgacatacgcatgcgaaaatgggcacaccgacgtggctgatgttctgcttcaagcaggcgctgacctggagcacgaaagcgaaggaggacgcactcctcttatgaaggcagctcgtgcgggtcatgtctgtacagtacagttcctgatatctaagggggcgaatgtgaatagaactactgccaacaacgaccacactgtgctgagtcttgcgtgcgccggggggcatttggcggtcgtggagctccttctggcacacggcgctgaccccacccacagactcaaggatggttccaccatgctgatcgaggctgcaaagggcggccacactagtgtggtatgctacttattggactaccctaacaatctattgagtgcaccccctccagacgttacgcagctaacccccccgtcacatgacttgaaccgcgccccaagagttccagtgcaggctttgccaatggtggttccaccccaagaaccagacaagccccccgctaacgtagccacgaccttgcctatccgcaataaagccgcttcaaagcagaagtccagcagccacctgccagcaaactcacaggatgtgcagggatatatcacaaatcagagcccagaatctatagttgaagaagcccaaggtaaactgactgaattggaacagcgaatcaaggaagcgattgagaagaatgcacagctccagtcccttgagctggcacatgccgaccagttaacaaaggaaaaaatagaagagctcaataaaactcgagaagaacagattcagaagaagcaaaagattctggaggagctgcaaaaggtcgaacgcgagctacaattgaagacgcagcaacagttgaagaagcaatatttagaggtcaaggcgcagagaattcagttgcagcagcagcagcagcagtcctgtcagcacctggggttgctgacacccgtcggggttggcgagcaactgagcgagggggactacgcacggttgcagcaagtggatcctgtactgttaaaggacgagcctcaacagaccgccgctcagatggggtttgcacccatacagccactcgccatgccacaagcgctgcccctggccgctggaccactgcctcctggatccatagccaatctcactgaactccaaggcgttatagtaggccaacctgtgctgggacaggcccagctggctggcctgggacaagggattttgacagagactcagcaggggctgatggtagcatcgccagcccagaccctgaatgataccctcgacgatatcatggcggtaagcggccgtgcctctgccatgtcaaatacgcccacccactcaatcgccgctagtatttctcagcctcagaccccgacccctagccctattatttcccccagcgccatgctccctatttatccagccatcgacatagatgcacagactgagagtaaccacgacaccgcactgaccctggcctgcgccggaggccacgaggaactcgtccagacactgcttgagaggggtgctagcatcgagcacagagataagaagggcttcacccctttaatccttgctgcgaccgcaggtcacgtgggcgtggtcgagattctgctagataatggggcggatattgaagcccaaagcgagcgcacaaaggatacacccctctccctcgcatgctccgggggtcgccaggaggtggtggagctcctcctcgcacgcggagcaaacaaggagcacaggaatgtgtcggactataccccactgtccttggccgcatctggcggatatgttaatatcattaagattcttctcaatgccggcgcagagatcaattctcggacggggtcaaagctagggattagccccttgatgctggcagctatgaatgggcacacagccgcggtgaaacttctgctcgacatgggctccgacattaacgctcagattgagactaatcggaacaccgccctgaccctggcatgcttccaaggtcgaacagaggtagtgtcgctgcttttggacaggaaggccaacgtggagcatagagctaagacggggctgacgcccttaatggaagccgctagtggggggtatgccgaggtggggcgggttctgctcgataagggtgccgacgtcaatgccccaccggttccgtctagtcgcgacacggcactgaccatcgccgccgataagggtcactacaaattctgtgaactgctaatcggaagaggtgcccatattgatgtacggaataaaaaggggaacacaccactgtggctggcagccaatggtggccacctcgatgtggtgcagctgttggtccaagccggcgctgacgttgatgctgcagacaatagaaaaatcactcccctgatggcagcttttcggaagggccacgttaaggttgtgcgctacctcgtcaaagaagtaaatcagtttccctcagacagtgaatgcatgaggtacattgcgaccatcaccgataaggaaatgcttaagaaatgccatttgtgtatggagagtatcgtccaagccaaggacagacaggccgctgaggccaacaaaaacgcctcaattttgctggaggagctagacctcgagaagcttagggaggaatccagaagactggctctggcggccaagcgtgagaagcggaaggaaaagcgaaggaaaaagaaggaagaacaacggcgaaagctggaagaaatagaagccaaaaacaaggaaaacttcgaactacaggccgcacaggagaaggaaaagctcaaggtcgaggatgagcctgaagtgctcaccgagccccccagcgctactacaacaacaacgatcggtatatcggccacgtggactaccctggccggctcacatggaaagaggaacaatacgattaccacgactagttcaaaacggaagaatcgaaagaacaagataacacctgagaatgtccagatcatctttgacgaccctctgcccataagctacagtcagcccgagaaggtcaacggcgaaagtaagtcaagctctacttccgagtccggcgactccgacaacatgcgaatctcaagctgttccgacgagagtagcaattctaactcgagcagaaaatccgacaaccattctcctgccgtagtaaccactactgtatcatcgaaaaaacagccgtccgttctagtgaccttcccaaaagaggaacgcaaaagtgtttctggcaaggcctctataaagcttagcgagacaatatccgagggcacttcaaacagcctcagtacttgcacaaaatcgggaccttcccccctttcctcacccaatggtaagctcaccgtcgcatccccaaagcggggtcagaagcgggaagaaggctggaaggaggttgttcggagaagtaagaaggtcagtgtgccctccaccgtgatttcgcgcgtgatcggccgcggcggatgcaatatcaacgccatcagggaatttactggagcccacattgacattgacaaacagaaggataagaccggtgatcgtattatcactattcgtggcggcaccgagtccactagacaggctacccaactcatcaacgcgctgattaaagaccccgataaggaaatcgatgagctgattcccaagaacaggctgaaaagcagtagtgccaactctaagatcggcagcagcgctcctacgacaactgctgcgaatacatctttgatgggaattaagatgacaaccgtagctctgtcctcaacttcccaaactgccacagccctcaccgttcctgccatctcctcagcctccacacacaagacaattaagaatccagtgaacaatgtaaggcccggcttcccagtgagcctgccattggcctaccctcctccccaatttgcgcatgcgctcctcgctgcccagacatttcagcagattagaccccctagattacctatgactcatttcgggggaacttttccccccgcccagtcaacatggggacccttccccgtcaggccactgtctcccgctagggcaaccaacagcccaaagcctcacatggtgcccaggcatagcaatcaaaacagttccggcagccaggtgaatagtgctggaagcttaacatcctctccaacaactaccacttcatccagcgcctccactgttcccgggacgagcacaaacggatccccctctagccccagtgttcgcagacagctgttcgtgacagtcgtgaagacgtccaatgccacaacaacaactgtgactaccacagcatctaataataatacggctccgacgaacgctacgtatcctatgcctaccgccaaggagcattatccagtttcgtctccgagtagccctagtccgccggcacagcccggtggagtctcaaggaatagccccttggactgtggttctgcttcccctaataaggttgcaagctcttccgaacaagaagcaggatctcctccagtggttgagaccactaacacccggccccccaatagctcttcaagtagcggcagttcctccgctcacagcaaccagcagcagccacctggcagcgtttcccaggagcctcgcccgcccttacagcagagtcaagtgcccccgcctgaagtccggatgaccgtgcctccattggccacttccagcgcccctgtggccgtgccctcaacagcccccgtcacgtacccgatgccccagacaccgatgggttgtccccagcctactcccaagatggagactcccgcaataagaccacccccccacggcacaacagccccacataagaactctgccagcgtacagaattcatctgtagccgtgctatcagtgaatcacatcaaaagaccacattcagtcccctcctccgtgcaactcccatcaaccctttcaacacagtccgcttgtcaaaatagcgtgcacccagccaataaacctatcgccccgaactttagtgctcctctaccctttggccctttctctaccctcttcgagaattcccccacttcagcacatgccttctggggcggctccgtggtctcctcccagtcaacccctgaaagcatgctgtcgggaaagtcctcatatctgcccaattcagacccgctccaccagagtgatacaagtaaagcccccggttttcgcccacctctccagcgccctgctccaagcccttctggaattgttaatatggactcaccctatggaagtgtgactccaagtagtacccatctggggaactttgcaagcaacatcagtggggggcaaatgtatggccccggtgctcccctcggaggagccccagctgcagctaatttcaaccggcagcacttctcacccctgagcctgttaactccctgttctagtgccagtaatgactctagtgctcagagcgtctctagtggggtgcgcgcccccagccccgcaccatcaagcgttccccttggcagtgaaaagccatcgaatgtctcgcaggacagaaaagtgcctgtccccatcggaactgagagaagtgcccgaatacgacagacaggtaccagcgcccctagcgtgatcggttccaatctgtcaacaagcgttggccattcaggtatctggtccttcgagggcattggaggcaaccaagataaggtcgattggtgtaatccagggatggggaatcccatgattcaccgaccgatgagcgatccaggagtgttttcccagcaccaggccatggaaagggactccaccggtatcgtgacaccatcaggaacatttcaccagcacgttccagctgggtatatggatttcccaaaggtgggcggcatgcccttcagcgtttacggtaacgcgatgattcctccggttgcccctatccccgacggcgccggcggtccgatcttcaacggcccacacgccgccgatcccagctggaatagcctaatcaagatggtgagctcaagtaccgagaacaacggtccccagacggtgtggactggaccatgggcccctcatatgaacagtgtccacatgaatcagctgggatag

SEQ ID NO: 18167 - DNA, 33 bp, Artificial Sequence
  Description of Artificial Sequence: Synthetic coding sequence
atggctctaccccatgactcaaatgagacttag

SEQ ID NO: 18168 - DNA, 462 bp, Artificial Sequence
  Description of Artificial Sequence: Synthetic coding sequence
atggctacgatgattccccccgtcaagttgaagtggctcgagcatctgaattcctcctggatcactgaggacagcgaaagtattgctacgcgggagggcgtggcagttctatactccaaactagtaagtaacaaggaggtggtccctttaccccagcaagtcctgtgcttaaagggtcctcagctacctgatttcgagagagagtcactgtcatccgatgaacaagaccattatttagatgcactcctctctagtcagctagctctggctaagatggtgtgctctgacagccccttcgccggggctcttaggaagagactcctggtcttgcagcgggtgttttacgccttgagtaacaagtaccatgataagggtaaagtcaagcagcagcaacattcacctgagtcgtcctccgggtctgctgacgtgcattctgtttctgaacgaccccgctctagttag

SEQ ID NO: 18169 - DNA, 111 bp, Artificial Sequence
  Description of Artificial Sequence: Synthetic coding sequence
atgctcccaccgaaacatctcagcgctacaaagccaaagaagtcctgggcaccaaacctctatgagctggacagtgatctcaccaaggaacccgacgtgattattggctag

SEQ ID NO: 18170 - DNA, 315 bp, Artificial Sequence
  Description of Artificial Sequence: Synthetic coding sequence
atggcccagagcggtggcgaggccaggcctggaccaaagactgcagtgcagatcagggtggccattcaagaggccgaagatgtcgatgaactggaagatgaggaggagggagccgagactagaggtgctggagatccagctaggtacctatcacccggatggggatcagcaagtgaggaggaaccttcccggggacaccgcaccgcgcagttgccttggttagagagtcagcaggtctttagcctcaagccttttctcctgccgactggaatcgagctgacccctgagaacccctggggctcttcagtttcctag

SEQ ID NO: 18171 - DNA, 645 bp, Artificial Sequence
  Description of Artificial Sequence: Synthetic coding sequence
atggcgcttcctcacgattccaacgagacatcttacttgttgccacctaataatgaggattggggccggcagaccatccccgatttcgtgtatggccagaaagacctcatggctgagggcattcagtggccccgaaacgcccctggcattcccgacgcactgccacagtcaccatttgacgcagccctatgcagcgcctggaagcagagagtggagctcggcctatttcggtacaggttgcgcgagctgcagacccaaattttgcccggggcagtcggcttcgtagcgcagctgaatgtggagcggggcgtgcagcgacgccctccccagaccattaaaagcgtcaggcaagctttcgatcccgtgcagtttaacttcaataagatccgacctggcgaagtcttatttcgcttacaccgggagcccgatctccccggaaccttgttacaggaggatattcttgtagtcataaatgtgtccccactggagtggggtcacgttctgctcgtgccagaacctgcccggcagctgcctcagcggttactgcccggcgccttacgagccggaatagaggcagttcttttaagtctccatcccggctttcgtgttggattcaattccttaggcggcctagctagcgtatag

SEQ ID NO: 18172 - DNA, 2988 bp, Artificial Sequence
  Description of Artificial Sequence: Synthetic coding sequence
atgtcacagtggacgccagagtataacgagttgtataccctgaaggtggatatgaaaagtgaaatccccagcgatgccccgaagacacaggagtcgttgaagggcattcttctgcatccagagcccattggcgccgctaagtctttccctgcgggcgtggaaatgatcaactccaaggtgggcaatgagtttagccatctctgtgacgactcgcagaagcaggagaaggagatgaatggcaatcagcaagagcaggagaaatctcttgtagtgcgaaaaaagcggaagagccagcaggctgggccttcctatgtgcagaactgtgtcaaagaaaaccaggggatcctgggacttcgtcagcatcttgggacccctagcgacgaagacaatgatagttccttcagcgactgcctgtcaagcccctccagctccctgcacttcggtgatagtgataccgtcacaagcgacgaagacaaagaggtcagtgtcagacactcgcagaccatactaaacgcaaagtcccgctctcattccgccaggtcgcataaatggccacgcaccgaaactgagtctgttagcggactgcttatgaaacggccctgccttcacgggtccagcttgcgtagactgccttgcagaaagcgcttcgtcaagaacaacagtagtcagaggacccagaaacagaaggaacggatactgatgcagagaaaaaaacgggaggttctggcccgcaggaaatacgccctcctgccaagctcctctagctcctcggaaaatgatttatcttcggagtccagttcctcatcatccacagagggcgaagaagacttgtttgtgtcagcatccgagaaccaccaaaacaaccccgctgtcccgtccggttcaatcgacgaagatgtggtggttatcgaggccagttctaccccgcaggtgaccgcgaatgaggaaattaacgtgacgtcaacagattccgaagtagaaatcgtgaccgttggagaaagttaccggtcacgctcaacactgggccacagtcgctcccattggagtcaggggtcgtcctcccatgctagtaggccacaggaaccacgcaacagaagcaggataagcaccgtgattcagccacttagacaaaacgcagccgaggtggttgatctgacagtcgatgaggacgaacccaccgtcgtccccacgaccagcgcacggatggagagtcaggccacctcagcctccatcaacaacagtaacccctccactagcgaacaggcctctgatactgcgtccgccgtgacttcgtcacagcccagtactgtcagtgaaacgtcagcgacgctgacgtctaacagcacaactgggacgagcattggcgacgacagcagacgcacaaccagcagcgcagttaccgagactgggcccccagcaatgcccaggcttccatcctgctgtccacagcacagcccttgtgggggaagcagccaaaaccatcacgcattgggacacccccatacctcctgcttccagcagcacgggcaccattttcagcatcaccatcaccaccaccacaccccccaccccgcagtgcccgtgtcgccatccttctccgatcccgcgtgccctgttgagcgccccccccaggttcaagcgccctgcggtgctaattcatcatccggcactagctatcacgaacaacaggccttgcccgtcgatctctcaaactctggcatacgcagccacggttccggcagttttcatggagcctcagctttcgatccctgctgtcctgtttcgtcttccagagctgcaatcttcggacaccaggccgctgcggcagcgccgagccagccgctgagttcaatagatggatacgggtcctccatggtggcccagccccagccccagccacctccccagcctagtctgtcaagctgtcgtcactacatgcctcctccctatgctagcctgactaggcctttgcaccaccaggcctccgcctgcccccactctcatggcaaccccccccctcagactcagcctccgcctcaagtagattatgtgatacctcatcccgttcacgcgtttcacagccagatcagtagccatgccacgtctcaccctgtggcgcctcccccgccaacccatctggcctctaccgcagctcccattccccaacatttaccaccaactcatcaacctatcagccaccatattcccgcaactgctccccccgcacaacgcctgcatcctcatgaggttatgcagcgaatggaagtgcaacgcagacggatgatgcaacaccctaccggactatttgttttctgcgtgtcccgcagggcccacgagcgccctcctcctcaccctcacaggatgcaccctaactatgggcacggccaccacatccatgttccacagactatgagttcacatcccaggcaggctcccgagagatctgcttgggaactaggtatagaagccggtgtcaccgccgctacttacaccccaggggctctccaccctcacctggctcactaccatgcccctccccgattacaccacctccaactgggggccctacctttgatggtgcctgatatggccggatacccacacatccgatacatttcaagcggactggatggaacatcctttcgggggccgtttcggggtaactttgaagaattaattcaccttgaggagagactaggtaatgtcaacaggggcgccagccagggaactatcgagcggtgcacttacccgcataagtataagaagcggaagctgcactgtaagcaggacggggaagaggggacagaggaagataccgaggagaagtgcaccatttgtttatcgatattggaagagggggaggacgtgcgaagactaccttgtatgcatctgtttcaccaagtatgtgttgatcaatggcttatcactaataaaaaatgtcccatctgtagagtggatatcgaggcccagttgcccagtgagagctag

SEQ ID NO: 18173 - DNA, 1851 bp, Artificial Sequence
  Description of Artificial Sequence: Synthetic coding sequence
atggcgggtggtagaggcgcacctggacgcgggcgtgatgagccgccggagtcttatccacagcggcaggatcacgagctgcaggccttagaagccatatatggtgccgatttccaggaccttaggcctgatgcatgtgggcctgtgaaagagcctcccgaaataaatctagttctctacccacagggtctcaccggggaagaggtctatgtgaaggtcgacttaagggtgaaatgccctcccacttaccccgatgtcgtaccggaaatcgaattaaagaatgctaaaggactctccaatgaaagcgtaaatctactcaaatcccgcctggaggaactggctaagaaacactgcggcgaggtgatgatctttgaattagcataccatgtacagtcctttttgtcggaacataataaaccgccccccaagagctttcacgaggaaatgctggagcgaagagcacaggaagagcagcaaaggcttttagaagcaaagagaaaagaagagcaggaacagcgtgaaatcctccacgaaattcagcgacggaaggaggaaatcaaggaagagaaaaagcgaaaagagatggctaagcaggagcgattagagatagcctccttgtctaatcaggaccacacttccaagaaggatcccggcggccaccgtaccgcagccattctgcacggagggtcccctgacttcgtgggaaacggcaaacatagggctaattcttccggaaggagcagacgggagcgacaatactccgtgtgcaactcagaggattcacccggtagttgcgagatactgtacttcaatatgggctcccctgaccagctgatggttcataagggtaaatgtataggatctgacgagcaactcggcaaactggtgtacaatgccttagaaacagcgaccggggggtttgttttgttgtacgagtgggtgctccaatggcagaagaaaatgggcccctttcttaccagtcaagaaaaggagaaaatcgacaagtgcaagaagcaaattcaggggaccgagacagagttcaatagcctcgtcaagctttcccatccaaacgttgtgagatatctagccatgaatcttaaggaacaagatgactccatcgtcgttgatattctggtcgagcacatcagcggtgtgagcctggctgcacatcttagccacagtggccctatacctgttcatcagctacgccgctataccgcacagctcctgagcggtctggattacctccatagtaacagtgttgtacataaagtgctgtcagcatccaatgttctggttgacgcggagggcaccgtaaagatcactgactattccataagcaaacgcctcgctgatatttgcaaggaggacgttttcgaacagactagagtcagattctccgacaacgccctgccatataagactggcaagaagggagacgtctggcgactgggactcctgctcctgagtctgtcccagggacaggagtgcggagaataccccgtcacaattccttccgacttgcccgcagacttccaggattttttaaagaagtgtgtctgcctcgacgacaaagaaagatggagtccacagcagctcctaaaacattctttcattaatcctcagccgaaaatgcctctcgttgagcagtcacctgaggatagcgagggacaagactatgtggagaccgttatcccaagcaaccggctcccatcagctgcctttttttccgaaacccagagacagtttagtaggtactttatcgaatttgaggagctgcagcttttagggaagggtgcgttcggggctgtgatcaaggtgtggtaccgggttatcccatcaccactttag

SEQ ID NO: 18174 - DNA, 396 bp, Artificial Sequence
  Description of Artificial Sequence: Synthetic coding sequence
atgtctcaatggactccggagtacaatgaattatacaccctgaaagtcgatatgaaatctgaaattccctcagatgccccgaaaacacaggagagcctaaaggggatacttctccatcctgagcccatcggagccgctaaatcgttccctgcgggtgtggagatgattaacagtaaagttggtaacgagttcagccacctctgcgatgacagccagaagcaggagaaggaaatgaatgggaaccagcaggagcaggagaaatcactcgtggtcaggaagaagagaaaatctcagcaagccggaccaagctatgttcaaaactgtgtcaaagaaaaccaggggatcctaggcctgagacagcacctcggcaccccttctgacgaggacaacgattag

SEQ ID NO: 18175 - DNA, 1863 bp, Artificial Sequence
  Description of Artificial Sequence: Synthetic coding sequence
atggctccagactctgacccattcccagagggccctcttctgaagctcctcccactcgacgctcgtgaccgtggaacccaaaggtgtagacttggaccagccgccctgcacgcgctcggcgccaggctgggaagcgcggtaaaaattagcctgcccgacggtggcagctgtttgtgtacggcttggccccgtcgcgacggcgccgacggattcgtgcagcttgatcccctctgcgcctctccaggcgccgcggtgggagcgtcacgctcacgaagatcactgtccttaaatcgattgcttctggttccctgccctcccctgcggcgcgttgcagtctggccggtgctgagagagagggccggagccccaggcgctaggaacacggctgccgtactagaggccgcgcaggaactactgaggaaccggcctatctctctgggacacgtggtagtggccccaccaggtgcccccggcctcgtcgccgcactgcatatagtaggcggaacacccagcccggaccccgctgggctggtgactccaagaactagggtgtcactcgggggagaaccaccaagtgaggcccagcctcaaccagaggtccctcttggcggtctgtcagaggctgcagattcactccgggagcttctgaggcttcctctaagatatccacgggccctgactgctctgggcctggccgtacctcgcggtgtgctactcgccgggcctcccggcgttgggaagacgcagctggtacgggctgtcgctcgagaggctggagccgagctgctcgcagtgagcgctcccgccttgcaggggagcagaccaggagagaccgaggagaacgtgaggcgagtgttccaaagggcaagagaactggcttcacggggaccctctctactctttctcgacgagatggacgcactctgccctcagcgtggctctagggccccagagagtagggtggtcgcccaggtactgactctgctggatggcgcctcaggtgatagagaagtcgtggttgtcggcgctacaaaccgccccgatgcactggaccccgcactccgcaggccaggacgctttgatagagaagtggttatcgggactccgactcttaagcagcgcaaggaaatactgcaggtcattacgtcaaagatgccaatttcgtcacatgttgatctgggtctcctggcggagatgacggttggctatgtgggagcagatctgactgctttatgtcgggaagctgcaatgcatgcccttctgcactccgaaaagaatcaagacaatccagttattgacgagatcgactttcttgaggcgttcaaaaatatccagcccagttcctttcggagcgtgattggcctcatggacattaaaccggtggactgggaggagatcggaggccttgaagatgtgaaattgaagctaaagcagagcattgagtggccgctgaagtttccttgggagtttgtgagaatgggtctgactcagccaaaaggcgtgcttctgtacggcccacctggttgcgccaaaacaaccctggtcagagccctagcaacctcttgccactgtagcttcgtcagcgtgtctggcgctgatttattttcaccttttgtcggcgatagtgaaaaggtgctatcacagatatttcgacaggcgagggcgtccactcccgccattctctttctagatgagatcgattctatcttgggcgcaagaagcgccagcaaaacgggatgtgacgtgcaagaacgggtcctgtcggtcctccttaacgaactggatggagttggcttgaaaacgatcgagcggagaggcagtaagagctcccagcaaggtaagtacaaagaacttaaaaaatag

SEQ ID NO: 18176 - DNA, 4767 bp, Artificial Sequence
  Description of Artificial Sequence: Synthetic coding sequence
atgctgccaccaaaacacctcagtgccaccaaacccaagaagtcgtgggcaccgaacctatacgaactggattctgaccttacgaaagagccagatgtgatcatcggagagggacctaccgacagcgaatttttccaccagcgatttaggaacctcatctacgtcgaatttgtaggcccccggaaaaccctcatcaagttgcggaatctgtgtcttgattggctgcagcccgagacacggactaaagaagagatcattgaactgctcgtgttagagcagtacctgactataattccagagaaacttaagccctgggttagggccaagaagcccgagaattgtgaaaaactggtcacgctcttggaaaattacaaggagatgtaccagccggaggacgataataatagcgatgtgacaagcgacgatgatatgacacggaatcgccgggagagctcgccaccacattctgtccactcttttagtgatcgggactgggacaggcgcggacgatcccgtgacatggaaccacgggataggtggtcacacactagaaaccctaggagcagaatgcccccccgcgacctgtcacttcctgtggtcgcgaagacttcattcgaaatggatcgtgaagatgatagggactcgcgggcttacgagtccagatcccaggacgctgagagctaccagaacgtcgtcgatttagcggaggatcgaaagccccacaatactatccaggacaatatggaaaactatcggaaactgctgtcattagttcagctcgcggaggacgacgggcactcacacatgacccaaggtcactcttcacgaagcaagcggtccgcctatcccagcacctcacgcggcctgaaaacaatgcccgaagctaagaaatcaacacataggaggggaatttgtgaggatgaatctagtcacggcgtcataatggagaagtttattaaagacgtttctagatcttctaagtctgggagggctcgggagtcatcagataggtcccaacggttccccaggatgtcagatgacaattggaaggacatatcactgaataaacgagaatctgtgatccagcagcgggtctacgagggtaatgctttccgcggtggtttccgttttaattccacccttgtttccagaaagagagtgctagagagaaaaagacggtatcattttgacacagacggtaagggatctattcacgatcagaaaggctgcccacgcaaaaagcctttcgaatgtggcagtgaaatgcgcaaggccatgtcagtaagcagtctttcctccctgtcatccccctcctttacggagtcccaacccattgacttcggagccatgccctacgtatgcgatgaatgcggcaggtctttctctgtgattagtgagtttgtggagcatcagattatgcatacgcgggagaacctttacgagtacggggaaagcttcatacactcagtagcagtttccgaggtgcagaagagccaagtgggaggtaagaggttcgaatgtaaagactgtggcgaaactttcaacaaatccgccgccctcgcggagcaccggaaaattcacgctaggggctaccttgttgaatgtaaaaatcaggagtgcgaggaagcctttatgccctcgcctaccttcagcgaactgcagaagatctacgggaaagacaaattctatgaatgcagggtgtgtaaggaaacatttcttcactcctctgcacttatagaacatcaaaagattcatttcggcgacgacaaagacaacgaaagagagcacgagagagagagagagcgcgaaagaggcgagacctttcgcccttccccagccctgaacgaatttcagaagatgtacggtaaggagaaaatgtacgaatgtaaagtgtgcggcgaaaccttccttcacagcagtagcctgaaagaacatcagaagattcacacccgcggcaaccccttcgaaaacaaaggcaaagtctgcgaggagacattcattccaggtcagagtctgaagcggcgccagaaaacatacaacaaagagaagctctgcgatttcacggacggtcgggacgcctttatgcaaagctcagagctttcagagcatcagaagatacactcaaggaaaaatcttttcgaaggaagagggtacgaaaagtctgtcatccatagtggtcccttcactgagagccaaaagtcccatacaatcaccagaccactggaaagtgatgaagatgaaaaagcatttacaatctcttctaatccctatgaaaaccagaagatcccaactaaggagaatgtgtacgaggccaagtcatatgagcgtagcgttatccactccctcgcttcagtagaagctcagaaatcacactccgttgccgggccctcaaagccgaaggtcatggccgaaagtacgatccagagtttcgacgccatcaatcatcagcgcgtgagagctgggggcaatacatccgagggaagagagtactcccggtcagtgatccattctcttgtggcttcaaaaccacccaggagccataatggcaatgagctcgtggagagtaacgaaaagggagagtcttctatttacatctccgacctcaatgacaaacgacagaagattccggctcgcgagaacccctgcgagggcgggtcaaagaatagaaattatgaggactctgtcatccagtcagtcttcagggcaaaaccacagaaatctgtaccgggcgaagggtctggagagttcaagaaagatggtgaattttccgtacctagtagtaatgtgagggagtaccagaaagctcgagcgaagaagaagtacattgaacacaggtctaacgagacaagtgtgatccactctctcccattcggagagcagacgttcagaccgcggggcatgctctacgaatgccaggaatgtggggagtgtttcgcgcattcctctgacctgactgagcaccaaaagattcacgaccgcgagaagcctagcggttctcgaaactacgaatggtccgtaattcgctcactggctcccactgacccccagacaagctacgctcaagaacagtatgctaaggagcaggcaaggaacaagtgtaaggactttagacaattttttgccactagcgaagacctgaatacaaatcaaaagatatacgaccaggagaaaagtcatggggaggagtctcagggagagaatacggacggtgaggagacacattccgaggaaacgcatggtcaagagacaatagaggacccggtgattcagggcagcgatatggaggacccacagaaggacgaccccgatgataagatctacgagtgtgaggattgtggtctcgggtttgtggacctgacagacctgaccgatcatcagaaggtgcactcccggaaatgcctggttgattcgagagagtacactcactctgtgattcatacacactccatcagtgagtatcagcgtgattacacaggtgaacagttgtacgaatgcccaaaatgtggcgaatcatttatccattcgtcctttcttttcgaacatcagcggattcatgagcaagaccaactgtacagcatgaaaggctgtgacgatggctttatcgctttgctgccaatgaagccaagaaggaaccgcgcggctgaacggaatcccgccttggcaggaagcgcaattcgttgtttgctctgtggacaaggcttcattcactcgtcagcgctcaatgagcacatgagactccatcgcgaagacgatcttcttgaacagagccagatggccgaagaggcgatcattcccggacttgccttaacagagtttcagagatcccagactgaagaacgcctatttgaatgtgccgtgtgcggggagtccttcgtgaaccctgcagagctcgccgaccacgtgactgtacataaaaacgaaccctatgagtatggtagcagttatacacatacctcattcctgaccgagcccttgaagggagctattccattttacgagtgcaaagactgcggaaaaagtttcatccattccactgtgctgacaaaacacaaggaactgcacctggaggaggaagaggaggacgaggcggccgctgcggctgctgcagctgcccaagaggtggaagctaatgtccatgtccctcaggttgtactgcgtattcagggattgaatgtcgaggcagcagaaccggaagtggaggcagctgagccggaggttgaagcggcagaaccagaggtagaagcagcagaacctaatggtgaggcggagggcccagacggtgaggcagcagaacctatcggtgaggccggacaacccaacggggaggccgagcagccaaacggagacgccgatgagcctgacggcgccggcattgaggaccccgaagaacgcgccgaggagcccgaaggcaaagctgaagaacctgaaggggacgctgacgagcctgatggtgtgggaattgaggaccccgaagaaggagaggaccaggaaatacaagtggaggaaccctattacgactgtcatgagtgcaccgaaacttttacctcaagcacggcgttctctgagcatttaaaaactcacgcttcaatgatcattttcgagcccgcaaacgcatttggggagtgctctggatacatagagcgggcatctacctccacggggggcgctaatcaggccgacgagaaatactttaagtgcgacgtgtgcgggcagctgttcaacgaccggttgagcttggcccggcaccagaatactcacacgggctag

SEQ ID NO: 18177 - DNA, 63 bp, Artificial Sequence
  Description of Artificial Sequence: Synthetic coding sequence
atggcgacaatgatccctcccgtgaaactgaaatggctcgagcatctgaattccagttggtag

SEQ ID NO: 18178 - DNA, 4389 bp, Artificial Sequence
  Description of Artificial Sequence: Synthetic coding sequence
atgtatcagccggaagacgacaacaactccgacgtcacaagcgacgacgacatgaccagaaatcggagagagagctccccgccccattccgtccacagcttcagcgatcgtgattgggaccgtcgcgggagatctcgggatatggaaccccgagatcggtggtcccatacacggaaccccagatctcgaatgcccccaagagatctgtcattgcccgtggtggcaaaaaccagtttcgaaatggatcgggaggatgaccgggactcacgggcatacgagagtaggtcacaggacgcagaatcttatcagaacgtcgtggatttggcggaggatcgaaagccacacaataccattcaggacaacatggaaaactacaggaagttgttatcattggtacagcttgctgaggatgatggtcatagccacatgacccaaggccactcttcacgctctaaacggtccgcgtacccaagcacttcacggggcctaaagactatgcccgaagcaaaaaaaagcacacaccgccgggggatctgtgaggacgagagctcccacggtgtgatcatggagaaattcattaaggacgtgtccaggagctctaagtcagggagggcccgggagtcgtctgaccgctcccagaggtttccacggatgtcagacgacaactggaaagacatatctctcaataaaagagaaagtgtgattcagcaaagagtctacgaggggaatgcattccgagggggcttccgttttaactccactctcgtcagccggaaaagggtcctagaacggaagcgcagataccatttcgacacggatggaaaaggctccattcatgatcagaaagggtgtccccgtaaaaagcctttcgagtgtggttccgaaatgcgaaaggccatgtcagtttcatccctatctagtctgagcagcccgagttttaccgaatcccaacctattgattttggtgcaatgccctatgtgtgcgacgaatgtggccgttctttctctgtgattagtgaatttgttgagcaccaaatcatgcataccagggagaacctgtatgagtatggtgaaagctttatccatagcgtcgccgttagtgaggtacagaaatcccaggtggggggcaaaagattcgagtgcaaagactgtggagaaaccttcaataaatctgctgctctggccgagcaccgaaagatacatgcacggggttatctggtggaatgcaagaatcaggaatgtgaagaagcgttcatgccatctccaaccttctctgagctgcaaaaaatatacggaaaggacaaattttacgagtgcagagtctgtaaggagactttcttacacagcagcgcactgatcgagcaccaaaaaatccactttggcgacgacaaggacaacgaacgcgagcacgagcgggagagagagcgagagcggggggaaacattccggccttctcctgctctcaatgagttccagaagatgtatggaaaggaaaagatgtacgagtgcaaagtgtgcggtgaaaccttccttcattctagcagccttaaggagcatcaaaagatccatacccggggcaatcccttcgagaataaaggcaaagtctgtgaggaaacatttattcctggacaatctctcaaacgcaggcagaaaacttataacaaggagaagctttgtgactttaccgacggccgcgatgcttttatgcagtccagcgaactgagcgagcaccagaagattcacagtagaaagaacttattcgagggacgggggtacgagaagagcgtcatacacagcgggccattcaccgagtcacagaagagtcacactattactagaccactggaaagcgatgaggatgaaaaggcattcacgatttcgtccaatccttatgagaatcagaagatccctaccaaagaaaacgtgtacgaggcaaaatcttacgaaaggagcgtcatccacagtctggcctctgtggaagctcagaaaagtcatagtgttgcaggtccctccaagcccaaagttatggcggagagcaccattcaaagctttgacgctatcaaccatcaacgcgttcgggccgggggcaatacatcggagggcagggaatactcacggtcagttatacactctctggtggcgagcaagcccccacgctctcataatggcaacgagttggtcgaatccaacgaaaaaggggagagttccatctacatttcagatctcaacgacaagagacagaagatcccagctagagaaaatccctgtgagggcgggagcaaaaatcgcaattacgaggactcagtgatccagagtgtcttccgcgctaagcctcagaagtccgttcctggggaaggaagcggtgagttcaagaaggatggcgaattttcggtgcctagtagtaacgtccgggagtaccagaaggcacgcgccaagaagaagtatatcgaacatagatcaaatgagactagcgtgatacactccctcccattcggggaacaaacattccgaccaaggggtatgctgtatgagtgccaggagtgcggcgagtgctttgcccattctagcgatcttactgaacaccagaagattcacgatagagaaaagccgtccgggtccaggaactatgagtggagtgtcattcgctccctggcaccaacagatccacaaactagctacgcccaggagcagtacgccaaggagcaggcgcggaacaaatgtaaagacttccgacaattcttcgccacctccgaggacctgaatactaaccaaaagatctatgatcaagagaagagccacggagaagagagtcagggtgaaaatacagacggggaggagacccattcagaggaaactcatgggcaggaaaccatagaagaccctgtcattcaaggctctgacatggaggacccccaaaaagatgaccccgatgacaaaatatatgagtgtgaggattgcggactggggttcgtggacctgaccgatcttactgatcaccagaaagtgcattctaggaaatgcctcgtggactcaagggaatacactcacagtgtcattcatactcactccatttccgagtaccagcgtgactatacgggcgaacaattgtacgaatgtcctaaatgtggcgagagtttcattcactctagcttccttttcgaacaccagagaattcacgaacaggaccaactgtactctatgaagggttgcgacgatggtttcattgctctcctcccaatgaaaccccggcgcaacagagcggctgaaagaaaccccgctctcgcaggttcggccatcaggtgtcttctgtgcggacaggggtttatccattcttcagccctgaatgaacacatgaggctgcaccgagaggatgacctcctggagcagtcacagatggccgaggaagccattatacccggtctggctctgactgagttccagaggtctcagacggaggaacgactgttcgaatgcgctgtatgcggagagtcctttgtgaacccagctgagctcgctgaccatgtgactgtccataagaacgagccatacgaatacggcagctcatatacccatacttcgttcctgaccgagcccctaaaaggcgcaatccctttttatgaatgtaaagactgtggtaagtcgtttatccacagcacggttcttaccaaacataaagagctccatttggaagaagaggaggaggatgaggccgcggccgccgccgccgccgcagcccaggaggtggaggctaatgtccacgtgccgcaggttgttctgcggatccaggggttaaatgttgaagcagcagaacctgaggttgaagctgcggaaccagaggttgaggccgccgagcccgaggtcgaggctgctgaaccaaatggggaagcagagggcccagatggagaagctgctgagccaatcggcgaggctggacagcctaacggagaggcggagcaaccaaatggggacgcagatgaaccagacggggctgggattgaagaccccgaggaacgagcagaagagcctgagggcaaggcagaagaacctgagggcgatgcggatgagcctgatggggtcggcattgaggatcccgaagaaggcgaggatcaggaaatacaggttgaagagccatattatgattgccacgagtgcacagagacttttacgagctctacggctttttctgagcatctgaaaacgcacgcctctatgatcatttttgaaccagccaacgcctttggcgagtgcagcgggtatatagagcgggctagcacgtccacaggaggagccaatcaagcagatgagaagtatttcaaatgtgacgtgtgtggtcaactattcaatgatcgcttatctctggctcgccatcaaaacacgcacacggggtag

SEQ ID NO: 18179 - DNA, 438 bp, Artificial Sequence
  Description of Artificial Sequence: Synthetic coding sequence
atggcaactatgatcccacctgtcaagcttaaatggctcgagcatctcaatagcagttggattaccgaggattccgagtctattgccacgagggagggcgttgctgtgttgtattccaaactcgtgtccaacaaagaagtggtacctctcccacaacaggtcctgtgcctgaaaggcccccaactgcccgacttcgagagagaatctctttcatccgacgaacaagatcactatctggatgcactcttgtcgtcccagctggccctggccaagatggtgtgttccgattccccctttgcaggcgcactgagaaagcggctcctggtcctgcagcgcgtgttctatgctctgtccaataaataccacgacaagggtaaagtgaagcaacagcaacattctccagaatccagctctggttcagctgatgtgcattcttag

SEQ ID NO: 18180 - DNA, 4284 bp, Artificial Sequence
  Description of Artificial Sequence: Synthetic coding sequence
taagcaaagcaggagcgtcttgaaatagcttctctaagtaatcaggatcacacaagtaaaaaagaccctggcggccacaggaccgctgccattttgcacggtggcagcccagacttcgtgggtaacggcaaacatagagccaactccagcggacgaagcaggagggagcggcaatactcagtgtgtaacagcgaggacagcccaggctcttgtgaaattctctatttcaatatgggtagtccagaccagttgatggtgcataaggggaaatgcattgggtcggatgagcagctcggtaaactggtgtataacgctctggagacagccactgggggattcgttttgctgtacgagtgggtattacagtggcagaaaaagatgggtccctttctcacctcccaggagaaggagaaaatagataagtgtaaaaaacagatccagggaaccgagacagagtttaacagtctcgtgaagctaagccatcctaacgtagtccgttacctggcaatgaatcttaaggagcaagatgactctatcgtggtcgatatcctcgtagaacatatttcgggcgtttcactggcagctcacctaagccatagcggacccatccccgtacatcagttaagacgttatacagctcagctgctctcaggcctcgactatttgcatagcaatagcgtcgttcataaagtgctcagcgcgtctaatgtgctggtggacgcagaggggacagtgaaaattactgactattcaatttctaagaggctcgccgacatttgtaaggaagatgtattcgagcagactcgggtgcgctttagtgataatgcgttgccctacaaaacaggcaagaaaggagatgtgtggcgattggggttgctactgctgagcctctctcagggccaggaatgtggcgagtatcctgtcacaattcctagcgacttacccgcagattttcaagattttcttaagaagtgtgtatgcctggatgacaaagaacggtggagtcctcagcagcttcttaagcatagcttcataaacccacagcccaagatgcccctcgtggagcagtcacctgaggactccgaaggccaagattatgttgagaccgtgatccccagcaatcgcctccctagtgcggctttttttagtgagacgcagcggcagttcagtagatactttatcgagttcgaggaactacagctgctgggcaaaggggccttcggcgccgtgatcaaggtacagaataaactggacggatgctgctacgccgtcaaacggattcctattaacccagcctctaggcagttcagacggattaaaggcgaagtgacccttctgtcacgactccatcacgagaacatcgtgcgatattacaatgcttggatcgagcggcacgaaaggcccgcaggccctggcactccccctcccgacagcgggccactggcaaaagatgaccgcgccgctagagggcagcccgcatctgatactgacggcctcgattccgttgaagcagcagccccgcccccgattctgtccagttctgtggaatggagtactagtggggaacggagcgcgagtgcaaggttccccgcgactggccccggaagttctgatgatgaggatgatgacgaagacgaacacggtggcgtgttttctcagagctttctgccagcttccgattcggaaagtgacatcatctttgacaacgaggatgaaaatagcaagagccagaatcaaatggagtattgcgagaaatctaccctcagagatacgatcgaccagggcctgtatcgggatacagtccgcctctggaggctgttcagggaaattctggatggcttagcctacattcatgagaaaggcatgatacatagggatctcaagcccgtgaacattttccttgattcggatgaccacgtgaaaatcggggactttgggctcgcgaccgatcacttggcctttagtgccgattcaaaacaggacgaccagaccggcgatttgatcaaatccgacccgtccgggcacctgaccggtatggttgggaccgcactgtacgtgtccccggaggtgcaggggtctaccaagtctgcctacaaccagaaggtagatctattttctcttggtatcattttcttcgagatgtcctatcatccaatggtgaccgcgagcgaaaggatctttgtcctcaatcagctgagagaccccacaagcccaaagtttcccgaggactttgatgacggggaacatgctaaacagaaaagtgtgatcagctggttgctcaaccacgacccggcaaaacgtcccacggccacggagctgctgaaaagcgagttgctgcctccacctcaaatggaggagtcagagcttcatgaagtcctgcatcatacactgaccaacgttgatggaaaggcataccgcaccatgatggctcagatctttagccaacgcatctctccagccattgattatacttacgattccgacattctgaaaggcaacttctctatccgaacagcaaagatgcagcagcacgtgtgcgagaccattattcgcatattcaaaaggcacggcgccgttcagctttgcaccccgctgctgctaccgcggaaccgccagatatatgaacacaatgaagccgccctctttatggatcacagcgggatgctcgtgatgctgccattcgacctgaggatcccctttgccaggtacgtggcacgtaacaacatcctgaacctgaaacggtactgcattgagcgggtatttagaccgaggaagctggatcggtttcacccgaaagaactcttagaatgcgcattcgacatagtgacgagcacaacaaactctttcctccccaccgccgagataatctataccatttatgagattattcaagaatttcctgccctgcaggaaaggaattattccatttacctgaatcacacaatgctacttaaagctatccttctgcattgtggcattcctgaggataagctgtctcaagtgtacatcatcctgtacgacgctgtgacagaaaagctgacgcgccgagaagtagaagcaaagttctgcaatcttagcctctcaagtaacagcctttgtcggttgtacaaattcattgaacagaaaggcgatctccaggacctcatgccaacaataaacagtctaatcaagcagaagacaggaatcgctcagctggtcaagtacggattgaaggacttggaggaggttgtgggactgctcaagaaacttggcatcaaactgcaggttcttatcaacttggggctggtatataaggtccagcaacacaacgggattattttccaatttgtggcatttatcaagagacggcagcgggccgtcccagagatccttgctgcagggggtcggtacgatttgcttatcccccagttccgcgggccacaagcattaggtcccgtaccgaccgccattggcgtctcgatagccatagataaaatctccgcggctgtgctgaacatggaagagtcagtcactatctcctcctgcgacctgctagtcgtttccgtgggccaaatgtccatgagtcgagccataaacttaacgcagaagctttggacagctggaataacggcagaaataatgtatgactggagccagtcccaagaggagcttcaagagtattgcaggcatcatgagattacttatgtggccctggtgtcagacaaggaaggctctcacgtgaaggtgaaatcctttgagaaagaacggcagacagagaagagagtgcttgaaacggaactagtggatcacgtgctccagaagttgaggaccaaggtgaccgacgaacggaacggccgggaggcctcggataatttggccgttcagaacctcaaggggagttttagtaacgcttctgggcttttcgagatccatggagccaccgtggttcctatcgtcagtgtattagctccggagaaactgagcgctagcacccgaagaagatacgagacacaagtgcagaccagactgcagacatcgctcgctaacctacatcaaaaaagtagtgagatcgagattctggctgtggatctgcccaaggagactatattgcagttcttgagtttagaatgggacgcagatgaacaggcattcaacacaactgtaaaacagctactttctcggctgccaaagcagagatacctcaagctggtgtgcgacgagatatataacatcaaggtggagaagaaggtgtcagtacttttcttgtactcttaccgcgacgattactatagaatactattctag

SEQ ID NO: 18181 - DNA, 4767 bp, Artificial Sequence
  Description of Artificial Sequence: Synthetic coding sequence
atgctaccgcccaagcatttgtccgctacaaagcccaagaaaagctgggcacctaacctctacgaactggatagcgacctcactaaggagccagatgtgatcataggcgaaggacctacagatagtgagttttttcatcagcggtttagaaacttgatatacgtcgagttcgtgggtccgcgcaagacgctcattaagctgagaaacctctgcctagactggctgcagcccgagacccgaaccaaagaggagatcatcgagctgttggtattggaacagtacctcaccataatacctgaaaaactgaaaccttgggtgcgtgcaaagaagcccgagaattgcgagaagcttgtcacactgctagagaattataaagaaatgtatcagccggaggatgataataatagtgacgtcacttcggatgatgatatgactcgcaacaggcgcgagtctagtccgccacactccgtccactccttttcagacagagactgggatcggaggggtcggagtagagacatggaaccacgggacagatggagccatactagaaatccacgtagccggatgccaccaagagacctaagcctgcccgtggtggctaagacgtcattcgagatggatcgggaagatgaccgagattctcgggcgtatgaaagcaggagtcaggacgccgagtcctatcagaatgtcgttgacctggccgaggaccgaaaaccacacaatacaattcaggacaatatggagaactacagaaaattgctgtccctcgtgcagcttgccgaggacgatggacattctcatatgactcagggacacagcagtcgctctaaacgctccgcctacccctcgacttccagaggcctgaagaccatgccagaggcaaagaaaagcacgcaccggaggggcatctgtgaagacgagtcaagtcacggggtaatcatggagaagttcataaaagacgttagccggtcaagcaaatcaggacgggcaagggagtcttctgatcggtcccagaggttcccacgcatgtcagatgacaactggaaagacataagcttaaacaagagagaaagtgttatccagcagagggtttacgaagggaatgccttcagagggggattcaggttcaacagtaccctagtaagccgaaagagggtgcttgaacgcaagagaaggtatcattttgacaccgatggcaagggcagtattcatgaccaaaagggctgcccacgtaaaaagccattcgagtgtggatcagagatgcgtaaagccatgtctgtgtcgagtctaagctctctcagtagtccttctttcaccgagagccagcccatcgatttcggggccatgccgtatgtgtgtgacgagtgcggacggagcttcagtgtgattagcgagttcgtggagcatcagatcatgcacaccagagaaaacctttacgagtatggtgagtcattcatccactcagtggccgtgtcggaggtgcagaagtctcaggttggtggcaaacggtttgagtgtaaggattgtggggagacattcaataaaagtgccgccctcgcagagcacagaaagatacatgccagaggctacctcgtcgaatgcaagaaccaggaatgtgaggaggcctttatgcccagtcctacttttagcgagctgcagaagatttatggaaaggacaagttctatgaatgccgcgtctgcaaagaaactttcctccatagcagcgccttaattgaacaccaaaaaatccactttggggacgacaaggataacgagcgggagcacgagcgcgaacgagagagagagcggggggaaacgttccggccttcgccagctcttaacgaatttcagaagatgtacggtaaagagaagatgtacgaatgtaaggtttgcggcgagacatttctacattcctcgagcctgaaggagcatcagaaaatccacacaaggggaaaccctttcgagaacaaggggaaggtttgcgaggagacatttatacccgggcaatctttaaagcgcagacaaaagacgtacaataaagaaaaactctgtgatttcacagatggccgggatgccttcatgcagagctcagaactgtctgagcaccagaaaatccatagtcggaaaaacctattcgaagggcgcggctacgaaaagagcgtgatccacagcggaccttttacagaatctcagaagtcccatacgatcacacggccactggagagcgacgaagacgagaaggccttcactatatcttcaaacccttacgagaaccagaaaataccaactaaagagaatgtgtacgaggctaaatcatacgagcggtctgtgattcacagcctggccagtgtagaggctcagaaaagccattctgtggctggcccttcaaagcctaaagtgatggcagagtcaacaattcagtcctttgacgccattaatcaccagcgcgtcagagcaggtggcaatacctctgaaggacgagaatattcaaggtcagtgatccactcattggtggcatctaagcctccaagatctcacaacggtaatgaacttgtagagtcaaatgagaaaggagagtcaagcatctacatcagcgatctaaatgacaagcgccagaagatcccggcgcgtgaaaatccgtgcgagggcggatctaagaatcgcaactatgaggattccgttattcaaagcgtgtttagagccaagccacaaaaatcagtgcctggagaaggcagcggagaatttaagaaagacggggagtttagcgtgccgtcctccaacgtgcgagagtatcaaaaggctagggcgaagaaaaaatatatagagcatagaagtaacgagaccagcgtcatccacagcctgccttttggcgagcagacttttcgcccaaggggcatgctctatgagtgtcaggagtgtggggagtgttttgcacactcttccgacctcactgaacaccagaagatccatgatcgcgaaaagccctcgggcagcagaaactatgaatggagcgttattaggtcactagctcccactgatccacagacaagctacgctcaagaacaatacgctaaggagcaggcccgtaataagtgtaaagacttcagacagtttttcgctacatctgaggacctgaacaccaatcagaagatttatgatcaagaaaaatcgcacggcgaggaatcacagggggaaaatacggacggcgaggaaacacactctgaggaaacacatggacaggagacaatcgaagatcctgtgatccagggtagcgacatggaagatccacagaaagacgacccggacgataaaatctatgaatgtgaagactgcgggctcgggttcgtggatctaactgacttgactgatcatcagaaggtgcacagtcgtaagtgtctggtggattccagggaatacactcatagcgtcatacacacacactccatctctgagtatcagcgggactatactggtgaacagttatacgaatgtcctaagtgcggagagtcattcatccacagctcctttttgttcgaacaccaacgaatccacgagcaggatcagctatacagtatgaagggctgtgacgatgggtttattgctttgctccctatgaagcccaggcgcaacagggcagcagagagaaatccagcgctggccggctcagccattcgctgcttattatgtggccagggctttatccattctagtgctctgaacgaacacatgagattgcacagggaagacgatctgctggagcagtctcagatggccgaagaagccattattccagggctggcgttaacagagtttcaaaggtcgcaaactgaggagcgtctgtttgagtgtgccgtctgtggtgagtcttttgtaaacccggcagaactggctgaccatgtgacggttcacaagaacgaaccttatgaatatggatcttcttacacccatacatccttcttaacagaaccactgaaaggcgctatccccttttatgaatgcaaggattgcggcaaaagcttcattcactccactgtgctgaccaaacacaaagaactgcacttggaggaggaggaagaagacgaggcagccgccgcggccgctgcagccgcccaggaagttgaggccaacgttcacgttcctcaggtggttttaagaatacagggtttaaacgtggaggctgccgaacccgaggtagaagctgcggagcctgaagttgaggccgctgaacccgaggtcgaagcagccgaacccaacggcgaggctgaagggccggatggggaggccgccgagccaatcggtgaagccggacagcccaatggggaggcagagcagcctaatggcgacgccgatgaaccagacggagcgggaatcgaggacccagaggagcgcgccgaggagcctgaaggcaaggctgaggagcccgagggcgacgctgacgagccggatggggtgggaattgaggacccagaagaaggggaagatcaggagatacaagttgaggaaccgtattacgactgccatgaatgtacagagactttcacctccagcacagccttctccgagcacctgaaaacgcacgcatctatgataatttttgaacccgcaaacgccttcggagagtgttctggatatattgagcgagccagtaccagtaccgggggcgctaaccaggcagacgagaagtactttaagtgtgatgtatgtgggcagctgtttaacgaccgcctgtccctggcaagacaccaaaatacccatacagggtag

SEQ ID NO: 18182 - DNA, 3012 bp, Artificial Sequence
  Description of Artificial Sequence: Synthetic coding sequence
atgtcgcagtggacgcccgagtacaatgagctgtacaccctcaaggtggatatgaaaagcgaaatcccctccgatgcccccaagacgcaagagagtttaaaaggcattttactacatcctgaacctatcggcgctgcgaaatccttccccgccggcgtggaaatgataaattccaaggttggcaatgagttctcccacttgtgcgatgactcccagaaacaagaaaaggagatgaacggcaaccaacaggaacaggagaagtcactcgtggtgcgcaagaagaggaagagccagcaagctggaccgagttatgtacaaaattgcgtcaaggagaaccaggggatcctgggacttcggcaacacctggggaccccaagcgatgaggataacgacagttccttttctgactgtttatcatcccccagttccagtctgcattttggcgattctgataccgtcactagcgatgaggacaaggaggtgagtgtacggcactcccaaaccattttgaacgctaagtcaaggtctcacagcgccaggtcacacaagtggccccgcaccgaaactgagtcagtatctggcctactgatgaaaaggccgtgcctgcacggatcttcactccggcggctaccttgccgaaagcggtttgtgaaaaacaattccagccagagaacacaaaagcagaaggagcgtattttaatgcaaaggaaaaaaagagaagtgctcgcacgacgcaagtacgcactgctgccatcctcttcatcttccagcgagaacgacctgtccagtgagtcctctagttcaagctcgaccgagggtgaggaggatctgtttgtgagcgccagcgaaaaccaccaaaacaatcctgccgtcccttcaggttcgatcgacgaagacgtggtcgtcatagaggccagcagcactccgcaagtcacggctaacgaagagattaacgtgacctcaacagactctgaagtcgagatcgtcacggtgggcgagtcctatcgaagtcgttctacactcggtcactctcgaagccactggtcacaagggtcttcttcacacgcatctcggccccaggaaccccgtaatagatcccgcatatcaacggtgatccagccactgcgacagaatgcggccgaggtggttgatctcacagtcgatgaggacgagcccaccgtagtaccgacaacttccgcccggatggagagccaggcaacctcggcctccataaacaacagtaacccgtctacttccgaacaggcaagcgacaccgcatccgccgtgactagtagccagccttccacagtaagcgaaacttcagcaacactaacgtctaattctacaacaggcacatcaatcggtgacgacagtagacgcacaaccagcagcgcagtaaccgaaactggccctcctgccatgccccggctgccttcttgctgcccccagcattccccctgcggaggaagtagtcaaaatcatcacgcactgggccatccccacaccagctgctttcaacagcatgggcaccacttccaacatcatcaccatcatcatcacacaccacaccctgcagtccctgtgagcccgtccttcagcgaccccgcatgcccggtagaacgcccaccccaggtacaggcaccttgtggagccaatagctcatccgggacttcataccacgagcagcaggcactcccagtggatctaagcaactctggcatccgatctcatgggagcgggagcttccatggagcatctgccttcgatccttgctgtccagttagttcctccagggctgctattttcgggcaccaggcagccgctgccgcgccaagtcagccgttgtcttctattgatggatacggatctagcatggtggcacaacctcagccccagcccccaccgcagccttccctgagttcctgcagacactatatgcctcccccgtatgccagcttgacaaggcccttgcaccaccaggcctccgcctgcccacattcacatggaaaccctcctccacaaacacagccccctccgcaggtcgattacgtgatcccccacccagtccatgcattccactcacagattagctctcacgccaccagtcacccggttgcgcctcctcctcctacccacctggcgtccacagcggccccgattccccagcacctgccaccaacccaccagccaatttctcatcatatcccagccaccgcacctccagctcagagacttcatccacacgaggttatgcaaagaatggaggtccagcgcagacggatgatgcagcaccccacaggactcttcgttttttgcgtatctcgacgggcccatgaaagacccccgcctcacccacacaggatgcaccctaattatgggcatggacaccatatacacgttccccagaccatgagctcacaccctagacaggcccccgaacgtagtgcttgggagcttgggatcgaggccggcgtgaccgcagctacatacactcccggagcgctgcatcctcatctggcgcactaccacgcacccccaagactccaccatctgcaacttggagcgttgccactcatggttccggacatggcagggtacccccacattcgctatatttctagcgggctggatggcacctctttccgcggcccttttaggggtaattttgaggaattgattcaccttgaggagcgtctcggcaatgtgaatcgtggggcatcccaaggaaccattgagaggtgtacttacccccacaaatacaagaaggtcaccaccgactggttctctcaaaggaagctgcattgcaagcaggatggtgaagagggtactgaggaggacaccgaagagaaatgcacaatttgtttgagcatcttggaggaaggcgaggacgtgaggcggttaccatgcatgcacctgtttcaccaggtgtgcgtggatcaatggctgattacgaacaagaaatgtcccatctgtagggtcgacatcgaggcccagctaccaagtgagtcctag

SEQ ID NO: 18183 - DNA, 150 bp, Artificial Sequence
  Description of Artificial Sequence: Synthetic coding sequence
atggctctgcctcatgattccaacgaaactagttacttgctgcctcccaataacgaggattgggggagacaaaccatccccgactttgtgtacggacagaaagacctcatggccgaaggcattcaatggccccgcaatgcacctggctag

SEQ ID NO: 18184 - DNA, 375 bp, Artificial Sequence
  Description of Artificial Sequence: Synthetic coding sequence
atgagagcgtctccatgcatcagccaacccgccgcttcatggcacccaagaccaagcgcactccggccaaccgccggctccggtccagatacaaggacaccaggcacagtcgaggatgggtctgctccctgcccagcatttcggagcccagcagtcagtccatgcggcgaggaaccgtgttgtttccagattagccccgctgaggaaacattagagctgggtaggctggtaagccccgggaattgtgatacgctctccccccgtgcggcaggcttttatgcctgccacgtgagaagcctgattccctgccgcagtactaaagggagatggcccctgacagccagcgctgctggcctgagttcgttctctggctag

SEQ ID NO: 18185 - DNA, 93 bp, Artificial Sequence
  Description of Artificial Sequence: Synthetic coding sequence
atggctaccgacagctgggcactagccgttgacgagcaggaagcagccgctgagtcgagaaccgaactcccatcaccatattctacctcttag

SEQ ID NO: 18186 - DNA, 804 bp, Artificial Sequence
  Description of Artificial Sequence: Synthetic coding sequence
atgtgggaccagcggttggtgaagttagctctacttcagcacctgagagcattttatggcattaaggtgaagggtgtgcgtggacagtgtgatcggaggaggcatgaaaccgcggccacagagataggtggtaagatctttggtgtgccgttcaatgctcttccacattcggccgttccagagtacggacatatcccgtcctttctagtagacgcttgtaccagccttgaagaacatattcataccgagggcctgttcagaaagtccggaagcgtgattagactgaaagccctaaaaaataaagtggatcatggagagggatgcctcagcagcgcccctccttgcgacatagctggcttactcaagcagttctttagagaactgcctgagcctattctccctgcagacctgcacgaagctctcttgaaggcccagcagctaggcacagaagagaagaacaaagcgatcttgcttctgagctgcctgctcgccgaccatacagttcacgtgctgcggtacttcttcaatttcctacgaaatgtgtctctacgctccagcgaaaacaaaatggattcatccaacctggctgttatatttgcccccaacctgttgcaaaccagtgaaggccatgagaagatgtcctcaaatgctgaaaaaaaaggagtttatcaaacactgagctggaagcgttaccaaccttgctgggtgctgatggtgagcgtgttactgcaccactggaaggcccttaagaaggtgaatatgaagcttctggtgaacatccgcgagcgggaagacaatgtttag

SEQ ID NO: 18187 - DNA, 1113 bp, Artificial Sequence
  Description of Artificial Sequence: Synthetic coding sequence
atggggtttaacaggccctccaaaattcaggaaaacgccctgccactgatgctcgccgagcccccgcagaatctcatcgcgcagagccagagtgggaccgggaaaactgcagccttcgttctggccatgctgtcccaggtagagcccgcgaacaaatatccacagtgtctgtgtctgtcccctacgtatgagctggccctgcagacaggtaaagtcatagagcagatggggaagttttacccggagctcaagctcgcctatgcagtgagaggcaataagctggaaagggggcaaaaaatcagtgagcagattgtcatcggcacaccggggactgtacttgactggtgctctaaactcaaatttatcgatcccaagaagatcaaagtgttcgtgctcgatgaggccgatgtcatgatagctacgcagggacatcaggaccaatctatacgcatccagagaatgctcccgcgcaattgccagatgctgctcttctctgctacgtttgaggattctgtctggaaatttgcccaaaaggtcgtgcccgatcccaacgtgatcaagttgaagcgcgaagaagaaactctggacaccataaaacagtattacgtgctgtgttccagcagggatgaaaaattccaggctttgtgcaatctttacggagccatcaccatcgctcaggccatgattttctgccataccagaaagactgcttcgtggctcgccgcagagctaagcaaagagggccaccaggttgccctactcagtggcgagatgatggtagagcagcgcgctgccgtcattgaaaggttccgggagggcaaagaaaaagtgctcgtaacgacaaacgtctgtgctagaggcatcgatgtcgagcaggtatctgtggtcatcaacttcgacctgccagtggacaaagatggtaacccagataacgaaacgtacctgcacagaatcgggcgtaccgggcgtttcgggaaacgaggcttggctgtcaatatggtcgatagtaaacactctatgaatatcctgaacagaatacaggaacattttaacaaaaagatcgaaaggctggacactgatgacctggacgagattgaaaagatcgctaactag

SEQ ID NO: 18188 - DNA, 2712 bp, Artificial Sequence
  Description of Artificial Sequence: Synthetic coding sequence
atggcaactagcgcagacagccccagcagtccgctcggagcggaagatctgctttcagactcatccgagcctcccggtctgaaccaggtgagttccgaagtgacatcccagttgtacgccagcctcaggctgtcaaggcaggccgaggctacagcacgcgcccaactttacttgccctccacttcaccgcctcatgagggactcgatgggtttgcgcaagaactgagtagaagtttgagcgtgggattggagaagaacctgaaaaaaaaggatggatccaagcatatcttcgaaatggagagtgtaagaggccaactgcaaaccatgctgcagacttctcgcgacactgcttacagagatcccttgatccccggggccggttcagaaaggcgggaagaagattccttcgacagtgattccacggcaaccctgctcaacactaggcctttgcaggatttgagcccttcgtcctcagcacaagcgctcgaggaactgtttcccagatatacctctctgcggcccggacctcctctgaaccctcccgactttcaggggctccgggatgccctcgacagtgaacacacacggcgtaaacattgcgaaagacacatacagtcccttcagacccgggtcctcgagcttcagcagcagctcgcagtggcagtcgcagcggaccgaaaaaaggacacaatgatagagcaactcgacaagacactcgcacgggtcgtggaaggctggaacaggcacgaggctgaacgcacggaagtgctacgcggcctccaagaagagcatcaagctgctgaactgaccagatctaagcaacaggaaacggtaacgagactagaacaaagtctgtccgaggccatggaggccttgaaccgtgagcaggagtcagcgagactccaacagcgagagagagaaacacttgaggaagaacggcaggccctcacccttcgtttagaggcagagcagcagcgatgctgtgtgctgcaggaagagcgtgacgctgcgagggctgggcagctgtccgagcaccgagaactggaaaccttacgggctgcattggaggaagagcggcagacttgggctcagcaggagcaccagctgaaagagcattatcaagccctccaagaagagtcacaggctcaactggaacgcgagaaagaaaaaagccagagagaggcgcaggccgcatgggagactcagcaccagctggccctcgtgcagtctgaggtccgtaggttggaaggagaattggacaccgcccgccgagaaagagatgctttgcagttagagatgtcactggtgcaggcacgttacgagagtcagagaatccagctcgagtctgaactagcagtgcagttggaacagcgggtgacagagcggctggcccaggcacaggaatcatcgctaaggcaagctgcgtccttaagagagcatcaccgaaagcagcttcaggatctgtccgggcagcatcagcaggagctggctagccaactggctcagttcaaagttgaaatggccgagagggaagagcgccagcagcaggttgcagaggattatgaactgcgtctcgcccgggagcaggcgcgagtatgtgagcttcagtcaggtaatcaacagctggaggagcagcgggttgagttggtggagagacttcaggcaatgctccaggcccattgggatgaagccaaccagctgctgagtacaaccctgcctccccccaatccaccagcccctcctgctggcccctccagccctggccctcaagaaccagaaaaggaagagcgacgagtgtggacaatgcctccgatggctgtagctcttaaaccagttctgcagcaatcacgcgaagcccgggacgagctgcctggagctccaccagttctctgctccagctcgagtgacttgtctctgctgctgggcccctcctttcagagccagcattcattccagccgcttgaacctaagcccgacctgacaagcagcaccgctggggccttcagcgctctcggtgcctttcaccccgaccatagagccgaacgcccttttcctgaggaggacccaggaccggatggagagggcctgctgaaacaggggctccctcccgcacaactggaaggcttaaagaatttcttacaccagctgctggagacagtgccccagaataacgagaacccctcagtggacctactgccccccaaatccggcccactcacagtaccatcatgggaagaggccccgcaggtcccccggattcccccaccagtacacaaaactaaggtgcccctagcaatggccagttcattgttccgcgtacccgaaccaccgagctcccacagccaggggtccggcccgagctccggtagcccagagcggggaggggacggacttactttccctaggcagctaatggaagtgtcgcagctcctgaggctgtatcaagcgagagggtggggtgcactcccggcggaggacctactgttgtatctgaagaggttggaacatagtggaaccgatggcagaggggataatgtgccaaggcgtaacaccgattcaaggcttggtgagattccacggaaggagataccgagccaggcagtgccaaggcgcttagccactgcccctaagaccgaaaaacctcctgcaaggaaaaagagtggacatccggccccttcgtctatgcgaagcagagggggtgtatggcgatag

SEQ ID NO: 18189 - DNA, 138 bp, Artificial Sequence
  Description of Artificial Sequence: Synthetic coding sequence
atgcccctgctggtagaaggacggcgtgtgcgcctgccccaaagcgctggtgatctcgtgcgcgcccaccctccgcttgaggctccttcccctttctgggtgctcatgatgcccctgctggttaccctgtggtcctag

SEQ ID NO: 18190 - DNA, 1083 bp, Artificial Sequence
  Description of Artificial Sequence: Synthetic coding sequence
atggaggaacttagtcaagccctggcctctagtttttctgttagccaggatttaaactctacagctgctcctcatcctagactatcgcagtataaatccaagtactcctctctggaacagtctgaaagaaggagacgactgctggagttgcagaaatcgaagagacttgactacgttaatcacgctagacggctggctgaggacgactggactgggatggagagcgaagaggaaaataaaaaagatgacgaggagatggacatcgacactgtgaaaaaactgcccaaacactatgccaaccagcttatgttgagtgagtggttaattgatgtgccatcagacctgggccaagagtggatcgttgtggtctgccccgttgggaagcgtgcactcatcgtggcctctaggggatcaactagcgcgtacaccaagagtggatactgtgtgaaccgcttttcaagcctgctgcccgggggaaatcgtcgtaattctactgcaaaggattacactattctggattgtatctacaacgaagtaaaccaaacttattacgtgttggatgtgatgtgctggaggggccacccgttttatgactgccagactgattttcggttctattggatgcatagcaagttacctgaggaggaaggccttggagagaaaaccaaacttaaccctttcaagttcgtgggcctcaagaacttcccctgcacacctgagagcctatgtgacgttctcagtatggattttcctttcgaggtggatggtcttctgttctatcataaacaaacacactactcccctggcagtacaccactagtgggatggcttagaccatacatggtgagtgacgtgctgggcgtggccgttcccgctggtccgttgacaacaaagcctgactatgcaggacaccagctccagcagatcatggaacataagaagagccaaaaggagggcatgaaggaaaaactgacccacaaagccagtgagaatggacattatgagctggagcacctaagtacacctaagttgaaaggatcctcccactccccagatcacccaggctgcctgatggaaaactag

SEQ ID NO: 18191 - DNA, 1353 bp, Artificial Sequence
  Description of Artificial Sequence: Synthetic coding sequence
atggtgccacttgtggccgtggtctcgggtccaagagctcagttgtttgcttgtttactgaggctgggcacgcagcaagtggggccactgcaacttcacaccggcgcctctcacgcggcacgaaatcattatgaagtgctagtcctcggaggcgggtccggtggtataacaatggccgctcggatgaaaaggaaggttggtgctgaaaacgttgccattgtggaacctagtgagaggcatttctaccagccaatatggacacttgttggcgccggagccaagcagctgagctcttcagggcgacctacagcaagtgtgataccaagtggcgttgagtggattaaggctcgtgtgaccgaactcaatcccgacaaaaattgtattcacaccgacgacgacgagaaaatcagctaccgctacttgatcatagcccttgggatccaactggactacgaaaagatcaaaggattgcccgagggcttcgcgcatcccaagataggcagcaattatagcgtcaaaaccgttgaaaaaacctggaaggccctgcaggatttcaaagaggggaacgccatttttacttttcccaatacccctgtgaaatgtgccggcgctccccaaaaaataatgtatctgagtgaggcttactttaggaaaacagggaaacgtagtaaagctaatatcatcttcaacacctccctgggcgcaatatttggagtgaagaaatatgccgatgctctgcaggagattatccaggaacggaatttaactgtcaactataaaaagaacctcatcgaagtgagggctgataagcaggaggctgtgttcgaaaaccttgataaacccggtgagactcaggtaatttcttacgaaatgctgcatgttaccccccctatgtccccacccgacgtcctcaaaacatctcctgtcgccgatgcggctggatgggtcgacgtcgacaaggaaactctccagcatagacgctaccccaacgttttcgggatcggcgattgcactaacttgcctacaagtaagacagccgcagccgtcgcagcgcagtcgggcatcttagatcggacaatttctgtgattatgaaaaatcaaaccccgacaaaaaaatacgatggttatacttcgtgtcccttggtcactggctacaaccgggtgattttggccgagtttgactacaaggctgaacccctcgagacatttccgttcgaccagtcaaaggagcgcctgagcatgtatctgatgaaagctgatcttatgccattcctgtactggaatatgatgctacgtggatactgggggggtcccgcgttccttaggaagctgttccaccttggcatgtcttag

SEQ ID NO: 18192 - DNA, 1113 bp, Artificial Sequence
  Description of Artificial Sequence: Synthetic coding sequence
atgggattcaatcggccatctaagattcaggagaatgcacttccactcatgctggccgaaccccctcagaacctgatcgcacaaagccaatccggtactggcaaaacggcagccttcgttctagctatgttatcacaggtggaacccgctaataaatacccccagtgtctttgcctgagcccaacttacgagctcgcgctccaaaccgggaaagtcattgaacagatgggcaaattctatcccgagcttaagctcgcgtacgctgtccgaggaaataaactggaacgtggccagaaaattagcgagcagatagtaattgggactccagggaccgtgctggattggtgctctaagctcaagtttatcgaccctaagaagattaaggtattcgtcctggacgaggccgacgtcatgatcgcaacacaaggtcaccaggatcaatctatccgcattcaaaggatgttacctagaaactgtcagatgctgctgttttctgcaacttttgaggattctgtgtggaagttcgcacagaaggtggtccctgacccaaacgttattaagctgaaaagagaagaggaaactctggatactatcaaacaatactatgtgctgtgttcatcccgagacgagaaatttcaagctctctgtaatctgtatggggcaatcactatagcgcaggctatgatattttgccatactcgcaaaacggctagttggttagccgccgaattgagcaaagaaggtcatcaggtcgccctgctttcaggggaaatgatggtggagcagagagcagctgtaatagagaggtttagagaagggaaggagaaagtccttgttacgactaatgtctgcgcccgtgggattgatgtcgaacaggtgagtgtagtgattaactttgacctacctgttgataaagatgggaaccccgataatgaaacgtacctgcaccgcattgggcggaccggaagattcggtaaacgtggcttggcagtgaatatggttgactccaagcacagcatgaacattctgaatcgaatccaagaacattttaacaagaagattgagcgactggacaccgacgatttggacgagatcgaaaagattgccaattag

SEQ ID NO: 18193 - DNA, 738 bp, Artificial Sequence
  Description of Artificial Sequence: Synthetic coding sequence
atgggtggtggctatgatctgaatctgtttgctagcccgccagacagcaattttgtttgcagtgtctgtcacggcgtgctgaagagaccagcgcgccttccctgctctcatatcttctgcaagaaatgcattctgcgctggctggccaggcaaaaaacttgtccgtgttgccgaaaggaggttaaacgtaaaaaggtggtacatatgaacaagctacgcaagaccattgggagactcgaagtaaaatgcaagaacgccgacgctggctgcattgttacttgtcccctggcgcacagaaagggacatcaggactcttgcccttttgagttaactgcctgcccaaatgagggctgcacatcacaagtgccaaggggtacgctggcggaacatcgccaacattgccagcaggggtctcagcagagatgtcctctgggatgtggtgccaccctagatcccgcagagagagcccggcataattgttacagagaactccacaatgcatggagcgtcaggcaggagcgcaggaggccgctccttctgtctctccttcggagagtgcggtggcttgaccaagcgacaagcgttgtgcgacgggaactcgccgaacttagcaatttcttagaagaggacacagcccttctggaaggcgctcctcaggaggaagctgaggccgcaccagagggtaacgtcggagcagaggtggtcggcgagccccgagctaacataccgtgtaagtag

SEQ ID NO: 18194 - DNA, 309 bp, Artificial Sequence
  Description of Artificial Sequence: Synthetic coding sequence
atgcgcgcatctccatgcattagtcagcccgctgcatcttggcacccccgcccatcagccctgcgccccacggctggctctgggcccgatactcggacacccggtacagtcgaggatggcagcgcgccttgcccggccttcagatctcccgccgtctccccatgcggcgaagagccttgttgctttcagattagcccagccgaggaaactctggaactgggtagattagtctctcctgggtgccacaagtcaagtgccccgcaggagcggaggctggacccgcgggcccgttgtgttgtgcatatctag

SEQ ID NO: 18195 - DNA, 1473 bp, Artificial Sequence
  Description of Artificial Sequence: Synthetic coding sequence
atggaggactccgcatcggcttcactgagctctgcagccgcgaccggtacttctacctcgactccagcggctcctacggcacgtaagcagttagacaaggaacaggtgcgtaaggccgtggacgctctgctcacacattgcaaaagccgcaagaacaattacggactattgttgaacgagaatgagtcgttattcctgatggttgtgctctggaagataccctctaaggagctaagggtgcggctgacccttccccacagtattcgctctgactctgaagacatttgtctttttaccaaagatgagccaaacagtactccagaaaagaccgaacagttctacagaaaactcctcaacaagcatggtatcaagaccgtctcccagattatcagtctccagacgttaaaaaaagagtataagagttacgaagctaaattacgtctgctatctagctttgactttttcttgactgacgcccgcatacgccggctgctgccctctctcatcggcagacatttttatcagagaaagaaggtgcccgtttctgttaacctcttgagcaagaatctaagtcgcgaaattaacgactgcattggtggaacggtgctgaacatcagcaaaagcggatcttgtagcgccatccggattggacacgtgggtatgcaaatagagcacatcatcgagaatattgtggctgtgaccaagggcctgagcgagaagctgcccgaaaagtgggaaagtgtaaagctgttattcgtaaaaactgagaaaagtgcagccctgccaatctttagtagttttgtgtcaaactgggatgaggctactaagcgatccctgcttaacaagaagaagaaagaggcgcgaaggaaaagacgcgagaggaatttcgaaaagcagaaggaacggaagaagaaacggcaacaagcgaggaaaacggcatctgttctttctaaggacgacgtggccccagagagcggcgatacaactgtgaagaagcccgagtccaagaaggagcaaaccccggagcatggcaaaaagaaacgaggacgcggcaaagctcaagtgaaggctaccaacgagtctgaggatgagattccgcaacttgtcccaatcggtaagaagacacccgccaacgagaaggtggagatccaaaaacacgcgaccgggaaaaaaagccctgccaaatctcccaatcctagtacacctcggggaaagaagaggaaagccctgcctgccagcgagacccctaaagccgccgagagcgaaacaccaggtaagagcccggagaagaagcccaagattaaggaggaggcggtgaaggagaaatcccccagccttggcaaaaaagatgcgaggcagacccccaagaagcctgaggccaagttctttacgactccatccaagtccgtccggaaagcctctcacacgcctaagaagtggccaaagaagcccaaagtcccacagagcacctag

SEQ ID NO: 18196 - DNA, 1809 bp, Artificial Sequence
  Description of Artificial Sequence: Synthetic coding sequence
atggctgagtttcgggtgcgagtttccacgggagaagccttcggagccggaacgtgggataaagtgtctgtctcgattgtggggactcggggagaaagtcccccattaccactggacaacctgggcaaggagttcacagctggggcagaggaagactttcaggttacactaccggaggacgttggccgggtgttgctcttgcgcgttcataaggcgcctccggtgctgccactcttgggtcctctggctccagatgcatggttttgtcgctggttccagctcacaccccccagaggtgggcacctgctgttcccatgctaccagtggctggaaggagctggcactttagtcctgcaggagggaaccgcaaaggtgtcgtgggccgatcaccatcctgtcttacagcagcagagacaggaagaactccaggcccgccaagaaatgtaccagtggaaggcctacaaccccggctggccccattgcctggacgaaaagacagtcgaagatttggaacttaacattaagtactccactgccaagaatgccaatttttacctgcaggcagggagtgctttcgcagagatgaaaatcaaagggttacttgaccgaaagggtctctggcgctctctcaacgagatgaagcggatattcaattttcgcagaacccctgcggccgagcatgcattcgaacattggcaggaagatgcgttttttgcatctcagttcctgaacggactgaatcccgtgctcattcgtcggtgccactacttgcctaaaaactttccggttactgacgcaatggtggctagcgtcctaggacccggtacgtccctgcaggctgagcttgagaagggctctctgttcctggtagaccatggtatcttgagcggtatacaaacaaatgtgatcaacggcaagcctcagttttccgctgccccgatgaccttactatatcagtctcccgggtgtgggcctctgctgcctttagcaatccagctgtctcagacacctggccctaatagtccgatctttctacctacagacgataaatgggactggttgcttgctaaaacctgggttcgtaacgcagagttctcattccacgaagcactgacccatttattacatagccatcttctccccgaggtgtttacgctggccacgttacgtcagctcccgcactgccatcccctgttcaagtccaccggcatcggaatcgagggcttcagcgaactgattcaacgtaacatgaagcagctgaactacagtcttctgtgtttgcctgaagacatcaggacaaggggcgtcgaggatataccagggtactattatcgagatgatggtatgcagatctgggggatcccttccagcctcgaaactagggaagcgcttgtacagtatgtgacaatggtaattttcacatgttcagcaaaacacgcagccgtctctgctggccaatttgattcctgtgcctggatgcctaacctacccccctcgatgcaattgcctccaccaacatccaagggtttggcaacatgcgagggttttatcgcaaccctgccccccgtgaatgccacatgtgacgtgattctggcattgtggctccttagcaaagaaccaggcgaccagcgccctctgggcacttaccctgatgagcactttacggaggaggcaccaaggaggagcatcgcgactttccagtcgcggctggctcagatttcacgcggtattcaggagaggaatcaaggcctcgtcttgccatacacctacctggacccgcccttaatcgaaaactctgtctccatatag

SEQ ID NO: 18197 - DNA, 618 bp, Artificial Sequence
  Description of Artificial Sequence: Synthetic coding sequence
atgagcgtagaccccatgacctacgaagctcagtttttcggcttcacgccccagacgtgcatgttacgaatttatattgcttttcaggactatttgttcgaggttatgcaagccgtcgagcaggtaatccttaagaaactagatggcatacctgattgcgatatctcccccgtccagattaggaaatgtacagagaaattcctgtgttttatgaagggccacttcgacaatctgtttagtaagatggagcagctttttttgcaattaatcctccggattcccagcaacattttgcttccagaggataaatgcaaggaaaccccctactctgaggaggattttcagcatctgcaaaaggagatcgagcaactgcaggagaagtataaaaccgagctttgcactaagcaagcgctgctagccgagttggaggagcaaaagatcgttcaggccaaactgaaacagactctgactttttttgatgagctccacaacgtgggaagagaccacggcaccagtgatttccgggagagtcttgtcagcctggtgcagaactccagaaagctgcaaaacataagagacaatgttgaaaaagagagcaaaagacttaagatatcttag

SEQ ID NO: 18198 - DNA, 360 bp, Artificial Sequence
  Description of Artificial Sequence: Synthetic coding sequence
atgatcctgcagcagccactgcagcgcggtcctcagggaggggcacagcggcttcccagggctgccctgggcgtgacatggggactcgatgcgagggagcctctgaggaagcagttcctgagtgaagagaatatggccacacattttagtcaactgagtctccacaatgatcacccttattgttcgccccccatgacattcagccccgcgctcccaccgctgcgctccccatgcagcgagctgctgctgtggaggtaccccggatccctgattcctgaggctcttcgcttgctccgattaggagacacgcctagccctccttacccggccacaccagccggtgatattatggaactttag

SEQ ID NO: 18199 - DNA, 1473 bp, Artificial Sequence
  Description of Artificial Sequence: Synthetic coding sequence
atgcccatgccaacagagggcacaccaccgcccctgtccggcactcctatccccgttcccgcatactttaggcatgccgaacctggatttagcctgaagcgccctaggggtttgtcccgctccctaccacccccgccccctgcaaaggggtcaattccaatcagtagactcttcccgccgagaacgccaggatggcatcaattgcaacccaggcgtgtaagcttcagaggagaggccagtgagaccctgcagtcccctggttacgacccgtccaggccagagtctttcttccagcagagcttccagcgcctgagccgtttaggccacggttcctatggggaggtcttcaaggtgcgatctaaggaggatggcagactttatgcggtgaaaaggagcatgagtccattccgcggtccaaaggatagagcccgcaagctcgccgaagtcggcagtcacgagaaagtaggtcagcatccctgctgtgtaaggctcgaacaggcctgggaagaggggggcattttatatctgcagaccgaactgtgtggccctagccttcagcagcattgtgaagcctggggcgcctcacttcccgaagcacaggtttgggggtacctgcgcgacactcttttagcactagcgcatttgcattctcagggcctcgtgcatctcgacgtgaagccagctaatatcttcttgggccccagggggcgttgcaagctcggagacttcggtctgctggttgagcttgggacggcaggtgcgggggaggtacaggaaggtgaccctaggtacatggcaccagaattgttgcagggatcatatggcactgccgccgatgtgttttcactaggcctaactattctcgaggtggcctgcaacatggaactgccccacgggggggagggatggcaacagctccgccaggggtacctacctcccgaattcaccgctggacttagctccgaactcaggtctgtcctggttatgatgttggagccggatccaaagctccgcgcaactgcagaagccttactcgctctacctgtcctgcgacagccgcgcgcgtggggagttctgtggtgcatggcggccgaagctcttagccgcgggtgggcgctgtggcaagcactcctggcacttctgtgctggctttggcacggcttggcccaccccgcatcctggctgcaaccattgggtccacctgccaccccaccgggctctccaccttgttctttactactcgatagttccctctcgagtaactgggacgacgactcactaggtccttccttgtcaccagaggccgtgctggccaggactgtgggatccacatctacacccaggagcaggtgtaccccaagagacgctctcgacctgtccgacatcaatagcgaacccccaaggggctcttttccaagcttcgagcctcggaacctcttatcgctcttcgaagacaccctggaccccacgtag

SEQ ID NO: 18200 - DNA, 1293 bp, Artificial Sequence
  Description of Artificial Sequence: Synthetic coding sequence
atgctggagcgatggcatcagctgcagcctcggcgggtgagttttcgaggagaagcgtctgagaccctccagagccctggatatgatccgtcccggccagagtccttctttcagcaatccttccaacggctgagtagactcgggcatggatcatacggggaggttttcaaggtcaggtctaaggaggacgggcgcttgtacgcagttaagcgctctatgagccctttcagaggaccaaaagatcgtgctaggaagcttgctgaggttggctcccacgagaaagtgggccagcatccgtgctgtgtgaggcttgagcaagcttgggaggagggtgggatcctgtatcttcagaccgagctgtgcgggccaagcctgcagcagcactgtgaggcgtggggtgccagcctgccagaagcccaggtatggggatacttgcgcgacacgctgctcgcgctagcccacctgcacagccagggtctggtgcatctggacgtaaagccagcgaacatatttctggggccacggggtcgatgcaagctgggcgacttcggattgcttgtggagctagggactgctggcgctggagaagttcaggaaggagaccctcgctacatggcgcctgagctgcttcagggttcctacggcacagcggccgatgtcttctccctgggacttactattttggaagtggcttgcaacatggagctgccgcatggaggcgaagggtggcagcaactccgacagggctacctccctcccgagttcacggccggattgtcttcagaactgcgatcagtgctcgtgatgatgcttgagccggaccctaagctcagagcgacagccgaggcgctgctagcgctcccagttcttaggcagccacgagcctggggtgtgctttggtgcatggctgcagaagcacttagtcgaggctgggcactctggcaagccctgcttgcgcttctgtgttggttatggcatggcttagcacaccctgcttcctggctgcaaccactgggaccaccagccactcctcccggatcacctccctgtagcctgttattagattccagcctttcctcaaattgggatgatgatagtctcgggcccagcctgtcccccgaggctgtgttagcgaggaccgtcgggtctacatcaacaccgcggtcacgctgcacacccagggacgccttggatttgtccgacatcaactcagaacctcctcgagggtcgttcccatctttcgaacctcgaaaccttttgagtctcttcgaggatactctggaccccacctag

SEQ ID NO: 18201 - DNA, 666 bp, Artificial Sequence
  Description of Artificial Sequence: Synthetic coding sequence
atgcaggtccaggatgatggtgtgaatctgatcccattcgctaagtgttctagagtggtaagtcggtccccgccacccagactcccctcccaaagtctgcgacccatgcctcagagatacggggacgtgttctggaaaaacttaaaccagcggcccacacctacttggctggaggagcagcatattccccctatgctcttgcctccccccgagatgctctggagaaggaagaagaggcgtccatgccttgaaggcatgcagcaacaagggctcggcggcgtgccagcaagagtgcgagcagtgacctaccatttagaagatcttagaaggcgccagagcattatcaatgaactcaagaaagctcaatggggatcgagtggtgcggcttctgaacctgtagtgctcggtgaagaggggtgcggctttcctagcaccaatgagtatcccgatctggaagaagagcgcgccacctaccctcaagaggaagaccggtttctaaccccagggcgcgcccagctattgtggagcccctggtctcccctagaccaggaagaggcctgcgccagccgccagctacactcactcgcctctttttccactgtgacagcccgacggaaccctttacacaatccttgggggatggagctggccgcctccgaggagtag

SEQ ID NO: 18202 - DNA, 2232 bp, Artificial Sequence
  Description of Artificial Sequence: Synthetic coding sequence
atggaagctgctgcggttactgtgacgcggtctgccactcgcagacggcggcgccagctgcagggcttagctgccccagaagctggaacacaagaggaacaggaggatcaagagccgcgtccgcgccggcgccgaccagggcgaagtattaaggatgaagaagaggaaacagtcttcagagaggtggtctctttttcaccggatccactgcccgtgcgatattacgacaaggacaccactaagcctatatctttttatctctcctccttagaggaactgctcgcttggaagccacggcttgaggacggctttaatgtggccctcgagcccctggcctgcaggcagcctccattatctagtcagcgacctcgcactcttctgtgccatgatatgatgggtgggtaccttgacgataggtttatacagggcagtgtcgtgcagacgccctacgctttctatcattggcagtgtatagatgtgtttgtgtacttcagtcaccatactgtaaccatcccacctgtgggatggaccaataccgcccacagacatggagtgtgcgtcctgggaaccttcatcacggaatggaacgagggcgggagactatgtgaggccttcctcgcaggcgacgagagatcttaccaggcggtggctgataggctcgtgcagatcactcaattcttccgatttgatggttggttaattaacatcgaaaattcactgtccctggctgcagttggcaatatgccccccttcctgcgctacctgaccactcagctacatcgtcaggtccccgggggactcgtgctctggtatgattccgtggtgcagtcgggtcaacttaagtggcaggacgagctgaaccagcacaaccgtgtgttcttcgactcttgcgatggatttttcacgaactacaactggcgcgaggaacatcttgagcgcatgctgggccaggccggagaacggcgggctgacgtgtacgtcggcgtggatgtgtttgccagaggcaatgtggtgggggggaggttcgataccgataagtcactggagttgattagaaaacatggttttagcgttgccctgttcgctcccggatgggtgtacgaatgcctcgagaaaaaagattttttccagaaccaggataaattctggggcaggctcgaacgttacttgcccacgcactccatttgctccctgccattcgtgactagcttttgtctgggaatgggggctagaagagtatgctatggtcaggaggaagccgtcgggccctggtatcatctgagcgcccaagaaattcagccattgtttggtgaacaccgcctgggcggtgacggccgcggctgggtccgtacccactgctgcttggaagacgcctggcacggaggctctagcctcctggtgcgcggcgtgattccacctgaagtaggcaatgtggcagttagattgttcagcctccaagccccagtccctcctaagatttacctgtcaatggtgtacaagctggaaggacctacagacgtcaccgtggcactggagttaacaactggggatgccggaagctgccatatagggggtatttccgtcctgaacgctgaaacttcaagtcgccacagcctgcgacctctgcgtgtgcctcccacaaaactggccaggtgggtgggccggtgcgggcgccagctaagtgggggttgggtccagcattgttatgaggtttcgcttagaggctgtctgcttttggatctgctggtgtgcttcagcagacctcccggctctagagaggaggagtcattcacatgtcggcttggcgagatccaagtcgtcgacgctgcaagtctcctcgctcctctgcctcaggtccaggctgttaccatatctcacattcggtggcagccctctgccagtgaaagggaagggcctcccgctctgctgcagctgagctgcaccctacattggtccttccttctgagccaggtgagatgttttcgaatccactgttggggtggaatgtcagacgattcacctggtcgcgaactcccacggccagagatgcctatgtttctggggctggcctttgcgacacagtacagaatcgttgacctgctcgtggaagccgctgggccgggccaggaccggagaatggagtttttggtcgagcctgtcccgaaggaaggcttcagggtaccacaggctgagtgggggcgggcagttcttttgtactctgcccccgcttag

SEQ ID NO: 18203 - DNA, 579 bp, Artificial Sequence
  Description of Artificial Sequence: Synthetic coding sequence
atgtcaaccgccgctgtgccagagctgaaacaaattagcagagtggaggctatgaggctggggccaggctggtcacactcatgccacgccatgttatacgcagcaaatcccggacagctgtttgggagaattccaatgagattctctgtgcttatgcaaatgcgcttcgacgggctgctggggttccctggaggtttcgtggataggcgattctggtctcttgaggacggactaaaccgtgttcttgggctggggctcggctgcctgagactgactgaagcggattatctaagctcccacctgacagaaggcccccatcgggtcgtggcccacctgtatgcccgtcagctgactcttgagcaactccacgccgtagagatctccgctgtacactcccgggatcacggcctcgaggtggggcccccacccggcccccggccgcctccaagagggctggcgttggccccatggaaagcgcccatgggtgccggcccccgggccggcccagccgtccatcctgaggggccctctagaagattaccgcagcttccagagcagcgactacgggagcatgggtag

SEQ ID NO: 18204 - DNA, 2553 bp, Artificial Sequence
  Description of Artificial Sequence: Synthetic coding sequence
atgctcgagcgtcgggcacttttatggcaaagggaggcaggcccgggctggggtgaccgggccagggccggcactggaggtgctgggggcggatgtggcggggcaatggctgaaagaggtcccgccttttgtggtctctatgacacttctagccttctgagatactgtaacgacgataacttatccggtactagtggcatggaagtggacgatagggtgtcagcgctcgagcagcgtctgcaactgcaggaggacgagttggccgtgctgaaagcagcactggctgatgccctacgacggctgcgagcgtgtgaggaacagggcgcagcccttcgcgccagaggcactcccaaaggcagagcaccccccaggttgggaactacggcttccgtgtgccaacttcttaaaggtcttccaacccgcactcccctcaatggcagtggaccacccaggcgagtcggcggctacgctacatcgccatcttcacctaaaaaggaggctacttctggcagatcttcggtgcgccggtacctttctcctgagagactcgcatccgtgagacgcgaagacccccgctcccggacaacctcttcttcctctaattgttccgctaaaaaagaagggaagaccaaagaggttattttctcagttgaagatggctcagtgaaaatgttcctgagaggacgacctgtccctatgatgatccctgatgagctggccccaacatacagtcttgatacgaggtctgaactgcccagctgtagattgaaactggagtgggtttacggatatcggggccgcgactgtcgggccaacctctatttgctgcccaccggtgaaatagtgtacttcgtagcctcagtagcagtgttatacagcgtcgaagaacagcgacagcgacactatttaggacacaacgatgacatcaaatgcctggccatccacccagatatggttacaattgccacaggacaggtggctggcactaccaaggaagggaaaccattgccgccacacgtgcggatatgggatagcgtcagcctttctacactccatgtgctcggactgggcgtatttgaccgagcagtgtgttgtgtgggcttttcaaaatctaatggcgggaatctcctgtgcgccgtcgacgagtccaacgaccacatgttaagcgtctgggactgggcaaaagaaacaaaggtggtggacgtcaagtgcagcaacgaggctgtcttggttgcgacctttcatcccacagatccaaccgtgctgatcacttgcggcaagagccacatttacttttggacactggagggcggatctctgagcaaacgtcagggtctcttcgaaaaacatgagaagcccaagtacgtgttatgcgtgacttttctggaaggaggcgatgtggtcactggagactccggaggcaatctgtatgtgtgggggaaaggcggaaacagaatcactcaggccgttttaggcgcccatgacggcggagtgttcgggttgtgcgccctccgcgatggaacattggtcagcgggggggggagggatcggagggtggtgctgtggggctcagattactcaaagctccaagaggtggaggttcctgaagatttcggtcccgttcgtaccgtcgctgagggccacggagataccctatacgtcgggacgactaggaactcaatcctacaaggctctgtgcacaccgggttctccttgttggtgcagggacacgttgaagagctgtgggggctcgctacgcacccttctagggctcagttcgtaacatgtggtcaggacaaacttgttcatttgtggagctccgacagccaccaaccactgtggagcagaataatcgaggatcccgcccgctcagctggcttccatccatccgggtccgtcctggccgtcgggacagtcacaggccgctggctcctgcttgataccgagacacacgacctcgtggccatacatactgatggcaatgaacagatcagcgtggtgtcttttagccccgacggcgcatatctggcagtggggtcccacgacaatttggtatatgtgtacacagtagaccaggggggaaggaaggttagcaggctgggaaaatgcagcggacacagtagtttcataacacatctggactgggctcaggactcctcatgtttcgtaacaaactccggagattatgagatcctgtactgggaccctgctacatgcaaacaaattacaagtgccgacgctgtgcggaacatggagtgggccacagctacttgcgtgctcgggtttggagtgtttgggatttggtccgagggggcggatgggacagacattaatgctgtggctcgatcccatgacggtaagctgctggccagtgctgatgacttcgggaaggtgcacctgtttagctacccgtgttgccaaccgagggccttatcccacaagtatggcgggcacagttcccacgttacgaatgtggcatttttgtgggatgattccatggctctgactacgggaggcaaagatacttctgtgcttcagtggcgagtggtatag

SEQ ID NO: 18205 - DNA, 2502 bp, Artificial Sequence
  Description of Artificial Sequence: Synthetic coding sequence
atggccgtggaggattctactctacaggtggtggtgagagttcgtcctcccacgccacgagaacttgactcccagagaagacctgtcgtccaagtcgttgatgagcgagtcctggtgttcaaccccgaagaacccgacggtgggttccccggactgaagtggggagggacccatgatgggcctaagaaaaagggaaaggatttgaccttcgtatttgatcgcgtgtttggggaagctgccacacagcaggatgtttttcaacacacgacccactccgttctagatagttttttgcagggatataattgtagcgttttcgcctacggtgctaccggggctggtaagacgcacaccatgctcggtagggagggggaccccggaataatgtatctgactaccgtggaactatataggaggctggaggctcgccagcaagagaagcactttgaggtccttatttcttatcaggaggtatacaacgaacaaatccacgacctcctggagccaaaaggtccattagccatccgagaagacccagataaaggcgttgtggtgcaagggctgtcgtttcatcaacccgctagtgccgagcaactcctggaaatactgacccgcgggaatcgaaacagaacccagcatccaaccgatgctaacgcaactagttccaggagtcacgctatctttcagatcttcgttaaacaacaggaccgcgtgccgggtctcacacaggccgtgcaggtggcaaaaatgagcctcattgacttagccggatcagagcgagcatcatctactcatgccaaaggcgagcgcctgcgggaaggagcgaacatcaatcgatcccttcttgcactcattaatgtgctgaatgcactagccgacgcaaaaggtcgcaagacccatgtgccatacagggattccaagcttacccggctactaaaggactcccttggtggaaattgcaggactgtaatgattgccgcgatttccccctcatctttaacatatgaagacacctacaacaccctgaagtatgctgaccgggccaaagagattcgactgtcacttaagtctaacgtgactagtctggattgccacatcagccagtacgctaccatctgccagcagttgcaagctgaagtcgccgctttgaggaagaaactccaggtatacgaaggcggaggccagcctccaccacaagatctgcctggcagcccaaaaagcggccctcctcccgaacatctgccttcctcacccctgccccctcacccaccttctcagccttgtaccccagaactgcccgccggacctcgcgcgctgcaggaagaaagcctgggtatggaagcccaggtggaacgagccatggagggcaacagtagcgatcaagagcagagcccagaggacgaagacgagggacccgcggaggaggtgccaacccagatgcctgagcagaaccctacccacgcccttccggaatcaccgcggttaactttacagccaaagcccgtggtcgggcatttctccgcccgggaactagacggcgatcgctccaagcagctggcactgaaagtcctgtgcgtcgcacaacgtcagtacagtctccttcaagccgcgaacttgctgacccccgacatgattactgagtttgaaacgctccagcagcttgtgcaggaggaaaaaattgaacccggcgctgaggcactgcgcacaagtggtttggcccgtggtgctcctctagcccaggagctgtgctcggagtctatcccagttccgagccctctctgtcccgagcctcccggttatacgggacctgtgactagaacaatggccagacggctgtctgggcccctccacaccctcgggatccccccaggccccaattgtacccctgcccaaggatcccgatggcccatggaaaagaaaagacggcgtccctctgctctcgaggcagatagccctatggcgcctaaacggggcaccaagcggcagcgacagagtttcttgccttgcctgcggcggggttccttgcctgatacgcaacctagtcagggcccctccactccaaaaggcgaacgcgcaagctctccatgtcacagcccccgggtctgcccagcaacagtgataaagtctcgagtccctcttggtccatccgccatgcaaaattgttccaccccactcgccctgcctacgcgggacttaaatgctactttcgatctgtcagaagagccccccagcaagccaagctttcacgaatgcattggctgggataagattcctcaggagctgtcccggctggaccagcccttcataccacgcgcgccagtgcccctctttaccatgaagggacctaagcctactagctctctcccaggtacaagtgcctgcaaaaaaaaaagggtagcatccagcagcgtatcacacgggcggagccgaatcgcccgactgccaagctctaccttaaagcggcctgctggcccgctagttttgccgggcgattggcattag

SEQ ID NO: 18206 - DNA, 3351 bp, Artificial Sequence
  Description of Artificial Sequence: Synthetic coding sequence
atgtatggcagtgccaggagcgtcgggaaggttgagcccagcagccagtccccggggcgcagccctaggctcccaagatccccacggctgggacataggagaacaaactctaccggcggaagctctggtagctccgtgggcggcggctccgggaaaaccttgagcatggagaatatccagtccctgaacgccgcctacgcgacttccggtcccatgtatctcagcgaccacgagaatgtgggaagcgaaacgccgaagtctactatgacccttggaagatctggtggcaggcttccttacggggtgcggatgaccgctatgggcagcagccccaacatcgcttcttcaggggtggccagcgatacaatcgctttcggcgagcaccatctcccccccgtttccatggcttcgaccgtgccccattccttgaggcaagcacgcgataatacaatcatggatctgcaaacacagttgaaggaggtgctcagagaaaatgacctattgcggaaggacgtagaggtgaaggagtcaaagctctctagctccatgaattccataaagacgttctggtcacctgaacttaaaaaagaacgggctctgcgaaaggacgaggcttctaagataactatttggaaagagcagtaccgtgttgtgcaggaggagaatcagcacatgcaaatgacgatccaagctttgcaggatgagctgcgcattcagcgcgatctcaatcagctcttccagcaggacagctctagccgcacaggggaaccttgtgttgcagagctgacggaagaaaacttccagcgcctccacgcagaacacgaaagacaggcaaaagagctcttcctcttgcgtaaaaccctcgaggagatggagttgcggatcgagactcagaagcagaccttaaacgcccgcgacgaatcaattaaaaagctgctggaaatgcttcagtctaaaggactcagcgctaaggccactgaagaggatcatgaacgcacacgaagactggccgaagctgaaatgcacgtacatcatctagaatcattgctcgaacagaaggagaaagaaaactccatgctgagagaggagatgcatcgccgattcgaaaacgctccggactctgccaaaaccaaggcgctccagaccgtcatcgaaatgaaagattccaagatatcgtccatggaaaggggtctgcgcgatctggaggaggagatccaaatgctgaaaagtaacggggctctgtcaacagaggaacgcgaagaagagatgaagcagatggaagtttaccgctcacattctaaattcatgaaaaacaaagttgaacagctgaaggaagagttatcttcaaaggaagcacaatgggaggaactgaaaaagaaagcagctggtctgcaggctgagatcgggcaggttaaacaagagctcagtaggaaagacacagagcttttagccctccagactaagctagagactctgaccaatcagtttagtgactcaaaacagcatatcgaggtgctcaaagagtccctgacagccaaggagcagcgcgctgccatcctccagacggaggtggatgcactgaggctaagactcgaagagaaagaaactatgctgaacaagaagactaaacagatacaggatatggctgaggaaaaggggacgcaggcaggtgaaattcatgacctgaaagatatgttagacgttaaggagcgcaaggtgaacgttctgcagaaaaagattgaaaatctgcaggagcagttacgcgataaagaaaaacaaatgtcatcactcaaagagagggtaaaatctctgcaggcagataccacaaacacagataccgccctgacaaccttagaggaagcactggctgaaaaggagcgaaccattgaacggcttaaggaacaaagagaccgcgatgaacgggaaaaacaggaggaaattgacaattacaaaaaagacttgaaagatctgaaagagaaagtgtcactgctgcagggggatctctccgagaaggaggcaagcctgttagatttgaaagaacacgcaagctcgctagcgtcaagcggcctgaaaaaggactcgagattaaaaactctggagattgccctcgaacagaagaaggaggaatgcctgaaaatggagtctcaattgaagaaagcccacgaggcagccctcgaagcacgcgctagcccagagatgtcagatcgaattcagcatctcgaaagagagattacgaggtataaggacgagtccagtaaggcccaggcagaagttgataggctgctagagatcctgaaagaggtggagaatgagaaaaatgataaagataaaaagattgcagagctggagcgccaggtgaaagatcaaaacaagaaggtggcaaatttgaaacacaaggaacaagttgaaaaaaagaagtccgcccagatgcttgaggaggcaagacgcagggaggacaatctgaacgatagcagccaacaactgcaagacagcttaagaaagaaagatgatcgcatagaggagctggaggaagctctgagagaatcagtgcagataaccgccgagagagagatggtgctggcccaggaggagtctgcaaggacgaacgccgaaaagcaggtggaggagttactcatggccatggagaaagttaagcaagaattggagtctatgaaagctaagctctcttctacacaacaaagtctcgccgagaaagagactcatcttactaatctgagagcagagcggagaaaacatttggaagaggttttggaaatgaaacaggaagcattgctcgcggcaatatccgaaaaggacgccaacattgccctcttagagttatccagttctaagaaaaagacccaggaggaggttgccgcccttaagagggaaaaggacagactggtccagcagcttaagcagcaaacgcagaataggatgaagctgatggccgataattacgaagacgaccactttaagagctcccatagcaaccagaccaaccataagccgtcccccgatcaaataatccagcctctcctggagctggatcagaaccggtcaaaattaaaattatatatcgggcacctgaccacactgtgccatgatcgagaccctctgatactgcgtgggctcaccccacccgcatcatataatctggatgacgatcaggcagcctgggaaaatgagctccaaaagatgactcgcgggcagttgcaagacgagctcgaaaagggtgaaagagacaacgctgaattacaggaatttgcaaatgccatactccagcagatcgccgatcattgcccagatattctcgagcaggtggtaaatgcactcgaggagagctcttag

SEQ ID NO: 18207 - DNA, 2055 bp, Artificial Sequence
  Description of Artificial Sequence: Synthetic coding sequence
atgatccccccacaggaggcctctgctcgcaggcgggaaatcgaggacaagcttaagcaagaggaggaaacgttgtcttttatccgggactcccttgagaagtcagatcaactgaccaagaatatggtaagtattctatccagcttcgagtcgcgtctgatgaaactggagaactcgatcattcccgttcacaagcagacagaaaacctgcagaggctccaagagaatgtggaaaaaaccctgagttgtcttgatcacgtcatttcttactatcacgtcgcttccgacactgagaagattatcagagagggccctacaggaaggcttgaagagtatctggggagcatggccaagatacagaaagctgtggaatactttcaggacaacagtcccgatagccccgagctgaataaggtgaagctgctctttgagagagggaaagaagccttggagtccgaatttcgatcattgatgacccggcattccaaggtagtcagtcccgtgttaattttggacttgatcagcggtgatgatgatctcgaggcccaggaggatgtcacactggagcacctccccgagtctgtactccaagacgttatccgaatttcccgttggttagtggaatatggccgcaatcaggatttcatgaacgtatattaccagatccggtcctcacagttggaccggtccatcaaggggctgaaagaacacttccacaagagcagctcttcctctggggttccttacagccccgccatccccaacaagcgcaaagacacaccaactaagaagccagtgaaacgtcccggtacgatcagaaaagcacagaaccttctgaagcagtactcccagcatggcttagatggaaagaaggggggctcaaacctgatccctttagaggggagggatgatatgttggatgtcgagaccgacgcctacatccactgtgtctccgcctttgtcaagttggcgcagtcagaataccagctgctggcagatattatcccagaacatcatcaaaaaaaaaccttcgatagcctgatccaagatgctctggatggcctgatgttagaaggcgaaaatatcgtctctgccgctcggaaagccatcgtgaggcatgatttctcaacagtgctaactgtgttccccatcctgaggcatcttaagcagactaagccggagttcgatcaggtgttacaagggaccgctgcgagcaccaaaaacaaactgcccggactgatcacgtctatggagaccattggagcaaaggctttagaagattttgctgataatattaagaatgatcctgataaggagtacaatatgccaaaggatggaacggtgcacgaactcacaagcaacgctatcctttttctgcagcagctcttggactttcaggaaacggcgggagccatgcttgcgtcccaggagacctcttccagtgctacttcctactcctccgagttttccaaacggcttcttagcacgtatatttgcaaagtccttggcaacttacagttgaatctcttgagtaagagcaaggtctacgaggacccggccttatcagccatttttttgcataacaattataactacatcctcaaaagcctcgaaaagagcgaattgatccagcttgtcgccgtgacccaaaaaacagccgagcggagttatcgggagcatatagagcagcaaatacagacctaccagagatcatggctcaaagtgaccgattacatcgcggagaaaaacctgcccgttttccaacctggtgtaaagctgcgcgacaaggagagacagattataaaagagaggtttaaaggttttaacgacggactggaggaactgtgtaaaattcaaaaagcttgggccatccctgacacggagcagcgtgatcgcatcaggcaggcccaaaagacgatagtgaaagagacttatggcgcctttctgcaaaagtttggcagcgtgccattcaccaagaacccggagaagtacattaagtacggggttgaacaggtaggagatatgatcgaccggctgtttgacacttccgcctag

SEQ ID NO: 18208 - DNA, 378 bp, Artificial Sequence
  Description of Artificial Sequence: Synthetic coding sequence
atggcagacgaggagctggaggccctcaggagacaaagactagctgagctgcaggccaaacacggcgatcccggtgacgccgctcaacaggaggccaaacatagagaggctgagatgcgcaacagcatcctcgctcaagtgctcgatcaatctgcacgcgctcgtctgagcaacttggctctcgttaagccagagaagacaaaggcagtggagaactatctgattcagatggcacgctatggccaattatctgagaaagtctcagaacaggggttaatcgaaatcctcaaaaaagtgtctcaacagacagagaagactacgaccgttaagtttaaccgtcgtaaggttatggatagtgacgaggacgacgactactag

SEQ ID NO: 18209 - DNA, 3327 bp, Artificial Sequence
  Description of Artificial Sequence: Synthetic coding sequence
atggctctaagacctggggccggaagcgggggcggcggcgcagcgggtgcgggcgccggatctgcaggaggcgggggtttcatgttcccagtggctggaggaattcggcccccacaggccggtttgatgccaatgcagcagcagggattccctatggtctccgtcatgcaaccaaatatgcagggaataatgggcatgaattactctagtcaaatgtctcagggccctattgcgatgcaggccgggatcccaatggggccgatgccagcggcgggcatgccttatttggggcaggcgccttttctgggcatgcgacctcctggcccacagtacacaccggacatgcaaaaacagtttgcagaggaacagcagaaaaggtttgagcagcagcagaaacttctggaagaggagaggaagagaaggcagttcgaggagcagaaacaaaagctgaggctgctttcctccgtgaaaccaaagactggggagaaaagccgggacgacgccctcgaggctatcaaaggcaacctagacgggttttctcgggatgcgaagatgcaccctaccccagccagtcaccctaagaaacccggagtgggcgtgttcccctcccaggatccggcccagccacggatgccgccttggatctacaacgaatctctcgtgcccgacgcgtacaagaagattcttgaaacaactatgacaccgaccgggatcgataccgccaaactgtaccccattctcatgagttccggactcccccgggagacgttaggacagatttgggccctggccaataggaccacacccggaaagcttactaaggaagagttgtacaccgtattggctatgattgcagtcacccaggtcgtaaagcccgaagaagatgattttcaagactttcaggacgcctcgaagagtgggagcctggatgattcattttcagactttcaggaactgcccgcctctagtaaaacatctaacagccagcatggcaattccgcacctagtctgctcatgcccctgcctgggaccaaagccctacctagcatggacaagtatgccgtcttcaaaggtatcgccgctgataaaagttctgagaacactgtgccacccggagaccccggagataaatattcggccttccgcgaactggagcagaccgcagaaaataagccactcggtgagtctttcgccgagttccgaagcgccgggaccgacgacggatttaccgacttcaagactgctgattccgttagcccactagagcctcctactaaagacaagacattccccccaagcttccctagtggaacaatacagcagaaacaacagacgcaggttaaaaatcccttaaacctggctgacttggatatgttttcttcggtgaactgctcgagcgaaaagcctctttccttttcagcagtgttctcaacttctaaatctgttagcacaccacagtccaccggatctgcagccaccatgactgccctggctgctacaaagacgagtagcctggccgacgactttggtgaattctccttatttggggagtactcaggcttagctcccgtgggagaacaggacgactttgccgactttatggccttttcgaatagctctatctcctcagaacaaaaacccgacgataagtatgatgctctgaaggaggaggcttctcctgtgccacttaccagcaatgtcggcagtaccgtgaaaggcggccaaaacagcacagccgccagcaccaagtatgatgtatttagacagctctctctcgaaggctcaggattgggcgtagaagatttaaaagacaatacacccagtggcaaatctgatgatgactttgccgactttcacagctctaagttttcttccatcaactcagacaagtccctgggtgaaaaagcggtggcatttagacataccaaggaagatagcgccagcgtcaagtccctggatttgccctcgattggtggctcaagcgtggggaaggaggactccgaggatgccctgtccgtccaatttgacatgaagctcgctgatgtcggcggagacttgaagcacgtgatgagtgattccagtctagacttgcctactgtcagcggccagcaccccccggctgccgctgggagtgggtctccttccgcaacatctattttgcaaaaaaaggaaacttctttcgggagtagtgaaaatatcactatgaccagcttgtcaaaagtgactacattcgtgtctgaggatgcgttacccgaaactaccttccccgcactcgcgagtttcaaggatacaatacctcagacaagtgaacaaaaagaatacgagaatcgcgactataaagactttacaaaacaggacctgccaaccgccgaacgcagccaggaagccacatgcccttccccagcttcgtcgggtgctagccaggagacacctaatgaatgctccgacgacttcggggaattccagagcgagaagcctaagatcagcaaattcgatttcctggtggccacatcacaaagcaagatgaaatcttctgaggaaatgatcaaatccgagttggctacctttgacctctcagtgcagggctcgcacaaaaggtccctgtcattaggcgacaaggaaatctccagatcaagtccctcgccagcacttgaacagccgttccgcgatcgctcaaacactcttaatgagaagccagcactgcccgtgatccgagataagtataaggatctgaccggggaggttgaggaaaacgagagatatgcttatgaatggcagcgttgcttgggatcggccctcaacgtaatcaaaaaagccaacgacactctgaacggaatatcttcttcaagcgtatgtacagaggtaatccaatccgcgcagggaatggagtacttgctaggcgtggtggaagtatatagagtgaccaaaagagtcgagcttgggattaaagctactgctgtttgttctgagaagctccagcagctcctcaaagatatagacaaagtatggaacaatttgatcggctttatgtcattagctacacttacacctgacgagaatagccttgactttagtagctgcatgctgagacctggcatcaaaaatgcccaggaattggcctgcggcgtctgcctgctgaatgttgatagcaggtctcgtaaagaagagaagccagccgaggagcaccctaagaaagctttcaactccgagacagattccttcaagctggcatatggtgggcatcaatatcatgcttcttgcgcaaatttctggatcaactgcgtagaacctaagcctccgggtttagtgctaccagacttgctgtag

SEQ ID NO: 18210 - DNA, 594 bp, Artificial Sequence
  Description of Artificial Sequence: Synthetic coding sequence
atggctgcattccgggatatcgaggaggtgagtcaggggttgctgtccctcctcggtgctaatcgcgctgaagcccagcagcgccgactgctcgggaggcacgaacaggtggttgagcgcttactggaaacgcaggacggcgccgagaagcagctgcgagagatactaaccatggaaaaggaagtagcacagtcactgctcaacgcgaaagagcaggttcaccagggaggcgtggagctgcagcagctggaggccggactgcaggaggctggcgaggaggacacccggcttaaggcctccctgttacagctgacacgggagctggaagagctgaaagagattgaggcagatctggaacgacaggaaaaagaggttgacgaagataccaccgtgaccattccgtcagctgtgtacgttgcgcagctataccaccaggtgagcaagatcgagtgggattacgaatgtgaacctgggatggtgaaggggattcatcatggtcctagtgttgctcagccgatacatctagatagtacccaactgtcaaggaaatttatctcagattacttgtggtccctggtggacactgagtggtag

SEQ ID NO: 18211 - DNA, 906 bp, Artificial Sequence
  Description of Artificial Sequence: Synthetic coding sequence
atgacaagacacggaaagaattgcacggccggggcagtatatacttaccatgaaaaaaaaaaggacaccgctgcaagcggttacgggactcagaacatcagactcagtcgagacgctgtgaaagattttgactgctgttgccttagccttcagccctgtcatgacccggttgtgactcccgacggatacctgtatgagcgcgaagctattctagagtatattctgcaccagaaaaaagagatcgccaggcagatgaaggcttatgagaaacagagggggacccgccgggaggaacagaaggagctgcagcgggccgcctcacaagaccacgtacgcggctttttggaaaaggagtccgcaatcgtcagtaggccgctcaacccctttaccgctaaagccctgagtggaacatccccagacgatgtgcagcccgggccttcagtgggcccaccaagcaaggataaagataaagtcctgcctagcttttggattccctcactcacacctgaagccaaggccactaaactggaaaagccttcccgcacggtgacctgtcctatgagcgggaaacccttgagaatgagcgatctaacgccagtccactttactcctttggactcttcagtggatcgtgtgggactcatcacacggagtgaaagatacgtgtgtgccgtaactcgggactctttgagtaacgcgaccccttgcgcagtgctccgcccgtcaggagcggtggtgacactggaatgcgtggagaagttaatacggaaggatatggtggacccggtcacgggcgacaagctgacagatcgggacatcattgtgcttcagcgcgggggaacagggttcgccggcagtggcgtcaagctacaagcggaaaagtcgaggcccgtgatgcaggcgtag

SEQ ID NO: 18212 - DNA, 990 bp, Artificial Sequence
  Description of Artificial Sequence: Synthetic coding sequence
atggaggtagctgaaccctcctcccctaccgaagaggaggaagaggaagaggagcactccgcagaacctaggccaagaactaggtcaaatcctgagggcgccgaagacagagcagtgggcgcacaggctagcgtggggagccgcagtgagggggagggcgaggctgcctcagcagacgacggctcactgaatacctctggagcaggtccgaagtcctggcaggttccccccccagcaccagaagttcagatccgcactcctcgagtcaactgtccagagaaggtcatcatctgcctggatctcagtgaagaaatgagtctgccaaagttggaaagcttcaatggttcaaagacaaatgccctcaacgtcagtcagaagatgattgaaatgttcgtcaggaccaagcataagatagacaagagccatgagttcgccctggtggtggtcaacgacgacacagcttggctttccggtctcacctcagatccgagggagctgtgctcctgtttgtacgatctagaaactgcttcttgtagtacattcaacttggaggggctgttctccttaattcagcagaaaaccgaactccctgtcaccgaaaatgtccagacaattcctcccccctatgtggttcggacaattctggtctattccaggcctccctgccagcctcagttctcactgaccgaaccaatgaaaaagatgtttcagtgcccctacttcttctttgacgtggtgtatattcacaacggaaccgaggagaaggaggaggagatgtcctggaaggacatgtttgcttttatgggttctttggatactaagggaaccagttacaaatatgaggtcgccctcgctggacccgccctggagctccataactgcatggctaagcttctcgctcacccacttcaacgaccgtgccaatcccacgcgtcctattcgctcctggaggaggaggatgaggccattgaggtggaagctactgtttag

SEQ ID NO: 18213 - DNA, 1263 bp, Artificial Sequence
  Description of Artificial Sequence: Synthetic coding sequence
atgctgagcagcttcccggtggttttactggaaactatgtctcactataccgatgaaccccggtttaccatcgaacagatcgatcttcttcaacgccttagacgcaccggaatgaccaaacacgaaattctccacgcgctggaaacactggacaggcttgatcaagaacactctgataagtttggccggagaagttcgtacggaggcagcagctatgggaactctacaaacaacgtcccagcctctagcagcaccgccaccgccagcacgcagacccagcactctggcatgtccccatcgccgtcaaacagttatgatacatctcctcaaccatgcacaacaaatcaaaatggtagggagaacaacgagcggctatctacatctaacggtaaaatgagcccaacgcgctaccacgccaactccatggggcaacgctcttactccttcgaagcctctgaggaagacctggatgtggacgacaaggttgaagagctgatgaggcgagattcgagcgtcattaaagaggagatcaaagcttttctggcaaaccgccggatatcccaagccgtggtagcccaggttacaggaattagccaatcccggatttcccactggttgctacagcagggctctgacctatctgagcagaaaaagcgtgctttttatagatggtaccaactggagaagaccaacccgggcgctacactgtccatgcgcccagcgccgattccgatagaagaccccgagtggagacagaccccaccccctgtgagcgcaacctctggcacctttcgattaagacgcggaagcaggttcacctggcggaaagaatgcctcgccgtgatggagtcatactttaatgaaaaccagtaccccgacgaagccaagagagaagagattgccaacgcttgcaatgcagtgatccagaagcctggcaaaaaactatccgacttggaaagggtgacatcactgaaggtgtataattggtttgctaataggcggaaggagatcaaacgccgcgcaaacatagaagcagccatcctcgagtcacatggaattgatgtgcaatcccctggcggacactccaattccgatgacgtcgatggaaacgactactccgagcaggatgacagcacttcacattctgaccatcaggaccccatcagccttgccgtagagatggcggccgtcaatcatactatcttggcacttgctagacaaggggccaatgaaattaagaccgaggccctcgatgatgattag

SEQ ID NO: 18214 - DNA, 1263 bp, Artificial Sequence
  Description of Artificial Sequence: Synthetic coding sequence
atgctgtcatctttcccagtcgttttgctggaaacgatgtcgcattacacagacgagcctaggtttaccatcgaacagatcgatctcctgcagcggctcagaaggacaggcatgactaagcacgagatccttcacgcactagaaactctggatagactggatcaggagcattctgacaagttcgggcgacgctcttcctatgggggctcaagctacggcaactcaaccaacaatgtgcctgcgtctagttcaaccgcaaccgccagcactcagacgcagcattcgggtatgtctccctcaccatccaactcttatgatactagtccacaaccttgcactaccaatcagaatgggcgtgagaacaacgaaagactctctacctctaacggcaaaatgagccctactcggtaccatgcaaactcgatgggccagaggtcttattctttcgaagcatctgaggaagacctggatgtggatgataaggtggaagagctgatgcgccgggacagtagcgtgatcaaggaggaaatcaaagcctttctcgccaaccgaagaattagtcaggccgtggtggctcaggtgactggcatcagccagtccagaattagccactggctccttcaacagggcagcgatctatcggagcagaagaagcgagcgttctacaggtggtaccaactggagaaaacaaaccccggtgcgactctgtctatgcggccggctccaataccgatcgaggaccccgagtggcgtcagactccacctccagtgagcgccacaagcggaacatttagactccggcgcgggtcgaggtttacttggcggaaagagtgcctggcagtgatggagagctattttaatgagaaccaatacccagacgaggctaagcgagaggaaattgctaacgcctgcaatgccgttatccagaagcccggcaagaagttgtcagatcttgagcgtgtaacctctttgaaggtgtacaactggttcgcaaacaggagaaaggaaattaaaagaagggccaacatcgaagctgccatactggaatcacatgggatcgatgtgcagtccccagggggccactctaatagcgatgatgtcgacggcaatgactacagcgaacaggacgattcaacatcccattccgatcatcaggacccaataagtctggccgttgaaatggcagctgtgaaccacacaatcctcgccctggcgcgccaaggcgccaatgaaatcaaaacggaggcgctcgacgatgactag

SEQ ID NO: 18215 - DNA, 915 bp, Artificial Sequence
  Description of Artificial Sequence: Synthetic coding sequence
atgctctctagcttccccgtcgtactgttggagaccatgagccattacaccgacgagcctaggtttactatcgaacagatagatctgctccagcggttacgcagaacaggcatgaccaagcatgaaattctccatgcactggagacactcgatcgtctcgatcaggaacattctgacaagttcggtcggaggtctagctacgggggcagttcctacgggaattctactaataatgtgcccgcctcgtcaagcaccgctacagcctctacccaaactcagcacagcggcatgtcccctagcccaagtaattcttacgataccagccctcagccctgtacaaccaatcagaacggccgagagaataatgagcgactgagcacaagcaatggaaagatgtctccaacgaggtaccacgccaatagtatggggcagcggtcatactctttcgaggccagtgaggaagatctggacgtggatgataaggtggaggaactcatgcggcgcgactcctctgtcataaaggaggagatcaaggcctttttggctaacaggaggatctcccaagcagttgtcgcccaggtgacaggaatctctcagtctaggatctcccattggctgcttcagcagggctcagacctgagtgaacagaagaagcgggcattctatagatggtatcaactggaaaagacgaatccgggggcaactctttctatgaggcctgccccaatccccatcgaggatcctgagtggagacaaactccaccccccgtgtccgccacctcaggaacatttagactgaggcgcggttcccgattcacctggagaaaagagtgcttagccgtaatggagcgcaacacgtggtctccggagcgacgtatggaggaaaataaatggaagctgctaagtgcgggatag

SEQ ID NO: 18216 - DNA, 1332 bp, Artificial Sequence
  Description of Artificial Sequence: Synthetic coding sequence
atgctgagtagttttcctgttgtgttgctcgaaactatgtcacattacacggacgagcccagattcaccattgaacaaattgacctgctccagcgcctacggaggaccggcatgacgaagcacgaaatcctccacgccctggagaccctcgacaggctcgaccaagagcactcagacaaattcggccgcagatcctcctacggtgggagctcctatggtaactctaccaataacgtccctgccagcagttccactgctaccgcaagtacccagacgcagcactccggcatgtctccatctccaagtaatagttatgatacatctccgcagccgtgtaccacaaatcaaaacggtagagagaataacgaacgtctgagtaccagcaatggaaagatgtctcccacccggtaccacgccaattctatgggacagagatcctatagttttgaggcatctgaagaggacttggatgtggacgataaggtggaagagttgatgcggagggatagctcggtgatcaaggaagaaatcaaagctttcctggccaatagacgcatcagtcaggctgtcgtggcccaggtaaccggtattagtcagtcccgcatttcgcactggctgctgcagcaaggttccgacctgtcagaacaaaagaagagagctttctatagatggtatcagctagaaaagaccaatccaggggccaccctgtcaatgagacccgctccaattccaattgaggatccagaatggcgtcagacaccaccccccgtgtcagccacttcaggaacgttcaggctgaggcgcggcagtagatttacctggcgcaaggagtgcttggccgtaatggagtcctattttaacgagaatcagtacccggacgaagccaagagagaagaaatagccaatgcatgcaacgcagtgattcagaaacccggcaagaagctgtctgaccttgagcgtgtgacgagcttaaaggtttacaactggttcgccaaccgtcggaaggaaattaaacgccgggctaatattgctgcgattctagagtcccatggcattgatgttcagtccccaggcggacacagtaattccgacgatgtggacgggaatgattattcggagcaggacacatggcaagtacgcaacggggaagaggaggaaggtcgtagctcagagggggggcgggaggcagagaaggacgatagcacgtcccatagcgatcaccaagatcctattagtctggctgtcgaaatggccgctgttaatcacaccatcctagctctggcccgccagggggccaatgagataaagaccgaggccctcgatgatgattag

SEQ ID NO: 18217 - DNA, 357 bp, Artificial Sequence
  Description of Artificial Sequence: Synthetic coding sequence
atgctctcctcctttccagtggtgctgctcgaaaccatgtcgcattataccgacgaaccgaggttcacaatcgagcagatcgacctcctgcaaagattgcgtagaactggaatgaccaagcatgaaatcctgcacgctctggaaaccctggataggctcgatcaagaacactccgacaagtttggcaggaggagctcctatggcggaagttcctacgggaacagcacaaataatgtgccggcatcttcatccacagccaccgcctctacccaaactcagcattctggtatgtcccctagcccttcaaactcctatgacacatccccccagccatgtacaaccaatcagaacgggtag

SEQ ID NO: 18218 - DNA, 1332 bp, Artificial Sequence
  Description of Artificial Sequence: Synthetic coding sequence
atgctcagttcattccccgtggtgctgctggagaccatgtcgcattacacagatgagccacgcttcaccatagagcaaattgacctccttcagcgcctgcgcaggactggcatgactaagcacgaaatcctgcacgcgttagagactctggatcgcctcgaccaggagcactctgataagttcggcagacggtcctcctatggggggagtagctacggtaatagcacaaacaacgtcccggctagttcctctacagccaccgcctcaacacagacacagcactcgggaatgtccccctccccaagtaacagctacgacacctccccacagccttgcaccaccaatcagaatggccgggagaacaacgaaagactctcaacctctaatgggaagatgtcccccacacgttaccacgcgaactccatgggtcaacggtcctactctttcgaggcaagcgaggaagatctcgatgtcgatgacaaagtggaagagctgatgaggcgggactctagtgtaatcaaggaggaaattaaagcattcctggctaatcgacgaatctctcaggcagttgtcgcacaagttactgggatcagccaatcccgaatttcgcactggctgttacagcagggaagtgatctgagtgagcagaagaagagggccttctacagatggtaccaactcgagaaaacaaatcctggagctactttaagtatgcgtccagccccgattcctatagaagacccagagtggaggcaaacaccaccacccgtgtcagccactagcggaacatttaggctgcgcaggggctctagattcacatggaggaaagagtgtttggccgtgatggagtcttatttcaacgagaatcagtatcctgatgaagcgaaacgcgaggagatcgcaaacgcttgtaatgcagtgattcagaagcctggaaaaaagcttagcgacctcgagagggttacatccctaaaagtgtacaattggtttgctaaccgccgcaaagagattaaaaggagagcgaatatcgcagccatcctcgaatcccacggcatagatgtgcagagccccggtggccactcaaatagcgacgacgtggacggcaatgactactcagaacaagacacgtggcaagtgagaaacggggaggaagaggagggacgatcctcggaaggcggccgcgaggccgagaaggatgacagtaccagccactctgaccaccaggaccctattagcctggccgtagagatggctgccgtgaatcacaccatcctggccttggccaggcagggagccaacgagataaagacagaggctttggacgatgactag

SEQ ID NO: 18219 - DNA, 1218 bp, Artificial Sequence
  Description of Artificial Sequence: Synthetic coding sequence
atgctgagctcctttccagtcgtactgctcgaaactatgtcacactacaccgatgaaccacgcttcacaatcgagcaaatagatctgcttcagaggctgaggagaacgggcatgaccaaacatgagatcttgcatgccttagaaacactggacaggctcgatcaggagcactccgataaattcgggaggagaagctcctatgggggatcctcctatggtaactctaccaacaacgttcctgcctcatcttccacagcgacagcctcgacacagacccagcatagtggcatgagtccttctccatcaaacagttatgacacaagtccacagccctgtacaacaaatcagaacggtcgggaaaataacgaacgcctgtccacatccaatggaaagatgagccccaccaggtaccatgccaactcaatgggacagcgcagctattctttcgaggcgtccgaagaagatttagatgtggatgataaggtggaggaactaatgaggagagactctagtgttatcaaggaggagattaaagccttccttgcaaacagacgaattagccaggccgtggttgcacaggttaccggcatttcacaaagcagaatctctcactggctgctccagcaaggtagcgacctttccgaacagaaaaaaagggccttctatcggtggtatcagctggagaagactaaccccggggctaccttaagcatgcggccagcgcctatccccatcgaagatcctgaatggagacagacacctcccccagtgtctgcgacatcaggcactttcagactgcggcgtggctctcgattcacctggcggaaggagtgcctggcggttatggaatcatattttaacgagaatcaatatccggacgaagccaaacgtgaagaaatcgctaacgcttgcaatgcggtcattcagaagcccgggaaaaaactgagcgacctggaacgggtgacgtctctgaaagtgtacaattggttcgctaatcgtagaaaggagatcaagcggagagcgaatatcgccgccattctggaaagccacgggatcgatgttcagtcccctggaggccactctaactcagacgatgtagacggaaatgactatagcgagcaggatacctggcaggtgaggaatggtgaggaggaggagggtcgcagcagcgaaggcgggcgcgaagccgaaaaggtggaggaggaaaggaggatctag

SEQ ID NO: 18220 - DNA, 1380 bp, Artificial Sequence
  Description of Artificial Sequence: Synthetic coding sequence
atgacagctgaggagatgaaggccacagaaagtggggcccagagcgcccccctgcccatggagggcgtggacatcagccccaagcaggatgagggcgtgctgaaggtgatcaagcgggagggcaccggcacagagatgcccatgattggagacagagtgtttgtgcactacacaggctggctgctggatggcaccaagtttgacagcagcctggacaggaaggacaagttctcctttgacctgggcaaaggagaggtgatcaaggcctgggacatcgccatcgccaccatgaaggtgggggaggtgtgccacatcacctgcaagccagaatatgcctacggcagcgctggcagcccccccaagatccccccaaatgccaccctggtgtttgaggtggagctgtttgagttcaagggggaggacctgacagaggaggaggatggcggcatcatccgccgcatccagaccagaggagagggctacgccaagcccaatgaaggagccatcgtggaggtggccctggagggctactacaaggacaagctgtttgaccagcgggagctgcgctttgagatcggggagggggagaacctggacctgccctacggcctggagcgggccatccagaggatggagaagggggagcacagcatcgtgtacctgaagcccagctatgcctttggatctgtgggcaaggagaagttccagatccccccaaatgctgagctgaagtatgagctgcacctgaagagctttgagaaggccaaggagagctgggagatgaacagcgaggagaagctggagcagagcaccatcgtgaaggagcggggcaccgtgtacttcaaggagggcaagtacaagcaggccctgctgcagtacaagaagatcgtgtcctggctggagtatgagagcagcttcagcaatgaggaggcccagaaggcccaggccctgcggctggccagccacctgaacctggccatgtgccacctgaagctgcaggccttctctgctgccatcgagagctgcaacaaggccctggagctggacagcaacaatgagaagggcctcttccggcggggggaggcccacctggccgtgaatgactttgagctggcccgggctgacttccagaaggtgctgcagctgtaccccaacaacaaggccgccaagacccagctggccgtgtgccagcagaggatccggcggcagctggcccgggagaagaagctgtatgccaacatgtttgagcggctggccgaggaggagaacaaggccaaggccgaggccagcagcggggaccaccccacagacacagagatgaaggaggagcagaagagcaacacagctggcagccagagccaggtggagacagaggcctag

SEQ ID NO: 18221 - DNA, 477 bp, Artificial Sequence
  Description of Artificial Sequence: Synthetic coding sequence
atggagcccccagagggcgccggcactggagagatcgtgaaggaggccgaggtgccccaggccgccctgggcgtgcctgcccagggcaccggggacaatggccacacccctgtggaggaggaggtgggcggcatccctgtgcctgcccctggcctgctgcaggtgacagagcggcggcagcccctgagctctgtgagcagcctggaggtgcactttgacctgctggacctgacagagctgacagacatgtctgaccaggagctggccgaggtgtttgctgacagtgatgatgagaacctgaacacagagagccctgctggcctgcaccccctgccccgggccggctacctgcggagccccagctggaccaggaccagggctgagcagagccatgagaagcagcccctgggggaccctgagcggcaggccaccgtgctggacaccttcctgactgtggagcggccccaggaggactag

SEQ ID NO: 18222 - DNA, 954 bp, Artificial Sequence
  Description of Artificial Sequence: Synthetic coding sequence
atggccagcgtcatcccagccagcaacagatccatgagaagtgacaggaacacctacgtgggcaagagatttgtgcacgtgaagaacccctacctggacctgatggatgaggacatcctgtaccacctggacctgggcaccaagacccacaacctgcctgccatgtttggagatgtgaagtttgtgtgtgtgggcggcagccccaacaggatgaaggcctttgccctcttcatgcacaaggagctgggctttgaggaggccgaggaggacatcaaggacatctgtgccggcacagaccgctactgcatgtacaagacaggccctgtgctggccatcagccacggcatgggcatccccagcatcagcatcatgctgcacgagctgatcaagctgctgcaccacgcccgctgctgtgatgtgaccatcatcagaattggcaccagcggcggcattggaattgcccctggcaccgtggtgatcacagacattgctgtggacagcttcttcaagcccaggtttgagcaggtgatcctggacaacatcgtgaccaggagcacagagctggacaaggagctgtctgaggagctgttcaactgcagcaaggagatccccaacttccccaccctggtgggccacaccatgtgcacctatgacttctatgagggccagggccgcctggatggagccctgtgcagcttcagccgggagaagaagctggactacctgaagagggccttcaaggccggcgtgagaaatattgagatggagagcacagtgtttgctgccatgtgtggcctgtgtggcctgaaggctgctgtggtgtgtgtgaccctgctggaccggctggactgtgaccagatcaacctgccccatgatgtgctggtggagtaccagcagaggccccagctgctgatcagcaacttcatcagaagaaggctgggcctgtgtgactag

SEQ ID NO: 18223 - DNA, 1095 bp, Artificial Sequence
  Description of Artificial Sequence: Synthetic coding sequence
atgtctgaggtggaggccgccgccggggccacagctgtgcctgctgccaccgtgcctgccacagctgctggggtggtggccgtggtggtgcctgtgcctgctggggagccccagaagggcggcggggccggcggcggcggcggggccgccagcggccctgctgctggcaccccatctgcccctggcagcaggaccccaggcaacccagccacagctgtgtctggcaccccagcccccccagcccggagccaggccgacaagcctgtgctggccatccaggtgctgggcaccgtgaagtggttcaacgtgagaaatggctacggcttcatcaacagaaatgacaccaaggaggatgtgtttgtgcaccagacagccatcaagaggaacaaccccaggaagttcctgcggtctgtgggagatggagaaacagtggagtttgatgtggtggagggggagaagggagctgaggccaccaacgtgactggacctggaggagtgcctgtgaagggcagccgctatgcccccaacagaaggaagagccgccgcttcatccccaggcctccttctgtggcccccccacccatggtggccgagatccccagcgctggcaccggccctggcagcaaaggagagagagctgaggacagcggccagaggccccggcgctggtgccccccacccttcttctacagaagaagatttgtgcggggcccccggccccccaaccagcagcagcccatcgagggcacagacagagtggagcccaaggagacagcccccctggagggccaccagcagcagggagatgagcgggtgcccccaccccgcttccggccccgctaccgccggcccttccggccccggccccggcagcagcccaccacagaaggaggagatggagagaccaagcccagccagggccctgcagatggcagcaggcctgagccccagaggcccaggaaccggccctacttccagaggcggcggcagcaggcccctggcccccagcaggcccctggcccccggcagcctgctgcccctgagaccagcgcccctgtgaacagcggggaccccaccaccaccatcctggagtag

SEQ ID NO: 18224 - DNA, 5706 bp, Artificial Sequence
  Description of Artificial Sequence: Synthetic coding sequence
atggccaccttcaggaacaaccacatgaagaccaaggcctctgtgaggaagagcttctctgaagatgtgttccagagcgtgaagagcctgctgcagagccagaaggagctgtgcagcgtgacagctgaggactgcctgcagcaggatgaacatgccaacctgacagaggtgaccttcctgggcttcaatgaggagacagatgctgcccacatccaggacctggccgctgtgtccctggagctgcctgacatcctgaacagcctgcacttctgcagcctgaatgaaaatgagatcatctgcatgaagaacatcaacaagcccctggacatcagcagtgaccccctgaaccagagccaccccagcggcatgctgtgtgtgatgagggtgagccccaccagcccccggctgagaattgacttcatcttcagcctgctgagcaaatatgccaccggcatccgctacaccctggacaccttcctgcaccagaagcaccagctggagaccacagatgaagatgatgatgacaccaaccagagcgtgagcagcattgaagatgactttgtgacagcctttgagcacctggaggaggaggagaccagcaagccctacaatgatggcatgaacatcaccgtgctgcggagccagtgtgatgctgccagccagacagtgacaggccaccacctggagacccatgacctgaagatcctgatcagcagcggccagcagaagagcctggccaagcccagcaccagctctgtgaatgtgctgggccacaaggagctgcccagcgtgaagacctctgtgaccaccagcatcagcgagccctggacccagaggagcttctaccgcagcagcaatgccagtgacaaggacagcgacctgcagaagaccttcttcagcagcagccctgcctacagcagcgagagcgagtgcagcagccccagccctgtgatcttcctggatgaggagggctaccagaagagcctgaaggccaagctggagctgcccaagatccctgtgatgaaggatgacatcgaggacagcgacagcgaggtgtctgagttctttgacagctttgaccagtttgatgagctggagcagaccctggagacctgcctcttcaacaaggaccccgtcatcggcaagagcagccagaggaagggccacaagcacggcaagagctgcatgaacccccagaagttcaagtttgacaggcctgccctgcctgccaacgtgaggaagcccacccccaggaagccagagagcccctacggcaacctgtgtgatgccccagacagccccaggcctgtgaaggccagccgggaggacagcggcctcttcagccccatccgcagcagcgccttcagccccctgggcggctgcaccccagctgagtgcttctgccagacagacatcggcggggaccgcatccatgaaaatcatgattctgtgtactacacctatgaagattatgccaagagcatcagctgtgaggtgctgggctctgtgctgcggacccaccacaccaacaccctgagcaacatcaacagcatcaagcacggggagaacaagacagtgaccttcaagcacggcaacctggaccagaagaacaagagcaagaacaagagcctgatgatcaaggacagcatccagaagtttgctgctgacctggtggagaagagctttggcagcgccttcaaggacctgcagaagggcgtgagcagctgcaccaatgccctgtaccacctggccatcaagctgaccagctctgtgctgcagatggcctttgatgagctgcggcggcagagggccttcagcctgaaggagcgggccatcagcggcctggccaacttcctggtgtctgaggccctgagcaatgccctgaaggacctgcagtatgtgaagaagcagatcttcaccaacacagtggccaggtttgctgctgacctggccgaggagctggtgtttgagggcatcatggaggtgtgccagttctcctacccccagaccccagccagcccccagtgtggcagctttgattttgaggacaaggtggtgaagctgtatgccaaggacctgtctgagagcgtcatccaggaggccttcatcgagctgagccaggtggatgtgaccttcaccaccaaggctgctgtgtctgtgtccacagacaacatcaagtatgtgtctgctgagagcgtggtgcccagcacccaggccgtgaccttcagccccagcttccacaaccaggccatcatggtgaccaagcctgtgcaggagtacaagaaggagtacacagtgcagcaggccctcttctgcaccagcggcatcgtgaccagcatccctgtgcccctggccggcagcgccctgctgccctaccacatcagcagcacagcctgccaggccaaggcccacctgagcagtgatgacagcaacagcaatggagacagcgcccaggtgcacatcgccaccaagaaccgggaggagaaggccgcctgcctgaggaacatctgcctgcccagcgagcacaaccctggcaaccagaatgacttcaagcccaccaatgatgacatcgagatgcagagcagcagcaagctgcccaatgaccctgccatcatcagcaacttctctgctgctgtggtgcacaccatcgtgaatgagaccctggagagcatgaccagcctggaggtgaccaagatggtggatgagaggacagactacctgaccaagagcctgaaggagaagaccccacccttcagccactgtgaccaggccgtgctgcagtgcagcgaggccagcagcaacaaggacatgtttgctgaccggctgagcaagagcatcatcaagcacagcattgacaagagcaagagcgtcatccccaacatcgacaagaatgctgtgtacaaggagagcctgcctgtgtctggagaggagagccagctgaccccagagaagagccccaagttcccagacagccagaaccagctgacccactgcagcctgtctgctgccaaggactgtgtgcctgagtgcaaggtgtccatggtgcacggcagcagcctggagaccctgcccagctgcccagctgtgacaggccagaagagtgacctgaaggagagcgccaaggaccagcccctgaagaagcacaacctgaacagcaccagcctggaggccctgagctttggccaggagaaccccttcccccacagccacaccttcagcagcacagccctgacctgtgtggatggcctgcacgtggaggacaagcagaaggtgcgggacagaaatgtcatcccagacaccccacccagcacccccctggtgcccagccgggccagcagcgagtgggacatcaagaagctgaccaagaagctgaagggggagctggccaaggagtttgccccagccaccccacccagcaccccccacaacagctctgtgggcagcctgtctgaaaatgagcagaacaccatcgagaaggaggagttcatgctgaagctgatgaggagcctgtctgaggaggtggagagcagcgagagcggggagctgcctgaggtggatgtgaagtctgagcacagcggcaagaaggtgcagtttgctgaggccctggccacccacatcctgagcctggccacagagatggccgccagccacctggacaacaagatcatccaggagcccaaggtgaagaacccctgcctgaatgtgcagagccagaggtctgtgagccccaccttcctgaaccccagtgatgagaacctgaagaccctgtgcaactttgctggggacctggccgctgaggtgatcacagaagctgagaagatcgccaaggtgaggaactgcatgctgttcaagcagaagaagaacagctgctacgcagatggagatgaggactacaaggtggaggagaagctggacatcgaggccgtggtgcacccccgggaggtggaccccttcatcctgagcctgccccccagcagctgcatgagcggcctgatgtacaagtaccccagctgtgagagcgtgacagatgaatatgccggccacctgatccagatcctgaagcaggagggcggcaacagcgagctgatcatggaccagtatgccaaccggctggcctacagatctgtgaagagcggcctgcaggaggccgccaagaccaccaaggtgcagtgcaacagcaggatgtttcctgtgcccagcagccaggtgaagaccaacaaggagctgctgatgttcagcaacaaggagcaccaccaggaggccgacaagaagaggcagagcaagagaaatgaaggctacttctgcaagaaccagacctgtgagaggaccctggacccctacagaaatgaggtgtcccagctgtacagcttcagcaccagcctggtgcacagcatcaccaaggatgccaaggaggagctgacagccagcctggtgggcctgcccaagagcctgacagacagctgcctgtttgagaagagcggctatgaagaagataatgaatgccacgtgaccccagagctgcccaagagcctgcagcccagcagccagaaccaccgcttctaccacagcacaggcagcctgaatggctacggctgtggggacaacgtggtgcaggccgtggagcagtatgccaagaaggtggtggatgacaccctggagctgaccctgggcagcacagtgttccgggtgtctgagaccaccaagtctgctgacagagtgacctacgccgagaagctgagccccctgaccggccaggcctgccgctactgtgacctgaaggagctgcacaactgcaccggcaacagcagccagcacttcttccggcagggcagcctggccagcagcaagccagccagcaaccccaagttcagcagccgctaccagaagagccgcatcttccacctgtctgtgccccagatccacgtgaacctggacaagaaggctgtgctggccgagaagatcgtggccgaggccatcgagaaggccgagcgggagctgagcagcaccagcctggccgctgacagcggcatcggccaggagggcgccagctttgctgagagcctggccacagagaccatgacagctgctgtgaccaacgtgggccatgctgtgagcagcagcaaggagattgaggacttccagagcacagagagcgtgagcagccagcagatgaacctgagcattggagatgacagcacaggctcctggagcaacctgagctttgaagatgagcaccaggatgagagcagcagcttccaccacctgtctgagagcaatggaaacagcagctcctggagcagcctgggcctggagggggacctgtatgaggacaacctgtccttccccaccagtgacagtgatggcccagatgacaaggatgaggagcatgaagatgaggtggagggcctgggccaggacggcaagaccctgctgatcaccaacatcgacatggagccctgcaccgtggacccccagctgcgcatcatcctgcagtggctgattgccagcgaggccgaggtggccgagctgtacttccatgacagcgccaacaaggagttcatgctgctgagcaagcagctgcaggagaagggctggaaggtgggggacctgctgcaggccgtgctgcagtactatgaggtgatggagaaggccagcagcgaggagcgctgcaagagcctgtttgactggctgctggagaatgcctag

SEQ ID NO: 18225 - DNA, 417 bp, Artificial Sequence
  Description of Artificial Sequence: Synthetic coding sequence
atggccgagctgcagcagctgcgggtgcaggaggccgtggagagcatggtgaagagcctggagcgggagaacatcaggaagatgcagggcctgatgttccgctgcagcgccagctgctgtgaggacagccaggcctccatgaagcaggtgcaccagtgcatcgagcgctgccacgtgcccctggcccaggcccaggccctggtgaccagcgagctggagaagttccaggaccggctggcccgctgcaccatgcactgcaatgacaaggccaaggacagcattgatgctggcagcaaggagctgcaggtgaagcagcagctggacagctgtgtgaccaagtgtgtggatgaccacatgcacctgatccccaccatgaccaagaagatgaaggaggccctgctgagcatcggcaagtag

SEQ ID NO: 18226 - DNA, 1110 bp, Artificial Sequence
  Description of Artificial Sequence: Synthetic coding sequence
atgaccctggaggccatccgctacagccggggcagcctgcagatcctggaccagctgctgctgcccaagcagagccgctatgaagctgtgggctctgtgcaccaggcctgggaggccatccgggccatgaaggtgcggggggccccagccatcgccctggtgggctgcctgagcctggccgtggagctgcaggccggggccggcggccctggcctggccgccctggtggcctttgtgcgggacaagctgtccttcctggtgacagcccggcccacagctgtgaacatggcccgggccgcccgggacctggctgatgtggccgcccgggaggccgagcgggagggcgccacagaggaggccgtgcgggagagggtcatctgctgcacagaggacatgctggagaaggacctgcgggacaacagaagcattggagacctgggcgcccggcacctgctggagcgggtggcccccagcggcggcaaggtgacagtgctgacccactgcaacacaggagccctggccacagctggctacggcacagccctgggcgtcatccgcagcctgcacagcctgggccgcctggagcacgccttctgcacagagacccggccctacaaccagggcgcccggctgacagcctttgagctggtgtatgagcagatcccagccaccctcatcacagacagcatggtggccgccgccatggcccacagaggagtgtctgctgtggtggtgggcgctgacagagtggtggccaatggagacacagccaacaaggtgggcacctaccagctggccatcgtggccaagcaccacggcatccccttctacgtggccgcccccagcagcagctgtgacctgcggctggagaccgggaaggagatcatcatcgaggagaggcctggccaggagctgacagatgtgaatggagtgagaattgctgcccctggcatcggcgtgtggaacccagcctttgatgtgacccctcatgacctgatcaccggcggcatcatcacagagctgggcgtgtttgcccctgaggagctgaggacagccctgaccaccaccatcagcagcagagatggcaccctggatggcccccagatgtag

SEQ ID NO: 18227 - DNA, 3660 bp, Artificial Sequence
  Description of Artificial Sequence: Synthetic coding sequence
atgatgagcctgtctgtgcggccccagaggcggctgctgagcgcccgggtgaacagaagccagagctttgctggggtgctgggcagccatgagcggggccccaggagcttccctgtgttcagccccccaggcccccccaggaagcccccagccctgagccgggtgtccaggatgttttctgtggcccaccctgctgccaaggtgccccagcctgagcggctggacctggtgtacacagccctgaagaggggcctgacagcctacctggaggtgcaccagcaggagcaggagaagctgcagggccagatccgggagagcaagaggaacagccggctgggcttcctgtatgacctggacaagcaggtgaagagcattgagcgcttcctgcggcggctggagttccacgccagcaagattgatgagctgtatgaggcctactgtgtgcagaggcggctgagagatggagcctacaacatggtgcgggcctacaccaccggcagccctggcagccgggaggcccgggacagcctggccgaggccacccggggccaccgggagtacacagagagcatgtgcctgctggagagcgagctggaggcccagctgggggagttccacctgaggatgaagggcctggccggctttgcccggctgtgtgtgggggaccagtatgagatctgcatgaagtatggccggcagcgctggaagctgcggggcagaattgagggcagcggcaagcaggtgtgggacagcgaggagaccatcttcctgcccctgctgacagagttcctgagcatcaaggtgacagagctgaagggcctggccaaccacgtggtggtgggctctgtgtcctgtgagaccaaggacctgtttgctgccctgccccaggtggtggccgtggacatcaatgacctgggcaccatcaagctgagcctggaggtgacctggagcccctttgacaaggatgaccagcccagcgctgccagctctgtgaacaaggccagcacagtgaccaagcgcttcagcacctacagccagagccccccagacacccccagcctgcgggagcaggccttctacaacatgctgcggcggcaggaggagctggagaatggaacagcctggagcctgagcagcgagagcagtgatgacagcagcagcccccagctgtctggaacagcccggcacagccctgccccccggcccctggtgcagcagcctgagcccctgcccatccaggtggccttcagaagacctgagacccccagcagcggccccctggatgaggagggcgctgtggcccctgtgctggccaatggacatgccccctacagcaggaccctgagccacatcagcgaggcctctgtggatgctgccctggccgaggcctctgtggaggccgtgggccctgagagcctggcctggggccccagcccccccacccacccagcccccacccatggagagcaccccagccctgtgcccccagccctggaccccggccacagcgccaccagcagcaccctgggcaccaccggctctgtgcccaccagcacagatcctgcccccagcgcccacctggacagcgtgcacaagagcacagacagcggccccagcgagctgcccggccccacccacaccaccaccggcagcacctacagcgccatcaccaccacccacagcgcccccagccccctgacccacaccaccaccggcagcacccacaagcccatcatcagcaccctgaccaccaccggccccaccctgaacatcatcggccctgtgcagaccaccaccagccccacccacaccatgcccagccccacccacaccacagccagccccacccacaccagcaccagccccacccacacccccaccagccccacccacaagacctccatgagcccccccaccaccaccagccccacccccagcggcatgggcctggtgcagacagccaccagccccacccaccccaccaccagccccacccaccccaccaccagccccatcctgatcaacgtgagccccagcaccagcctggagctggccaccctgagcagccccagcaagcacagcgaccccaccctgcctggaacagacagcctgccctgcagcccccctgtgagcaacagctacacccaggccgaccccatggcccccaggaccccccaccccagccctgcccacagcagcaggaagcccctgaccagccctgccccagaccccagcgagagcacagtgcagagcctgagccccacccccagcccccccaccccagccccccagcacagcgacctgtgcctggccatggctgtgcagacccctgtgcccacagctgctgggggcagcggggacaggagcctggaggaggccctgggcgccctgatggccgccctggatgactaccggggccagtttcctgagctgcagggcctggagcaggaggtgacccggctggagagcctgctgatgcagaggcagggcctgaccaggagccgggccagcagcctgagcatcaccgtggagcacgccctggagagcttctccttcctgaatgaagatgaagatgaagataatgatgtgcctggggaccggccccccagcagccctgaggccggggctgaagattccattgacagccccagcgcccggcccctgagcacaggctgcccagccctggatgctgccctggtgcgccacctgtaccactgcagccggctgctgctgaagctgggcaccttcggccccctgcgctgccaggaggcctgggccctggagcggctgctgcgggaggcccgggtgctggaggccgtgtgtgagttcagccgccgctgggagatcccagccagcagcgcccaggaggtggtgcagttcagcgccagcaggcctggcttcctgaccttctgggaccagtgcacagagcggctgagctgcttcctgtgccctgtggagcgggtgctgctgaccttctgcaaccagtacggggcccggctgagcctgcggcagcccggcctggccgaggccgtgtgtgtgaagttcctggaggatgccctgggccagaagctgccccggcggccccagcccggccctggagagcagctgactgtgttccagttctggagctttgtggagaccctggacagccccaccatggaggcctacgtgacagaaacagctgaggaggtgctgctggtgaggaacctgaacagtgatgaccaggccgtggtgctgaaggccctgcggctggcccctgagggccgcctgcggagagatggcctgcgggccctgagcagcctgctggtgcacggcaacaacaaggtgatggctgctgtgtccacccagctgcggagcctgagcctgggccccaccttccgggagcgggccctgctgtgcttcctggaccagctggaggatgaagatgtgcagaccagggtggccggctgcctggccctgggctgcatcaaggcccctgagggcatcgagcccctggtgtacctgtgccagacagacacagaagctgtgcgggaggccgcccggcagagcctgcagcagtgtggggaggagggccagagcgcccaccggcggctggaggagagcctggatgccctgccccgcatctttggacctggctccatggccagcacagccttctag

SEQ ID NO: 18228 - DNA, 1326 bp, Artificial Sequence
  Description of Artificial Sequence: Synthetic coding sequence
atggcctctgtggccgccgcccgggctgtgcctgtgggcagcggcctgcggggcctgcagaggaccctgcccctggtggtgatcctgggcgccaccggcaccgggaagagcaccctggccctgcagctgggccagaggctgggcggggagatcgtgtctgctgacagcatgcaggtgtatgagggcctggacatcatcaccaacaaggtgtctgcccaggagcagaggatctgccgccaccacatgatcagctttgtggaccccctggtgaccaactacacagtggtggacttcaggaacagagccacagccctgattgaggacatctttgcccgggacaagatccccatcgtggtgggcggcaccaactactacatcgagagcctgctgtggaaggtgctggtgaacaccaagccccaggagatgggcacagagaaggtgattgacaggaaggtggagctggagaaggaggatggcctggtgctgcacaagaggctgagccaggtggaccctgagatggccgccaagctgcacccccatgacaagaggaaggtggcccggagcctgcaggtgtttgaggagaccggcatcagccacagcgagttcctgcaccggcagcacacagaggagggcggcggccccctgggcggccccctgaagttcagcaacccctgcatcctgtggctgcatgctgaccaggccgtgctggatgagcggctggacaagagggtggatgacatgctggccgccggcctgctggaggagctgcgggacttccaccggcgctacaaccagaagaatgtgtctgagaacagccaggactaccagcacggcatcttccagagcatcggcttcaaggagttccacgagtacctgatcacagagggcaagtgcaccctggagaccagcaaccagctgctgaagaagggccctggccccatcgtgccccctgtgtatggcctggaggtgtctgatgtgtccaagtgggaggagagcgtgctggagcccgccctggagatcgtgcagagcttcatccagggccacaagcccacagccacccccatcaagatgccctacaatgaagctgagaacaagaggagctaccacctgtgtgacctgtgtgaccgcatcatcattggagaccgggagtgggccgcccacatcaagagcaagagccacctgaaccagctgaagaagagaagaaggctggacagtgatgctgtgaacaccatcgagagccagagcgtgtccccagaccacaacaaggagcccaaggagaagggcagccctggccagaatgaccaggagctgaagtgcagcgtgtag

SEQ ID NO: 18229 - DNA, 618 bp, Artificial Sequence
  Description of Artificial Sequence: Synthetic coding sequence
atggccgagcccctgcagcctgaccctggagctgctgaagatgctgctgcccaggccgtggagaccccaggctggaaggccccagaagatgctggcccccagcccggcagctatgagatccgccactacggccctgccaagtgggtgtccacctctgtggagagcatggactgggacagcgccatccagacaggcttcaccaagctgaacagctacatccagggcaagaatgagaaggagatgaagatcaagatgacagcccctgtgaccagctatgtggagcccggcagcggccccttcagcgagagcaccatcaccatcagcctgtacatccccagcgagcagcagtttgatcctccccggcccctggagagtgatgtgttcatcgaggacagagctgagatgacagtgtttgtgcgcagctttgatggcttcagcagcgcccagaagaaccaggagcagctgctgaccctggccagcatcctgcgggaggatggcaaggtgtttgatgagaaggtgtactacacagctggctacaacagccctgtgaagctgctgaacagaaataatgaggtgtggctgatccagaagaatgagcccaccaaggaaaatgaatag

SEQ ID NO: 18230 - DNA, 624 bp, Artificial Sequence
  Description of Artificial Sequence: Synthetic coding sequence
atgagctgcaccatcgagaagatcctgacagatgccaagaccctgctggagcggctgcgggagcatgatgctgctgctgagagcctggtggaccagagcgctgccctgcaccggcgggtggccgccatgagggaggccggcacagccctgcctgaccagtaccaggaggatgccagtgacatgaaggacatgagcaagtacaagccccacatcctgctgagccaggagaacacccagatccgggacctgcagcaggagaaccgggagctgtggatcagcctggaggagcaccaggatgccctggagctgatcatgagcaagtacaggaagcagatgctgcagctgatggtggccaagaaggctgtggatgctgagcctgtgctgaaggcccaccagagccacagcgctgagattgagagccagattgaccgcatctgtgagatgggagaggtgatgaggaaggctgtgcaggtggatgatgaccagttctgcaagatccaggagaagctggcccagctggagctggagaacaaggagctgcgggagctgctgagcatcagcagcgagagcctgcaggccaggaaggagaacagcatggacacagccagccaggccatcaagtag

SEQ ID NO: 18231 - DNA, 1032 bp, Artificial Sequence
  Description of Artificial Sequence: Synthetic coding sequence
atgaacatccacaggagcacccccatcaccatcgcccgctatggccgcagcaggaacaagacccaggactttgaggagctgagcagcatccgctctgctgagcccagccagagcttcagccccaacctgggcagccccagccccccagagacccccaacctgagccactgtgtgtcctgcatcggcaagtacctgctgctggagcccctggagggggaccacgtgttccgggctgtgcacctgcacagcggggaggagctggtgtgcaaggtgtttgacatcagctgctaccaggagagcctggccccctgcttctgcctgagcgcccacagcaacatcaaccagatcacagagatcatcctgggggagaccaaggcctacgtgttctttgagaggagctatggagacatgcacagctttgtgaggacctgcaagaagctgcgggaggaggaggccgcccggctcttctaccagatcgccagcgctgtggcccactgccatgatggcggcctggtgctgcgggacctgaagctgaggaagttcatcttcaaggatgaggagaggaccagggtgaagctggagagcctggaggatgcctacatcctgcggggagatgatgacagcctgagtgacaagcacggctgcccagcctacgtgtccccagagatcctgaacaccagcggcagctacagcggcaaggctgctgatgtgtggagcctgggcgtgatgctgtacaccatgctggtgggccgctaccccttccatgacatcgagcccagcagcctcttcagcaagatcagaagaggccagttcaacatccctgagaccctgagccccaaggccaagtgcctgatccgcagcatcctgcggcgggagcccagcgagcggctgaccagccaggagatcctggaccacccctggttcagcacagacttctctgtgagcaacagcgcctatggagccaaggaggtgtctgaccagctggtgcctgatgtgaacatggaggagaacctggaccccttcttcaactag

SEQ ID NO: 18232 - DNA, 3048 bp, Artificial Sequence
  Description of Artificial Sequence: Synthetic coding sequence
atgaggcgcttcctgcggcccggccatgaccctgtgcgggagcggctgaagagggacctcttccagttcaacaagacagtggagcacggcttcccccaccagcccagcgccctgggctacagccccagcctgcgcatcctggccatcggcaccaggtctggggccatcaagctgtatggagcccctggggtggagttcatgggcctgcaccaggagaacaatgctgtgacccagatccacctgctgcccggccagtgccagctggtgaccctgctggatgacaacagcctgcacctgtggagcctgaaggtgaagggcggggccagcgagctgcaggaggatgagagcttcaccctgcggggccccccaggagctgcccccagcgccacccagatcaccgtggtgctgccccacagcagctgtgagctgctgtacctgggcacagagagcggaaatgtgtttgtggtgcagctgcctgccttccgggccctggaggacaggaccatcagcagtgatgctgtgctgcagaggctgcctgaggaggcccggcacagaagagtgtttgagatggtggaggccctgcaggagcacccccgggaccccaaccagatcctgattggctacagccggggcctggtggtgatctgggacctgcagggcagccgggtgctgtaccacttcctgagcagccagcagctggagaacatctggtggcagagagatggccgcctgctggtgtcctgccacagtgatggcagctactgccagtggcctgtgtcctctgaggcccagcagcctgagcccctgcggagcctggtgccctacggccccttcccctgcaaggccatcacccgcatcctgtggctgaccacccggcagggcctgcccttcaccatcttccagggcggcatgccccgggccagctatggagacagacactgcatcagcgtcatccatgatggccagcagacagcctttgacttcaccagccgggtgattggcttcaccgtgctgacagaagctgaccctgctgccacctttgatgacccctatgccctggtggtgctggccgaggaggagctggtggtgattgacctgcagacagctggctggccccctgtgcagctgccctacctggccagcctgcactgcagcgccatcacctgcagccaccacgtgagcaacatccccctgaagctgtgggagcgcatcatcgctgctggcagccggcagaatgcccacttcagcaccatggagtggcccattgatggcggcaccagcctgaccccagccccaccccagagggacctgctgctgaccggccatgaagatggcaccgtgcgcttctgggatgccagcggcgtgtgcctgcggctgctgtacaagctgagcacagtgcgggtcttcctgacagacacagaccccaatgaaaacttcagcgcccagggagaagatgagtggccacccctgaggaaggtgggcagctttgacccctacagtgatgacccccggctgggcatccagaagatcttcctgtgcaagtacagcggctacctggccgtggccggcacagctggccaggtgctggtgctggagctgaatgatgaagctgctgagcaggccgtggagcaggtggaggccgacctgctgcaggaccaggagggctaccgctggaagggccacgagcggctggccgcccggagcggccctgtgcgctttgagcccggcttccagccctttgtgctggtgcagtgccagcccccagctgtggtgaccagcctggccctgcacagcgagtggaggctggtggccttcggcaccagccacggcttcggcctgtttgaccaccagcagaggcggcaggtgtttgtgaagtgcaccctgcaccccagcgaccagctggccctggagggccccctgagccgggtgaagagcctgaagaagagcctgcggcagagcttccggaggatgaggaggagccgggtgagcagcaggaagaggcaccctgctggccccccaggagaggcccaggagggcagcgccaaggccgagcggcccggcctgcagaacatggagctggcccctgtgcagaggaagattgaggcccggtctgctgaggacagcttcaccggctttgtgaggaccctgtactttgctgacacctacctgaaggacagcagccgccactgccccagcctgtgggccggcaccaacggcggcaccatctatgccttcagcctgcgggtgcccccagctgagaggaggatggatgagcctgtgcgggcagagcaggccaaggagatccagctgatgcaccgggcccctgtggtgggcatcctggtgctggatggccacagcgtgcccctgcctgagcccctggaggtggcccatgacctgagcaagagcccagacatgcagggcagccaccagctgctggtggtgtctgaggagcagttcaaggtgttcaccctgcccaaggtgtctgccaagctgaagctgaagctgacagccctggagggcagccgggtgcggcgggtgtctgtggcccacttcggcagccggcgggcagaagattatggagagcaccacctggccgtgctgaccaacctgggggacatccaggtggtgtccctgcccctgctgaagccccaggtgcgctacagctgcatcagaagagaagatgtgtctggcatcgccagctgtgtgttcaccaagtatggccagggcttctacctgatcagccccagcgagtttgagcgcttcagcctgagcaccaagtggctggtggagccccgctgcctggtggacagcgctgagaccaagaaccacaggcctggaaatggagctggccccaagaaggcccccagccgggccagaaattctggcacccagagtgatggagaggagaagcagcccggcctggtgatggagcgggccctgctgagtgatgagcgggccgccaccggggtgcacatcgagcccccctggggcgccgccagcgccatggccgagcagagcgagtggctgtctgtgcaggccgccaggtag

SEQ ID NO: 18233 - DNA, 897 bp, Artificial Sequence
  Description of Artificial Sequence: Synthetic coding sequence
atggctgctgctgagcctgctgtgctggccctgcccaacagcggggccggcggggccggggcccccagcggcaccgtgcctgtgctcttctgcttctctgtgtttgcccggcccagctctgtgccccatggagctggctatgagctgctgatccagaagttcctgagcctgtatggagaccagattgacatgcacaggaagtttgtggtgcagctgtttgctgaggagtggggccagtatgtggacctgcccaagggctttgctgtgtctgagcgctgcaaggtgcggctggtgcccctgcagatccagctgaccaccctgggcaacctgacccccagcagcacagtgttcttctgctgtgacatgcaggagcgcttccggcctgccatcaagtactttggagacatcatctctgtgggccagaggctgctgcagggcgcccgcatcctgggcatccctgtgattgtgacagagcagtaccccaagggcctgggcagcacagtgcaggagattgacctgactggagtgaagctggtgctgcccaagaccaagttctccatggtgctgcctgaggtggaggccgccctggccgagatccctggggtgcgctctgtggtgctgtttggagtggagacccacgtgtgcatccagcagacagccctggagctggtgggccggggcgtggaggtgcacatcgtggctgatgccaccagcagccgctccatgatggacaggatgtttgccctggagcggctggccaggacaggcatcatcgtgaccaccagcgaggccgtgctgctgcagctggtggccgacaaggaccaccccaagttcaaggagatccagaacctgatcaaggccagcgcccctgagagcggcctgctgagcaaggtgtag

SEQ ID NO: 18234 - DNA, 2439 bp, Artificial Sequence
  Description of Artificial Sequence: Synthetic coding sequence
atgtctgagcagggcgacctgaaccaggccatcgccgaggagggcggcacagagcaggagacagccaccccagaaaatggcatcgtgaagtctgagagcctggatgaggaggagaagctggagctgcagaggcggctggaggcccagaaccaggagaggaggaagagcaagagcggggccggcaagggcaagctgaccaggagcctggccgtgtgtgaggagagcagcgcccggcctggaggagagagcctgcaggaccaggagagcatccacctgcagctgagcagcttcagcagcctgcaggaggaggacaagagcaggaaggatgattctgagcgggagaaggagaaggacaagaacaaggacaagaccagcgagaagcccaagatccgcatgctgagcaaggactgcagccaggagtacacagacagcactggaattgacctgcacgagttcctgatcaacaccctgaagaacaacagccgggacaggatgatcctgctgaagatggagcaggagatcatcgacttcatcgctgacaacaacaaccactacaagaagttcccccagatgagcagctaccagaggatgctggtgcaccgggtggccgcctacttcggcctggaccacaacgtggaccagacaggcaagagcgtcatcatcaacaagaccagcagcacccgcatccctgagcagcgcttctgtgagcacctgaaggatgagaagggggaggagagccagaagcgcttcatcctgaagagggacaacagcagcattgacaaggaggacaaccagcagaacaggatgcaccccttcagagatgaccggcgcagcaagagcattgaggagcgggaggaggagtaccagagggtgcgggagcgcatctttgcccatgacagcgtgtgcagccaggagagcctgtttgtggagaacagccggctgctggaggacagcaacatctgcaatgagacctacaagaagaggcagctgttccggggcaacagagatggcagcggccgcaccagcggcagccggcagagcagcagtgaaaatgagctgaagtggagcgaccaccagagggcctggagcagcacagacagcgacagcagcaacagaaacctgaagccagccatgaccaagacagccagctttggaggcatcaccgtgctgaccaggggggacagcaccagcagcaccaggagcacaggcaagctgagcaaggccggcagcgagagcagcagcagcgctggcagcagcggcagcctgagcaggacccacccccccctgcagagcacccccctggtgtctggagtggccgccggcagccctggctgtgtgccctacccagaaaatggaattggaggccaggtggcccccagcagcaccagctacatcctgctgcccctggaggccgccaccggcatccccccaggcagcatcctgctgaacccccacacaggccagccctttgtgaacccagatggcaccccagccatctacaacccccccaccagccagcagcccctgcggagcgccatggtgggccagagccagcagcagcccccccagcagcagcccagcccccagccccagcagcaggtgcagcccccccagccccagatggccggccccctggtgacccagagagatgatgtggccacccagtttggccagatgaccctgagccggcagagcagcggggagaccccagagccccccagcggccctgtgtaccccagcagcctgatgccccagcctgcccagcagcccagctatgtgattgccagcacaggccagcagctgcccactggaggcttcagcggcagcggcccccccatcagccagcaggtgctgcagcccccacccagcccccagggctttgtgcagcagcccccaccagcccagatgcctgtgtactactaccccagcggccagtaccccaccagcaccacccagcagtaccggcccatggcccctgtgcagtacaatgcccagaggagccagcagatgccccaggccgcccagcaggccggctaccagcctgtgctgagcggccagcagggcttccagggcctgattggagtgcagcagcccccccagagccagaatgtcatcaacaaccagcagggcacccctgtgcagagcgtgatggtgtcctaccccaccatgagcagctaccaggtgcccatgacccagggcagccagggcctgccccagcagagctaccagcagcccatcatgctgcccaaccaggccggccagggcagcctgcctgccaccggcatgcctgtgtactgcaatgtgaccccacccaccccccagaacaacctgcggctcatcggcccccactgccccagcagcacagtgcctgtgatgtctgccagctgcaggaccaactgtgcctccatgagcaatgccggctggcaggtgaagttctag

SEQ ID NO: 18235 - DNA, 1191 bp, Artificial Sequence
  Description of Artificial Sequence: Synthetic coding sequence
atgaccaccctggtgctggacaacggggcctacaatgccaagattggctacagccatgaaaatgtgtctgtcatccccaactgccagttccgcagcaagacagcccggctgaagaccttcaccgccaaccagattgatgagatcaaggaccccagcggcctcttctacatcctgcccttccagaagggctacctggtgaactgggatgtgcagaggcaggtgtgggactacctgtttgggaaggagatgtaccaggtggacttcctggacaccaacatcatcatcacagagccctacttcaacttcaccagcatccaggagagcatgaatgagatcctgtttgaggagtaccagttccaggccgtgctgcgggtgaatgctggggccctgagcgcccaccgctacttccgggacaaccccagcgagctgtgctgcatcatcgtggacagcggctacagcttcacccacatcgtgccctactgccgcagcaagaagaagaaggaggccatcatccgcatcaacgtgggcggcaagctgctgaccaaccacctgaaggagatcatctcctaccggcagctgcacgtgatggatgagacccacgtgatcaaccaggtgaaggaggatgtgtgctacgtgtcccaggacttctacagagacatggacatcgccaagctgaagggggaggagaacacagtgatgattgattatgtgctgcctgacttcagcaccatcaagaagggcttctgcaagccccgggaggagatggtgctgagcggcaagtacaagtctggagagcagatcctgcggctggccaatgaaagatttgctgtgcctgagatcctcttcaaccccagcgacatcggcatccaggagatgggcatccctgaggccatcgtgtacagcatccagaacctgcctgaggagatgcagccccacttcttcaagaacatcgtgctgaccggcggcaacagcctcttccctggcttccgggacagagtgtacagcgaggtgcgctgcctgacccccacagattatgatgtgtctgtggtgctgcctgagaaccccatcacctacgcctgggagggcggcaagctgatcagtgaaaatgatgactttgaggacatggtggtgacccgggaggactatgaggagaatggccacagcgtgtgtgaggagaagtttgacatctag

SEQ ID NO: 18236 - DNA, 1005 bp, Artificial Sequence
  Description of Artificial Sequence: Synthetic coding sequence
atggagcccggccccacagctgcccagaggcgctgcagcctgcccccctggctgcccctgggcctgctgctgtggagcggcctggccctgggcgccctgcccttcggcagcagcccccacagggtcttccatgacctgctgtctgagcagcagctgctggaggtggaggacctgagcctgagcctgctgcagggcggcggcctgggccccctgagcctgcccccagacctgcctgacctggaccctgaatgtcgggagctgctgctggactttgccaacagcagcgctgagctgaccggctgcctggtgcgcagcgcccggcctgtgcggctgtgccagacctgctaccccctcttccagcaggtggtgtccaagatggacaacatcagcagagctgctggcaacaccagcgagagccagagctgtgcccggagcctgctgatggctgacaggatgcagatcgtggtgatcctgtctgagttcttcaacaccacctggcaggaggccaactgtgccaactgcctgaccaacaacagcgaggagctgagcaacagcacagtgtacttcctgaacctcttcaaccacaccctgacctgctttgagcacaacctgcagggcaatgcccacagcctgctgcagaccaagaactacagcgaggtgtgcaagaactgccgggaggcctacaagaccctgagcagcctgtacagcgagatgcagaagatgaatgagctggagaacaaggccgagcccggcacccacctgtgcattgatgtggaggatgccatgaacatcaccaggaagctgtggagcaggaccttcaactgcagcgtgccctgcagcgacacagtgcctgtgattgctgtgtctgtgttcatcctcttcctgcctgtggtgttctacctgagcagcttcctgcacagcgagcagaagaagaggaagctgatcctgcccaagaggctgaagagcagcaccagctttgccaacatccaggagaacagcaactag

SEQ ID NO: 18237 - DNA, 2172 bp, Artificial Sequence
  Description of Artificial Sequence: Synthetic coding sequence
atgagcacagccactggacctgaggccgcccccaagcccagcgccaagagcatctatgagcagaggaagcgctacagcacagtggtgatggctgatgtgtcccagtaccctgtgaaccacctggtgaccttctgcctgggggaggatgatggagtgcacacagtggaggatgccagcaggaagctggccgtgatggacagccagggccgggtgtgggcccaggagatgctgctgcgggtgtccccagaccacgtgaccctgctggaccctgccagcaaggaggagctggagagctaccccctgggcgccatcgtgcgctgtgatgctgtgatgcctcctggccgcagccgcagcctgctgctgctggtgtgccaggagcctgagcgggcccagccagatgtgcacttcttccagggcctgcggctgggcgctgagctgatccgggaggacatccagggcgccctgcacaactaccgcagcggccgcggggagaggagagctgctgccctgcgggccacccaggaggagctgcagagggacaggagccctgctgctgagaccccacccctgcagaggcggcccagcgtgcgggccgtcatcagcacagtggagagaggagctggccggggccggccccaggccaagcccatccctgaggccgaggaggcccagaggcctgagcctgtgggcaccagcagcaatgctgacagcgccagcccagacctgggcccccggggccctgacctggccgtgctgcaggccgagcgggaggtggacatcctgaaccacgtgtttgatgatgtggagagctttgtgtcccggctgcagaagtctgctgaggccgcccgggtgctggagcaccgggagcggggccgccgcagcagaagaagagctgctggggagggcctgctgaccctgcgggccaagccacccagcgaggccgagtacacagatgtgctgcagaagatcaagtatgccttcagcctgctggcccggctgcggggcaacattgctgaccccagcagccctgagctgctgcacttcctgtttggccccctgcagatgattgtgaacaccagcggcggccctgagtttgccagctctgtgcggcggccccacctgaccagtgatgctgtggccctgctgcgggacaacgtgaccccccgggagaatgagctgtggaccagcctgggggacagctggacccggcccggcctggagctgagccctgaggagggccccccctacagacctgagttcttcagcggctgggagccccctgtgacagacccccagagccgggcctgggaggaccctgtggagaagcagctgcagcacgagaggagaagacggcagcagagcgccccccaggtggccgtgaatggccaccgggacctggagcctgagagcgagccccagctggagagcgagacagctgggaagtgggtgctgtgcaactatgacttccaggccaggaacagcagcgagctgtctgtgaagcagagagatgtgctggaggtgctggatgacagcaggaagtggtggaaggtgcgggaccctgctggccaggagggctacgtgccctacaacatcctgaccccctacccaggcccccggctgcaccacagccagagccctgcccggagcctgaacagcaccccacctcctcctccagccccagccccagcccctcctccagccctggcccggccccgctgggaccggccccgctgggacagctgtgacagcctgaatggcctggaccccagcgagaaggagaagttcagccagatgctgattgtgaatgaggagctgcaggcccggctggcccagggccgcagcggccccagcagagctgtgcccggcccccgggcccctgagccccagctgagccctggcagtgatgccagcgaggtgcgggcctggctgcaggccaagggcttcagcagcggcaccgtggatgccctgggcgtgctgaccggggcccagctgttcagcctgcagaaggaggagctgcgggctgtgtccccagaggagggcgcccgggtgtacagccaggtgacagtgcagaggagcctgctggaggacaaggagaaggtgtctgagctggaggccgtgatggagaagcagaagaagaaggtggagggggaggtggagatggaggtgatctag

SEQ ID NO: 18238 - DNA, 5622 bp, Artificial Sequence
  Description of Artificial Sequence: Synthetic coding sequence
atgttcagccgccgcagccatggagatgtgaagaagagcacccagaaggtgctggaccccaagaaggatgtgctgacccggctgaagcacctgcgggccctgctggacaacgtggatgccaatgacctgaagcagttctttgagaccaactacagccagatctacttcatcttctatgagaacttcatcgccctggagaacagcctgaagctgaagggcaacaacaagagccagcgggaggagctggacagcatcctcttcctgtttgagaagatcctgcagttcctgcctgagcgcatcttcttccgctggcactaccagagcatcggcagcaccctgaagaagctgctgcacactggaaacagcatcaagatccgctgtgagggcatccgcctcttcctgctgtggctgcaggccctgcagaccaactgtgccgaggagcaggtgctgatctttgcctgcctggtgcccggcttccctgctgtgatgagcagccggggcccctgcaccctggagaccctcatcaaccccagccccagcgtggctgatgtgaagatctacccagaggagatcacccccctgctgcctgccatctctggagagaagattgctgaggaccagacctgcttcttcctgcagatcctgctgaagtacatggtgatccaggccgccagcctggagtggaagaacaaggagaaccaggacaccggcttcaagttcctgttcaccctcttcaggaagtactacctgccccacctgttccccagcttcaccaagctgaccaacatctacaagcctgtgctggacatcccccacctgcggcccaagcctgtgtacatcaccaccacccgggacaatgaaaacatctacagcaccaagatcccctacatggccgcccgggtggtgttcatcaagtggatcgtgaccttcttcctggagaagaagtacctgacagccacccagaacaccaagaatggagtggatgtgctgcccaagatcatccagacagtgggcggcggcgctgtgcaggagcgggcccctgagctggatggcggcggccccacagagcaggacaagagccacagcaacagcagcaccctgagtgaccggcggctgagcaacagcagcctgtgcagcattgaggaggagcacaggatggtgtatgagatggtgcagaggatcctgctgagcacccggggctacgtgaactttgtgaatgaggtgttccaccaggccttcctgctgcccagctgtgaaattgctgtgaccaggaaggtggtgcaggtgtacaggaagtggatcctgcaggacaagcctgtgttcatggaggagccagacaggaaggatgtggcccaggaggatgctgagaagctgggcttcagcgagacagacagcaaggaggccagcagcgagagcagcggccacaagaggagcagctcctggggccgcacctacagcttcaccagcgccatgagccggggctgtgtgacagaggaggagaacaccaacgtgaaggccggcgtgcaggccctgctgcaggtgttcctgaccaacagcgccaacatcttcctgctggagccctgtgccgaggtgcctgtgctgctgaaggagcaggtggatgcctgcaaggctgtgctgatcatcttccggaggatgatcatggagctgaccatgaacaagaagacctgggagcagatgctgcagatcctgctgcgcatcacagaggccgtgatgcagaagcccaaggacaagcagatcaaggacctgtttgcccagagcctggccggcctgctcttccgcaccctgatggtggcctggatccgggccaacctgtgtgtgtacatcagccgggagctgtgggatgacttcctgggcgtgctgagcagcctgacagagtgggaggagctgatcaatgagtgggccaacatcatggacagcctgacagctgtgctggccaggacagtgtatggagtggagatgaccaacctgcccctggacaagctgtctgagcagaaggagaagaagcagaggggcaagggctgtgtgctggacccccagaagggcaccaccgtgggccgctccttcagcctgtcctggaggagccacccagatgtgacagagcccatgaggttccgcagcgccaccaccagcggggcccctggggtggagaaggccaggaacatcgtgcggcagaaggccacagaggtggaggagtgccagcagagtgaaaatgccccagctgctggcagcggccacctgactgtgggccagcagcagcaggtgctgcggagcagcagcaccagtgacatccctgagcccctgtgcagcgacagcagccagggccagaaggccgagaacacccagaacagcagcagcagcgagccccagcccatccaggagaacaagggccacgtgaagcgggagcacgagggcatcaccatcctggtgagaagaagcagcagccctgctgagctggacctgaaggatgacctgcagcagacccagggcaaatgtcgggagcggcagaagtctgagagcaccaacagcgacaccaccctgggctgcaccaatgaagctgagctgtccatgggcccctggcagacctgtgaagaagatcctgagctgaacacccccacagatgtggtggctgatgctgatgcccggcactggctgcagctgagccccacagatgccagcaacctgacagacagcagcgagtgcctgacagatgactgcagcatcatcgccggcggcagcctgaccggctggcacccagattctgctgctgtgctgtggaggagagtgctgggcatcctgggagatgtgaacaacatccagagccccaagatccacgcccgggtcttctgctacctgtatgagctgtggtacaagctggccaagatccgggacaacctggccatcagcctggacaaccagagcagccccagcccccctgtgctgatcccccccctgaggatgtttgcctcctggctgttcaaggccgccaccctgcccaatgagtacaaggagggcaagctgcaggcctaccgcctcatctgtgccatgatgacccggcggcaggatgtgctgcccaacagcgacttcctggtgcacttctacctggtgatgcacctgggcctgaccagcgaggaccaggacatcctgaacaccatcatccgccactgccccccacgcttcttcagcctgggcttccctggcttctccatgctggtgggggacttcatcacagctgctgcccgggtgctgagcacagacatcctgacagcccccaggtctgaggccgtgacagtgctgggcagcctggtgtgcttccccaacacctaccaggagatccccctgctgcagagcgtgcctgaggtgaatgaggccatcaccggcacagaagatgtgaagcactacctgatcaacatcctgctgaagaatgccacagaggagcccaatgaatatgcccgctgcatcgctgtgtgcagcctgggcgtgtggatctgtgaggagctggcccagtgcaccagccacccccaggtgaaggaggccatcaacgtgattggagtgaccctgaagttccccaacaagatcgtggcccaggtggcctgtgatgtgctgcagctgctggtgtcctactgggagaagctgcagatgtttgagaccagcctgcccaggaagatggccgagatcctggtggccaccgtggccttcctgctgcccagcgctgagtacagctctgtggagacagacaagaagttcatcgtgtccctgctgctgtgcctgctggactggtgcatggccctgcctgtgtctgtgctgctgcaccctgtgtccacagctgtgctggaggagcagcacagcgcccgggcccccctgctggactacatctacagagtgctgcactgctgcgtgtgtggcagcagcacctacacccagcagagccactacatcctgaccctggccgacctgagcagcacagattatgaccccttcctgcccctggccaacgtgaagagcagcgagcctgtgcagtaccacagcagcgctgagctgggcaacctgctgactgtggaggaggagaagaagagaagaagcctggagctgatccccctgacagccaggatggtgatggcccacctggtgaaccacctgggccactaccccctgagcggcggccctgccatcctgcacagcctggtgtctgagaaccacgacaatgcccacgtggagggcagcgagctgagctttgaggtgttccgcagccccaacctgcagctgtttgtgttcaatgacagcaccctcatctcctacctgcagacccccacagagggccctgtgggcggcagccctgtgggcagcctgagtgatgtgcgggtcatcgtgcgggacatcagcggcaagtacagctgggatggcaaggtgctgtatggccccctggagggctgcctggcccccaacggcaggaaccccagcttcctgatcagctcctggcaccgggacaccttcggcccccagaaggacagcagccaggtggaggagggagatgatgtgctggacaagctgctggagaacatcggccacaccagcccagaatgtctgctgcccagccagctgaacctgaatgagcccagcctgaccccctgtggcatgaactatgaccaggagaaggagatcattgaagtcatcctgcggcagaatgcccaggaggatgagtacatccagagccacaactttgacagcgccatgaaggtgaccagccagggccagcccagccctgtggagccccggggccccttctacttctgccgcctgctgctggatgacctgggcatgaacagctgggacaggaggaagaacttccacctgctgaagaagaacagcaagctgctgcgggagctgaagaacctggacagccggcagtgccgggagacccacaagattgctgtgttctacatcgccgagggccaggaggacaagtgcagcatcctgagcaatgaaagaggcagccaggcctatgaagattttgtggccggcctgggctgggaggtggacctgagcacccactgcggcttcatgggcggcctgcagagaaatggcagcacaggccagacagccccctactatgccaccagcacagtggaggtgatcttccacgtgtccaccaggatgcccagcgacagtgatgacagcctgaccaagaagctgcggcacctgggcaatgatgaggtgcacatcgtgtggagcgagcacagccgggactacagaagaggcatcatccccacagcctttggagatgtgtccatcatcatctaccccatgaagaaccacatgttcttcatcgccatcaccaagaagccagaggtgcccttcttcggccccctgtttgatggagccatcgtgtctgggaagctgctgcccagcctggtgtgtgccacctgcatcaatgccagcagagctgtgaagtgcctgatccccctgtaccagagcttctatgaggagcgggccctgtacctggaggccatcatccagaaccaccgggaggtgatgacctttgaggactttgctgcccaggtgttcagccccagccccagctacagcctgagcggcacagactag

SEQ ID NO: 18239 - DNA, 1041 bp, Artificial Sequence
  Description of Artificial Sequence: Synthetic coding sequence
atggcccggcccggccagcgctggctgggcaagtggctggtggccatggtggtgtgggccctgtgccgcctggccacccccctggccaagaacctggagcctgtgtcctggagcagcctgaaccccaagttcctgagcggcaagggcctggtgatctaccccaagatcggggacaagctggacatcatctgccccagggctgaggccggccggccctatgagtactacaagctgtacctggtgcggcctgagcaggccgccgcctgcagcacagtgctggaccccaacgtgctggtgacctgcaacagacctgagcaggagatccgcttcaccatcaagttccaggagttcagccccaactacatgggcctggagttcaagaagcaccacgactactacatcaccagcaccagcaatggcagcctggagggcctggagaaccgggagggcggcgtgtgcaggaccaggaccatgaagatcatcatgaaggtgggccaggaccccaatgctgtgaccccagagcagctgaccaccagccggcccagcaaggaggccgacaacacagtgaagatggccacccaggcccctggcagccggggcagcctgggggacagtgatggcaagcatgaaacagtgaaccaggaggagaagagcggccctggggccagcggcggcagcagcggggaccctgatggcttcttcaacagcaaggtggccctgtttgctgctgtgggcgccggctgcgtcatcttcctgctgatcatcatcttcctgactgtgctgctgctgaagctgaggaagaggcacaggaagcacacccagcagagagctgctgccctgagcctgagcaccctggccagccccaagggcggcagcggcacagctggaacagagcccagcgacatcatcatccccctgcggaccacagagaacaactactgcccccactatgagaaggtgtctggggactatggccaccctgtgtacatcgtgcaggagatgccaccccagagccctgccaacatctactacaaggtgtag

SEQ ID NO: 18240 - DNA, 1617 bp, Artificial Sequence
  Description of Artificial Sequence: Synthetic coding sequence
atggccagtgaccccatcttcaccctggccccacccctgcactgccactatggagccttccccccaaatgccagcggctgggagcagcccccaaatgccagcggcgtgtctgtggccagcgctgccctggccgccagcgctgccagccgggtggccaccagcacagaccccagctgcagcggctttgcccccccagacttcaaccactgcctgaaggactgggactacaacggcctgcctgtgctgaccaccaatgccatcggccagtgggacctggtgtgtgacctgggctggcaggtgatcctggagcagatcctcttcatcctgggctttgccagcggctacctgttcctgggctacccagctgacagatttggaagaagaggcatcgtgctgctgaccctgggcctggtgggcccctgtggggtgggcggcgctgctgctggcagcagcactggagtgatggccctgcgcttcctgctgggcttcctgctggccggcgtggacctgggcgtgtacctgatgaggctggagctgtgtgaccccacccagaggctgcgggtggccctggccggggagctggtgggcgtgggcggccacttcctgttcctgggcctggccctggtgtccaaggactggaggttcctgcagaggatgatcacagccccctgcatcctcttcctgttctacggctggccaggcctcttcctggagagcgcccgctggctgattgtgaagaggcagatcgaggaggcccagagcgtgctgcgcatcctggccgagaggaaccggccccacggccagatgctgggggaggaggcccaggaggccctgcaggacctggagaacacctgccccctgcctgccaccagcagcttctcctttgccagcctgctgaactacagaaacatctggaagaacctgctgatcctgggcttcaccaacttcatcgcccacgccatccgccactgctaccagcctgtgggcggcggcggcagccccagcgacttctacctgtgcagcctgctggccagcggcacagctgccctggcctgtgtgttcctgggcgtgacagtggaccgcttcggccggcggggcatcctgctgctgtccatgaccctgactggaattgccagcctggtgctgctgggcctgtgggactgtgagcaccccatcttccccaccgtgtgggcccagcagggcaaccccaacagagacctgaatgaggccgccatcaccaccttctctgtgctgggcctcttcagcagccaggccgccgccatcctgagcaccctgctggccgctgaggtgatccccaccaccgtgcggggccggggcctgggcctcatcatggccctgggcgccctgggcggcctgagcggccctgcccagaggctgcacatgggccacggggccttcctgcagcacgtggtgctggccgcctgtgccctgctgtgcatcctgagcatcatgctgctgcctgagaccaagaggaagctgctgcctgaggtgctgagagatggagagctgtgccggcggcccagcctgctgcggcagcccccacccacccgctgtgaccacgtgcccctgctggccacccccaacccagccctgtag

SEQ ID NO: 18241 - DNA, 1128 bp, Artificial Sequence
  Description of Artificial Sequence: Synthetic coding sequence
atgagcacagctgggaaggtgatcaagtgcaaggctgctgtgctgtgggagctgaagaagcccttcagcattgaggaggtggaggtggccccacccaaggcccacgaggtgcgcatcaagatggtggccgtgggcatctgtggcacagatgaccacgtggtgtctggcaccatggtgacccccctgcctgtgatcctgggccacgaggccgccggcatcgtggagagcgtgggggagggcgtgaccaccgtgaagccaggggacaaggtgatccccctggccatcccccagtgtgggaagtgccgcatctgcaagaaccctgagagcaactactgcctgaagaatgatgtgagcaacccccagggcaccctgcaggacggcaccagccgcttcacctgcaggaggaagcccatccaccacttcctgggcatcagcaccttcagccagtacacagtggtggatgaaaatgctgtggccaagattgatgctgccagccccctggagaaggtgtgcctgattggctgcggcttcagcacaggctacggcagcgctgtgaatgtggccaaggtgaccccaggcagcacctgtgctgtgtttggcctgggcggcgtgggcctgagcgccatcatgggctgcaaggctgctggagctgcccgcatcatcgctgtggacatcaacaaggacaagtttgccaaggccaaggagctgggcgccacagagtgcatcaacccccaggactacaagaagcccatccaggaggtgctgaaggagatgacagatggcggcgtggacttctcctttgaagtcatcggccgcctggacaccatgatggccagcctgctgtgctgccacgaggcctgtggcaccagcgtcatcgtgggcgtgcccccagacagccagaacctgtccatgaaccccatgctgctgctgactggaagaacctggaagggggccatcctgggcggcttcaagagcaaagaatgtgtgcccaagctggtggccgacttcatggccaagaagttcagcctggatgccctgatcacccacgtgctgccctttgagaagatcaatgaaggatttgacctgctgcacagcggcaagagcatccgcaccatcctgatgttttag

SEQ ID NO: 18242 - DNA, 1641 bp, Artificial Sequence
  Description of Artificial Sequence: Synthetic coding sequence
atgtgcagcctgggcctcttccccccacctccaccccggggccaggtgaccctgtatgagcacaacaatgagctggtgacaggcagcagctatgagagccccccaccagacttccggggccagtggatcaacctgcctgtgctgcagctgaccaaggaccccctgaagaccccaggccgcctggaccacggcaccaggacagccttcatccaccaccgggagcaggtgtggaagcgctgcatcaacatctggagagatgtgggcctgtttggagtgctgaatgagatcgccaacagcgaggaggaggtgtttgagtgggtgaagacagccagcggctgggccctggccctgtgccgctgggccagcagcctgcacggcagcctcttcccccacctgagcctgcggtctgaggacctgattgctgagtttgcccaggtgaccaactggagcagctgctgcctgcgggtgtttgcctggcacccccacaccaacaagtttgctgtggccctgctggatgacagcgtgcgggtgtacaatgccagcagcaccatcgtgcccagcctgaagcaccggctgcagagaaatgtggccagcctggcctggaagcccctgagcgcctctgtgctggccgtggcctgccagagctgcatcctgatctggaccctggaccccaccagcctgagcacccggcccagcagcggctgtgcccaggtgctgagccaccctggccacacccctgtgaccagcctggcctgggcccccagcggcggccgcctgctgagcgccagccctgtggatgctgccatccgggtgtgggatgtgtccacagagacctgtgtgcccctgccctggttccggggcggcggcgtgaccaacctgctgtggagcccagatggcagcaagatcctggccaccacccccagcgctgtgttccgggtgtgggaggcccagatgtggacctgtgagcgctggcccaccctgagcggccgctgccagacaggctgctggagcccagatggcagccggctgctcttcaccgtgctgggggagcccctcatctacagcctgtccttccctgagcgctgtggggagggcaagggctgtgtgggcggggccaagagcgccaccatcgtggccgacctgtctgagaccaccatccagaccccagatggagaggagcggctgggcggggaggcccacagcatggtgtgggaccccagcggggagcggctggccgtgctgatgaagggcaagccccgggtgcaggacggcaagcctgtgatcctgctcttccgcaccaggaacagccctgtgtttgagctgctgccctgtggcatcatccagggcgagcccggggcccagccccagctgatcaccttccaccccagcttcaacaagggggccctgctgtctgtgggctggagcactggaagaattgcccacatccccctgtactttgtgaatgcccagttcccccgcttcagccctgtgctgggccgggcccaggagcccccagctgggggcggcggcagcatccatgacctgcccctcttcacagagaccagccccaccagcgccccctgggaccccctgcccggccccccacctgtgctgccccacagcccccacagccacctgtag

SEQ ID NO: 18243 - DNA, 576 bp, Artificial Sequence
  Description of Artificial Sequence: Synthetic coding sequence
atgggcaagaagaccaagaggacagctgacagcagcagcagtgaagatgaggaggagtatgtggtggagaaggtgctggaccggcgggtggtgaagggccaggtggagtacctgctgaagtggaagggcttcagcgaggagcacaacacctgggagcctgagaagaacctggactgcccagagctgatcagcgagttcatgaagaagtacaagaagatgaaggagggggagaacaacaagccccgggagaagtctgagagcaacaagaggaagagcaacttcagcaacagcgcagatgacatcaagagcaagaagaagcgggagcagagcaatgacatcgcccggggctttgagcggggcctggagcctgagaagatcattggagccacagacagctgtggggacctgatgttcctgatgaagtggaaggacacagatgaggccgacctggtgctggccaaggaggccaacgtgaagtgcccccagatcgtgattgccttctatgaggagcggctgacctggcacgcctacccagaagatgctgagaacaaggagaaggagacagccaagagctag

SEQ ID NO: 18244 - DNA, 1554 bp, Artificial Sequence
  Description of Artificial Sequence: Synthetic coding sequence
atgggcaggaagagcaagaagtggggcaagaaggtgagccgctatgagggcaaggtgcggctgaagaaggtgcctgccaagaagctggtgcctgcctggaaggagaaggtgctgtgggccctgctggccgtgctgctggcctcctggaggctgtgggccatcaaggacttccaggagtgcacctggcaggtggtgctgaatgagttcaagagggtgggggagagcggcgtgtctgacagcttctttgagcaggagcctgtggacacagtgagcagcctcttccacatgctggtggacagccccatcgaccccagcgagaagtacctgggcttcccctactacctgaagatcaactacagctgtgaggagaagcccagcgaggacctggtgaggatgggccacctgaccggcctgaagcccctggtgctggtgaccttccagagccctgtgaacttctaccgctggaagattgagcagctgcagatccagatggaggccgcccccttccgcagcaagggcggccctgggggcggcggccgggacaggaacctggccggcatgaacatcaatggcttcctgaagagggaccgggacaacaacatccagttcaccgtgggggaggagctgttcaacctgatgccccagtactttgtgggcgtgagcagccggcccctgtggcacacagtggaccagagccctgtgctgatcctgggcggcatccccaatgagaagtatgtgctgatgacagacaccagcttcaaggacttcagcctggtggaggtgaatggagtgggccagatgctgagcattgacagctgctgggtgggcagcttctactgcccccacagcggcttcaccgccaccatctatgacaccatcgccacagagagcaccctcttcatccggcagaaccagctggtgtactacttcaccggcacctacaccaccctgtatgaaagaaacagaggcagcggggagtgtgctgtggccggccccaccccaggagagggcaccctggtgaaccccagcacagagggctcctggatccgggtgctggccagcgagtgcatcaagaagctgtgccctgtgtacttccacagcaatggcagcgagtacatcatggccctgaccaccgggaagcatgagggctacgtgcacttcggcaccatccgggtgaccacctgcagcatcatctggagcgagtacatcgccggggagtacaccctgctgctgctggtggagagcggctatggaaatgccagcaagcgcttccaggtggtgtcctacaacacagccagtgatgacctggagctgctgtaccacatccctgagttcatccctgaggcccggggcctggagttcctgatgatcctgggcacagagagctacaccagcacagccatggcccccaagggcatcttctgcaacccctacaacaacctgatcttcatctggggcaacttcctgctgcagaggagcggcacctcctggagggctgccaccggcagcaccagctgcagcctgcccagggctggccgctgcaccagcgcctag

SEQ ID NO: 18245 - DNA, 1203 bp, Artificial Sequence
  Description of Artificial Sequence: Synthetic coding sequence
atgagcggccgggtgggggacctgagccccaagcaggccgagaccctggccaagttcagagaaaatgtgcaggatgtgctgcctgccctgcccaacccagatgactacttcctgctgcgctggctgcgggccaggaactttgacctgcagaagtctgaggccctgctgaggaagtacatggagttcaggaagaccatggacatcgaccacatcctggactggcagcccccagaggtgatccagaagtacatgcctgggggcctgtgtggctatgacagagatggctgccctgtgtggtatgacatcatcggccccctggaccccaagggcctgctcttctctgtgaccaagcaggacctgctgaagaccaagatgagggactgtgagcgcatcctgcatgaatgtgacctgcagacagagcggctgggcaagaagattgagaccatcgtgatgatctttgactgtgagggcctgggcctgaagcacttctggaagcccctggtggaggtgtaccaggagttcttcggcctgctggaggagaactacccagagaccctgaagttcatgctgattgtgaaggccaccaagctgtttcctgtgggctacaacctgatgaagcccttcctgtctgaggacaccaggaggaagatcatcgtgctgggcaacaactggaaggagggcctgctgaagctgatcagccctgaggagctgcctgcccagtttggaggcaccctgacagatcctgatggcaaccccaagtgcctgaccaagatcaactacggcggggagatccccaagtccatgtatgtgcgggaccaggtgaagacccagtatgagcacagcgtgcagatcaacagaggcagcagccaccaggtggagtatgagatcctcttccctggctgtgtgctgcgctggcagttcagcagtgatggagctgacatcggctttggagtcttcctgaagaccaagatgggagagcggcagagagctggggagatgacagatgtgctgcccagccagcgctacaatgcccacatggtgcctgaagatggcaacctgacctgcagcgaggccggcgtgtatgtgctgcgctttgacaacacctacagctttgtgcacgccaagaaggtgtccttcaccgtggaggtgctgctgcctgatgagggcatgcagaagtatgacaaggagctgacccctgtgtag

SEQ ID NO: 18246 - DNA, 636 bp, Artificial Sequence
  Description of Artificial Sequence: Synthetic coding sequence
atggccgagcagcacggggcccctgagcaggccgctgctgggaagagccatggagacctgggcggcagctacaaggtgatcctgtatgagctggagaacttccagggcaagagatgtgagctgtctgctgagtgccccagcctgacagacagcctgctggagaaggtgggcagcatccaggtggagagcggcccctggctggcctttgagagccgggccttccggggggagcagtttgtgctggagaagggggactacccccgctgggatgcctggagcaacagccgggacagcgacagcctgctgagcctgcggcccctgaacatcgacagcccccaccacaagctgcacctgtttgagaacccagccttcagcggcaggaagatggagatcgtggatgatgatgtgcccagcctgtgggcccacggcttccaggacagagtggcctctgtgcgggccatcaatggcacctgggtgggctatgagttccctggctaccggggccggcagtatgtgtttgagcggggggagtaccgccactggaatgagtgggatgccagccagccccagctgcagagcgtgcggcgcatccgggaccagaagtggcacaagaggggccgcttccccagcagctag

SEQ ID NO: 18247 - DNA, 387 bp, Artificial Sequence
  Description of Artificial Sequence: Synthetic coding sequence
atgacagaagcagatgtgaaccccaaggcctaccccctggctgatgcccacctgaccaagaagctgctggacctggtgcagcagagctgcaactacaagcagctgaggaaaggagccaatgaggccaccaagaccctgaacagaggcatcagcgagttcatcgtgatggccgcagatgctgagcccctggagatcatcctgcacctgcccctgctgtgtgaggacaagaatgtgccctacgtgtttgtgcgcagcaagcaggccctgggccgggcctgtggggtgtccaggcctgtgattgcctgcagcgtgaccatcaaggagggcagccagctgaagcagcagatccagagcatccagcagagcattgagcggctgctggtgtag

SEQ ID NO: 18248 - DNA, 2592 bp, Artificial Sequence
  Description of Artificial Sequence: Synthetic coding sequence
atggccggccccaggggggccctgctggcctggtgccggcggcagtgtgagggctacagaggagtggagatccgggacctgagcagcagcttcagagatggcctggccttctgtgccatcctgcaccgccacaggccagacctgctggactttgacagcctgagcaaggacaacgtgtttgagaacaaccggctggcctttgaggtggccgagaaggagctgggcatcccagccctgctggaccccaatgacatggtgtccatgtctgtgcctgactgcctgagcatcatgacctacgtgtcccagtactacaaccacttctgcagccctggccaggccggcgtgtccccacccaggaagggcctggccccctgcagccccccatctgtggcccccacccctgtggagccagaagatgtggcccagggcgaggagctgagcagcggcagcctgtctgagcagggcaccggccagacccccagcagcacctgtgccgcctgccagcagcacgtgcacctggtgcagcgctacctggctgatggccgcctgtaccaccgccactgcttccgctgccgccgctgcagcagcaccctgctgcccggggcctatgaaaatggacctgaggagggcacctttgtgtgtgccgagcactgtgcccggctgggccctggcaccaggagcggcaccaggcctggccccttcagccagcccaagcagcagcaccagcagcagctggctgaagatgccaaggatgtgcctgggggcggccccagcagcagcgccccagctggagctgaggctgatggccccaaggccagccctgaggcccggccccagatccccaccaagccccgggtgcctgggaagctgcaggagctggccagccccccagctggccggcccaccccagcccccaggaaggccagcgagagcaccaccccagccccacccaccccccggcccaggagcagcctgcagcaggagaacctggtggagcaggccggcagcagcagcctggtgaatggccgcctgcacgagctgcctgtgcccaagccccggggcacccccaagcccagcgagggcaccccagcccccaggaaggaccccccctggatcaccctggtgcaggccgagcccaagaagaagccagcccccctgccccccagcagcagccctggcccccccagccaggacagccggcaggtggagaatggaggaacagaggaggtggcccagcccagccccacagccagcctggagagcaagccctacaacccctttgaggaggaggaggaggacaaggaggaggaggccccagctgcccccagcctggccaccagccctgccctgggccaccctgagagcacccccaagagcctgcacccctggtacggcatcacccccaccagcagccccaagaccaagaagaggcctgccccccgggcccccagcgccagccccctggccctgcacgccagccggctgagccacagcgagccccccagcgccacccccagccctgccctgtctgtggagagcctgagcagcgagagcgccagccagacagctggagctgagctgctggagcccccagctgtgcccaagagcagcagcgagcctgctgtgcacgcccctggcaccccaggcaaccctgtgtccctgagcaccaacagcagcctggccagcagtggagagctggtggagccccgggtggagcagatgccccaggccagccctggcctggcccccaggacccggggcagcagcggcccccagcctgccaagccctgcagcggggccacccccacccccctgctgctggtgggggacaggagccctgtgcccagccctggcagcagcagcccccagctgcaggtgaagagcagctgcaaggagaaccccttcaacaggaagcccagccctgctgccagccctgccaccaagaaggccaccaagggcagcaagcctgtgcggcccccagcccctggccacggcttccccctcatcaagaggaaggtgcaggccgaccagtacatccctgaggaggacatccatggagagatggacaccattgaaagaaggctggatgccctggagcaccggggcgtgctgctggaggagaagctgcggggcggcctgaatgaaggccgggaggatgacatgctggtggactggttcaagctgatccacgagaagcacctgctggtgagaagagagagcgagctgatctacgtgttcaagcagcagaacctggagcagaggcaggctgatgtggagtatgagctgcgctgcctgctgaacaagccagagaaggactggacagaggaggaccgggcccgggagaaggtgctgatgcaggagctggtgaccctcatcgagcagagaaatgccatcatcaactgcctggatgaggaccggcagcgggaggaggaggaggacaagatgctggaggccatgatcaagaagaaggagttccagcgggaggccgagcctgagggcaagaagaagggcaagttcaagaccatgaagatgctgaagctgctgggcaacaagagagatgccaagagcaagagcccccgggacaagagctag

SEQ ID NO: 18249 - DNA, 708 bp, Artificial Sequence
  Description of Artificial Sequence: Synthetic coding sequence
atgtggaggggccgggccggggccctgctgcgggtgtggggcttctggcccaccggggtgcccaggagaagacccctgagctgtgatgctgccagccaggccggcagcaactacccccgctgctggaactgtggcggcccctggggccctggaagagaagatcgcttcttctgcccccagtgccgggccctgcaggccccagaccccacccgggactacttcagcctgatggactgcaacagaagcttccgggtggacacagccaagctgcagcaccgctaccagcagctgcagaggctggtgcacccagacttcttcagccagaggagccagacagagaaggacttcagcgagaagcacagcaccctggtgaatgatgcctacaagaccctgctggcccccctgagccggggcctgtacctgctgaagctgcatggaattgagatccctgagaggacagattatgagatggaccggcagttcctgattgagatcatggagatcaatgagaagctggccgaggccgagagcgaggccgccatgaaggagattgagagcatcgtgaaggccaagcagaaggagttcacagacaacgtgtcctctgcctttgagcaggatgactttgaggaggccaaggagatcctgaccaagatgagatacttcagcaacatcgaggagaagatcaagctgaagaagatccccctgtag

SEQ ID NO: 18250 - DNA, 2010 bp, Artificial Sequence
  Description of Artificial Sequence: Synthetic coding sequence
atggccacagagaggagccgcagcgccatggacagccctgtgcctgcctccatgtttgcccctgagcccagcagccctggggccgcccgggctgctgctgctgctgcccggctgcatggaggctttgacagcgactgcagtgaagatggagaggccctgaatggagagcctgagctggacctgaccagcaagctggtgctggtgagccccaccagcgagcagtatgacagcctgctgcggcagatgtgggagaggatggatgagggctgtggggagaccatctacgtgattggccagggcagtgatggaacagaatatggcctgtctgaggccgacatggaggccagctatgccaccgtgaagtccatggccgagcagattgaagcagatgtgatcctgctgcgggagcggcaggaggccggcggccgggtgcgggactacctggtgaggaagagggtgggggacaatgacttcctggaggtgcgggtggccgtggtgggcaatgtggatgctgggaagagcaccctgctgggcgtgctgacccacggggagctggacaatggccggggctttgcccggcagaagctgttccgccacaagcatgaaattgaaagtggccgcaccagctctgtgggcaatgacatcctgggctttgacagcgagggcaatgtggtgaacaagccagacagccatggaggcagcctggagtggaccaagatctgtgagaagagcaccaaggtgatcaccttcatcgacctggccggccacgagaagtacctgaagaccaccgtgtttggcatgacaggccacctgcctgacttctgcatgctgatggtgggcagcaatgccggcatcgtgggcatgaccaaggagcacctgggcctggccctggccctgaatgtgcctgtgtttgtggtggtgaccaagattgacatgtgcccagccaacatcctgcaggagaccctgaagctgctgcagaggctgctgaagagccctggctgcaggaagatccctgtgctggtgcagagcaaggatgatgtgattgtgacagccagcaacttcagcagcgagaggatgtgccccatcttccagatcagcaatgtgactggagagaacctggacctgctgaagatgttcctgaacctgctgagccccaggaccagctaccgggaggaggagcctgctgagttccagattgatgacacctacagcgtgcctggggtgggcaccgtggtgtctggcaccaccctgcggggcctcatcaagctgaatgacaccctgctgctgggccctgaccccctgggcaacttcctgagcattgctgtgaagagcatccacaggaagaggatgcctgtgaaggaggtgcggggcggccagacagccagctttgccctgaagaagatcaagaggagcagcatcaggaagggcatggtgatggtgagcccccggctgaacccccaggcctcctgggagtttgaggccgagatcctggtgctgcaccaccccaccaccatcagcccccgctaccaggccatggtgcactgcggcagcatccggcagacagccaccatcctgtccatggacaaggactgcctgaggactggagacaaggccaccgtgcacttccgcttcatcaagaccccagagtacctgcacatcgaccagaggctggtgttccgggagggccgcaccaaggctgtgggcaccatcaccaagctgctgcagaccaccaacaacagccccatgaacagcaagccccagcagatcaagatgcagagcaccaagaagggccccctgaccaagagagatgaaggaggccccagcggcggccctgctgtgggcgcccctcctcctggagatgaggccagctctgtgggcgccggccagcctgctgccagcagcaacctgcagccccagcccaagcccagcagcggcggcagaagaagaggaggccagaggcacaaggtgaagagccagggcgcctgtgtgaccccagccagcggctgctag

SEQ ID NO: 18251 - DNA, 1656 bp, Artificial Sequence
  Description of Artificial Sequence: Synthetic coding sequence
atggccgccccagccctgtcctggaggctgcccctgctgatcctgctgctgcccctggccacctcctgggccagcgctgctgtgaatggcaccagccagttcacctgcttctacaacagccgggccaacatcagctgtgtgtggagccaggatggagccctgcaggacaccagctgccaggtgcacgcctggccagacagaagacgctggaaccagacctgtgagctgctgcctgtgtcccaggcctcctgggcctgcaacctgatcctgggcgccccagacagccagaagctgaccaccgtggacatcgtgaccctgcgggtgctgtgccgggagggcgtgcgctggagggtgatggccatccaggacttcaagccctttgagaacctgcggctgatggcccccatcagcctgcaggtggtgcacgtggagacccaccgctgcaacatctcctgggagatcagccaggccagccactactttgagcggcacctggagtttgaggcccggaccctgagccctggccacacctgggaggaggcccccctgctgaccctgaagcagaagcaggagtggatctgcctggagaccctgaccccagacacccagtatgagttccaggtgcgggtgaagcccctgcagggcgagttcaccacctggagcccctggagccagcccctggccttccgcaccaagccagctgccctgggcaaggacaccatcccctggctgggccacctgctggtgggcctgagcggggccttcggcttcatcatcctggtgtacctgctgatcaactgcaggaacacaggcccctggctgaagaaggtgctgaagtgcaacaccccagaccccagcaagttcttcagccagctgagcagcgagcacggcggagatgtgcagaagtggctgagcagccccttccccagcagcagcttcagccctgggggcctggcccctgagatcagccccctggaggtgctggagcgggacaaggtgacccagctgctgctgcagcaggacaaggtgcctgagcccgccagcctgagcagcaaccacagcctgaccagctgcttcaccaaccagggctacttcttcttccacctgcctgatgccctggagattgaggcctgccaggtgtacttcacctatgacccctacagcgaggaggaccctgatgaaggagtggccggggcccccaccggcagcagcccccagcccctgcagcccctgagcggggaggatgatgcctactgcaccttccccagcagagatgacctgctgctcttcagccccagcctgctgggcggccccagcccccccagcacagcccctgggggcagcggggccggggaggagaggatgccacccagcctgcaggagcgggtgccccgggactgggacccccagcccctgggcccccccaccccaggagtgcctgacctggtggacttccagcccccacctgagctggtgctgcgggaggccggggaggaggtgcctgatgctggcccccgggagggcgtgtccttcccctggagccggcccccaggccagggcgagttccgggccctgaatgcccggctgcccctgaacacagatgcctacctgagcctgcaggagctgcagggccaggaccccacccacctggtgtag

SEQ ID NO: 18252 - DNA, 3516 bp, Artificial Sequence
  Description of Artificial Sequence: Synthetic coding sequence
atggagaacaacctgaagacctgccccaaggaggatggagactttgtgtctgacaagatcaagttcaagattgaggaggaggatgatgatggcatccccccagacagcctggagaggatggacttcaagtctgagcaggaggacatgaagcagacagacagcggcggggagagagctggcctgggcggcaccggctgcagctgcaagcccccaggcaagtacctgtctgctgagagtgaagatgattatggagccctcttcagccagtacagcagcaccctgtatgatgtggccatggaggccgtgacccagagcctgctgagcagcaggaacatgagcagcaggaagaagagccctgcctggaagcacttcttcatcagcccccgggacagcaccaaggccatctgcatgtactgtgtgaaggagttcagccggggcaagaatgagaaggacctgagcaccagctgcctgatgagacatgtgcggcgggcccaccccaccgtgctgatccaggagaatggatctgtgtctgctgtgtcctccttccccagccccagcctgctgctgcccccccagcctgcagatgctggggacctgagcaccatcctgagccccatcaagctggtgcagaaggtggccagcaagatccccagcccagaccgcatcacagaggagagcgtgtctgtggtgagcagcgaggagatcagcagtgacatgtctgtgtctgagaagtgtggccgggaggaggccctggtgggcagcagcccccacctgcctgccctgcactatgatgagcctgctgagaacctggccgagaagagcctgcccctgcccaagagcaccagcggcagcagaagaagatctgctgtgtggaagcacttctacctgagccccctggacaacagcaaggctgtgtgcatccactgcatgaatgagttcagccggggcaagaatggcaaggacctgggcaccagctgcctgatccgccacatgtggagggcccaccgggccatcgtgctgcaggagaatggaggcaccggcatcccccccctgtacagcaccccacccaccctgctgcccagcctgctgcccccagagggggagctgagctctgtgagcagcagccctgtgaagcctgtgcgggagagccccagcgccagcagcagcccagaccggctgacagaggacctgcagagccacctgaaccctggagatggcctgatggaggatgtggccgccttcagcagcagtgatgacatcggggaggccagcgccagcagccctgagaagcagcaggctgatggcctgagcccccggctgtttgaaagtggggccatcttccagcagaacaagaaggtgatgaagaggctgaagtctgaggtgtggcaccacttcagcctggcccccatggacagcctgaaggccgagtgccgctactgcggctgtgccatcagccggggcaagaagggagatgtgggcaccagctgcctgatgaggcacctgtacagaagacaccctgaggtggtgggcagccagaagggcttcctgggcgccagcctggccaacagcccctatgccaccctggccagcgctgagagcagcagcagcaagctgacagacctgcccaccgtggtgaccaagaacaaccaggtgatgtttcctgtgaacagcaagaagaccagcaagctgtggaaccacttcagcatctgcagcgctgacagcaccaaggtggtgtgcctgcactgcggccgcaccatcagccggggcaagaagcccaccaacctgggcaccagctgcctgctgcggcacctgcagcgcttccacagcaatgtgctgaagacagaggtgtctgaaacagcccggcccagcagcccagacaccagggtgccccggggcacagagctgagcggggccagcagctttgatgacaccaatgagaagttctatgacagccaccctgtggccaagaagatcaccagcctgattgctgagatgattgccctggacctgcagccctacagctttgtggacaacgtgggcttcaaccggctgctggagtacctgaagccccagtacagcctgcctgcccccagctacttcagcaggacagccatccctggcatgtatgacaacgtgaagcagatcatcatgagccacctgaaggaggccgagagcggggtcatccacttcaccagcggcatctggatgagcaaccagacccgggagtacctgaccctgacagcccactgggtgtcctttgagagccctgcccggccccgctgtgatgaccaccactgcagcgccctgctggatgtgtcccaggtggactgtgactacagcggcaacagcatccagaagcagctggagtgctggtgggaggcctgggtgaccagcacaggcctgcaggtgggcatcaccgtgacagacaatgccagcatcggcaagaccctgaatgaaggagagcacagctctgtgcagtgcttcagccacacagtgaacctgattgtgtctgaggccatcaagagccagaggatggtgcagaacctgctgagcctggccaggaagatctgtgagcgggtgcacaggagccccaaggccaaggagaagctggccgagctgcagcgggagtatgccctgccccagcaccacctgatccaggatgtgcccagcaagtggagcaccagcttccacatgctggagcggctgattgagcagaagagggccatcaatgagatgtctgtggagtgcaacttccgggagctgatcagctgtgaccagtgggaggtgatgcagagcgtgtgccgggccctgaagccctttgaggccgccagccgggagatgagcacccagatgagcaccctgagccaggtgatccccatggtgcacatcctgaacaggaaggtggagatgctgtttgaggagaccatgggcatcgacaccatgctgcggagcctgaaggaggccatggtgtcccggctgagcgccaccctgcatgacccccgctacgtgtttgccaccctgctggacccccgctacaaggccagcctcttcacagaggaggaggccgagcagtacaagcaggacctgatccgggagctggagctgatgaacagcaccagtgaagatgtggccgccagccaccgctgtgatgctggcagccccagcaaggacagcgctgctgaggagaacctgtggagcctggtggccaaggtgaagaagaaggacccccgggagaagctgcctgaggccatggtgctggcctacctggaggaggaggtgctggagcacagctgtgaccccctgacctactggaacctgaagaaggcctcctggccaggcctgagcgccctggccgtgcgcttcctgggctgccccccatccatcgtgcccagcgagaagctgttcaacacccccacagaaaatggcagcctgggccagagccggctgatgatggagcactttgagaagctgatcttcctgaaggtgaacctgcccctcatctacttccagtactag

SEQ ID NO: 18253 - DNA, 744 bp, Artificial Sequence
  Description of Artificial Sequence: Synthetic coding sequence
atgcagcccatcctgctgctgctggccttcctgctgctgcccagggcagatgctggggagatcatcggcggccacgaggccaagccccacagccggccctacatggcctacctgatgatctgggaccagaagagcctgaagagatgtggcggcttcctgatcagagatgactttgtgctgacagctgcccactgctggggcagcagcatcaacgtgaccctgggcgcccacaacatcaaggagcaggagcccacccagcagttcatccctgtgaagaggcccatcccccacccagcctacaaccccaagaacttcagcaatgacatcatgctgctgcagctggagaggaaggccaagaggaccagggctgtgcagcccctgcggctgcccagcaacaaggcccaggtgaagccaggccagacctgcagcgtggccggctggggccagacagcccccctgggcaagcacagccacaccctgcaggaggtgaagatgacagtgcaggaggacagaaaatgtgagagtgacctgcggcactactatgacagcaccatcgagctgtgtgtgggggaccctgagatcaagaagaccagcttcaagggggacagcggcggccccctggtgtgcaacaaggtggcccagggcatcgtgtcctatggaagaaataatggcatgccaccccgggcctgcaccaaggtgtcctcctttgtgcactggatcaagaagaccatgaagcgctactag

SEQ ID NO: 18254 - DNA, 1062 bp, Artificial Sequence
  Description of Artificial Sequence: Synthetic coding sequence
atggaggatggagtgctgaaggagggcttcctggtgaagaggggccacatcgtgcacaactggaaggcccgctggttcatcctgcggcagaacaccctggtgtactacaagctggagggcggccggcgggtgaccccacccaagggccgcatcctgctggatggctgcaccatcacctgcccctgcctggagtatgagaaccggcccctgctgatcaagctgaagacccagaccagcacagagtacttcctggaggcctgcagccgggaggagagagatgcctgggcctttgagatcaccggggccatccatgctggccagcccgggaaggtgcagcagctgcacagcctgaggaacagcttcaagctgcccccccacatcagcctgcaccgcatcgtggacaagatgcatgacagcaacacaggcatccgcagcagccccaacatggagcagggcagcacctacaagaagaccttcctgggcagcagcctggtggactggctgatcagcaacagcttcaccgccagccggctggaggccgtgaccctggcctccatgctgatggaggagaacttcctgcggcctgtgggcgtgcgctccatgggcgccatccgcagcggggacctggccgagcagttcctggatgacagcacagccctgtacacctttgctgagagctacaagaagaagatcagccccaaggaggagatcagcctgagcacagtggagctgtctggaacagtggtgaagcagggctacctggccaagcagggccacaagaggaagaactggaaggtgagaagatttgtgctgaggaaggaccctgccttcctgcactactatgaccccagcaaggaggagaacagacctgtgggcggcttcagcctgcggggcagcctggtgtctgccctggaggacaatggagtgcccactggagtgaagggaaatgtgcagggcaacctcttcaaggtgatcaccaaggatgacacccactactacatccaggccagcagcaaggccgagagagctgagtggattgaggccatcaagaagctgacctag

SEQ ID NO: 18255 - DNA, 2025 bp, Artificial Sequence
  Description of Artificial Sequence: Synthetic coding sequence
atggccgaggtgcctgaggactatgacagcggcccagatgaagatggagagctggagcctgagaggcctgagctgcccggcctgcacaagctgtatgaaaatgctgagccagacaccatggccaaggctgacagcaagctgcctgctgagatctaccaggagccccagcctgagacagaggaggaggacttcaaggagggggagccagattctgccaagaatgtgcagctgaagccaggcggcaccagccaggagggcatcgccaaggagagcaagagagatgtgcccagcgagacagagcccggcatccaccaggaggtgaagtctgagaccagccgggagatgggagagttcttcaaggacctggaggcccccatggatgagacccacaaggagagtgacctggagcccccagaggaggccaagcccaacgtgacagaagatgtgttcctggagagcgccatggagacagatcctgaccctgtgcccccaacagagaccatgtctgaggtgtctggggccaccgtgcgggagaggaacctggagctgctggaggaggagacagagcccggggtgcctgaggagagcctgcgggtgcagcacgaggagaccggcctggagcccccagagcagaccaagcaggacttccccagcgagaagctgggggagagcctggaggagacagacctgcagccccccaagatgaccaagccagagaccccagaggagacccagcgggagagcacagagaagaagaggacagagcccccagagcaggcccggctggagttcctggagaaggagcccaggaagagcagcgaggaggccggcctggagcccccagaggagacccagcctgaggtgcctgaggagatgcagaggaaggccacagaggagaagggcacagagctgcctgagaggaccaagccagacttcccagaccacaagcccaggaagagcacagatgaaaatgtgcctgagcccctggaggagatcaagctggagttccctgaggaggagagcaggaagaccaatgaggagaccatcctggagcagagcgagatgatgaagccagagagccctgaggagatcaggaagagcaatgagaagaagaacccccagcccccagaggagactggacctgtgctgccccaggagatcaacccccaggtggaggagaagacccagaccaagcccacagagaagatcctggagctgcctgatgagaccaagccccgggagacccacgtggagttcagcaaggaggacaggcctgagcccatcaagagcaagtacagcgtgggcaatgatgagctggagcaccgggagcccaagaggggcaagctgagcctgagtgacaagttcaggaaggagtactatgccctgggcagcctgcgggagagcgaggagagcatcggcacccactatgagttcctgcagcccctgcagaagctgctgaatgtgtctgaagaatgttcctacagcgaccccagcgagagccagacagagctgtctgaatttgtgcatgagaaggaggtggtggacctgagccaggagctgaaggagcgggtgtctgaagatgatgagacccagcctgagaagggcacagagctgcagtttgagcacctgaactgggaccctgaggaggtggccgagtggatcagccagctgggcttcccccagtacaaggagtgcttcatcaccaacttcatcagcggcaggaagctgatccacgtgaactgcagcaacctgccccagatgggcatcaccaactttgaggacatgaaggccatcagccgccacacccaggagctgctggagattgaggagcccctcttcaagaggagcatcagcctgccctacagagacatcatcggcctgtacctggagcagaagggccacacaggcatcaagagtgacagcctgaccctgtctgaatttgtgaaggctgctggcctgcaggactatgcccctgagatcacagccccagaagaaaatgaggagctgccctgcacagagccctag

SEQ ID NO: 18256 - DNA, 1689 bp, Artificial Sequence
  Description of Artificial Sequence: Synthetic coding sequence
atgaggcctgagcccggcggctgctgctgcagaagaacagtgcgggccaacggctgtgtggccaacggggaggtgagaaatggctacgtgcgcagcagcgctgctgctgctgctgctgctgctgctggccagatccaccacgtgacccagaatggaggcctgtacaagaggcccttcaatgaggcctttgaggagacccccatgctggtggccgtgctgacctacgtgggctacggcgtgctgaccctgtttggctacctgcgggacttcctgcgctactggagaattgagaagtgccaccacgccacagagcgggaggagcagaaggactttgtgtccctgtaccaggactttgagaacttctacaccaggaacctgtacatgaggatccgggacaactggaaccggcccatctgcagcgtgcctggggcccgggtggacatcatggagcggcagagccatgactacaactggagcttcaagtacacaggcaacatcatcaagggcgtcatcaacatgggcagctacaactacctgggctttgccaggaacacaggcagctgccaggaggccgccgccaaggtgctggaggagtatggagctggggtgtgcagcacccggcaggagatcggcaacctggacaagcatgaggagctggaggagctggtggcccgcttcctgggcgtggaggccgccatggcctacggcatgggctttgccaccaacagcatgaacatcccagccctggtgggcaagggctgcctgatcctgagtgatgagctgaaccacgccagcctggtgctgggcgcccggctgagcggggccaccatccgcatcttcaagcacaacaacatgcagagcctggagaagctgctgaaggatgccatcgtgtatggccagcccaggacccggcggccctggaagaagatcctgatcctggtggagggcatctacagcatggagggcagcatcgtgcggctgcctgaggtgattgccctgaagaagaagtacaaggcctacctgtacctggatgaggcccacagcattggagccctgggccccaccggccggggcgtggtggagtacttcggcctggaccctgaagatgtggatgtgatgatgggcaccttcaccaagagctttggagccagcggcggctacatcggcggcaagaaggagctgattgactacctgcggacccacagccacagcgctgtgtatgccaccagcctgagcccccctgtggtggagcagatcatcacctccatgaagtgcatcatgggccaggacggcaccagcctgggcaaggaatgtgtgcagcagctggccgagaacacccgctacttcagaagaaggctgaaggagatgggcttcatcatctatggaaatgaagacagccctgtggtgcccctgatgctgtacatgcctgccaagattggagccttcggccgggagatgctgaagagaaatattggagtggtggtggtgggcttccctgccacccccatcatcgagagccgggcccgcttctgcctgtctgctgcccacaccaaggagatcctggacacagccctgaaggagattgatgaggtgggggacctgctgcagctgaagtacagccgccaccggctggtgcccctgctggaccggccctttgatgagaccacctatgaggagacagaagattag

SEQ ID NO: 18257 - DNA, 2346 bp, Artificial Sequence
  Description of Artificial Sequence: Synthetic coding sequence
atgagcagcagcagccccaccggccagatcgccagcgctgctgacatcaagcaggagaatggcatggagagcgccagcgagggccaggaggcccaccgggaggtggccggcggcgctgctgtgggcctgagccccccagccccagcccccttccccctggagcctggagatgctgccacagctgctgcccgggtgtctggagaggagggcgctgtggccgctgctgctgctggagctgctgctgaccaggtgcagctgcacagcgagctgctgggccgccaccaccacgccgctgctgctgctgcccagacccccctggccttctccccagaccacgtggcctgtgtgtgtgaggccctgcagcagggcggcaacctggaccggctggcccgcttcctgtggagcctgccccagagcgacctgctgcggggaaatgaaagcctgctgaaggcccgggccctggtggccttccaccagggcatctacccagagctgtacagcatcctggagagccacagctttgagagcgccaaccaccccctgctgcagcagctgtggtacaaggcccgctacacagaggccgagcgggcccggggccggcccctgggcgctgtggacaagtaccgcctgcggaggaagttccccctgcccaggaccatctgggatggagaggagaccgtgtactgcttcaaggagaagagcagaaatgccctgaaggagctgtacaagcagaaccgctaccccagccctgctgagaagaggcacctggccaagatcaccggcctgagcctgacccaggtgagcaactggttcaagaacagacggcagagggacaggaaccccagcgagacccagagcaagtctgagagtgatggcaaccccagcacagaagatgagagcagcaagggccacgaggacctgagcccccaccccctgagcagcagcagtgatggcatcaccaacctgagcctgagcagccacatggagcctgtgtacatgcagcagattggaaatgccaagatcagcctgagcagcagcggcgtgctgctgaatggcagcctggtgcctgccagcaccagccctgtgttcctgaatggaaacagcttcatccagggccccagcggggtcatcctgaatggcctgaatgtgggcaacacccaggccgtggccctgaacccccccaagatgagcagcaacatcgtgtccaatggcatctccatgacagacatcctgggcagcaccagccaggatgtgaaggagttcaaggtgctgcagagcagcgccaacagcgccaccaccaccagctacagccccagcgtgcctgtgtccttccctggcctcatccccagcacagaggtgaagcgggagggcatccagacagtggccagccaggacggcggctctgtggtgaccttcaccacccctgtgcagatcaaccagtatggaattgtgcagatccccaacagcggggccaacagccagttcctgaatggcagcatcggcttcagccccctgcagctgccccctgtgtctgtggccgccagccagggcaacatctctgtgagcagcagcaccagtgatggcagcaccttcaccagcgagagcaccaccgtgcagcagggcaaggtgttcctgagcagcctggcccccagcgctgtggtgtacacagtgcccaacacaggccagaccatcggctctgtgaagcaggagggcctggagaggagcctggtgttcagccagctgatgcctgtgaaccagaatgcccaggtgaatgccaacctgagcagcgagaacatcagcggcagcggcctgcaccccctggccagcagcctggtgaatgtgagccccacccacaacttcagcctgagccccagcaccctgctgaaccccacagagctgaacagagacattgctgacagccagcccatgtctgcccctgtggccagcaagagcacagtgacctctgtgagcaacaccaactatgccaccctgcagaactgcagcctcatcaccggccaggacctgctgtctgtgcccatgacccaggccgccctgggggagatcgtgcccacagctgaggaccaggtgggccaccccagccctgctgtgcaccaggactttgtgcaggagcaccggctggtgctgcagagcgtggccaacatgaaggagaacttcctgagcaacagcgagagcaaggccaccagcagcctgatgatgctggacagcaagagcaaatatgtgctggatggcatggtggacacagtgtgtgaggacctggagacagacaagaaggagctggccaagctgcagacagtgcagctggatgaggacatgcaggacctgtag

SEQ ID NO: 18258 - DNA, 1392 bp, Artificial Sequence
  Description of Artificial Sequence: Synthetic coding sequence
atgggcaaggagaagacccacatcaacatcgtggtgattggacatgtggacagcggcaagagcaccaccaccggccacctgatctacaagtgtggcggcatcgacaagaggaccatcgagaagtttgagaaggaggccgctgagatgggcaagggcagcttcaagtatgcctgggtgctggacaagctgaaggccgagcgggagcggggcatcaccatcgacatcagcctgtggaagtttgagaccaccaagtactacatcaccatcattgatgcccctggccaccgggacttcatcaagaacatgatcaccggcaccagccaggccgactgtgctgtgctgattgtggccgccggcgtgggggagtttgaagctggcatcagcaagaatggccagacccgggagcacgccctgctggcctacaccctgggcgtgaagcagctgattgtgggcgtgaacaagatggacagcacagagcccgcctacagcgagaagagatatgatgagatcgtgaaggaggtgtctgcctacatcaagaagattggctacaacccagccaccgtgccctttgtgcccatcagcggctggcatggagacaacatgctggagcccagccccaacatgccctggttcaagggctggaaggtggagaggaaggagggcaatgccagcggcgtgtccctgctggaggccctggacaccatcctgccccccacccggcccacagacaagcccctgcggctgcccctgcaggatgtgtacaagattggaggcattggaacagtgcctgtgggccgggtggagaccggcatcctgcggcccggcatggtggtgacctttgcccctgtgaacatcaccacagaggtgaagtctgtggagatgcaccacgaggccctgtctgaggccctgcccggggacaacgtgggcttcaacgtgaagaatgtgtctgtgaaggacatcagaagaggaaatgtgtgtggggacagcaagagtgaccccccccaggaggccgcccagttcaccagccaggtgatcatcctgaaccaccctggccagatctctgctggctacagccctgtgattgactgccacacagcccacatcgcctgcaagtttgctgagctgaaggagaagattgacagaagaagtggcaagaagctggaggacaaccccaagagcctgaagtctggagatgctgccatcgtggagatggtgcctgggaagcccatgtgtgtggagagcttcagccagtacccacccctgggccgctttgctgtgcgggacatgaggcagacagtggccgtgggcgtcatcaagaatgtggagaagaagtctggaggagctgggaaggtgaccaagagcgcccagaaggcccagaaggccggcaagtag

SEQ ID NO: 18259 - DNA, 600 bp, Artificial Sequence
  Description of Artificial Sequence: Synthetic coding sequence
atggctgctgccaacaagggcaagtgcctgcccggggtggtgggcctggcccaggccctgcctgtgggccctggccggcgggccatcgctgctggcaacaagccccgggtgcgcagcatccgctttgctgctggccatgatgctgagggcagccacagccacgtgcactttgatgagaagctgcatgacagcgtggtgatggtgacccaggagagtgacagcagcttcctggtgaaggtgggcttcctgaagatcctgcacagatatgagatcaccttcaccctgccccctgtgcaccggctgagcaaggatgtgcgggaggcccctgtgcccagcctgcacctgaagctgctgtctgtggtgcctgtgcctgagggctacagcgtgaagtgtgagtacagcgcccacaaggagggcgtgctgaaggaggagatcctgctggcctgtgagggcggcaccggcacctgtgtgcgggtgacagtgcaggcccgggtgatggacagacaccacggcacccccatgctgctggatggagtgaagtgtgtgggcgctgagctggagtatgacagcgagcacagcgactggcacggctttgattag

SEQ ID NO: 18260 - DNA, 270 bp, Artificial Sequence
  Description of Artificial Sequence: Synthetic coding sequence
atgcagctgcaggccagcctgtccttcctgctgatcctgaccctgtgcctggagctgcggtctgagctggcccgggacaccatcaaggacctgctgcccaacgtgtgtgccttccccatggagaagggcccctgccagacctacatgacccgctggttcttcaactttgagaccggggagtgtgagctgtttgcctacggcggctgcggcggcaacagcaacaacttcctgaggaaggagaagtgtgagaagttctgcaagttcacctag

SEQ ID NO: 18261 - DNA, 1251 bp, Artificial Sequence
  Description of Artificial Sequence: Synthetic coding sequence
atgtctgaggctgatggcctgcggcagaggcggcccctgcggccccaggtggtgacagatgatgatggccaggcccctgaggccaaggatggcagcagcttcagcggccgggtcttccgggtgaccttcctgatgctggccgtgtccctgactgtgcccctgctgggcgccatgatgctgctggagagccccatcgacccccagcccctgtccttcaaggagccccccctgctgctgggcgtgctgcaccccaacaccaagctgcggcaggccgagcggctgtttgagaaccagctggtgggccctgagagcatcgcccacatcggagatgtgatgttcaccggcacagcagatggccgggtggtgaagctggagaatggagaaattgagaccatcgccaggtttggaagtggcccctgcaagaccagagatgatgagcctgtgtgtggccggcccctgggcatccgggccggccccaacggcaccctgtttgtggctgatgcctacaagggcctgtttgaggtgaacccctggaagcgggaggtgaagctgctgctgagcagcgagacccccatcgagggcaagaacatgagctttgtgaatgacctgactgtgacccaggacggcaggaagatctacttcacagacagcagcagcaagtggcagaggcgggactacctgctgctggtgatggagggcacagatgatggccgcctgctggagtatgacacagtgacccgggaggtgaaggtgctgctggaccagctgcgcttccccaacggggtgcagctgagccctgctgaggactttgtgctggtggccgagaccaccatggcccgcatccggcgggtgtatgtgtctggcctgatgaagggcggcgctgacctgtttgtggagaacatgcctggcttcccagacaacatccggcccagcagcagcggcggctactgggtgggcatgagcaccatccggcccaaccctggcttctccatgctggacttcctgtctgagcggccctggatcaagaggatgatcttcaagctgttcagccaggagaccgtgatgaagtttgtgccccgctacagcctggtgctggagctgagtgacagcggggccttccgccgcagcctgcatgaccctgatggcctggtggccacctacatcagcgaggtgcatgaacatgatggccacctgtacctgggcagcttccgcagccccttcctgtgccgcctgagcctgcaggccgtgtag

SEQ ID NO: 18262 - DNA, 870 bp, Artificial Sequence
  Description of Artificial Sequence: Synthetic coding sequence
atggtgggcgtgaagcctgtgggcagtgaccctgacttccagcctgagctgagcggggccggcagccggctggccgtggtgaagttcaccatgaggggctgcggcccctgcctgcgcatcgccccagccttcagctccatgagcaacaagtacccccaggccgtgttcctggaggtggatgtgcaccagtgccagggcacagctgccaccaacaacatcagcgccacccccaccttcctgttcttcaggaacaaggtgagaattgaccagtaccagggcgcagatgctgtgggcctggaggagaagatcaagcagcacctggagaatgaccccggcagcaatgaagacacagacatccccaagggctacatggacctgatgcccttcatcaacaaggccggctgtgagtgcctgaatgaaagtgatgagcacggctttgacaactgcctgaggaaggacaccaccttcctggagagtgactgtgatgagcagctgctgatcaccgtggccttcaaccagcctgtgaagctgtacagcatgaagttccagggccctgacaatggccagggccccaagtatgtgaagatcttcatcaacctgcccaggtccatggactttgaggaggccgagaggtctgagcccacccaggccctggagctgacagaagatgacatcaaggaggatggcatcgtgcccctgcgctacgtgaagttccagaatgtgaacagcgtgaccatctttgtgcagagcaaccagggcgaggaggagaccacccgcatctcctacttcaccttcatcggcacccctgtgcaggccaccaacatgaatgacttcaagagggtggtgggcaagaagggggagagccactag

SEQ ID NO: 18263 - DNA, 1164 bp, Artificial Sequence
  Description of Artificial Sequence: Synthetic coding sequence
atggtgtttgccttctggaaggtgttcctgatcctgagctgcctggccggccaggtgtctgtggtgcaggtgaccatcccagatggctttgtgaatgtgacagtgggcagcaatgtgaccctcatctgcatctacaccaccaccgtggccagccgggagcagctgagcatccagtggagcttcttccacaagaaggagatggagcccatcagcatctacttcagccagggcggccaggccgtggccatcggccagttcaaggaccgcatcaccggcagcaatgaccctggaaatgccagcatcaccatcagccacatgcagcctgctgacagcggcatctacatctgtgatgtgaacaaccccccagacttcctgggccagaaccagggcatcctgaatgtgtctgtgctggtgaagcccagcaagcccctgtgcagcgtgcagggccggcctgagaccggccacaccatcagcctgagctgcctgagcgccctgggcacccccagccctgtgtactactggcacaagctggagggccgggacatcgtgcctgtgaaggagaacttcaaccccaccaccggcatcctggtgattggcaacctgaccaactttgagcagggctactaccagtgcacagccatcaaccggctgggcaacagcagctgtgaaattgacctgaccagcagccaccctgaggtgggcatcatcgtgggcgccctgattggcagcctggtgggcgccgccatcatcatctctgtggtgtgctttgccaggaacaaggccaaggccaaggccaaggagaggaacagcaagaccatcgccgagctggagcccatgaccaagatcaaccccagaggagagagcgaggccatgccccgggaggatgccacccagctggaggtgaccctgcccagcagcatccacgagaccggccctgacaccatccaggagccagactatgagcccaagcccacccaggagcccgcccctgagcccgcccctggcagcgagcccatggctgtgcctgacctggacatcgagctggagctggagcctgagacccagagcgagctggagcctgagcctgagcctgagcctgagagcgagcccggggtggtggtggagcccctgtctgaagatgagaagggcgtggtgaaggcctag

SEQ ID NO: 18264 - DNA, 1821 bp, Artificial Sequence
  Description of Artificial Sequence: Synthetic coding sequence
atgtctgacaccagcgagagcggggccggcctgacccgcttccaggccgaggccagcgagaaggacagcagctccatgatgcagaccctgctgactgtgacccagaatgtggaggtgcctgagacccccaaggccagcaaggccctggaggtgtctgaagatgtgaaggtgtccaaggccagcggcgtgtccaaggccacagaggtgtccaagaccccagaggcccgggaggccccagccacccaggccagcagcaccacccagctgacagacacccaggtgctggccgctgagaacaagagcctggccgctgacaccaagaagcagaatgctgacccccaggccgtgaccatgcctgccacagagaccaagaaggtgagccacgtggccgacaccaaggtgaacaccaaggcccaggagacagaagctgcccccagccaggccccagcagatgagcctgagcctgagagcgctgctgcccagagccaggagaaccaggacacccggcccaaggtgaaggccaagaaggccaggaaggtgaagcacctggatggagaagaagatggcagcagtgaccagagccaggccagcggcaccaccggcggcagaagagtgtccaaggccctgatggcctccatggcccggcgggccagccggggccccatcgccttctgggcccggcgggccagcaggacccggctggccgcctgggcccggcgggccctgctgagcctgcggagccccaaggcccggcggggcaaggccaggagaagagctgccaagctgcagagcagccaggagcctgaggcccccccaccaagagatgtggccctgctgcagggccgggccaatgacctggtgaagtacctgctggccaaggaccagaccaagatccccatcaagagaagtgacatgctgaaggacatcatcaaggagtacacagatgtgtacccagagatcatcgagcgggccggctacagcctggagaaggtgtttggcatccagctgaaggagattgacaagaatgaccacctgtacatcctgctgagcaccctggagcccacagatgctggcatcctgggcaccaccaaggacagccccaagctgggcctgctgatggtgctgctgagcatcatcttcatgaatggaaacagaagcagcgaggccgtcatctgggaggtgctgaggaagctgggcctgcggcccggcatccaccacagcctgtttggagatgtgaagaagctgatcacagatgaatttgtgaagcagaagtacctggactatgcccgggtgcccaacagcaaccccccagaatatgagttcttctggggcctgcggagctactatgagaccagcaagatgaaggtgctgaagtttgcctgcaaggtgcagaagaaggaccccaaggagtgggccgcccagtaccgggaggccatggaggccgacctgaaggctgctgctgaggccgctgctgaggccaaggcccgggcagagatccgggccaggatgggcatcggcctgggctctgaaaatgctgctggcccctgcaactgggatgaagctgacatcggcccctgggccaaggcccgcatccaggccggggctgaggccaaggccaaggcccaggagagcggcagcgccagcactggagccagcaccagcaccaacaacagcgccagcgccagcgccagcaccagcggcggcttctctgctggggccagcctgacagccaccctgaccttcggcctgtttgctggcctgggcggggccggggccagcaccagcggcagcagcggggcctgtggcttctcctacaagtag

SEQ ID NO: 18265 - DNA, 369 bp, Artificial Sequence
  Description of Artificial Sequence: Synthetic coding sequence
atgaccacagccacccggcaggaggtgctgggcctgtaccgcagcatcttccggctggccaggaagtggcaggccaccagcggccagatggaggacaccatcaaggagaagcagtacatcctgaatgaggcccggaccctcttcaggaagaacaagaacctgacagacacagacctgatcaagcagtgcattgatgagtgcacagccagaattgaaattggcctgcactacaagatcccctacccccggcccatccacctgccccccatgggcctgacccccctgcggggccggggcctgcggagccaggagaagctgaggaagctgagcaagcctgtgtacctgcggagccatgatgaggtgtcctag

SEQ ID NO: 18266 - DNA, 582 bp, Artificial Sequence
  Description of Artificial Sequence: Synthetic coding sequence
atgctgggcgtgctggagctgctgctgctgggcgccgcctggctggccggccctgcccggggccagaatgaaacagagcccatcgtgctggagggcaagtgcctggtggtgtgtgacagcaaccccaccagtgaccccactggaacagccctgggcatctctgtgcgcagcggcagcgccaaggtggccttcagcgccatccgcagcaccaaccacgagcccagcgagatgagcaacagaaccatgatcatctactttgaccaggtgctggtgaacatcggcaacaactttgattctgagaggagcaccttcatcgcccccaggaagggcatctacagcttcaacttccacgtggtgaaggtgtacaaccggcagaccatccaggtgtccctgatgctgaatggctggcctgtgatcagcgcctttgctggggaccaggatgtgacccgggaggccgccagcaatggagtgctgatccagatggagaagggggaccgggcctacctgaagctggagcggggcaacctgatgggcggctggaagtacagcaccttcagcggcttcctggtgttccccctgtag

SEQ ID NO: 18267 - DNA, 1578 bp, Artificial Sequence
  Description of Artificial Sequence: Synthetic coding sequence
atgagccggcagctgctgcctgtgctgctgctgctgctgctgcgggccagctgcccctggggccaggagcagggcgcccggagccccagcgaggagcccccagaggaggagatccccaaggaggatggcatcctggtgctgagccgccacaccctgggcctggccctgcgggagcacccagccctgctggtggagttctacgccccctggtgtggccactgccaggccctggcccctgagtacagcaaggctgctgctgtgctggccgctgagagcatggtggtgaccctggccaaggtggatggccctgcccagcgggagctggccgaggagtttggagtgacagagtaccccaccctgaagttcttcagaaatggaaacagaacccaccctgaggagtacacaggccccagagatgctgagggcattgctgagtggctgcggaggagagtgggccccagcgccatgaggctggaggatgaggccgccgcccaggccctgattggaggccgggacctggtggtgattggcttcttccaggacctgcaggatgaagatgtggccaccttcctggccctggcccaggatgccctggacatgaccttcggcctgacagaccggcccaggctcttccagcagtttggcctgaccaaggacacagtggtgctcttcaagaagtttgatgagggccgggctgacttccctgtggatgaggagctgggcctggacctgggggacctgagccgcttcctggtgacccacagcatgaggctggtgacagagttcaacagccagaccagcgccaagatctttgctgcccgcatcctgaaccacctgctgctgtttgtgaaccagaccctggccgcccaccgggagctgctggccggctttggagaggccgccccccgcttccggggccaggtgctgtttgtggtggtggatgtggccgctgacaatgaacatgtgctgcagtacttcggcctgaaggccgaggccgcccccaccctgcggctggtgaacctggagaccaccaagaagtatgcccctgtggatggcggccctgtgacagctgccagcatcacagccttctgccacgctgtgctgaatggccaggtgaagccctacctgctgagccaggagatccccccagactgggaccagaggcctgtgaagaccctggtgggcaagaactttgagcaggtggcctttgatgagaccaagaatgtgtttgtgaagttctacgccccctggtgcacccactgcaaggagatggccccagcctgggaggccctggccgagaagtaccaggaccacgaggacatcatcatcgccgagctggatgccacagccaatgagctggatgcctttgctgtgcacggcttccccaccctgaagtacttccctgctggccctggcaggaaggtgattgagtacaagagcacccgggacctggagaccttcagcaagttcctggacaatggaggagtgctgcccacagaggagcccccagaggagcctgctgcccccttccctgagcccccagccaacagcaccatgggcagcaaggaggagctgtag

SEQ ID NO: 18268 - DNA, 2262 bp, Artificial Sequence
  Description of Artificial Sequence: Synthetic coding sequence
atggctgacaagaggaagctgcagggcgagattgaccgctgcctgaagaaggtgtctgaaggagtggagcagtttgaggacatctggcagaagctgcacaatgctgccaatgccaaccagaaggagaagtatgaggccgacctgaagaaggagatcaagaagctgcagaggctgcgggaccagatcaagacctgggtggccagcaatgagatcaaggacaagaggcagctgattgacaacaggaagctgattgagacccagatggagcgcttcaaggtggtggagcgggagaccaagaccaaggcctacagcaaggagggcctgggcctggcccagaaggtggaccctgcccagaaggagaaggaggaggtgggccagtggctgaccaacaccatcgacaccctgaacatgcaggtggaccagtttgagagcgaggtggagagcctgtctgtgcagaccaggaagaagaagggggacaaggacaagcaggaccgcatcgagggcctgaagaggcacatcgagaagcaccgctaccacgtgaggatgctggagaccatcctgaggatgctggacaatgacagcatcctggtggatgccatcaggaagatcaaggatgatgtggagtactacgtggacagcagccaggaccctgactttgaagaaaatgagttcctgtatgatgacctggacctggaggacatcccccaggccctggtggccaccagcccccccagccacagccacatggaggatgagatcttcaaccagagcagcagcacccccaccagcaccaccagcagcagccccatcccccccagccctgccaactgcaccacagagaacagtgaagatgacaagaagaggggccgcagcacagacagcgaggtgtcccagagccctgccaagaatggcagcaagcctgtgcacagcaaccagcacccccagagccctgctgtgccccccacctaccccagcggccccccacctgctgccagcgccctgagcaccaccccaggcaacaatggagtgcctgccccagctgcccctccttctgccctgggccccaaggccagccctgcccccagccacaacagcggcaccccagccccctatgcccaggccgtggcccccccagcccccagcggccccagcaccacccagccccggccccccagcgtgcagcccagcggcggcggcggcggcggcagcggcggcggcggcagcagcagcagcagcaacagcagcgctgggggcggggccggcaagcagaatggagccaccagctacagctctgtggtggccgacagccctgctgaggtggccctgagcagcagcggcggcaacaatgccagcagccaggccctgggccccccatctggcccccacaaccccccacccagcaccagcaaggagcccagcgctgctgcccccaccggggccggcggcgtggcccctggcagcggcaacaacagcggcggccccagcctgctggtgcccctgcctgtgaacccccccagcagccccacccccagcttcagtgatgccaaggccgccggggccctgctgaatggaccaccccagttcagcacagcccctgagatcaaggcccctgagcccctgagcagcctgaagtccatggccgagcgggccgccatcagcagcggcattgaagatcctgtgcccaccctgcacctgacagagcgggacatcatcctgagcagcaccagcgcccccccagccagcgcccagccccccctgcagctgtctgaggtgaacatccccctgagcctgggcgtgtgccccctgggccctgtgcccctgaccaaggagcagctgtaccagcaggccatggaggaggccgcctggcaccacatgccccaccccagcgacagcgagcgcatccggcagtacctgcccaggaacccctgccccaccccaccctaccaccaccagatgcccccaccccacagcgacacagtggagttctaccagaggctgagcacagagaccctcttcttcatcttctactacctggagggcaccaaggcccagtacctggccgccaaggccctgaagaagcagagctggaggttccacaccaagtacatgatgtggttccagagacatgaggagcccaagaccatcacagatgaatttgagcagggcacctacatctactttgattatgagaagtggggccagaggaagaaggagggcttcacctttgagtaccgctacctggaggaccgggacctgcagtag

SEQ ID NO: 18269 - DNA, 1146 bp, Artificial Sequence
  Description of Artificial Sequence: Synthetic coding sequence
atgccctttggaaacacccacaacaagttcaagctgaactacaagccagaggaggagtacccagacctgagcaagcacaacaaccacatggccaaggtgctgaccctggagctgtacaagaagctgcgggacaaggagaccccatctggcttcaccgtggatgatgtgatccagacaggagtggacaaccctggccaccccttcatcatgacagtgggctgtgtggccggagatgaggagagctatgaggtgttcaaggagctgtttgaccccatcatcagtgacagacatggaggctacaagcccacagacaagcacaagacagacctgaaccacgagaacctgaagggaggagatgacctggaccccaactacgtgctgagcagccgggtgaggacaggccgcagcatcaagggctacaccctgcccccccactgcagcagaggagagaggagagctgtggagaagctgtctgtggaggccctgaacagcctgaccggggagttcaagggcaagtactaccccctgaagtccatgacagagaaggagcagcagcagctgattgatgaccacttcctgtttgacaagcctgtgagccccctgctgctggccagcggcatggcccgggactggccagatgcccggggcatctggcacaatgacaacaagagcttcctggtgtgggtgaatgaggaggaccacctgcgggtcatctccatggagaagggcggcaacatgaaggaggtgttccgccgcttctgtgtgggcctgcagaagattgaggagatcttcaagaaggccggccaccccttcatgtggaaccagcacctgggctacgtgctgacctgccccagcaacctgggcaccggcctgcggggcggcgtgcacgtgaagctggcccacctgagcaagcaccccaagtttgaggagatcctgacccggctgcggctgcagaagaggggcaccggcggcgtggacacagctgctgtgggctctgtgtttgatgtgtccaatgctgaccggctgggcagcagcgaggtggagcaggtgcagctggtggtggatggagtgaagctgatggtggagatggagaagaagctggagaagggccagagcattgatgacatgatcccagcccagaagtag

SEQ ID NO: 18270 - DNA, 300 bp, Artificial Sequence
  Description of Artificial Sequence: Synthetic coding sequence
atggcccagggccagaggaagttccaggcccacaagccagccaagagcaagacagctgctgctgccagcgagaagaacagaggccccaggaaaggaggccgggtcatcgcccccaagaaggcccgggtggtgcagcagcagaagctgaagaagaacctggaggtgggcatcaggaagaagattgaacatgatgtggtgatgaaggccagcagcagcctgcccaagaagctggccctgctgaaggccccagccaagaagaagggagctgctgctgccaccagcagcaagacccccagctag

SEQ ID NO: 18271 - DNA, 1491 bp, Artificial Sequence
  Description of Artificial Sequence: Synthetic coding sequence
atggatgatgtgcctgcccccaccccagccccagcccctcctgctgctgctgccccccgggtgcccttccactgcagtgaatgtgggaagagcttccgctacagaagtgacctgcggcggcactttgcccggcacacagccctgaagccccacgcctgcccccgctgtgggaagggcttcaagcacagcttcaacctggccaaccacctgcggagccacactggagagcggccctaccgctgcagcgcctgccccaagggcttccgggacagcacaggcctgctgcaccaccaggtggtgcacactggagagaagccctactgctgcctggtgtgtgagctgcgcttcagcagccgcagcagcctgggccgccacctgaagaggcagcaccggggcgtgctgcccagccccctgcagcccggccctggcctgcctgccctgagcgccccctgcagcgtgtgctgcaatgtgggcccctgcagcgtgtgtggcggcagcggggccggcggcggggagggccctgagggcgctggggccggcctgggctcctggggcctggccgaggccgctgctgctgctgctgccagcctgcccccatttgcctgtggggcctgtgccaggagatttgaccacggccgggagctggccgcccactgggccgcccacacagatgtgaagcccttcaagtgcccccgctgtgagcgggacttcaatgccccagccctgctggagcggcacaagctgacccatgacctgcagggccctggggcccccccagcccaggcctgggccgccggccctggagctggccctgagacagctggggagggcacagctgctgaggccggagatgcccccctggccagtgaccggcggctgctgctgggccctgctgggggcggcgtgcccaagctgggcggcctgctgcctgagggcggcggggaggccccagccccagctgctgctgctgagcccagcgaggacaccctgtaccagtgtgactgtggcaccttctttgccagcgctgctgccctggccagccacctggaggcccacagcggccctgccacctacggctgcggccactgtggggccctgtatgctgccctggccgccctggaggagcacagaagagtgtcccatggagagggcggcggggaggaggccgccacagctgcccgggagcgggagcccgccagcggggagcccccatctggcagcggccggggcaagaagatcttcggctgcagtgaatgtgagaagctgttccgcagcccccgggacctggagcggcacgtgctggtgcacactggagagaagcccttcccctgcctggagtgtgggaagttcttcagacatgagtgctacctgaagaggcaccggctgctgcacggcacagagcggcccttcccctgccacatctgtgggaagggcttcatcaccctgagcaacctgagccgccacctgaagctgcaccggggcatggactag

SEQ ID NO: 18272 - DNA, 663 bp, Artificial Sequence
  Description of Artificial Sequence: Synthetic coding sequence
atgaagagcgtcatctaccacgccctgagccagaaggaggccaatgacagtgatgtgcagcccagcggggcccagagagctgaggcctttgtgcgggccttcctgaagaggagcacccccaggatgagcccccaggcccgggaggaccagctgcagaggaaggctgtggtgctggagtacttcaccaggcacaagaggaaggagaagaagaagaaggccaagggcctgagcgcccggcagaggcgggagctgcggctgtttgacatcaagccagagcagcagcgctacagcctcttcctgcccctgcacgagctgtggaagcagtacatccgggacctgtgcagcggcctgaagccagacacccagccccagatgatccaggccaagctgctgaaggctgacctgcacggggccatcatctctgtgaccaagagcaagtgccccagctatgtgggcatcaccggcatcctgctgcaggagaccaagcacatcttcaagatcatcaccaaggaggaccggctgaaggtgatccccaagctgaactgtgtgttcaccgtggagacagatggcttcatctcctacatctacggcagcaagttccagctgcggagcagcgagaggtctgccaagaagttcaaggccaagggcaccatcgacctgtag

SEQ ID NO: 18273 - DNA, 768 bp, Artificial Sequence
  Description of Artificial Sequence: Synthetic coding sequence
atggcccgggccaaggccctgctgggcggccctggagaggagctggaggccgacacagagtacctggacccctttgatgcccagccccacccagcccccccagatgatggctacatggagccctatgatgcccagtgggtgatgtctgagctgcccggccggggcgtgcagctgtatgacaccccctatgaggagcaggaccctgagacagcagatggcccccccagcggccagaagccccggcagagcaggatgccccaggaggatgagaggcctgcagatgaatatgaccagccctgggagtggaagaaggaccacatcagccgggcctttgctgtgcagtttgacagccctgagtgggagaggaccccaggcagcgccaaggagctgcggcggcccccacccaggagcccccagcctgctgagcgggtggaccctgccctgcccctggagaagcagccctggttccacggccccctgaacagagcagatgctgagagcctgctgagcctgtgcaaggagggcagctacctggtgcggctgtctgagaccaacccccaggactgcagcctgagcctgcggagcagccagggcttcctgcacctgaagtttgcccggacccgggagaaccaggtggtgctgggccagcacagcggccccttccccagcgtgcctgagctggtgctgcactacagcagccggcccctgcctgtgcagggcgctgagcacctggccctgctgtaccctgtggtgacccagaccccctag

SEQ ID NO: 18274 - DNA, 858 bp, Artificial Sequence
  Description of Artificial Sequence: Synthetic coding sequence
atgtctgatgacttcctgtggtttgagggcatcgccttccccaccatgggcttccgctctgagaccctgaggaaggtgagagatgaatttgtgatcagagatgaagatgtgatcatcctgacctaccccaagagcggcaccaactggctggccgagatcctgtgcctgatgcacagcaaaggagatgccaagtggatccagagcgtgcccatctgggagaggagcccctgggtggagagcgagatcggctacacagccctgtctgaaacagagagccccaggctcttcagcagccacctgcccatccagctgttccccaagagcttcttcagcagcaaggccaaggtgatctacctgatgaggaaccccagagatgtgctggtgtctggctacttcttctggaagaacatgaagttcatcaagaagcccaagtcctgggaggagtactttgagtggttctgccagggcaccgtgctgtatggctcctggtttgaccacatccacggctggatgcccatgagggaggagaagaacttcctgctgctgtcctatgaggagctgaagcaggacaccggccgcaccatcgagaagatctgccagttcctgggcaagaccctggagcctgaggagctgaacctgatcctgaagaacagcagcttccagagcatgaaggagaacaagatgagcaactacagcctgctgtctgtggactatgtggtggacaaggcccagctgctgaggaagggcgtgtctggggactggaagaaccacttcaccgtggcccaggccgaggactttgacaagctgttccaggagaagatggctgacctgccccgggagctgttcccctgggagtag

SEQ ID NO: 18275 - DNA, 1647 bp, Artificial Sequence
  Description of Artificial Sequence: Synthetic coding sequence
atgaagaccccagctgacaccggctttgccttcccagactgggcctacaagccagagagcagccctggcagccggcagatccagctgtggcacttcatcctggagctgctgaggaaggaggagtaccagggcgtcatcgcctggcagggcgactatggagaatttgtgatcaaggaccctgatgaggtggcccggctgtggggcgtgaggaagtgcaagccccagatgaactatgacaagctgagccgggccctgcgctactactacaacaagaggatcctgcacaagaccaagggcaagcgcttcacctacaagttcaacttcaacaagctggtgctggtgaactaccccttcattgatgtgggcctggccggcggcgctgtgccccagagcgcccctcctgtgcccagcggcggcagccacttccgcttcccccccagcacccccagcgaggtgctgagccccacagaggaccccaggagccccccagcctgcagcagcagcagcagcagcctcttctctgctgtggtggcccggcggctgggccggggctctgtgtctgactgcagtgatggcaccagcgagctggaggagcccctgggggaggacccccgggcccggcccccaggccccccagacctgggcgccttccggggcccccccctggcccggctgccccatgaccccggggtcttccgggtgtacccccggccccggggcggccctgagcccctgagccccttccctgtgagccccctggccggccctggcagcctgctgcccccccagctgagccctgccctgcccatgacccccacccacctggcctacacccccagccccaccctgagccccatgtaccccagcggcggcggcggccccagcggcagcggcggcggcagccacttctccttcagccctgaggacatgaagcgctacctgcaggcccacacccagagcgtgtacaactaccacctgagcccccgggccttcctgcactacccaggcctggtggtgccccagccccagaggccagacaagtgccccctgccccccatggcccctgagaccccacctgtgcccagcagcgccagcagcagcagcagcagcagcagcagccccttcaagttcaagctgcagcccccacccctgggccggcggcagagagctgctggggagaaggctgtggccggggctgacaagagcggcggcagcgctgggggcctggccgagggcgctggggccctggcccctcctcctcctccaccccagatcaaggtggagcccatcagcgagggggagagcgaggaggtggaggtgacagacatcagtgatgaagatgaagaagatggagaggtgttcaagaccccccgggcccccccagccccacccaagccagagcccggggaggcccctggggccagccagtgcatgcccctgaagctgcgcttcaagaggcgctggagcgaggactgccgcctggagggcggcggcggccctgctgggggctttgaagatgaaggagaggacaagaaggtgcggggggagggccctggagaggccggcggccccctgaccccccggcgggtgtccagtgacctgcagcacgccacagcccagctgagcctggagcaccgggacagctag

SEQ ID NO: 18276 - DNA, 1530 bp, Artificial Sequence
  Description of Artificial Sequence: Synthetic coding sequence
atgggcgtgctgaagttcaagcacatcttcttccgcagctttgtgaagagcagcggcgtgtcccagatcgtgttcaccttcctgctgatcccctgctgcctgaccctgaacttccgggcccctcctgtgatccccaacgtgcccttcctgtgggcctggaatgcccccagcgagttctgcctgggcaagtttgatgagcccctggacatgagcctcttctccttcatcggcagcccccgcatcaatgccaccggccagggcgtgaccatcttctacgtggaccggctgggctactacccctacatcgacagcatcaccggggtgacagtgaatggaggcatcccccagaagatcagcctgcaggaccacctggacaaggccaagaaggacatcaccttctacatgcctgtggacaacctgggcatggctgtgattgactgggaggagtggaggcccacctgggccaggaactggaagcccaaggatgtgtacaagaacagaagcattgagctggtgcagcagcagaatgtgcagctgagcctgacagaggccacagagaaggccaagcaggagtttgagaaggccggcaaggacttcctggtggagaccatcaagctgggcaagctgctgcggcccaaccacctgtggggctactacctgttcccagactgctacaaccaccactacaagaagccaggctacaacggcagctgcttcaacgtggagatcaagagaaatgatgacctgtcctggctgtggaatgaaagcacagccctgtaccccagcatctacctgaacacccagcagagccctgtggccgccaccctgtatgtgaggaacagagtgcgggaggccatccgggtgtccaagatcccagatgccaagagccccctgcctgtgtttgcctacacccgcatcgtgttcacagaccaggtgctgaagttcctgagccaggatgagctggtgtacacctttggagagaccgtggccctgggcgccagcggcatcgtcatctggggcaccctgagcatcatgaggtccatgaagagctgcctgctgctggacaactacatggagaccatcctgaacccctacatcatcaacgtgaccctggccgccaagatgtgcagccaggtgctgtgccaggagcagggcgtgtgcatcaggaagaactggaacagcagtgactacctgcacctgaacccagacaactttgccatccagctggagaagggcggcaagttcaccgtgcggggcaagcccaccctggaggacctggagcagttcagcgagaagttctactgcagctgctacagcaccctgagctgcaaggagaaggcagatgtgaaggacacagatgctgtggatgtgtgcatcgcagatggagtgtgcattgatgccttcctgaagccacccatggagacagaggagccccagatcttctacaatgccagccccagcaccctgagcgccaccatgtttattgtgtccatcctcttcctgatcatcagctctgtggccagcctgtag

SEQ ID NO: 18277 - DNA, 1041 bp, Artificial Sequence
  Description of Artificial Sequence: Synthetic coding sequence
atggagacccagctgagcaatggccccacctgcaacaacacagccaacggccccaccaccatcaacaacaactgcagcagccctgtggacagcggcaacacagaggacagcaagaccaacctgattgtgaactacctgccccagaacatgacccaggaggagctgaagagcctgtttggcagcatcggggagattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgacaggcatcagcagaggagtgggcttcatccgctttgacaagagaattgaagctgaggaggccatcaagggcctgaatggccagaagcccccaggggccacagagcccatcaccgtgaagtttgccaacaaccccagccagaagaccaaccaggccatcctgagccagctgtaccagagccccaacagacgctacccaggccccctggcccagcaggcccagcgcttccgcttcagccccatgaccattgatggcatgaccagcctggccggcatcaacatccctggccaccctggcaccggctggtgcatctttgtgtacaacctggccccagatgctgatgagagcatcctgtggcagatgtttggcccctttggagctgtgaccaacgtgaaggtgatccgggacttcaacaccaacaagtgcaagggcttcggctttgtgaccatgaccaactatgatgaagctgccatggccatcgccagcctgaatggctaccgcctgggggacagagtgctgcaggtgtccttcaagaccaacaagacccacaaggcctag

SEQ ID NO: 18278 - DNA, 1437 bp, Artificial Sequence
  Description of Artificial Sequence: Synthetic coding sequence
atggcccacgtgcctgcccggaccagccctggccctggcccccagctgctgctgctgctgctgcccctcttcctgctgctgctgagagatgtggccggcagccaccgggccccagcctggagcgccctgcctgctgctgctgatggcctgcagggcgaccgggacctgcagaggcaccctggagatgctgctgccaccctgggccccagcgcccaggacatggtggccgtgcacatgcaccggctgtatgagaagtacagccggcagggcgcccggcctgggggcggcaacacagtgcgctccttccgggcccggctggaggtggtggaccagaaggctgtgtacttcttcaacctgacctccatgcaggacagcgagatgatcctgacagccaccttccacttctacagcgagcccccacgctggccccgggccctggaggtgctgtgcaagccccgggccaagaatgccagcggccggcccctgcccctgggcccccccacccggcagcacctgctcttccgcagcctgagccagaacacagccacccagggcctgctgcggggggccatggccctggcccccccaccccggggcctgtggcaggccaaggacatcagccccatcgtgaaggccgccaggagagatggagagctgctgctgagcgcccagctggacagcgaggagcgggaccccggggtgccccggcccagcccctatgccccctacatcctggtgtatgccaatgacctggccatcagcgagcccaacagcgtggccgtgaccctgcagagatatgaccccttccctgctggggaccctgagccccgggccgcccccaacaacagcgctgacccccgggtgagaagagctgcccaggccaccggccccctgcaggacaatgagctgcccggcctggatgagcggcccccccgggcccacgcccagcacttccacaagcaccagctgtggcccagccccttccgggccctgaagcccaggcctggcaggaaggacaggaggaagaagggccaggaggtgttcatggccgccagccaggtgctggactttgatgagaagaccatgcagaaggcccggaggaagcagtgggatgagccccgggtgtgcagccgccgctacctgaaggtggactttgctgacatcggctggaatgagtggatcatcagccccaagagctttgatgcctactactgtgccggggcctgtgagttccccatgcccaagatcgtgcggcccagcaaccacgccaccatccagagcatcgtgcgggctgtgggcatcatccctggcatccctgagccctgctgcgtgcctgacaagatgaacagcctgggcgtgctcttcctggatgagaacagaaatgtggtgctgaaggtgtaccccaacatgtctgtggacacctgtgcctgcaggtag

SEQ ID NO: 18279 - DNA, 978 bp, Artificial Sequence
  Description of Artificial Sequence: Synthetic coding sequence
atggagagcaagatgggagagctgcccctggacatcaacatccaggagccccgctgggaccagagcaccttcctgggccgggcccggcacttcttcaccgtgacagaccccaggaacctgctgctgagcggggcccagctggaggccagcagaaatattgtgcagaactacagagctggggtggtgaccccaggcatcacagaggaccagctgtggagggccaagtatgtgtatgacagcgccttccacccagacaccggggagaaggtggtgctgattggaaggatgtctgcccaggtgcccatgaacatgaccatcaccggctgcatgctgaccttctacaggaagacccccaccgtggtgttctggcagtgggtgaaccagagcttcaatgccatcgtgaactacagcaacagaagtggggacacccccatcaccgtgcggcagctgggcacagcctacgtgtctgccaccactggagctgtggccacagccctgggcctgaagagcctgaccaagcacctgccccccctggtgggccgctttgtgccctttgctgctgtggccgccgccaactgcatcaacatccccctgatgaggcagcgggagctgcaggtgggcatccctgtggctgatgaggccggccagaggctgggctacagcgtgacagctgccaagcagggcatcttccaggtggtgatcagccgcatctgcatggccatcccagccatggccatccccccactcatcatggacaccctggagaagaaggacttcctgaagaggcggccctggctgggcgcccccctgcaggtgggcctggtgggcttctgcctggtgtttgccacccccctgtgctgtgccctcttcccccagaagagcagcatccacatcagcaacctggagcctgagctgcgggcccagatccacgagcagaaccccagcgtggaggtggtgtactacaacaagggcctgtag

SEQ ID NO: 18280 - DNA, 1068 bp, Artificial Sequence
  Description of Artificial Sequence: Synthetic coding sequence
atggagccccacctgctgggcctgctgctgggcctgctgctgggcggcaccagggtgctggccggctaccccatctggtggagcctggccctgggccagcagtacaccagcctgggcagccagcccctgctgtgtggcagcatccctggcctggtgcccaagcagctgcgcttctgcaggaactacatcgagatcatgcccagcgtggccgagggcgtgaagctgggcatccaggagtgccagcaccagttccggggccgccgctggaactgcaccaccattgatgacagcctggccatctttggacctgtgctggacaaggccacccgggagagcgcctttgtgcacgccatcgccagcgctggggtggcctttgctgtgaccaggagctgtgccgagggcaccagcaccatctgtggctgtgacagccaccacaagggccccccaggagagggctggaagtggggcggctgcagtgaagatgctgactttggagtgctggtgtcccgggagtttgctgatgccagagaaaatagaccagatgcccggagcgccatgaacaagcacaacaatgaagctggccgcaccaccatcctggaccacatgcacctgaagtgcaagtgccacggcctgagcggcagctgtgaggtgaagacctgctggtgggcccagcctgacttccgggccatcggggacttcctgaaggacaagtatgacagcgccagcgagatggtggtggagaagcaccgggagagccggggctgggtggagaccctgcgggccaagtacagcctcttcaagccacccacagagcgggacctggtgtactatgagaacagccccaacttctgtgagcccaaccctgagaccggcagctttggcacccgggacaggacctgcaatgtgaccagccatggaattgatggctgtgacctgctgtgctgcggccggggccacaacaccaggacagagaagaggaaggagaagtgccactgcatcttccactggtgctgctacgtgtcctgccaggagtgcatccgcatctatgatgtgcacacctgcaagtag

SEQ ID NO: 18281 - DNA, 1437 bp, Artificial Sequence
  Description of Artificial Sequence: Synthetic coding sequence
atggccgcccggcccatcaccctgggcatcgacctgggcaccacctctgtgaaggccgccctgctgcgggccgccccagatgaccccagcggctttgctgtgctggccagctgtgcccgggccgcccgggcagaggccgctgtggagagcgctgtggccggcccccagggccgggagcaggatgtgagccgcatcctgcaggccctgcatgaatgtctggccgccctgccccggccccagctgcggtctgtggtgggcattggagtgtctggccagatgcacggcgtggtgttctggaagacaggccagggctgtgagtggacagagggcggcatcacccctgtgtttgagcccagggctgtgagccacctggtgacctggcaggacggccgctgcagcagcgagttcctggccagcctgccccagcccaagagccacctgtctgtggccactggatttggctgtgccaccatcttctggctgctgaagtacagacctgagttcctgaagagctatgatgctgctggcaccatccatgactatgtggtggccatgctgtgtggcctgccccggcccctgatgtctgaccagaatgctgcctcctggggctacttcaacacccagagccagagctggaatgtggagaccctgcggagcagcggcttccctgtgcacctgctgcctgacattgctgagcccggctctgtggccggccgcaccagccacatgtggtttgagatccccaagggcacccaggtgggcgtggccctgggggacctgcaggcctctgtgtacagctgcatggcccagaggacagatgctgtgctgaacatcagcacctctgtgcagctggccgcctccatgcccagcggcttccagcctgcccagaccccagaccccacagcccctgtggcctacttcccctacttcaacagaacctacctgggcgtggccgccagcctgaatggaggaaatgtgctggccacctttgtgcacatgctggtgcagtggatggctgacctgggcctggaggtggaggagagcacagtgtacagcaggatgatccaggccgctgtgcagcagagggacacccacctgaccatcacccccaccgtgctgggggagcggcacctgcctgaccagctggcctctgtgacccgcatcagcagcagtgacctgagcctgggccacgtgacccgggccctgtgccggggcatcgtgcagaacctgcacagcatgctgcccatccagcagctgcaggactggggcgtggagcgggtgatgggcagcggcagcgccctgagcagaaatgatgtgctgaagcaggaggtgcagagggccttccccctgcccatgagctttggccaggatgtggatgctgctgtgggcgccgccctggtgatgctgcggcggcacctgaaccagaaggagagctag

SEQ ID NO: 18282 - DNA, 1578 bp, Artificial Sequence
  Description of Artificial Sequence: Synthetic coding sequence
atgagaagaagaagaagaagagatggcttctacccagccccagacttccgggaccgggaggccgaggacatggccggcgtgtttgacatcgacctggaccagccagaagatgctggctctgaagatgagctggaggagggcggccagctgaatgaatccatggaccacggcggcgtgggcccctatgagctgggcatggagcactgtgagaagtttgagatcagcgagacctctgtgaacagaggccctgagaagatccggccagaatgttttgagctgctgcgggtgctgggcaaaggaggctacggcaaggtgttccaggtgaggaaggtgactggagccaacacaggcaagatctttgccatgaaggtgctgaagaaggccatgattgtgagaaatgccaaggacacagcccacaccaaggccgagaggaacatcctggaggaggtgaagcaccccttcatcgtggacctgatctatgccttccagacaggaggcaagctgtacctgatcctggagtacctgagcggcggggagctgttcatgcagctggagcgggagggcatcttcatggaggacacagcctgcttctacctggccgagatctccatggccctgggccacctgcaccagaagggcatcatctacagagacctgaagccagagaacatcatgctgaaccaccagggccacgtgaagctgacagactttggcctgtgcaaggagagcatccatgatggcaccgtgacccacaccttctgtggcaccatcgagtacatggcccctgagatcctgatgaggagcggccacaacagagctgtggactggtggagcctgggcgccctgatgtatgacatgctgaccggggccccacccttcaccggggagaacaggaagaagaccatcgacaagatcctgaagtgcaagctgaacctgcccccctacctgacccaggaggcccgggacctgctgaagaagctgctgaagagaaatgctgccagccggctgggcgccggccctggagatgctggggaggtgcaggcccaccccttcttccgccacatcaactgggaggagctgctggccaggaaggtggagccccccttcaagcccctgctgcagagtgaagaagatgtgtcccagtttgacagcaagttcacccggcagacccctgtggacagcccagatgacagcaccctgtctgagagcgccaaccaggtgttcctgggcttcacctacgtggcccccagcgtgctggagagcgtgaaggagaagttctcctttgagcccaagatccgcagcccccggcgcttcatcggcagccccaggacccctgtgtcccctgtgaagttcagccctggggacttctggggccgcggggccagcgccagcacagccaacccccagacccctgtggagtaccccatggagaccagcggcatcgagcagatggatgtgaccatgtctggagaggccagcgcccccctgcccatccggcagcccaacagcggcccctacaagaagcaggccttccccatgatcagcaagaggcctgagcacctgaggatgaacctgtag

SEQ ID NO: 18283 - DNA, 987 bp, Artificial Sequence
  Description of Artificial Sequence: Synthetic coding sequence
atggccaggacagtggtgctgatcaccggctgcagcagcggcatcggcctgcacctggccgtgcggctggccagtgaccccagccagagcttcaaggtgtatgccaccctgcgggacctgaagacccagggccgcctgtgggaggccgcccgggccctggcctgccccccaggcagcctggagaccctgcagctggatgtgcgggacagcaagtctgtggccgccgcccgggagcgggtgacagagggccgggtggatgtgctggtgtgcaatgccggcctgggcctgctgggccccctggaggccctgggagaagatgctgtggcctctgtgctggatgtgaatgtggtgggcaccgtgaggatgctgcaggccttcctgcctgacatgaagaggcggggcagcggccgggtgctggtgactggatctgtgggcggcctgatgggcctgcccttcaatgatgtgtactgtgccagcaagtttgccctggagggcctgtgtgagagcctggccgtgctgctgctgccctttggagtgcacctgagcctgattgaatgtggccctgtgcacacagccttcatggagaaggtgctgggcagccctgaggaggtgctggacagaacagacatccacaccttccaccgcttctaccagtacctggcccacagcaagcaggtgttccgggaggccgcccagaaccctgaggaggtggccgaggtgttcctgacagccctgcgggcccccaagcccaccctgcgctacttcaccacagagcgcttcctgcccctgctgaggatgaggctggatgaccccagcggcagcaactacgtgacagccatgcaccgggaggtgtttggagatgtgcctgccaaggccgaggccggggctgaggccggcggcggggccggccctggagcagaagatgaggccggccgcggggctgtgggggaccctgagctgggggaccccccagctgccccccagtag

SEQ ID NO: 18284 - DNA, 1626 bp, Artificial Sequence
  Description of Artificial Sequence: Synthetic coding sequence
atgcctggcctgcggcgggaccggctgctgaccctgctgctgctgggcgccctgctgtctgctgacctgtacttccacctgtggccccaggtgcagaggcagctgcggccccgggagcggccccggggctgcccctgcaccggccgggccagcagcctggcccgggacagcgctgctgctgccagtgaccccggcaccatcgtgcacaacttcagcaggacagagcccaggacagagcctgctgggggcagccacagcggcagcagcagcaagctgcaggccctgtttgcccaccccctgtacaacgtgcctgaggagccccccctgctgggcgctgaggacagcctgctggccagccaggaggccctgcgctactacagaaggaaggtggcccgctggaacagaagacacaagatgtaccgggagcagatgaacctgaccagcctggacccccccctgcagctgcggctggaggcctcctgggtgcagttccacctgggcatcaacagacatggcctgtacagccgcagcagccctgtggtgtccaagctgctgcaggacatgaggcacttccccaccatctctgctgactacagccaggatgagaaggccctgctgggcgcctgtgactgcacccagatcgtgaagcccagcggcgtgcacctgaagctggtgctgcgcttcagtgactttgggaaggccatgttcaagcccatgaggcagcagagagatgaggagacccctgtggacttcttctacttcatcgacttccagaggcacaatgctgagattgctgccttccacctggaccgcatcctggacttccggcgggtgcccccaacagtgggcagaattgtgaatgtgaccaaggagatcctggaggtgaccaagaatgagatcctgcagagcgtcttctttgtgtccccagccagcaatgtgtgcttctttgccaagtgcccctacatgtgcaagacagaatatgctgtgtgtggcaacccccacctgctggagggcagcctgagcgccttcctgcccagcctgaacctggccccccggctgtctgtgcccaacccctggatccgcagctacaccctggccggcaaggaggagtgggaggtgaaccccctgtactgtgacacagtgaagcagatctacccctacaacaacagccagaggctgctgaatgtgattgacatggccatctttgacttcctgattggcaacatggacagacaccactatgagatgttcaccaagtttggagatgatggcttcctgatccacctggacaatgcccggggcttcggccgccacagccatgatgagatcagcatcctgagccccctgagccagtgctgcatgatcaagaagaagaccctgctgcacctgcagctgctggcccaggccgactaccgcctgagtgatgtgatgagggagagcctgctggaggaccagctgagccctgtgctgacagagccccacctgctggccctggaccggcggctgcagaccatcctgaggacagtggagggctgcatcgtggcccacggccagcagagcgtcatcgtggatggccctgtggagcagctggccccagacagcggccaggccaacctgaccagctag

SEQ ID NO: 18285 - DNA, 954 bp, Artificial Sequence
  Description of Artificial Sequence: Synthetic coding sequence
atgaagacagccctgatcctgctgagcatcctgggcatggcctgtgccttctccatgaagaacctgcaccggcgggtgaagattgaagattctgaagaaaatggagtcttcaagtaccggccccgctactacctgtacaagcacgcctacttctacccccacctgaagcgcttccctgtgcagggcagcagtgacagcagtgaagaaaatggagatgacagcagcgaggaggaggaggaggaggaggagaccagcaatgaaggagaaaataatgaggagagcaatgaagatgaggacagcgaggccgagaacaccaccctgagcgccaccaccctgggctacggggaggatgccaccccaggcaccggctacacaggcctggccgccatccagctgcccaagaaggccggggacatcaccaacaaggccaccaaggagaaggagagtgatgaggaggaggaggaggaggaggagggcaatgaaaatgaggagagcgaggccgaggtggatgaaaatgagcagggcatcaatggcaccagcaccaacagcacagaagcagaaaatggaaatggcagcagtggaggagacaatggagaggagggggaggaggagagcgtgactggagccaatgctgaggacaccacagaaacaggccggcagggcaagggcaccagcaagaccaccaccagccccaacggcggctttgagcccaccaccccaccccaggtgtaccgcaccaccagccccccatttgggaagaccaccaccgtggagtatgaaggagaatatgagtacaccggggccaatgaatatgacaatggctatgagatctatgaaagtgaaaatggagagcccaggggggacaactaccgggcctatgaagatgagtacagctacttcaagggccagggctatgatggctatgatggccagaactactaccaccaccagtag

SEQ ID NO: 18286 - DNA, 345 bp, Artificial Sequence
  Description of Artificial Sequence: Synthetic coding sequence
atgagcctgcccagcagccgggccgcccgggtgcccggccccagcggcagcctgtgtgccctgctggccctgctgctgctgctgaccccacctggccccctggccagcgctggccctgtgtctgctgtgctgacagagctgcgctgcacctgcctgcgggtgaccctgcgggtgaaccccaagaccatcggcaagctgcaggtgtttcctgctggcccccagtgcagcaaggtggaggtggtggccagcctgaagaatggcaagcaggtgtgcctggaccctgaggcccccttcctgaagaaggtgatccagaagatcctggacagcggcaacaagaagaactag

SEQ ID NO: 18287 - DNA, 2100 bp, Artificial Sequence
  Description of Artificial Sequence: Synthetic coding sequence
atgcccagcctgtggagggagatcctgctggagagcctgctgggctgtgtgtcctggagcctgtaccatgacctgggccccatgatctactacttccccctgcagaccctggagctgaccggcctggagggcttcagcatcgccttcctgagccccatcttcctgaccatcacccccttctggaagctggtgaacaagaagtggatgctgaccctgctgcgcatcatcaccatcggcagcatcgccagcttccaggccccaaatgccaagctgcggctgatggtgctggccctgggcgtgagcagcagcctgattgtgcaggccgtgacctggtggagcggcagccacctgcagcgctacctgcgcatctggggcttcatcctgggccagatcgtgctggtggtgctgcgcatctggtacaccagcctgaaccccatctggagctaccagatgagcaacaaggtgatcctgaccctgagcgccatcgccaccctggaccgcatcggcacagatggagactgcagcaagccagaggagaagaagacaggagaggtggccaccggcatggccagccggcccaactggctgctggccggggccgccttcggcagcctggtgttcctgacccactgggtgtttggagaggtgtccctggtgagccgctgggccgtgtctggccacccccaccctggccctgaccccaacccctttggaggagctgtgctgctgtgcctggccagcggcctgatgctgcccagctgcctgtggttccggggcaccggcctcatctggtgggtgactggaacagccagcgctgctggcctgctgtacctgcacacctgggccgctgctgtgtctggctgtgtgtttgccatcttcaccgcctccatgtggccccagaccctgggccacctgatcaacagcggcaccaaccctgggaagaccatgaccatcgccatgatcttctacctgctggagatcttcttctgtgcctggtgcacagccttcaagtttgtgcctgggggcgtgtatgcccgggagaggagtgatgtgctgctgggcaccatgatgctgatcatcggcctgaacatgctgtttggccccaagaagaacctggacctgctgctgcagaccaagaacagcagcaaggtgctcttcaggaagtctgagaagtacatgaagctgttcctgtggctgctggtgggcgtgggcctgctgggcctgggcctgcggcacaaggcctatgaaaggaagctgggcaaggtggcccccaccaaggaggtgtctgctgccatctggcccttccgcttcggctatgacaatgaaggctggagcagcctggagaggtctgcccacctgctgaatgaaacaggagctgacttcatcaccatcctggagagtgatgccagcaagccctacatgggcaacaatgacctgaccatgtggctgggggagaagctgggcttctacacagactttggccccagcacccgctaccacacctggggcatcatggccctgagccgctaccccatcgtgaagtctgagcaccacctgctgcccagccctgagggggagatcgccccagccatcaccctgactgtgaacatcagcggcaagctggtggactttgtggtgacccactttggaaatcatgaagatgacctggacaggaagctgcaggccatcgctgtgtccaagctgctgaagagcagcagcaaccaggtgatcttcctgggctacatcaccagcgcccctggcagccgggactacctgcagctgacagaacatggaaatgtgaaggacatcgacagcacagaccatgaccgctggtgtgagtacatcatgtaccggggcctcatccggctgggctacgcccgcatcagccatgctgagctgagtgacagcgagatccagatggccaagttccgcatcccagatgaccccaccaactacagagacaaccagaaggtggtgattgaccaccgggaggtgtctgagaagatccacttcaaccccaggtttggcagctacaaggagggccacaactatgagaacaaccaccacttccacatgaacacccccaagtacttcctgtag

SEQ ID NO: 18288 - DNA, 1449 bp, Artificial Sequence
  Description of Artificial Sequence: Synthetic coding sequence
atgctgtttgagggcaaggtgaacccccagacccagagcctgctggctgaatgtggggagtggaccaggaggagcctgcacctgcgggtgctgggccggcagctgatcctgcccacagacaagggcgtgcagcacttccagggcagcaccccagccagcgctgtgcaccggccccccctgagcgcctgtggccacagcagcaacatccgggagctgtgcatcagcggcagccagatcgtgcctgctgccctgagcgccagcgccctgcccggcccagatgacacaggagtggccgacctgacagcccggagcagcctggaggaggaggtgtaccacgtggatggcaagattgaggagtactttgcctttgacagaaaagaagatgatgatgaatgtctggagcagaagccagcccagcccggcaggaagtggaggaagctgggcctgccccctgtgagcccccgggactgtgtgaaggatgctgtggccgctgaggtgtttgaccacgtgtggaccaacatggtggagctgctggaggagctgatcaggaagcactgggagaccaccctgacagagggcaagaagcagcgggagaccctgaaggtggccggcaaccgcttcccccacgtgctggtgccccacgcccatgctgatggagccagcggccccccatctggccacgccgaggcccacggcatcagcctggccagccggctgaaccccccccagatccaccacttcagcagcagcttctacagcgacatgaatggagtgatgaccatccaggccaagcccctgcagaggaggcctgcctactttgctgacaggacccagaatgagaaggaggacaaggccagcggcggcggggccggggccctgagcagcgccccccaccggctgggccgggccagtgacacccacggcctgagccccagcgccaagaagacccctgtgccctggaggctgcccagcctggccagtgacagccagaggctgaagacccccaacatctacagtgatgaggtgctgcggggcaccaagctgcccaccggggtggaccacatggccagccccctggtgcagaccagccgcagccgcttcccccccctggtgacagagacccggggccagaacacagctgtgcccggctgccgcctggtgtcctaccggggccgccacctgcagaacagagtgctgagcgccatgccagatggaacagagaggagccggctgcgggagaggacagccaccctggagcggctgagccggcccagcaccacccacaccttccggcagagcgacacccccaggaagagcagcctgacccagatggagtttgctgcccacacctggacaggccagagcatcctgaccggcagccagtatgtgcccaagagcttccagaggaccaccctgaccttcaagaggcgcttccaggtgaccagctag

SEQ ID NO: 18289 - DNA, 1392 bp, Artificial Sequence
  Description of Artificial Sequence: Synthetic coding sequence
atgggcgccggccccagcctgctgctggccgccctgctgctgctgctgtctggagatggagctgtgcgctgtgacaccccagccaactgcacctacctggacctgctgggcacctgggtgttccaggtgggcagcagcggcagccagagagatgtgaactgcagcgtgatgggcccccaggagaagaaggtggtggtgtacctgcagaagctggacacagcctatgatgacctgggcaacagcggccacttcaccatcatctacaaccagggctttgagatcgtgctgaatgactacaagtggtttgccttcttcaagtacaaggaggagggcagcaaggtgaccacctactgcaatgagaccatgacaggctgggtgcatgatgtgctgggcaggaactgggcctgcttcaccgggaagaaggtgggcacagcctctgaaaatgtgtatgtgaacatcgcccacctgaagaacagccaggagaagtacagcaacagactctacaagtatgaccacaactttgtgaaggccatcaatgccatccagaagtcctggacagccaccacctacatggagtatgagaccctgaccctgggggacatgatcagaagaagtggcggccacagcaggaagatcccccggcccaagccagcccccctgacagctgagatccagcagaagatcctgcacctgcccacctcctgggactggagaaatgtgcacggcatcaactttgtgtcccctgtgaggaaccaggccagctgtggcagctgctacagctttgcctccatgggcatgctggaggcccgcatccgcatcctgaccaacaacagccagacccccatcctgagcccccaggaggtggtgtcctgcagccagtatgcccagggctgtgagggcggcttcccctacctgattgctgggaagtatgcccaggactttggcctggtggaggaggcctgcttcccctacacaggaacagacagcccctgcaagatgaaggaggactgcttccgctactacagcagcgagtaccactacgtgggcggcttctacggcggctgcaatgaggccctgatgaagctggagctggtgcaccacggccccatggctgtggcctttgaggtgtatgatgacttcctgcactacaagaagggcatctaccaccacacaggcctgcgggaccccttcaacccctttgagctgaccaaccacgctgtgctgctggtgggctacggcacagacagcgccagcggcatggactactggatcgtgaagaacagctggggcaccggctggggagaaaatggctacttccgcatccggcggggcacagatgaatgtgccatcgagagcattgctgtggccgccacccccatccccaagctgtag

SEQ ID NO: 18290 - DNA, 1941 bp, Artificial Sequence
  Description of Artificial Sequence: Synthetic coding sequence
atgagcaaaggacctgctgtgggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaaccccaccaacacagtgtttgatgccaagaggctcatcggccgccgctttgatgatgctgtggtgcagagcgacatgaagcactggcccttcatggtggtgaatgatgctggccggcccaaggtgcaggtggagtacaagggggagaccaagagcttctacccagaggaggtgtcctccatggtgctgaccaagatgaaggagattgctgaggcctacctgggcaagacagtgaccaatgctgtggtgacagtgcctgcctacttcaatgacagccagaggcaggccaccaaggatgctggcaccatcgccggcctgaatgtgctgcgcatcatcaatgagcccacagctgctgccatcgcctacggcctggacaagaaggtgggcgctgagagaaatgtgctgatctttgacctgggcggcggcacctttgatgtgtccatcctgaccattgaagatggcatctttgaggtgaagagcacagctggggacacccacctgggcggagaagattttgacaacaggatggtgaaccacttcatcgccgagttcaagaggaagcacaagaaggacatcagcgagaacaagagagctgtgcggcggctgaggacagcctgtgagcgggccaagaggaccctgagcagcagcacccaggccagcattgaaattgacagcctgtatgagggcatcgacttctacaccagcatcacccgggccaggtttgaggagctgaatgctgacctcttccggggcaccctggaccctgtggagaaggccctgagagatgccaagctggacaagagccagatccatgacatcgtgctggtgggcggcagcacccgcatccccaagatccagaagctgctgcaggacttcttcaacgggaaggagctgaacaagagcatcaacccagatgaggccgtggcctatggagctgctgtgcaggccgccatcctgagcggggacaagtcagaaaatgtgcaggacctgctgctgctggatgtgacccccctgagcctgggcattgaaacagctgggggcgtgatgacagtgctgatcaagaggaacaccaccatccccaccaagcagacccagaccttcaccacctacagcgacaaccagcccggggtgctgatccaggtgtatgaaggagagcgggccatgaccaaggacaacaacctgctgggcaagtttgagctgaccggcatccccccagccccccggggcgtgccccagatcgaggtgacctttgatattgatgccaacggcatcctgaatgtgtctgctgtggacaagagcacaggcaaggagaacaagatcaccatcaccaatgacaagggccgcctgagcaaagaagatattgaaagaatggtgcaggaggccgagaagtacaaggccgaggatgagaagcagagggacaaggtgagcagcaagaacagcctggagagctatgccttcaacatgaaggccaccgtggaggatgagaagctgcagggcaagatcaatgatgaggacaagcagaagatcctggacaagtgcaatgagatcatcaactggctggacaagaaccagacagctgagaaggaggagtttgagcaccagcagaaggagctggagaaggtgtgcaaccccatcatcaccaagctgtaccagagcgctgggggcatgcctgggggcatgcctgggggcttccctgggggcggggcccctccttctggaggagccagcagcggccccaccatcgaggaggtggactag

SEQ ID NO: 18291 - DNA, 1017 bp, Artificial Sequence
  Description of Artificial Sequence: Synthetic coding sequence
atgtgggaggccaaccctgagatgttccacaaggccgaggagctgttcagcaagaccaccaacaatgaggtggatgacatggacaccagtgacacccagtggggctggttctacctggctgaatgtgggaagtggcacatgttccagcctgacaccaacagccagtgcagcgtgtccagtgaagatattgagaagagcttcaagaccaacccctgtggcagcatctccttcaccaccagcaagttctcctacaagattgactttgctgagatgaagcagatgaacctgaccaccgggaagcagaggctcatcaagagggcccccttcagcatcagcgccttctcctacatctgtgaaaatgaggccatccccatgccaccccactgggagaatgtgaacacccaggtgccctaccagctgatccccctgcacaaccagacccatgagtacaatgaggtggccaacctgtttgggaagaccatggacaggaaccgcatcaagaggatccagaggatccagaacctggacctgtgggagttcttctgcaggaagaaggcccagctgaagaagaagaggggcgtgccccagatcaatgagcagatgctgttccacggcaccagcagcgagtttgtggaggccatctgcatccacaactttgactggaggatcaatggcatccatggagctgtgtttgggaagggcacctactttgccagagatgctgcctacagcagccgcttctgcaaggatgacatcaagcacggcaacaccttccagatccatggagtgtccctgcagcagaggcacctgttccgcacctacaagtccatgttcctggcccgggtgctgattggagactacatcaatggagacagcaagtacatgaggcctcccagcaaggatggcagctatgtgaacctgtatgacagctgtgtggatgacacctggaaccccaagatctttgtggtgtttgatgccaaccagatctacccagagtacctgattgacttccactag

SEQ ID NO: 18292 - DNA, 1059 bp, Artificial Sequence
  Description of Artificial Sequence: Synthetic coding sequence
atggtgcggcctgtgcgccacaagaagcctgtgaactacagccagtttgaccacagcgacagtgatgatgactttgtgtctgccaccgtgcccctgaacaagaagagcaggacagcccccaaggagctgaagcaggacaagcccaagcccaacctgaacaacctgaggaaggaggagatccctgtgcaggagaagacccccaagaagaggctgcctgagggcaccttcagcatcccagccagcgctgtgccctgcaccaagatggccctggatgacaagctgtaccagagggacctggaggtggccctggccctgtctgtgaaggagctgcccaccgtgaccaccaacgtgcagaacagccaggacaagagcattgagaagcacggcagcagcaagattgagaccatgaacaagagcccccacatcagcaactgcagcgtggccagtgactacctggacctggacaagatcaccgtggaggatgatgtgggcggcgtgcagggcaagaggaaggccgccagcaaggctgctgcccagcagaggaagatcctgctggagggcagtgatggagacagcgccaatgacacagagccagactttgcccctggagaggacagtgaagatgacagcgacttctgtgagagcgaggacaatgatgaggacttctccatgaggaagagcaaggtgaaggagatcaagaagaaggaggtgaaggtgaagagccctgtggagaagaaggagaagaagagcaagagcaaatgtaatgccctggtgacctctgtggacagcgccccagctgctgtgaagtctgagagccagagcctgcccaagaaggtgtccctgagcagtgacaccaccaggaagcccctggagatccgcagccccagcgctgagagcaagaagcccaagtgggtgcccccagctgccagcggcggcagccgcagcagcagcagccccctggtggtggtgtctgtgaagagccccaaccagagcctgcggctgggcctgagccggctggcccgggtgaagcccctgcaccccaatgccaccagcacctag

SEQ ID NO: 18293 - DNA, 1488 bp, Artificial Sequence
  Description of Artificial Sequence: Synthetic coding sequence
atgacagtgatgtctggagaaaatgtggatgaggccagcgctgcccctggccacccccaggacggcagctacccccggcaggccgaccatgatgaccacgagtgctgtgagcgggtggtgatcaacatcagcggcctgcgctttgagacccagctgaagaccctggcccagttccccaacaccctgctgggcaaccccaagaagaggatgagatactttgaccccctgagaaatgagtacttctttgacaggaaccggcccagctttgatgccatcctgtactactaccagagcggcggccgcctgcggcggcctgtgaatgtgcccctggacatgttcagcgaggagatcaagttctatgagctgggggaggaggccatggagaagttccgggaggatgagggcttcatcaaggaggaggagcggcccctgcctgagaaggagtaccagaggcaggtgtggctgctgtttgagtacccagagagcagcggccctgcccgggtgattgccatcgtgtctgtgatggtgatcctgatcagcatcgtcatcttctgcctggagaccctgcctgagctgaaggatgacaaggacttcaccggcaccgtgcacagaattgacaacaccaccgtcatctacaacagcaacatcttcacagaccccttcttcatcgtggagaccctgtgcatcatctggttctcctttgagctggtggtgcgcttctttgcctgccccagcaagacagacttcttcaagaacatcatgaacttcattgatattgtggccatcatcccctacttcatcaccctgggcacagaaattgctgagcaggagggcaaccagaagggggagcaggccaccagcctggccatcctgcgggtcatccggctggtgcgggtcttccgcatcttcaagctgagccgccacagcaagggcctgcagatcctgggccagaccctgaaggcctccatgagggagctgggcctgctgatcttcttcctgttcatcggggtcatcctcttcagcagcgctgtgtactttgctgaggccgaggaggccgagagccacttcagcagcatcccagatgccttctggtgggccgtggtgtccatgaccaccgtgggctatggagacatgtaccctgtgaccatcggcggcaagatcgtgggcagcctgtgtgccatcgccggcgtgctgaccatcgccctgcctgtgcctgtgattgtgagcaacttcaactacttctaccaccgggagacagaaggagaggagcaggcccagctgctgcacgtgagcagccccaacctggccagtgacagcgacctgagcagaagaagcagcagcaccatgagcaagtctgagtacatggagattgaggaggacatgaacaacagcatcgcccactaccggcaggtgaacatcagaacagccaactgcaccacagccaaccagaactgtgtgaacaagagcaagctgctgacagatgtgtag

SEQ ID NO: 18294 - DNA, 1632 bp, Artificial Sequence
  Description of Artificial Sequence: Synthetic coding sequence
atgaggaagccagctgctggcttcctgcccagcctgctgaaggtgctgctgctgcccctggccccagctgctgcccaggacagcacccaggccagcaccccaggcagccccctgagccccacagaatatgagcgcttctttgccctgctgacccccacctggaaggccgagaccacctgccgcctgcgggccacccacggctgcaggaaccccaccctggtgcagctggaccagtatgagaaccacggcctggtgcctgatggagctgtgtgcagcaacctgccctatgcctcctggtttgagagcttctgccagttcacccactaccgctgcagcaaccacgtgtactatgccaagagggtgctgtgcagccagcctgtgtccatcctgagccccaacaccctgaaggagattgaggccagcgctgaggtgagccccaccaccatgaccagccccatcagcccccacttcaccgtgacagagcggcagaccttccagccctggccagagcggctgagcaacaacgtggaggagctgctgcagagcagcctgagcctgggcggccaggagcaggcccctgagcacaagcaggagcagggcgtggagcaccggcaggagcccacccaggagcacaagcaggaggagggccagaagcaggaggagcaggaggaggagcaggaggaggagggcaagcaggaggagggccagggcaccaaggagggccgggaggccgtgtcccagctgcagacagacagcgagcccaagttccacagcgagagcctgagcagcaaccccagcagctttgccccccgggtgcgggaggtggagagcacccccatgatcatggagaacatccaggagctgatccgcagcgcccaggagattgatgagatgaatgagatctatgatgagaacagctactggaggaaccagaaccctggcagcctgctgcagctgccccacacagaggccctgctggtgctgtgctacagcatcgtggagaacacctgcatcatcacccccacagccaaggcctggaagtacatggaggaggagatcctgggctttgggaagtctgtgtgtgacagcctgggccgccgccacatgagcacctgtgccctgtgtgacttctgcagcctgaagctggagcagtgccacagcgaggccagcctgcagaggcagcagtgtgacaccagccacaagaccccatttgtgagccccctgctggccagccagagcctgagcatcggcaaccaggtgggcagccctgagagcggccgcttctacggcctggacctgtatggaggcctgcacatggacttctggtgtgcccggctggccaccaagggctgtgaagatgtgcgggtgtctggctggctgcagacagagttcctgtccttccaggatggagacttccccaccaagatctgtgacacagactacatccagtaccccaactactgcagcttcaagagccagcagtgcctgatgaggaacagaaacaggaaggtgtccaggatgcgctgcctgcagaatgagacctacagcgccctgagccctgggaagtcagaagatgtggtgctgcgctggagccaggagttcagcaccctgaccctgggccagtttggatag

SEQ ID NO: 18295 - DNA, 666 bp, Artificial Sequence
  Description of Artificial Sequence: Synthetic coding sequence
atgagcggctgggcagatgagcggggcggggagggagatggccgcatctacgtgggcaacctgcccacagatgtgcgggagaaggacctggaggacctcttctacaagtatggccgcatccgggagattgagctgaagaacagacatggcctggtgccctttgcctttgtgcgctttgaggaccccagagatgctgaagatgccatctacggcagaaatggctatgactatggccagtgccgcctgcgggtggagttccccaggacctacggcggccggggcggctggccccggggcggcagaaatggcccccccaccaggagaagtgacttccgggtgctggtgtctggcctgcccccatctggctcctggcaggacctgaaggaccacatgagggaggccggagatgtgtgctacgcagatgtgcagaaggatggagtgggcatggtggagtacctgaggaaggaggacatggagtatgccctgaggaagctggatgacaccaagttccgcagccatgaaggagagaccagctacatccgggtgtacccagagaggagcaccagctatggctacagccgcagccgcagcggcagccggggccgggacagcccctaccagagccggggcagcccccactacttcagccccttccggccctactag

SEQ ID NO: 18296 - DNA, 2523 bp, Artificial Sequence
  Description of Artificial Sequence: Synthetic coding sequence
atgtctgccttccggctgtggccaggcctgctgatcatgctgggcagcctgtgccaccggggcagcccctgtggcctgagcacccacgtggagatcggccaccgggccctggagttcctgcagctgcacaacggccgggtgaactaccgggagctgctgctggagcaccaggatgcctaccaggccggcatcgtgtttcctgactgcttctaccccagcatctgcaagggcggcaagttccatgatgtgtctgagagcacccactggacccccttcctgaatgcctctgtgcactacatccgggagaactaccccctgccctgggagaaggacacagagaagctggtggccttcctgtttggcatcaccagccacatggccgcagatgtgtcctggcacagcctgggcctggagcagggcttcctgcggaccatgggcgccatcgacttccacggcagctacagcgaggcccacagcgctggggactttggaggagatgtgctgagccagtttgagttcaacttcaactacctggcccggcgctggtacgtgcctgtgaaggacctgctgggcatctatgagaagctgtatggcaggaaggtgatcacagaaaatgtgattgtggactgcagccacatccagttcctggagatgtatggagagatgctggccgtgtccaagctgtaccccacctacagcaccaagagccccttcctggtggagcagttccaggagtacttcctgggcggcctggatgacatggccttctggagcaccaacatctaccacctgaccagcttcatgctggagaatggcaccagtgactgcaacctgcctgagaaccccctcttcatcgcctgtggcggccagcagaaccacacccagggcagcaagatgcagaagaatgacttccacaggaacctgaccaccagcctgacagaatctgtggacaggaacatcaactacacagagcggggcgtcttcttctctgtgaacagctggaccccagacagcatgtccttcatctacaaggccctggagaggaacatccgcaccatgtttattggaggcagccagctgagccagaagcacgtgagcagccccctggccagctacttcctgtccttcccctatgcccggctgggctgggccatgaccagcgctgacctgaaccaggacggccatggagacctggtggtgggcgcccctggctacagccggcccggccacatccacatcggccgggtgtacctgatctatggaaatgacctgggcctgccccctgtggacctggacctggacaaggaggcccaccgcatcctggagggcttccagcccagcggccgcttcggcagcgccctggccgtgctggacttcaacgtggatggagtgcctgacctggccgtgggcgcccccagcgtgggcagcgagcagctgacctacaagggagctgtgtatgtgtacttcggcagcaagcagggcggcatgagcagcagccccaacatcaccatcagctgccaggacatctactgcaacctgggctggaccctgctggccgcagatgtgaatggagacagcgagccagacctggtgattggcagcccctttgcccctgggggcggcaagcagaagggcatcgtggccgccttctacagcggccccagcctgagtgacaaggagaagctgaatgtggaggccgccaactggacagtgcggggggaggaggacttctcctggtttggctacagcctgcatggagtgacagtggacaacagaaccctgctgctggtgggcagccccacctggaagaatgccagccggctgggccacctgctgcacatcagagatgagaagaagagcctgggccgggtgtatggctacttccccccaaatggccagagctggttcaccatcagcggggacaaggccatgggcaagctgggcaccagcctgagcagcggccacgtgctgatgaatggcaccctgaagcaggtgctgctggtgggcgcccccacctatgatgatgtgtccaaggtggccttcctgactgtgaccctgcaccagggcggggccaccaggatgtatgccctgaccagtgatgcccagcccctgctgctgagcaccttcagcggggaccggcgcttcagcagatttggaggagtgctgcacctgagtgacctggatgatgatggcctggatgagatcatcatggccgcccccctgagaattgctgatgtgaccagcggcctgattggaggagaagatggccgggtgtatgtgtacaacgggaaggagaccaccctgggggacatgaccgggaagtgcaagtcctggatcaccccctgcccagaggagaaggcccagtatgtgctgatcagccctgaggccagcagccgcttcggcagcagcctcatcaccgtgcgcagcaaggccaagaaccaggtggtgattgctgctggccgcagcagcctgggcgcccggctgagcggggccctgcacgtgtacagcctgggcagtgactag

SEQ ID NO: 18297 - DNA, 972 bp, Artificial Sequence
  Description of Artificial Sequence: Synthetic coding sequence
atgaagagcgccctcttcacccgcttcttcatcctgctgccctggatcctgattgtcatcatcatgctggatgtggacacccggcggcctgtgccccccctgaccccccggccctacttcagcccctatgctgtgggccggggcggggcccggctgcccctgcggcggggcggccctgcccacggcacccagaagaggaaccagagccggccccagccccagcctgagccccagctgcccaccatctatgccatcacccccacctacagcaggcctgtgcagaaggccgagctgacccggctggccaacaccttccggcaggtggcccagctgcactggatcctggtggaggatgctgctgcccggtctgagctggtgagccgcttcctggcccgggccggcctgcccagcacccacctgcacgtgcccaccccccggcgctacaagaggcctggcctgccccgggccacagagcagagaaatgccggcctggcctggctgcggcagaggcaccagcaccagagggcccagcccggggtgctcttctttgctgatgatgacaacacctacagcctggagctgttccaggagatgaggaccaccaggaaggtgtctgtgtggcctgtgggcctggtgggcggcagaagatatgagcggcccctggtggagaatggcaaggtggtgggctggtacacaggctggagggctgaccggccctttgccatcgacatggccggctttgctgtgtccctgcaggtgatcctgagcaaccccaaggctgtgttcaagaggcggggcagccagcccggcatgcaggagagtgacttcctgaagcagatcaccaccgtggaggagctggagcccaaggccaacaactgcaccaaggtgctggtgtggcacaccaggacagagaaggtgaacctggccaatgagcccaagtaccacctggacacagtgaagattgaggtgtag

SEQ ID NO: 18298 - DNA, 3213 bp, Artificial Sequence
  Description of Artificial Sequence: Synthetic coding sequence
atgggcgccgcccggggcagccctgcccggccccggcggctgcccctgctgtctgtgctgctgctgcccctgctgggcggcacccagacagccatcgtgttcatcaagcagcccagcagccaggatgccctgcagggcagaagagccctgctgcgctgtgaggtggaggcccctggccctgtgcacgtgtactggctgctggatggagcccctgtgcaggacacagaaagaagatttgcccagggcagcagcctgagctttgctgctgtggaccggctgcaggacagcggcaccttccagtgtgtggccagagatgatgtgactggagaggaggcccggagcgccaatgccagcttcaacatcaagtggattgaggccggccctgtggtgctgaagcacccagccagcgaggccgagatccagccccagacccaggtgaccctgcgctgccacattgatggccacccccggcccacctaccagtggttcagagatggcacccccctgagtgatggccagagcaaccacacagtgagcagcaaggagaggaacctgaccctgcggcctgctggccctgagcacagcggcctgtacagctgctgtgcccacagcgccttcggccaggcctgcagcagccagaacttcaccctgagcattgctgatgagagctttgcccgggtggtgctggccccccaggatgtggtggtggcccgctatgaggaggccatgttccactgccagttcagcgcccagcccccacccagcctgcagtggctgtttgaagatgagacccccatcaccaacagaagccggcccccccacctgcggcgggccaccgtgtttgccaacggcagcctgctgctgacccaggtgcggcccagaaatgccggcatctaccgctgcatcggccagggccagaggggcccccccatcatcctggaggccaccctgcacctggccgagattgaggacatgcccctgtttgagcccagggtcttcaccgctggcagcgaggagcgggtgacctgcctgccccccaagggcctgcctgagcccagcgtgtggtgggagcacgccggcgtgcggctgcccacccacggccgggtgtaccagaagggccacgagctggtgctggccaacattgctgagagtgatgctggggtgtacacctgccacgccgccaacctggccggccagaggcggcaggatgtgaacatcaccgtggccaccgtgcccagctggctgaagaagccccaggacagccagctggaggagggcaagccaggctacctggactgcctgacccaggccacccccaagcccaccgtggtgtggtacagaaaccagatgctgatcagcgaggacagcagatttgaggtgttcaagaatggcaccctgcgcatcaacagcgtggaggtgtatgatggcacctggtaccgctgcatgagcagcaccccagctggcagcattgaggcccaggcccgggtgcaggtgctggagaagctgaagttcaccccaccaccccagccccagcagtgcatggagtttgacaaggaggccaccgtgccctgcagcgccaccggccgggagaagcccaccatcaagtgggagcgggcagatggcagcagcctgcctgagtgggtgacagacaatgccggcaccctgcactttgcccgggtgaccagagatgatgctggcaactacacctgcatcgccagcaatggcccccagggccagatccgggcccacgtgcagctgactgtggccgtgttcatcaccttcaaggtggagcctgagaggaccaccgtgtaccagggccacacagccctgctgcagtgtgaggcccagggcgaccccaagcccctcatccagtggaagggcaaggaccgcatcctggaccccaccaagctgggccccaggatgcacatcttccagaatggcagcctggtgattcatgatgtggccccagaagattctggccgctacacctgcatcgccggcaacagctgcaacatcaagcacacagaggcccccctgtatgtggtggacaagcctgtgcctgaggagagcgagggccctggcagccccccaccctacaagatgatccagaccatcggcctgtctgtgggcgctgctgtggcctacatcatcgctgtgctgggcctgatgttctactgcaagaagcgctgcaaggccaagaggctgcagaagcagcctgagggggaggagcctgagatggagtgcctgaatggaggccccctgcagaatggccagcccagcgctgagatccaggaggaggtggccctgaccagcctgggcagcggccctgctgccaccaacaagaggcacagcaccagtgacaagatgcacttccccaggagcagcctgcagcccatcaccaccctgggcaagtcagaatttggagaggtgttcctggccaaggcccagggcctggaggagggcgtggccgagaccctggtgctggtgaagagcctgcagagcaaggatgagcagcagcagctggacttccggcgggagctggagatgtttgggaagctgaaccacgccaacgtggtgcggctgctgggcctgtgccgggaggccgagccccactacatggtgctggagtatgtggacctgggggacctgaagcagttcctgcgcatcagcaagagcaaggatgagaagctgaagagccagcccctgagcaccaagcagaaggtggccctgtgcacccaggtggccctgggcatggagcacctgagcaacaacagatttgtgcacaaggacctggccgccaggaactgcctggtgtctgcccagaggcaggtgaaggtgtctgccctgggcctgagcaaggatgtgtacaacagcgagtactaccacttccggcaggcctgggtgcccctgcgctggatgagccctgaggccatcctggagggggacttcagcaccaagagtgatgtgtgggccttcggcgtgctgatgtgggaggtgttcacccacggggagatgcctcatggaggccaggctgatgatgaggtgctggccgacctgcaggccggcaaggcccggctgccccagcctgagggctgccccagcaagctgtaccgcctgatgcagcgctgctgggccctgagccccaaggaccggcccagcttcagcgagatcgccagcgccctgggggacagcacagtggacagcaagccctag

SEQ ID NO: 18299 - DNA, 1521 bp, Artificial Sequence
  Description of Artificial Sequence: Synthetic coding sequence
atgcccctgctgggcctgctgccccggcgggcctgggccagcctgctgagccagctgctgcggcccccctgtgccagctgcaccggggctgtgcgctgccagagccaggtggccgaggccgtgctgaccagccagctgaaggcccaccaggagaagcccaacttcatcatcaagacccccaagggcacccgggacctgagcccccagcacatggtggtgcgggagaagatcctggacctggtgatcagctgcttcaagagacatggagccaagggcatggacaccccagcctttgagctgaaggagaccctgacagagaagtacggggaggacagcggcctgatgtatgacctgaaggaccagggcggggagctgctgagcctgcgctatgacctgactgtgccctttgcccgctacctggccatgaacaaggtgaagaagatgaagcgctaccacgtgggcaaggtgtggaggcgggagagccccaccatcgtgcagggccgctaccgggagttctgccagtgtgactttgatattgctggccagtttgaccccatgatcccagatgctgaatgtctgaagatcatgtgtgagatcctgagcggcctgcagctgggggacttcctgatcaaggtgaatgacagaagaattgtggatggcatgtttgctgtgtgtggggtgcctgagagcaagttccgggccatctgcagcagcattgacaagctggacaagatggcctggaaggatgtgagacatgagatggtggtgaagaagggcctggcccctgaggtggccgaccgcatcggggactatgtgcagtgccacggcggcgtgtccctggtggagcagatgttccaggacccccggctgagccagaacaagcaggccctggagggcctgggggacctgaagctgctgtttgagtacctgaccctgtttggaattgctgacaagatcagctttgacctgagcctggcccggggcctggactactacacaggagtcatctatgaagctgtgctgctgcagacccccacccaggccggggaggagcccctgaatgtgggctctgtggccgccggcggccgctatgatggcctggtgggcatgtttgaccccaagggccacaaggtgccctgtgtgggcctgagcattggagtggagcgcatcttctacatcgtggagcagaggatgaagaccaagggggagaaggtgaggaccacagagacccaggtgtttgtggccaccccccagaagaacttcctgcaggagcggctgaagctgattgctgagctgtgggacagcggcatcaaggccgagatgctgtacaagaacaaccccaagctgctgacccagctgcactactgtgagagcacaggcatccccctggtggtgatcattggagagcaggagctgaaggagggcgtcatcaagatccgctctgtggccagccgggaggaggtggccatcaagagagaaaattttgtggccgagatccagaagaggctgtctgagagctag

SEQ ID NO: 18300 - DNA, 912 bp, Artificial Sequence
  Description of Artificial Sequence: Synthetic coding sequence
atgagggcctggatcttcttcctgctgtgcctggccggccgggccctggccgccccccagcaggaggccctgcctgatgaaacagaggtggtggaggagaccgtggccgaggtgacagaggtgtctgtgggcgccaaccctgtgcaggtggaggtgggggagtttgatgatggagctgaggagacagaggaggaggtggtggccgagaacccctgccagaaccaccactgcaagcacggcaaggtgtgtgagctggatgagaacaacacccccatgtgtgtgtgccaggaccccaccagctgcccagcccccatcggggagtttgagaaggtgtgcagcaatgacaacaagacctttgacagcagctgccacttctttgccaccaagtgcaccctggagggcaccaagaagggccacaagctgcacctggactacatcggcccctgcaagtacatccccccctgcctggacagcgagctgacagagttccccctgaggatgagggactggctgaagaatgtgctggtgaccctgtatgaaagagatgaggacaacaacctgctgacagagaagcagaagctgcgggtgaagaagatccatgaaaatgagaagaggctggaggccggggaccaccctgtggagctgctggcccgggactttgagaagaactacaacatgtacatcttccctgtgcactggcagtttggccagctggaccagcaccccattgatggctacctgagccacacagagctggcccccctgcgggcccccctcatccccatggagcactgcaccacccgcttctttgagacctgtgacctggacaatgacaagtacatcgccctggatgagtgggccggctgcttcggcatcaagcagaaggacatcgacaaggacctggtgatctag

SEQ ID NO: 18301 - DNA, 2634 bp, Artificial Sequence
  Description of Artificial Sequence: Synthetic coding sequence
atggcccggccccggcgggcccgggagcccctgctggtggccctgctgcccctggcctggctggcccaggccggcctggcccgggccgccggctctgtgcggctggccggcggcctgaccctgggcggcctcttccctgtgcacgcccggggagctgctggccgggcctgtggccagctgaagaaggagcagggcgtgcaccggctggaggccatgctgtatgccctggacagagtgaatgctgaccctgagctgctgcccggggtgcggctgggcgcccggctgctggacacctgcagccgggacacctacgccctggagcaggccctgagctttgtgcaggccctgatccggggcagaggagatggagatgaggtgggcgtgcgctgccctggaggagtgccccccctgcggcctgcccctcctgagcgggtggtggccgtggtgggcgccagcgccagctctgtgtccatcatggtggccaacgtgctgcggctgtttgccatcccccagatctcctatgccagcacagcccctgagctgagtgacagcaccaggtatgacttcttcagccgggtggtgcccccagacagctaccaggcccaggccatggtggacatcgtgcgggccctgggctggaactacgtgtccaccctggccagcgagggcaactatggagagagcggcgtggaggcctttgtgcagatcagccgggaggccggcggcgtgtgcatcgcccagagcatcaagatcccccgggagcccaagccaggagagttcagcaaggtgatccggcggctgatggagaccccaaatgcccggggcatcatcatctttgccaatgaagatgacatccggcgggtgctggaggccgcccggcaggccaacctgaccggccacttcctgtgggtgggcagtgacagctggggcgccaagaccagccccatcctgagcctggaggatgtggccgtgggcgccatcaccatcctgcccaagagggccagcattgatggctttgaccagtacttcatgaccaggagcctggagaacaacagaagaaacatctggtttgctgagttctgggaggagaacttcaactgcaagctgaccagcagcggcacccagagtgatgacagcaccaggaagtgcaccggggaggagagaattggccgggacagcacctatgagcaggagggcaaggtgcagtttgtgattgatgctgtgtatgccatcgcccacgccctgcacagcatgcaccaggccctgtgccccggccacacaggcctgtgcccagccatggagcccacagatggccgcatgctgctgcagtacatccgggctgtgcgcttcaatggatctgctggcacccctgtgatgtttaatgaaaatggagatgcccctggccgctatgacatcttccagtaccaggccaccaatggaagtgccagcagcggcggctaccaggccgtgggccagtgggccgagaccctgcggctggatgtggaggccctgcagtggagcggggacccccatgaggtgcccagcagcctgtgcagcctgccctgtggccctggagagaggaagaagatggtgaagggcgtgccctgctgctggcactgtgaggcctgtgatggctaccgcttccaggtggatgagttcacctgtgaggcctgccctggggacatgaggcccacccccaaccacacaggctgccggcccacccctgtggtgcggctgtcctggagcagcccctgggccgccccacccctgctgctggccgtgctgggcatcgtggccaccaccaccgtggtggccacctttgtgcgctacaacaacacccccatcgtgcgggccagcggccgggagctgtcctatgtgctgctgaccggcatcttcctgatctatgccatcaccttcctgatggtggccgagcctggagctgctgtgtgtgccgcccggcggctcttcctgggcctgggcaccaccctgagctacagcgccctgctgaccaagaccaaccgcatctaccgcatctttgagcagggcaagaggtctgtgaccccaccacccttcatcagccccaccagccagctggtgatcaccttcagcctgaccagcctgcaggtggtgggcatgattgcctggctgggcgcccggcccccccacagcgtgattgattatgaggagcagaggacagtggaccctgagcaggcccggggcgtgctgaagtgtgacatgtctgacctgagcctcatcggctgcctgggctacagcctgctgctgatggtgacctgcaccgtgtatgccatcaaggcccggggcgtgcctgagaccttcaatgaggccaagcccatcggcttcaccatgtacaccacctgcatcatctggctggcctttgtgcccatcttcttcggcacagcccagagcgctgagaagatctacatccagaccaccaccctgactgtgtccctgagcctgagcgcctctgtgtccctgggcatgctgtatgtgcccaagacctacgtgatcctcttccaccctgagcagaatgtgcagaagaggaagaggagcctgaaggccaccagcacagtggccgccccacccaagggagaagatgctgaggcccacaagtag

SEQ ID NO: 18302 - DNA, 798 bp, Artificial Sequence
  Description of Artificial Sequence: Synthetic coding sequence
atggctgctgctgtgcccaagaggatgaggggccctgcccaggccaagctgctgcccggcagcgccatccaggccctggtgggcctggcccggcccctggtgctggccctgctgctggtgtctgctgccctgagctctgtggtgtccaggacagacagccccagccccaccgtgctgaacagccacatcagcaccccaaatgtgaatgccctgacccatgagaaccagaccaagcccagcatcagccagatcagcaccaccctgccccccaccaccagcaccaagaagtctggaggagcctctgtggtgccccaccccagccccacccccctgagccaggaggaggccgacaacaatgaagaccccagcattgaggaggaggacctgctgatgctgaacagcagccccagcacagccaaggacaccctggacaatggagactatggagagccagactatgactggaccaccggccccagagatgatgatgaaagtgatgacaccctggaggagaacagaggctacatggagattgagcagagcgtgaagagcttcaagatgcccagcagcaacatcgaggaggaggacagccacttcttcttccacctgatcatctttgccttctgcatcgctgtggtgtacatcacctaccacaacaagaggaagatcttcctgctggtgcagagcaggaagtggagagatggcctgtgcagcaagacagtggagtaccaccggctggaccagaatgtgaatgaggccatgcccagcctgaagatcaccaatgactacatcttctag

SEQ ID NO: 18303 - DNA, 2349 bp, Artificial Sequence
  Description of Artificial Sequence: Synthetic coding sequence
atggcccccagcgcctgggccatctgctggctgctgggcggcctgctgctgcacggcggcagcagcggccccagccctggccccagcgtgccccggctgcggctgagctacagagacctgctgagcgccaacagaagtgccatcttcctgggcccccagggcagcctgaacctgcaggccatgtacctggatgagtacagagacaggctcttcctgggcggcctggatgccctgtacagcctgcggctggaccaggcctggccagacccccgggaggtgctgtggccaccccagcccggccagcgggaggagtgtgtgaggaagggccgggaccccctgacagaatgtgccaactttgtgcgggtgctgcagccccacaacagaacccacctgctggcctgtggcaccggggccttccagcccacctgtgccctgatcaccgtgggccacagaggagagcacgtgctgcacctggagcccggctctgtggagagcggccggggccgctgcccccatgagcccagccggccctttgccagcaccttcattgatggagagctgtacacaggcctgacagctgacttcctgggccgggaggccatgatcttccgcagcggcggccccaggcctgccctgcggagtgacagcgaccagagcctgctgcatgaccccaggtttgtgatggccgcccgcatccctgagaacagcgaccaggacaatgacaaggtgtacttcttcttcagcgagaccgtgcccagcccagatggcggcagcaaccacgtgacagtgtcccgggtgggccgggtgtgtgtgaatgatgctgggggccagagggtgctggtgaacaagtggagcaccttcctgaaggcccggctggtgtgcagcgtgcccggccctggaggagctgagacccactttgaccagctggaggatgtgttcctgctgtggcccaaggccggcaagagcctggaggtgtatgccctcttcagcacagtgtctgctgtgttccagggctttgctgtgtgtgtgtaccacatggctgacatctgggaggtgttcaacggcccctttgcccacagagatggcccccagcaccagtggggcccctacggcggcaaggtgcccttccccaggcctggggtgtgccccagcaagatgacagcccagcccggccggcccttcggcagcaccaaggactacccagatgaggtgctgcagtttgcccgggcccaccccctgatgttctggcctgtgcggcccaggcatggccggcctgtgctggtgaagacccacctggcccagcagctgcaccagatcgtggtggacagagtggaggctgaagatggcacctatgatgtgatcttcctgggcacagacagcggctctgtgctgaaggtgattgccctgcaggccggcggcagcgctgagcctgaggaggtggtgctggaggagctgcaggtgttcaaggtgcccacccccatcacagagatggagatctctgtgaagaggcagatgctgtatgtgggcagccggctgggcgtggcccagctgcggctgcaccagtgtgagacctatggaacagcctgtgccgagtgctgcctggcccgggacccctactgtgcctgggatggagccagctgcacccactaccggcccagcctgggcaagaggcgcttccggcggcaggacatccgccacggcaacccagccctgcagtgcctgggccagagccaggaggaggaggccgtgggcctggtggccgccaccatggtgtatggaacagagcacaacagcaccttcctggagtgcctgcccaagagcccccaggccgctgtgcgctggctgctgcagaggcctggagatgagggccctgaccaggtgaagacagatgagcgggtgctgcacacagagcggggcctgctcttccggcggctgagcagatttgatgctggcacctacacctgcaccaccctggagcacggcttcagccagacagtggtgcggctggccctggtggtgattgtggccagccagctggacaacctcttccccccagagcccaagccagaggagcccccagcccggggcggcctggccagcaccccacccaaggcctggtacaaggacatcctgcagctgattggatttgccaacctgccccgggtggatgagtactgtgagcgggtgtggtgccggggcaccacagagtgcagcggctgcttccgcagccgcagccggggcaagcaggcccggggcaagtcctgggccggcctggagctgggcaagaagatgaagagccgggtgcacgccgagcacaacagaacaccccgggaggtggaggccacctag

SEQ ID NO: 18304 - DNA, 1725 bp, Artificial Sequence
  Description of Artificial Sequence: Synthetic coding sequence
atggtggaggatggagctgaggagctggaggacctggtgcacttctctgtgtctgagctgcccagccggggctatggagtgatggaggagatccggcggcagggcaagctgtgtgatgtgaccctgaagatcggggaccacaagttcagcgcccaccgcatcgtgctggccgccagcatcccctacttccacgccatgttcaccaatgacatgatggagtgcaagcaggatgaaattgtgatgcagggcatggaccccagcgccctggaggccctgatcaactttgcctacaacggcaacctggccatcgaccagcagaatgtgcagagcctgctgatgggcgccagcttcctgcagctgcagagcatcaaggatgcctgctgcaccttcctgcgggagcggctgcaccccaagaactgcctgggcgtgcggcagtttgctgagaccatgatgtgtgctgtgctgtatgatgctgccaacagcttcatccaccagcactttgtggaggtgtccatgtctgaggagttcctggccctgcccctggaggatgtgctggagctggtgtccagagatgagctgaatgtgaagtctgaggagcaggtgtttgaggccgccctggcctgggtgcgctatgaccgggagcagaggggcccctacctgcctgagctgctgagcaacatccggctgcccctgtgccggccccagttcctgagtgacagagtgcagcaggatgacctggtgcgctgctgccacaagtgccgggacctggtggatgaggccaaggactaccacctgatgcctgagcggcggccccacctgcctgccttccgcacccggccccgctgctgcaccagcattgctggcctcatctatgctgtgggcggcctgaacagcgctggggacagcctgaatgtggtggaggtgtttgaccccatcgccaactgctgggagcgctgccggcccatgaccacagcccggagccgggtgggcgtggccgtggtgaatggcctgctgtatgccatcggcggctatgatggccagctgcggctgagcacagtggaggcctacaaccctgagacagacacctggaccagggtgggctccatgaacagcaagaggtctgccatgggcaccgtggtgctggatggccagatctacgtgtgtggcggctatgatggcaacagcagcctgagctctgtggagacctacagccctgagacagacaagtggacagtggtgacctccatgagcagcaacagatctgctgctggggtgacagtgtttgagggccgcatctacgtgtctgggggccatgatggcctgcagatcttcagctctgtggagcactacaaccaccacacagccacctggcaccctgctgctggcatgctgaacaagcgctgccgccacggggccgccagcctgggcagcaagatgtttgtgtgtggcggctatgatggcagcggcttcctgagcattgctgagatgtacagctctgtggccgaccagtggtgcctgattgtgcccatgcacaccaggaggagccgggtgtccctggtggccagctgtggccgcctgtatgctgtgggcggctatgatggccagagcaacctgagctctgtggagatgtatgaccctgagacagactgctggaccttcatggcccccatggcctgccacgagggcggcgtgggcgtgggctgcatccccctgctgaccatctag

SEQ ID NO: 18305 - DNA, 486 bp, Artificial Sequence
  Description of Artificial Sequence: Synthetic coding sequence
atggccaaggaggagccccagagcatcagccgggacctgcaggagctgcagaagaagctgagcctgctgattgacagcttccagaacaacagcaaggtggtggccttcatgaagagccctgtgggccagtacctggacagccaccccttcctggccttcaccctgctggtgttcatcgtgatgtctgctgtgcctgtgggcttcttcctgctgattgtggtgctgaccaccctggccgccctgctgggcgtcatcatcctggagggcctggtgatctctgtgggcggcttcagcctgctgtgcatcctgtgtggcctgggctttgtgtccctggccatgagcggcatgatgattgccagctatgtggtggtgagcagcctcatcagctgctggttcagcccccggcccctgacccagcagaacaccagctgtgacttcctgcctgccatgaagtctgctgagtttgagggcctgtaccaggagtag

SEQ ID NO: 18306 - DNA, 4503 bp, Artificial Sequence
  Description of Artificial Sequence: Synthetic coding sequence
atgacccgcatcctgacagccttcaaggtggtgaggaccctgaagacaggcttcggcttcaccaacgtgacagcccaccagaagtggaagttcagccggcccggcatccggctgctgtctgtgaaggcccagacagcccacatcgtgctggaggatggcaccaagatgaagggctacagctttggccaccccagctctgtggccggggaggtggtgttcaacacaggcctgggcggctacccagaggccatcacagatcctgcctacaagggccagatcctgaccatggccaaccccatcattggaaatggaggagccccagacaccacagccctggatgagctgggcctgagcaagtacctggagagcaatggcatcaaggtgtctggcctgctggtgctggactacagcaaggactacaaccactggctggccaccaagagcctgggccagtggctgcaggaggagaaggtgcctgccatctacggcgtggacaccaggatgctgaccaagatcatccgggacaagggcaccatgctgggcaagattgaatttgagggccagcctgtggactttgtggaccccaacaagcagaacctgattgctgaggtgtccaccaaggatgtgaaggtgtatggcaagggcaaccccaccaaggtggtggccgtggactgtggcatcaagaacaacgtcatccggctgctggtgaagagaggagctgaggtgcacctggtgccctggaaccacgacttcaccaagatggagtatgatggcatcctgattgctgggggccctggcaacccagccctggccgagcccctcatccagaatgtgaggaagatcctggagagtgacaggaaggagcccctgtttggcatcagcactggaaacctgatcaccggcctggccgccggggccaagacctacaagatgtccatggccaacagaggccagaaccagcctgtgctgaacatcaccaacaagcaggccttcatcacagcccagaaccacggctacgccctggacaacaccctgcctgctggctggaagcccctgtttgtgaatgtgaatgaccagaccaatgaaggcatcatgcatgagagcaagcccttctttgctgtgcagttccaccctgaggtgaccccaggccccatcgacacagagtacctgtttgacagcttcttcagcctcatcaagaagggcaaggccaccaccatcacctctgtgctgcccaagccagccctggtggccagccgggtggaggtgtccaaggtgctgatcctgggcagcggcggcctgagcatcggccaggccggggagtttgactacagcggcagccaggccgtgaaggccatgaaggaggagaatgtgaagacagtgctgatgaaccccaacatcgcctctgtgcagaccaatgaggtgggcctgaagcaggccgacacagtgtacttcctgcccatcaccccccagtttgtgacagaggtgatcaaggccgagcagccagatggcctcatcctgggcatgggcggccagacagccctgaactgtggggtggagctgttcaagaggggcgtgctgaaggagtatggagtgaaggtgctgggcacctctgtggagagcatcatggccacagaagatcggcagctgttcagtgacaagctgaatgagatcaatgagaagatcgcccccagctttgctgtggagagcattgaagatgccctgaaggctgctgacaccatcggctaccctgtgatgatccgcagcgcctatgccctgggcggcctgggcagcggcatctgccccaaccgggagaccctgatggacctgagcaccaaggcctttgccatgaccaaccagatcctggtggagaagtctgtgacaggctggaaggagattgaatatgaggtggtgagagatgctgatgacaactgtgtgacagtgtgcaacatggagaatgtggatgccatgggcgtgcacactggagacagcgtggtggtggccccagcccagaccctgagcaatgctgagttccagatgctgcggaggaccagcatcaacgtggtgcgccacctgggcatcgtgggggagtgcaacatccagtttgccctgcaccccacctccatggagtactgcatcatcgaggtgaatgcccggctgagccgcagcagcgccctggccagcaaggccaccggctaccccctggccttcatcgccgccaagatcgccctgggcatccccctgcctgagatcaagaatgtggtgtctgggaagaccagcgcctgctttgagcccagcctggactacatggtgaccaagatcccccgctgggacctggaccgcttccacggcaccagcagccgcatcggcagctccatgaagtctgtgggggaggtgatggccatcggccgcacctttgaggagagcttccagaaggccctgaggatgtgccaccccagcattgagggcttcaccccccggctgcccatgaacaaggagtggcccagcaacctggacctgaggaaggagctgtctgagcccagcagcacccgcatctatgccatcgccaaggccattgatgacaacatgagcctggatgaaattgagaagctgacctacatcgacaagtggttcctgtacaagatgagggacatcctgaacatggagaagaccctgaagggcctgaacagcgagagcatgacagaggagaccctgaagagggccaaggagatcggcttcagtgacaagcagatcagcaagtgcctgggcctgacagaggcccagacccgggagctgcggctgaagaagaacatccacccctgggtgaagcagattgacaccctggccgctgagtaccccagcgtgaccaactacctgtatgtgacctacaacggccaggagcatgatgtgaactttgatgaccacggcatgatggtgctgggctgcggcccctaccacatcggcagctctgtggagtttgactggtgtgctgtgagcagcatccgcaccctgcggcagctgggcaagaagacagtggtggtgaactgcaaccctgagaccgtgtccacagactttgatgaatgtgacaagctgtactttgaggagctgagcctggagcgcatcctggacatctaccaccaggaggcctgtggcggctgcatcatctctgtgggcggccagatccccaacaacctggccgtgcccctgtacaagaatggagtgaagatcatgggcaccagccccctgcagattgacagagcagaagatagaagcatcttctctgctgtgctggatgagctgaaggtggcccaggccccctggaaggctgtgaacaccctgaatgaggccctggagtttgccaagtctgtggactacccctgcctgctgcggcccagctatgtgctgagcggcagcgccatgaatgtggtgttttctgaagatgagatgaagaagttcctggaggaggccaccagggtgtcccaggagcaccctgtggtgctgaccaagtttgtggagggcgcccgggaggtggagatggatgctgtgggcaaggatggccgggtcatcagccacgccatcagcgagcacgtggaggatgctggggtgcacagcggagatgccaccctgatgctgcccacccagaccatcagccagggcgccatcgagaaggtgaaggatgccaccaggaagatcgccaaggcctttgccatcagcggccccttcaacgtgcagttcctggtgaagggaaatgatgtgctggtgattgagtgcaacctgcgggccagccgctccttcccctttgtgtccaagaccctgggcgtggacttcattgatgtggccaccaaggtgatgattggagaaaatgtggatgagaagcacctgcccaccctggaccaccccatcatcccagctgactatgtggccatcaaggcccccatgttctcctggccccggctgagagatgctgaccccatcctgcgctgtgagatggccagcactggagaggtggcctgcttcggggagggcatccacacagccttcctgaaggccatgctgagcacaggcttcaagatcccccagaagggcatcctgattggcatccagcagagcttccggccccgcttcctgggcgtggccgagcagctgcacaatgaaggcttcaagctgtttgccacagaggccaccagtgactggctgaatgccaacaacgtgcctgccacccctgtggcctggcccagccaggagggccagaaccccagcctgagcagcatcaggaagctgatcagagatggcagcattgacctggtgatcaacctgcccaacaacaacaccaagtttgtgcatgacaactacgtgatcagaagaacagctgtggacagcggcatccccctgctgaccaacttccaggtgaccaagctgtttgctgaggccgtgcagaagagcaggaaggtggacagcaagagcctcttccactaccggcagtacagcgctgggaaggccgcctag

SEQ ID NO: 18307 - DNA, 846 bp, Artificial Sequence
  Description of Artificial Sequence: Synthetic coding sequence
atggctgtgaatgtgtacagcacctctgtgaccagcgagaacctgagcagacatgacatgctggcctgggtgaatgacagcctgcacctgaactacaccaagattgagcagctgtgcagcggggccgcctactgccagttcatggacatgctgtttcctggctgtgtgcacctgaggaaggtgaagttccaggccaagctggagcacgagtacatccacaacttcaaggtgctgcaggccgccttcaagaagatgggcgtggacaagatcatccctgtggagaagctggtgaagggcaagttccaggacaactttgagttcatccagtggttcaagaagttctttgatgccaactatgatggcaaggactacaaccccctgctggcccggcagggccaggatgtggcccccccacccaaccctggggaccagatcttcaacaagagcaagaagctgattggaacagctgtgccccagaggaccagccccaccggccccaagaacatgcagaccagcggccgcctgagcaatgtggccccaccctgcatcctgaggaagaacccccccagcgccagaaatggaggccacgagacagatgcccagatcctggagctgaaccagcagctggtggacctgaagctgactgtggatggcctggagaaggagcgggacttctacttcagcaagctgcgggacatcgagctgatctgccaggagcacgagagcgagaacagccctgtgatcagcggcatcatcggcatcctgtatgccacagaggagggctttgcccccccagaagatgatgaaattgaggagcaccagcaggaggaccaggatgagtactag

SEQ ID NO: 18308 - DNA, 531 bp, Artificial Sequence
  Description of Artificial Sequence: Synthetic coding sequence
atggccctgtggagggcctaccagagggccctggccgcccacccctggaaggtgcaggtgctgacagctggcagcctgatgggcctgggggacatcatcagccagcagctggtggagcggcggggcctgcaggagcaccagaggggccgcaccctgaccatggtgtccctgggctgcggctttgtgggccctgtggtgggcggctggtacaaggtgctggaccgcttcatccctggcaccaccaaggtggatgccctgaagaagatgctgctggaccagggcggctttgccccctgcttcctgggctgcttcctgcccctggtgggcgccctgaatggcctgagcgcccaggacaactgggccaagctgcagagggactacccagatgccctgatcaccaactactacctgtggccagctgtgcagctggccaacttctacctggtgcccctgcactaccgcctggccgtggtgcagtgtgtggccgtcatctggaacagctacctgtcctggaaggcccaccggctgtag

SEQ ID NO: 18309 - DNA, 1143 bp, Artificial Sequence
  Description of Artificial Sequence: Synthetic coding sequence
atggccagcctgcctgtgctgcagaaggagagcgtcttccagagcggggcccacgcctaccgcatcccagccctgctgtacctgcccggccagcagagcctgctggcctttgctgagcagagggccagcaagaaggatgagcacgccgagctgattgtgctgcggcggggggactatgatgcccccacccaccaggtgcagtggcaggcccaggaggtggtggcccaggcccggctggatggccaccgctccatgaacccctgccccctgtatgatgcccagacaggcaccctcttcctgttcttcatcgccatccctggccaggtgacagagcagcagcagctgcagacccgggccaacgtgacccggctgtgccaggtgaccagcacagaccacggccgcacctggagcagcccccgggacctgacagatgctgccatcggccctgcctaccgggagtggagcacctttgctgtgggccctggccactgcctgcagctgcatgaccgggcccggagcctggtggtgcctgcctatgcctacaggaagctgcaccccatccagaggcccatccccagcgccttctgcttcctgagccatgaccacggccgcacctgggcccggggccactttgtggcccaggacaccctggagtgccaggtggccgaggtggagaccggggagcagagggtggtgaccctgaatgcccggagccacctgcgggcccgggtgcaggcccagagcaccaatgatggcctggacttccaggagagccagctggtgaagaagctggtggagcccccaccccagggctgccagggcagcgtcatctccttccccagccccaggagcggccctggcagccctgcccagtggctgctgtacacccaccccacccacagctggcagagagctgacctgggcgcctacctgaacccccggcccccagcccctgaggcctggagcgagcctgtgctgctggccaagggcagctgtgcctacagcgacctgcagagcatgggcaccggcccagatggcagccccctgtttggctgcctgtatgaggccaatgactatgaggagatcgtgttcctgatgttcaccctgaagcaggccttccctgctgagtacctgccccagtag

SEQ ID NO: 18310 - DNA, 3165 bp, Artificial Sequence
  Description of Artificial Sequence: Synthetic coding sequence
atggctgctgtgaaggagcccctggagttccacgccaagaggccctggaggcctgaggaggccgtggaggaccctgatgaggaggatgaggacaacaccagcgaggctgaaaatggcttcagcctggaggaggtgctgcggctgggcggcaccaagcaggactacctgatgctggccaccctggatgaaaatgaggaggtgattgatggcggcaagaagggggccattgatgacctgcagcagggcgagctggaggccttcatccagaacctgaacctggccaagtacaccaaggccagcctggtggaggaggatgagcctgctgagaaggagaacagcagcaagaaggaggtgaagatccccaagatcaacaacaagaacacagctgagagccagaggacctctgtgaacaaggtgaagaacaagaacagacctgagccccacagtgatgaaaatggcagcaccacccccaaggtgaagaaggacaagcagaacatctttgagttctttgagcggcagaccctgctgctgcggcctgggggcaagtggtatgacctggagtacagcaatgagtacagcctgaagccccagccccaggatgtggtgtccaagtacaagaccctggcccagaagctgtaccagcacgagatcaacctcttcaagagcaagaccaacagccagaagggggccagcagcacctggatgaaggccatcgtgagcagcggcaccctgggggacaggatggccgccatgatcctgctgatccaggatgatgctgtgcacaccctgcagtttgtggagaccctggtgaacctggtgaagaagaagggcagcaagcagcagtgcctgatggccctggacaccttcaaggagctgctgatcacagacctgctgcctgacaacaggaagctgcgcatcttcagccagaggccctttgacaagctggagcagctgagcagcggcaacaaggacagccgggaccggcggctcatcctgtggtactttgagcaccagctgaagcacctggtggccgagtttgtgcaggtgctggagaccctgagccatgacaccctggtgaccaccaagacccgggccctgactgtggcccacgagctgctgtgcaacaagccagaggaggagaaggccctgctggtgcaggtggtgaacaagctgggggacccccagaaccgcatcgccaccaaggccagccacctgctggagaccctgctgtgcaagcaccccaacatgaagggcgtggtgtctggagaggtggagcggctgctcttccgcagcaacatcagcagcaaggcccagtactatgccatctgcttcctgaaccagatggccctgagccatgaggagagcgagctggccaacaagctgatcaccgtgtacttctgcttcttccgcacctgtgtgaagaagaaggatgtggagagcaagatgctgagcgccctgctgactggagtgaacagagcctacccctacagccagacaggagatgacaaggtgcgggagcagattgacaccctcttcaaggtgctgcacatcgtgaacttcaacacctctgtgcaggccctgatgctgctcttccaggtgatgaacagccagcagaccatcagtgaccgctactacacagccctgtacaggaagatgctggaccccggcctgatgacctgcagcaagcaggccatgttcctgaacctggtgtacaagagcctgaaggctgacatcgtgctgcggcgggtgaaggcctttgtgaagaggctgctgcaggtgacctgccagcagatgccacccttcatctgtggggccctgtacctggtgtctgagatcctgaaggccaagccaggcctgcggagccagctggatgaccaccctgagagtgatgatgaggagaacttcattgatgccaatgatgatgaggacatggagaagttcacagatgctgacaaggagacagagatcgtgaagaagctggagacagaggagaccgtgcctgagacagatgtggagaccaagaagccagaggtggcctcctgggtgcactttgacaacctgaagggcggcaagcagctgaacaagtatgaccccttcagcaggaaccccctcttctgtggggctgagaacaccagcctgtgggagctgaagaagctgtctgtgcacttccaccccagcgtggccctgtttgccaagaccatcctgcagggcaactacatccagtacagcggggaccccctgcaggacttcaccctgatgaggttcctggacagatttgtgtacagaaaccccaagccccacaagggcaaggaaaatacagattctgtggtgatgcagcccaagaggaagcacttcatcaaggacatccgccacctgcctgtgaacagcaaggagttcctggccaaggaggagagccagatccctgtggatgaggtgttcttccaccgctactacaagaaggtggccgtgaaggagaagcagaagagagatgctgatgaggagagcattgaagatgtggatgatgaggagtttgaggagctgattgacacctttgaagatgacaactgcttcagcagcggcaaggatgacatggactttgctggaaatgtgaagaagaggaccaagggggccaaggacaacaccctggatgaggacagcgagggcagtgatgatgagctgggcaacctggatgatgatgaggtgtccctgggctccatggatgatgaggagtttgctgaggtggatgaagatggcggcaccttcatggatgtgctggatgatgaaagtgaatctgtgcctgagctggaggtgcacagcaaggtgtccaccaagaagagcaagaggaaaggaacagatgactttgattttgctggcagcttccagggccccaggaagaagaagaggaacctgaatgacagcagcctgtttgtgtctgctgaggagtttggccacctgctggatgagaacatgggcagcaagtttgacaacatcggcatgaatgccatggccaacaaggacaatgccagcctgaagcagctgcgctgggaggccgagagagatgactggctgcacaacagagatgccaagagcatcatcaagaagaagaagcacttcaagaagaagaggatcaagaccacccagaagaccaagaagcagaggaagtag

SEQ ID NO: 18311 - DNA, 1107 bp, Artificial Sequence
  Description of Artificial Sequence: Synthetic coding sequence
atggagcccggccagccccgggagccccaggagccccgggagcccggccctggagctgagacagctgctgcccctgtgtgggaggaggccaagatcttctatgacaacctggcccccaagaagaagcccaagagccccaagccccagaatgctgtgaccatcgctgtgagcagccgggccctcttcaggatggatgaggagcagcagatctacacagagcagggcgtggaggagtatgtgcgctaccagctggagcatgaaaatgagcccttcagccctggccctgccttcccctttgtgaaggccctggaggccgtgaacagaaggctgcgggagctgtacccagattctgaagatgtgtttgatattgtgctgatgaccaacaaccacgcccaggtgggcgtgcggctcatcaacagcatcaaccactatgacctcttcatcgagcgcttctgcatgactggaggcaacagccccatctgctacctgaaggcctaccacaccaacctgtacctgtctgcagatgctgagaaggtgcgggaggccattgatgagggcattgctgctgccaccatcttcagccccagcagagatgtggtggtgtcccagagccagctgcgggtggcctttgatggagatgctgtgctcttcagtgatgaaagtgagcgcatcgtgaaggcccacggcctggaccgcttctttgagcacgagaaggcccacgagaacaagcccctggcccagggccccctgaagggcttcctggaggccctgggccgcctgcagaagaagttctacagcaagggcctgcggctggagtgccccatccgcacctacctggtgacagcccggtctgctgccagcagcggggcccgggccctgaagaccctgcgctcctggggcctggagacagatgaggccctcttcctggccggggcccccaagggccccctgctggagaagatccggccccacatcttctttgatgaccagatgtttcatgtggccggggcccaggagatgggcaccgtggccgcccacgtgccctatggagtggcccagacccccaggagaacagccccagccaagcaggcccccagcgcccagtag

SEQ ID NO: 18312 - DNA, 1080 bp, Artificial Sequence
  Description of Artificial Sequence: Synthetic coding sequence
atgctgtctgctgccagccgggtggtgtccagagctgctgtgcactgtgccctgcggagccccccacctgaggcccgggccctggccatgagcaggcctcctccaccccgggtggcctctgtgctgggcaccatggagatgggccgcaggatggatgccccagccagcgctgctgctgtgcgggccttcctggagcggggccacacagagctggacacagccttcatgtacagtgatggccagagcgagaccatcctgggcggcctgggcctgggcctgggcggcggggactgccgggtgaagatcgccaccaaggccaacccctgggatggcaagagcctgaagccagacagcgtgcgcagccagctggagaccagcctgaagaggctgcagtgcccccaggtggacctcttctacctgcacgccccagaccacggcacccctgtggaggagaccctgcacgcctgccagaggctgcaccaggagggcaagtttgtggagctgggcctgagcaactatgcctcctgggaggtggccgagatctgcaccctgtgcaagagcaatggctggatcctgcccaccgtgtaccagggcatgtacaatgccaccacccggcaggtggagacagagctgttcccctgcctgcggcacttcggcctgcgcttctacgcctacaaccccctggccggcggcctgctgaccgggaagtacaagtatgaggacaaggatggcaagcagcctgtgggccgcttcttcggcaacagctgggccgagacctacagaaaccgcttctggaaggagcaccactttgaggccatcgccctggtggagaaggccctgcaggccgcctacggggccagcgcccccagcgtgaccagcgctgccctgcgctggatgtaccaccacagccagctgcagggcgcccatggagatgctgtgatcctgggcatgagcagcctggagcagctggagcagaacctggccgccacagaggagggccccctggagcctgctgtggtggatgccttcaaccaggcctggcacctggtggcccatgaatgtcccaactacttcagatag

SEQ ID NO: 18313 - DNA, 561 bp, Artificial Sequence
  Description of Artificial Sequence: Synthetic coding sequence
atggatgctgacagtgatgtggccctggacatcctgatcaccaacgtggtgtgtgtgttccgcacccgctgccacctgaacctgaggaagatcgccctggagggcgccaacgtcatctacaagagagatgtgggcaaggtgctgatgaagctgaggaagccccgcatcacagccaccatctggagcagcggcaagatcatctgcacaggagccaccagcgaggaggaggccaagtttggagcccggcggctggcccggagcctgcagaagctgggcttccaggtgatcttcacagacttcaaggtggtgaatgtgctggccgtgtgcaacatgccctttgagatccggctgcctgagttcaccaagaacaaccggccccacgccagctatgagcctgagctgcaccctgctgtgtgctaccgcatcaagagcctgcgggccaccctgcagatcttcagcacaggcagcatcaccgtgacaggccccaacgtgaaggctgtggccacagctgtggagcagatctacccctttgtgtttgagagcaggaaggagatcctgtag

SEQ ID NO: 18314 - DNA, 537 bp, Artificial Sequence
  Description of Artificial Sequence: Synthetic coding sequence
atggccgcccccctgggcggcatgttcagcggccagcccccaggccccccccaggcccctcctggcctgcccggccaggccagcctgctgcaggccgcccctggggccccccggcccagcagcagcaccctggtggatgagctggagagcagctttgaggcctgctttgccagcctggtgtcccaggactatgtgaatggaacagaccaggaggagatcagaactggagtggaccagtgcatccagaagttcctggacatcgcccggcagacagagtgcttcttcctgcagaagaggctgcagctgtctgtgcagaagccagagcaggtgatcaaggaggatgtgtctgagctgagaaatgagctgcagaggaaggatgccctggtgcagaagcacctgaccaagctgcggcactggcagcaggtgctggaggacatcaacgtgcagcacaagaagccagctgacatcccccagggcagcctggcctacctggagcaggccagcgccaacatcccagcccccctgaagcccacctag

SEQ ID NO: 18315 - DNA, 738 bp, Artificial Sequence
  Description of Artificial Sequence: Synthetic coding sequence
atggagaagacagagctgatccagaaggccaagctggccgagcaggccgagagatatgatgacatggccacctgcatgaaggctgtgacagagcagggcgctgagctgagcaatgaggagaggaacctgctgtctgtggcctacaagaatgtggtgggcggcagaagaagtgcctggagggtcatcagcagcattgagcagaagacagacaccagtgacaagaagctgcagctgatcaaggactaccgggagaaggtggagagcgagctgcggagcatctgcaccaccgtgctggagctgctggacaagtacctgattgccaatgccaccaaccctgagagcaaggtgttctacctgaagatgaagggggactacttccgctacctggccgaggtggcctgtggagatgacaggaagcagaccatcgacaacagccagggcgcctaccaggaggcctttgacatcagcaagaaggagatgcagcccacccaccccatccggctgggcctggccctgaacttctctgtgttctactatgagatcctgaacaaccctgagctggcctgcaccctggccaagacagcctttgatgaggccatcgccgagctggacaccctgaatgaagacagctacaaggacagcaccctcatcatgcagctgctgcgggacaacctgaccctgtggaccagtgacagcgctggggaggagtgtgatgctgctgagggcgctgagaactag

SEQ ID NO: 18316 - DNA, 534 bp, Artificial Sequence
  Description of Artificial Sequence: Synthetic coding sequence
atgcctggcctgacagcctacttcggcctgctggagatctgtggggtgaagggcggggagaccgtgatggtgaatgctgctgctggagctgtgggctctgtggtgggccagatcgccaagctgaagggctgcaaggtggtgggcgctgtgggcagtgatgagaaggtggcctacctgcagaagctgggctttgatgtggtgttcaactacaagacagtggagagcctggaggagaccctgaagaaggccagcccagatggctatgactgctactttgacaacgtgggcggggagttcagcaacacagtcatcggccagatgaagaagtttggaagaattgccatctgtggggccatcagcacctacaacagaacaggccccctgcccccaggccccccacctgagatcgtcatctaccaggagctgaggatggaggcctttgtggtgtaccgctggcagggagatgcccggcagaaggccctgaaggacctgctgaagtgggtgctggagctgccctacttcgtcatcgactag

SEQ ID NO: 18317 - DNA, 3660 bp, Artificial Sequence
  Description of Artificial Sequence: Synthetic coding sequence
atgtttggagctggagatgaagatgacacagacttcctgagccccagcggcggggcccggctggccagcctgtttggcctggaccaggccgccgccggccacggcaatgagttcttccagtacacagcccccaagcagcccaagaagggccagggcacagctgccaccggcaaccaggccacccccaagacagccccagccaccatgagcacccccaccatcctggtggccacagctgtgcacgcctaccgctacaccaacggccagtatgtgaagcagggcaagtttggagctgctgtgctgggcaaccacacagcccgggagtaccgcatcctgctgtacatcagccagcagcagcctgtgacagtggcccgcatccacgtgaactttgagctgatggtgcggcccaacaactacagcaccttctatgatgaccagaggcagaactggagcatcatgtttgagagcgagaaggctgctgtggagttcaacaagcaggtgtgcatcgccaagtgcaacagcaccagcagcctggatgctgtgctgagccaggacctgattgtggctgatggccctgctgtggaggtgggggacagcctggaggtggcctacacaggctggctgttccagaaccacgtgctgggccaggtgtttgacagcacagccaacaaggacaagctgctgcggctgaagctgggcagcggcaaggtgatcaagggctgggaggatggcatgctgggcatgaagaagggcggcaagaggctgctgattgtgcccccagcctgtgctgtgggcagcgagggcgtcatcggctggacccaggccacagacagcatcctggtgtttgaggtggaggtgagaagagtgaagtttgcccgggacagcggcagtgatggccacagcgtgagcagccgggacagcgctgcccccagccccatccctggagctgacaacctgtctgctgaccctgtggtgtccccacccaccagcatccccttcaagtctggagagcccgccctgcggaccaagagcaacagcctgtctgagcagctggccatcaacaccagcccagatgctgtgaaggccaagctgatcagcaggatggccaagatgggccagcccatgctgcccatcctgcccccccagctggacagcaatgacagcgagattgaagatgtgaacaccctgcagggcggcggccagcctgtggtgaccccatctgtgcagcccagcctgcacccagcccacccagccctgccccagatgaccagccaggccccccagcccagcgtgacaggcctgcaggcccccagcgctgccctgatgcaggtgagcagcctggacagccacagcgctgtgtctggaaatgcccagagcttccagccctatgccggcatgcaggcctatgcctacccccaggccagcgctgtgaccagccagctgcagcctgtgcggcccctgtacccagcccccctgagccagcccccccacttccagggcagcggggacatggccagcttcctgatgacagaggcccggcagcacaacacagagatccgcatggctgtgtccaaggtggccgacaagatggaccacctgatgaccaaggtggaggagctgcagaagcacagcgctggcaacagcatgctgatccccagcatgtctgtgaccatggagacctccatgatcatgagcaacatccagaggatcatccaggagaatgaaaggctgaagcaggagatcctggagaagagcaaccgcatcgaggagcagaatgacaagatcagcgagctgattgaaagaaaccagagatatgtggagcagagcaacctgatgatggagaagaggaacaacagcctgcagacagccacagagaacacccaggcccgggtgctgcacgccgagcaggagaaggccaaggtgacagaggagctggccgccgccacagcccaggtgagccacctgcagctgaagatgacagcccaccagaagaaggagacagagctgcagatgcagctgacagagagcctgaaggagacagacctgctgcggggccagctgaccaaggtgcaggccaagctgtctgagctgcaggagaccagcgagcaggcccagagcaagttcaagtctgagaagcagaacaggaagcagctggagctgaaggtgaccagcctggaggaggagctgacagacctgcgggtggagaaggagagcctggagaagaacctgtctgagaggaagaagaagagcgcccaggagaggagccaggccgaggaggagattgatgagatcaggaagagctaccaggaggagctggacaagctgcggcagctgctgaagaagaccagggtgtccacagaccaggccgctgctgagcagctgagcctggtgcaggccgagctgcagacccagtgggaggccaagtgtgagcacctgctggccagcgccaaggatgagcacctgcagcagtaccaggaggtgtgtgcccagagagatgcctaccagcagaagctggtgcagctgcaggagaagtgcctggccctgcaggcccagatcacagccctgaccaagcagaatgagcagcacatcaaggagctggagaagaacaagagccagatgtctggagtggaggccgccgccagtgaccccagcgagaaggtgaagaagatcatgaaccaggtgttccagagcctgcggcgggagtttgagctggaggagagctacaatggaagaaccatcctgggcaccatcatgaacaccatcaagatggtgaccctgcagctgctgaaccagcaggagcaggagaaggaggagagcagcagcgaggaggaggaggagaaggccgaggagcggccccggcggcccagccaggagcagagcgccagcgccagcagcggccagccccaggcccccctgaaccgggagaggcctgagagccccatggtgcccagcgagcaggtggtggaggaggccgtgcccctgcccccccaggccctgaccaccagccaggacggccacagaagaaaaggagacagcgaggccgaggccctgtctgagatcaaggatggcagcctgcccccagagctgagctgcatccccagccaccgggtgctgggcccccccaccagcatccccccagagcccctgggccctgtgtccatggacagtgaatgtgaggagagcctggccgccagccccatggccgccaagccagacaaccccagcggcaaggtgtgtgtgcgggaggtggccccagatggccccctgcaggagagcagcacccggctgagcctgaccagtgaccctgaggagggggaccccctggccctgggccctgagagccctggagagccccagcccccccagctgaagaaggatgatgtgaccagcagcacaggcccccacaaggagctgagcagcacagaagctggcagcacagtggccggggccgccctgcggcccagccaccacagccagaggagcagcctgtctggagatgaggaggatgagctgttcaagggggccaccctgaaggccctgcggcccaaggcccagcctgaggaggaggatgaagatgaggtgtccatgaagggccggcccccacccacccccctgtttggagatgatgatgatgatgatgacatcgactggctgggctag

SEQ ID NO: 18318 - DNA, 6978 bp, Artificial Sequence
  Description of Artificial Sequence: Synthetic coding sequence
atgaagaagggcagccagcagaagatcttcagcaaggccaagatccccagcagcagccacagccccatccccagctccatgagcaacatgaggagccgcagcctgagccccctgattggcagcgagaccctgcccttccacagcggcggccagtggtgtgagcaggtggagattgctgatgagaacaacatgctgctggactaccaggaccacaagggagctgacagccacgccggcgtgcgctacatcacagaggccctgatcaagaagctgaccaagcaggacaacctggccctgatcaagagcctgaacctgagcctgagcaaggatggcggcaagaagttcaagtacatcgagaacctggagaagtgtgtgaagctggaggtgctgaacctgagctacaacctgattggcaagattgagaagctggacaagctgctgaagctgcgggagctgaacctgagctacaacaagatcagcaagattgagggcatcgagaacatgtgcaacctgcagaagctgaacctggccggaaatgaaattgagcacatccctgtgtggctgggcaagaagctgaagagcctgcgggtgctgaacctgaagggcaacaagatcagcagcctgcaggacatcagcaagctgaagcccctgcaggacctgatcagcctcatcctggtggagaaccctgtggtgaccctgccccactacctgcagttcaccatcttccacctgcggagcctggagagcctggagggccagcctgtgaccacccaggaccggcaggaggcctttgagcgcttcagcctggaggaggtggagcggctggagcgggacctggagaagaagatgattgaaacagaggagctgaagagcaagcagacccgcttcctggaggagatcaagaaccaggacaagctgaacaagagcctgaaggaggaggccatgctgcagaagcagagctgtgaggagctgaagagtgacctgaacaccaagaatgagctgctgaagcagaagaccatcgagctgacccgggcctgccagaagcagtatgagctggagcaggagctggccttctacaagattgatgccaagtttgagcccctgaactactaccccagtgaatatgcagaaattgacaaggccccagatgagagcccctacatcggcaagagccgctacaagaggaacatgtttgccacagagagctacatcattgattctgcccaggccgtgcagatcaagaagatggagccagatgagcagctgagaaatgaccacatgaacctgcggggccacacccccctggacacccagctggaggacaaggagaagaagatctctgctgcccagacccggctgtctgagctgcatgatgaaattgagaaggccgagcagcagatcctgcgggccacagaggagttcaagcagctggaggaggccatccagctgaagaagatcagcgaggccggcaaggacctgctgtacaagcagctgagcggccgcctgcagctggtgaacaagctgcggcaggaggccctggacctggagctgcagatggagaagcagaagcaggagattgctgggaagcagaaggagatcaaggacctgcagatcgccatcgacagcctggacagcaaggaccccaagcacagccacatgaaggcccagaagagcggcaaggagcagcagctggacatcatgaacaagcagtaccagcagctggagagccggctggatgagatcctgagcagaattgccaaggagacagaggagatcaaggacctggaggagcagctgacagagggccagattgctgccaatgaggccctgaagaaggacctggagggcgtcatcagcggcctgcaggagtacctgggcaccatcaagggccaggccacccaggcccagaatgaatgtaggaagctgagagatgagaaggagaccctgctgcagaggctgacagaggtggagcaggagcgggaccagctggagatcgtggccatggatgctgagaacatgaggaaggagctggccgagctggagagcgccctgcaggagcagcacgaggtgaatgccagcctgcagcagacccagggcgacctgagcgcctatgaggccgagctggaggcccggctgaacctgagagatgctgaggccaaccagctgaaggaggagctggagaaggtgacccggctgacccagctggagcagagcgccctgcaggccgagctggagaaggagcggcaggccctgaagaatgccctgggcaaggcccagttcagcgaggagaaggagcaggagaacagcgagctgcacgccaagctgaagcacctgcaggatgacaacaacctgctgaagcagcagctgaaggacttccagaaccacctgaaccacgtggtggatggcctggtgcggcctgaggaggtggccgcccgggtggatgagctgcggaggaagctgaagctgggcaccggggagatgaacatccacagccccagtgatgtgctgggcaagagcctggccgacctgcagaagcagttcagcgagatcctggcccggagcaagtgggagagagatgaggcccaggtgcgggagaggaagctgcaggaggagatggccctgcagcaggagaagctggccaccggccaggaggagttccggcaggcctgtgagcgggccctggaggccaggatgaactttgacaagaggcagcacgaggcccgcatccagcagatggagaatgagatccactacctgcaggagaacctgaagtccatggaggagatccagggcctgacagacctgcagctgcaggaggctgatgaggagaaggagcgcatcctggcccagctgcgggagctggagaagaagaagaagctggaggatgccaagagccaggagcaggtgtttggcctggacaaggagctgaagaagctgaagaaggctgtggccaccagtgacaagctggccacagctgagctgaccatcgccaaggaccagctgaagagcctgcatggaacagtgatgaagatcaaccaggagcgggcagaggagctgcaggaggccgagcgcttcagcaggaaggccgcccaggccgcccgggacctgaccagggctgaggccgagattgagctgctgcagaacctgctgcggcagaagggggagcagttccggctggagatggagaagacaggagtgggcaccggggccaacagccaggtgctggagattgagaagctgaatgagaccatggagcggcagaggacagaaattgcccggctgcagaatgtgctggacctgactggaagtgacaacaagggcggctttgaaaatgtgctggaggagattgctgagctgcggcgggaggtgtcctaccagaatgactacatcagctccatggctgaccccttcaagagaagaggctactggtacttcatgcctcctccacccagcagcaaggtgagcagccacagcagccaggccaccaaggacagcggcgtgggcctgaagtacagcgccagcacccctgtgaggaagccccggcccggccagcaggacggcaaggagggcagccagcccccaccagccagcggctactgggtgtacagccccatccgcagcggcctgcacaagctgttccccagcagagatgctgacagcggcggggacagccaggaggagagcgagctggatgaccaggaggagcccccatttgtgcccccacctggctacatgatgtacacagtgctgcctgatggcagccctgtgccccagggcatggccctgtatgcccctcctccacccctgcccaacaacagccggcccctgaccccaggcaccgtggtgtatggccccccacctgctggggcccccatggtgtatggccccccaccacccaacttcagcatccccttcatccccatgggcgtgctgcactgcaatgtgcctgagcaccacaacctggagaatgaggtgtcccggctggaggacatcatgcagcacctgaagagcaagaagcgggaggagcgctggatgagggccagcaagaggcagagcgagaaggagatggaggagctgcaccacaacattgatgacctgctgcaggagaagaagagcctggagtgtgaggtggaggagctgcacaggacagtgcagaagaggcagcagcagaaggacttcattgatggaaatgtggagagcctgatgacagagctggagattgagaagagcctgaagcaccatgaagatattgtggatgaaattgagtgcatcgagaagaccctgctgaagagaagaagtgagctgcgggaggccgaccggctgctggccgaggccgagagcgagctgagctgcaccaaggagaagaccaagaatgctgtggagaagttcacagatgccaagaggagcctgctgcagacagaaagtgatgctgaggagctggagcggcgggcccaggagacagctgtgaacctggtgaaggctgaccagcagctgcggagcctgcaggctgatgccaaggacctggagcagcacaagatcaagcaggaggagatcctgaaggagatcaacaagatcgtggccgccaaggacagcgacttccagtgcctgagcaagaagaaggagaagctgacagaggagctgcagaagctgcagaaggacatcgagatggccgagagaaatgaagaccaccacctgcaggtgctgaaggagagcgaggtgctgctgcaggccaagagagctgagctggagaagctgaagagccaggtgaccagccagcagcaggagatggctgtgctggaccggcagctgggccacaagaaggaggagctgcacctgctgcagggctccatggtgcaggccaaggctgacctgcaggaggccctgcggctgggggagacagaggtgacagagaagtgcaaccacatccgggaggtgaagagcctgctggaggagctgtccttccagaagggggagctgaatgtgcagatcagcgagaggaagacccagctgaccctcatcaagcaggagattgagaaggaggaggagaacctgcaggtggtgctgcggcagatgagcaagcacaagacagagctgaagaacatcctggacatgctgcagctggagaaccacgagctgcagggcctgaagctgcagcacgaccagagggtgtctgagctggagaagacccaggtggccgtgctggaggagaagctggagctggagaacctgcagcagatcagccagcagcagaagggggagattgagtggcagaagcagctgctggagcgggacaagcgggagattgaaagaatgacagctgagagccgggccctgcagagctgtgtggagtgcctgagcaaggagaaggaggacctgcaggagaagtgtgacatctgggagaagaagctggcccagaccaagagggtgctggccgctgctgaggagaacagcaagatggagcagagcaacctggagaagctggagctgaatgtgaggaagctgcagcaggagctggaccagctgaacagagacaagctgagcctgcacaatgacatcagcgccatgcagcagcagctgcaggagaagcgggaggccgtgaacagcctgcaggaggagctggccaacgtgcaggaccacctgaacctggccaagcaggacctgctgcacaccaccaagcaccaggatgtgctgctgtctgagcagacccggctgcagaaggacatcagcgagtgggccaacagatttgaggactgccagaaggaggaggagaccaagcagcagcagctgcaggtgctgcagaatgaaattgaggagaacaagctgaagctggtgcagcaggagatgatgttccagaggctgcagaaggagcgggagagcgaggagagcaagctggagaccagcaaggtgaccctgaaggagcagcagcaccagctggagaaggagctgacagaccagaagagcaagctggaccaggtgctgagcaaggtgctggccgctgaggagcgggtgaggaccctgcaggaggaggagcgctggtgtgagagcctggagaagaccctgagccagaccaagaggcagctgtctgagcgggagcagcagctggtggagaagagcggggagctgctggccctgcagaaggaggccgacagcatgagagctgacttcagcctgctgaggaaccagttcctgacagagaggaagaaggccgagaagcaggtggccagcctgaaggaggccctgaagatccagaggagccagctggagaagaacctgctggagcagaagcaggagaacagctgcatccagaaggagatggccaccatcgagctggtggcccaggacaaccacgagcgggcccggcggctgatgaaggagctgaaccagatgcagtatgagtacacagagctgaagaagcagatggccaaccagaaggacctggagcggcggcagatggagatcagtgatgccatgaggaccctgaagtctgaggtgaaggatgagatccgcaccagcctgaagaacctgaaccagttcctgcctgagctgcctgctgacctggaggccatcctggagagaaatgaaaacctggagggggagctggagagcctgaaggagaacctgcccttcaccatgaatgaaggcccctttgaggagaagctgaacttcagccaggtgcacatcatggatgagcactggagaggagaggccctgcgggagaagctgcggcacagagaagatcggctgaaggcccagctgcggcactgcatgagcaagcaggccgaggtgctgatcaagggcaagaggcagacagagggcaccctgcacagcctgcggcggcaggtggatgccctgggggagctggtgaccagcaccagcgctgacagcgccagcagccccagcctgagccagctggagagcagcctgacagaggacagccagctgggccagaaccaggagaagaatgccagcgccaggtag

SEQ ID NO: 18319 - DNA, 2811 bp, Artificial Sequence
  Description of Artificial Sequence: Synthetic coding sequence
atggagccagacatcatccgcatgtacagcagcagccccccacccctggacaacggggctgaagatgatgatgatgatgaatttggagaatttggaggcttcagcgaggtgagccccagcggcgtgggctttgtggactttgacaccccagactacacccggcccaaggaggagtttgtgcccagcaaccacttcatgcccatccacgagttctctgaaaatgtggacagcctgaccagcttcaagagcatcaagaatggaaatgacaaggacatcacagctgagctgagcgcccctgtgaagggccagagtgatgtgctgctgagcaccaccagcaaggagatcatcagcagcgagatgctggccaccagcattgatggcatggagaggcctggcaacctgaacaaggtggtggagcagaggcagaatgtgggcaccctggagagcttcagccctggggacttccgcaccaacatgaatgtggtgcaccagaacaagcagctggagagctgcaatggagagaagccaccctgcctggagatcctgaccaacggctttgctgtgctggagaccgtgaacccccagggcacagatgacctggacaacgtggccgacagcaaaggaaggaagcccctgagcacccacagcacagagtacaacctggacagcgtgcccagccctgctgaggagtttgctgactttgccaccttcagcaagaaggagcgcatccagctggaggagattgaatgtgctgtgctgaatgaccgggaggccctgaccatccgggagaacaacaagatcaacagagtgaatgagctgaacagcgtgaaggaggtggccctgggccgcagcctggacaacaagggggacacagatggagaggaccaggtgtgtgtgtctgagatcagcatcgtgaccaacagaggcttctctgtggagaagcagggcctgcccaccctgcagcaggatgagttcctgcagagcggcgtgcagagcaaggcctggagcctggtggacagcgctgacaacagcgaggccatccggcgggagcagtgcaagacagaggagaagctggacctgctgaccagcaaatgtgcccacctgtgcatggacagcgtgaagaccagtgatgatgaggtgggcagccccaaggaggagagcaggaagttcaccaacttccagagccccaacatcgaccccacagaagaaaatgacctggatgacagcctgtctgtgaagaatggagacagcagcaatgactttgtgacctgcaatgacatcaatgaagatgactttggagactttggagactttggcagcgccagcggcagcaccccaccatttgtgacaggcacccaggacagcatgtctgatgccacctttgaggagagcagcgagcacttcccccacttcagcgagcctggagatgactttggagaatttggagacatcaatgctgtgtcctgccaggaggagaccatcctgaccaagagtgacctgaagcagaccagtgacaacctgtctgaggagtgccagctggccaggaagagcagcggcaccggcacagagcctgtggccaagctgaagaatggccaggagggggagatcggccactttgattctgtgcccaacatccaggatgactgcaatggcttccaggacagtgatgactttgctgacttcagcagcgctggccccagccaggtggtggactggaatgcctttgaagatgagcagaaggacagctgctcctgggccgccttcggggaccagcaggccacagagagccaccacaggaaggaggcctggcagagccacaggacagatgagaacatcgacaccccaggcacccccaagacccacagcgtgcccagcgccaccagcaaaggagctgtggccagcggccacctgcaggagagcgccacctctgtgcagacagccctgctgaaccggctggagcgcatctttgaggcctgcttccccagcatcctggtgcctgatgctgaggaggaggtgaccagcctgaagcacctgctggagaccagcaccctgcccatcaagacccgggaggccctgcctgagagcggggagctgctggatgtgtggacagagctgcaggacatccatgatgcccacggcctgcgctaccagtggggcggcagccacagcaacaagaagctgctgagcagcctgggcatcgacaccaggaacatcctcttcaccggcaacaagaagcagcctgtgattgtgcccatgtatgctgctggcctgggcatgctggagcccaccaaggagcccctgaagcccctgtctgctgctgagaagatcgccagcatcggccagacagccaccatgagcccagacatgaacacctgcaccagtgaccagttccaggagagcctgccccctgtgcagtttgactggagcagcagcggcctgaccaaccccctggatgccagcggcggcagcaccctgctgaacctggacttctttggacctgtggatgacagcagcagcagcagcagcaccaccatccctggggtggaccctgagctgtatgagctgaccaccagcaagctggagatcagcaccagcagcctgaaggtgacagatgcctttgcccggctgatgagcacagtggagaagaccagcaccagcaccaggaagcccaagcgggaggagcacctgtctgaggaggccatcaaggtgattgctggcctgcctgacctgaccttcatgcacgccaaggtgctgatgtttcctgccaccctgacccccagcaccagcagccaggagaaggcagatggatag

SEQ ID NO: 18320 - DNA, 2730 bp, Artificial Sequence
  Description of Artificial Sequence: Synthetic coding sequence
atggagccagacatcatccgcatgtacagcagcagccccccacccctggacaacggggctgaagatgatgatgatgatgaatttggagaatttggaggcttcagcgaggtgagccccagcggcgtgggctttgtggactttgacaccccagactacacccggcccaaggaggagtttgtgcccagcaaccacttcatgcccatccacgagttctctgaaaatgtggacagcctgaccagcttcaagagcatcaagaatggaaatgacaaggacatcacagctgagctgagcgcccctgtgaagggccagagtgatgtgctgctgagcaccaccagcaaggagatcatcagcagcgagatgctggccaccagcattgatggcatggagaggcctggcaacctgaacaaggtggtggagcagaggcagaatgtgggcaccctggagagcttcagccctggggacttccgcaccaacatgaatgtggtgcaccagaacaagcagctggagagctgcaatggagagaagccaccctgcctggagatcctgaccaacggctttgctgtgctggagaccgtgaacccccagggcacagatgacctggacaacgtggccgacagcaaaggaaggaagcccctgagcacccacagcacagagtacaacctggacagcgtgcccagccctgctgaggagtttgctgactttgccaccttcagcaagaaggagcgcatccagctggaggagattgaatgtgctgtgctgaatgaccgggaggccctgaccatccgggagaacaacaagatcaacagagtgaatgagctgaacagcgtgaaggaggtggccctgggccgcagcctggacaacaagggggacacagatggagaggaccaggtgtgtgtgtctgagatcagcatcgtgaccaacagaggcttctctgtggagaagcagggcctgcccaccctgcagcaggatgagttcctgcagagcggcgtgcagagcaaggcctggagcctggtggacagcgctgacaacagcgaggccatccggcgggagcagtgcaagacagaggagaagctggacctgctgaccagcaaatgtgcccacctgtgcatggacagcgtgaagaccagtgatgatgaggtgggcagccccaaggaggagagcaggaagttcaccaacttccagagccccaacatcgaccccacagaagaaaatgacctggatgacagcctgtctgtgaagaatggagacagcagcaatgactttgtgacctgcaatgacatcaatgaagatgactttggagactttggagactttggcagcgccagcggcagcaccccaccatttgtgacaggcacccaggacagcatgtctgatgccacctttgaggagagcagcgagcacttcccccacttcagcgagcctggagatgactttggagaatttggagacatcaatgctgtgtcctgccaggaggagaccatcctgaccaagagtgacctgaagcagaccagtgacaacctgtctgaggagtgccagctggccaggaagagcagcggcaccggcacagagcctgtggccaagctgaagaatggccaggagggggagatcggccactttgattctgtgcccaacatccaggatgactgcaatggcttccaggacagtgatgactttgctgacttcagcagcgctggccccagccaggtggtggactggaatgcctttgaagatgagcagaaggacagctgctcctgggccgccttcggggaccagcaggccacagagagccaccacaggaaggaggcctggcagagccacaggacagatgagaacatcgacaccccaggcacccccaagacccacagcgtgcccagcgccaccagcaaaggagctgtggccagcggccacctgcaggagagcgccacctctgtgcagacagccctgctgaaccggctggagcgcatctttgaggcctgcttccccagcatcctggtgcctgatgctgaggaggaggtgaccagcctgaagcacctgctggagaccagcaccctgcccatcaagacccgggaggccctgcctgagagcggggagctgctggatgtgtggacagagctgcaggacatccatgatgcccacggcctgcgctaccagtggggcggcagccacagcaacaagaagctgctgagcagcctgggcatcgacaccaggaacatcctcttcaccggcaacaagaagcagcctgtgattgtgcccatgtatgctgctggcctgggcatgctggagcccaccaaggagcccctgaagcccctgtctgctgctgagaagatcgccagcatcggccagacagccaccatgagcccagacatgaacacctgcaccagtgaccagttccaggagagcctgccccctgtgcagtttgactggagcagcagcggcctgaccaaccccctggatggagtggaccctgagctgtatgagctgaccaccagcaagctggagatcagcaccagcagcctgaaggtgacagatgcctttgcccggctgatgagcacagtggagaagaccagcaccagcaccagcaggaagcccaagcgggaggagcacctgtctgaggaggccatcaaggtgattgctggcctgcctgacctgaccttcatgcacgccaaggtgctgatgtttcctgccaccctgacccccagcaccagcagccaggagaaggcagatggatag

SEQ ID NO: 18321 - DNA, 306 bp, Artificial Sequence
  Description of Artificial Sequence: Synthetic coding sequence
atggtgtgtgagaagtgtgagaagaagctgggcaccgtcatcaccccagacacctggaaggatggagccaggaacaccacagaaagtggcggcaggaagctgaatgaaaacaaggccctgaccagcaagaaggccaggtttgacccctacggcaagaacaagttcagcacctgccgcatctgcaagagctctgtgcaccagcccggcagccactactgccagggctgtgcctacaagaagggcatctgtgccatgtgtgggaagaaggtgctggacaccaagaactacaagcagacctctgtgtag

SEQ ID NO: 18322 - DNA, 1467 bp, Artificial Sequence
  Description of Artificial Sequence: Synthetic coding sequence
atgaacttcacccccacccacacccctgtgtgcaggaagaggacagtggtgtccaagaggggcgtggccgtgtctggccccaccaagaggcggggcatggctgacagcctggagagcacccccctgcccagccctgaggaccggctggccaagctgcaccccagcaaggagctgctggagtactaccagaagaagatggccgagtgtgaggccgagaatgaagacctgctgaagaagctggagctgtacaaggaggcctgtgagggccagcacaagctggagtgtgacctgcagcagcgggaggaggagattgctgagctgcagaaggccctgagtgacatgcaggtgtgcctcttccaggagcgggagcacgtgctgcggctgtacagtgaaaatgaccggctgcgcatccgggagctggaggacaagaagaagatccagaacctgctggccctggtgggcacagatgctggggaggtgacctacttctgcaaggagcccccccacaaggtgaccatcctgcagaagaccatccaggccgtgggagaatgtgagcagagcgagagcagcgccttcaaggctgaccccaagatcagcaagagaagacccagccgggagaggaaggagagcagcgagcactaccagagggacatccagaccctcatcctgcaggtggaggccctgcaggcccagctgggggagcagaccaagctgagccgggagcagatcgagggcctgattgaggaccggcgcatccacctggaggagatccaggtgcagcaccagaggaaccagaacaagatcaaggagctgaccaagaacctgcaccacacccaggagctgctgtatgagagcaccaaggacttcctgcagctgcggtctgagaaccagaacaaggagaagtcctggatgctggagaaggacaacctgatgagcaagatcaagcagtacagagtgcagtgcaagaagaaggaggacaagattggcaaggtgctgcctgtgatgcatgagagccaccacgcccagagcgagtacatcaagagcctgaaggacaagctggtgcaggagaagaagctgagcaacatgtaccaggagcagtgcatcagcctggaggaggagctggcccgcatccgggaggaggagggcatgaggcgggagatcttcaaggacaggaccaacaagatgggcaagaggctgcagatcatgaccaagagatatgaggccctggagcggcggcgcatcctggaggtggagggcttcaagacagacatcaaggtgctgcggcagaagctgaaggacctggagcagatgctgtacaaggccaccgtgaatgcccgggccaaccaggacctggccctgctgtgtgaggtgcgggacagcaacagaagagcccacaagatccagggcgagctgaagaacctgaagagcaaggtgtttggcctggagaatgagctgcggctgtgctag

SEQ ID NO: 18323 - DNA, 258 bp, Artificial Sequence
  Description of Artificial Sequence: Synthetic coding sequence
atgagcaaggtgtccttcaagatcaccctgaccagtgacccccggctgccctacaaggtgctgtctgtgcctgagagcacccccttcaccgctgtgctgaagtttgctgctgaggagttcaaggtgcctgctgccaccagcgccatcatcaccaatgatggcatcggcatcaacccagcccagacagctggaaatgtgttcctgaagcacggcagcgagctgcgcatcatcccccgggacagagtgggcagctgctag

SEQ ID NO: 18324 - DNA, 585 bp, Artificial Sequence
  Description of Artificial Sequence: Synthetic coding sequence
atggatgaagatggcctgcccctgatgggcagcggcatcgacctgaccaaggtgcctgccatccagcagaagaggacagtggccttcctgaaccagtttgtggtgcacacagtgcagttcctgaaccgcttcagcacagtgtgtgaggagaagctggccgacctgagcctgcgcatccagcagatcgagaccaccctgaacatcctggatgccaagctgagcagcatccctggcctggatgatgtgacagtggaggtgagccccctgaatgtgacctctgtgaccaacggggcccaccctgaggccaccagcgagcagccccagcagaacagcacccaggacagcggcctgcaggagagcgaggtgtctgctgagaacatcctgactgtggccaaggaccccaggtatgcccgctacctgaagatggtgcaggtgggcgtgcctgtgatggccatccggaacaagatgatcagcgagggcctggaccctgacctgctggagaggccagatgcccctgtgcctgatggagagagcgagaagacagtggaggagagcagtgacagcgagagcagcttcagtgactag

SEQ ID NO: 18325 - DNA, 2226 bp, Artificial Sequence
  Description of Artificial Sequence: Synthetic coding sequence
atgggccccccaggccctgccctgcctgccaccatgaacaacagcagcagcgagacccggggccacccccacagcgccagcagccccagcgagagggtcttccccatgcccctgcccaggaaggcccccctgaacatccctggcacccctgtgctggaggacttcccccagaatgatgatgagaaggagcggctgcagaggcggcgcagccgggtgtttgacctgcagttcagcacagacagcccccggctgctggccagccccagcagccgcagcattgacatcagcgccaccatccccaagttcaccaacacccagatcacagagcactacagcacctgcatcaagctgagcacagagaacaagatcaccaccaagaatgccttcggcctgcacctgattgacttcatgtctgagatcctgaagcagaaggacacagagcccaccaacttcaaggtggccgccggcaccctggatgccagcaccaagatctatgctgtgcgggtggatgctgtgcatgctgatgtgtacagagtgctgggcggcctgggcaaggatgcccccagcctggaggaggtggagggccacgtggctgatggcagcgccacagagatgggcaccaccaagaaggctgtgaagcccaagaagaagcacctgcacaggaccatcgagcagaacatcaacaacctgaatgtgtctgaggccgacagaaaatgtgaaattgaccccatgttccagaagacagctgccagctttgatgagtgcagcacagctggggtcttcctgagcaccctgcactgccaggactacagaagtgagctgctcttccccagtgatgtgcagaccctgagcactggagagcccctggagctgcctgagctgggctgtgtggagatgacagacctgaaggcccccctgcagcagtgtgctgaagatcggcagatctgccccagcctggccggcttccagttcacccagtgggacagcgagacccacaatgaatctgtgtctgccctggtggacaagttcaagaagaatgaccaggtgtttgacatcaatgctgaggtggatgaaagtgactgtggggacttcccagatggcagcctgggagatgactttgatgccaatgatgagccagaccacacagctgtgggggaccacgaggagttccgctcctggaaggagccctgccaggtgcagagctgccaggaggagatgatcagcctgggagatggagacatccgcaccatgtgccccctgctgtccatgaagccaggagagtacagctacttcagccccaggaccatgtccatgtgggccggccctgaccactggaggttccggcccaggaggaagcaggatgcccccagccagagcgagaacaagaagaagagcaccaagaaggactttgaaattgactttgaagatgacatcgactttgatgtgtacttcaggaagaccaaggccgccaccatcctgaccaagagcaccctggagaaccagaactggagggccaccaccctgcccacagacttcaactacaacgtggacaccctggtgcagctgcacctgaagccaggcacccggctgctgaagatggcccagggccaccgggtggagacagagcactatgaggagattgaggactatgactacaacaaccccaatgacaccagcaacttctgccccggcctgcaggccgctgacagtgatgatgaggacctggatgacctgtttgtgggccctgtgggcaacagcgacctgagcccctacccctgccacccccccaagacagcccagcagaatggagacaccccagaggcccagggcctggacatcaccacctacggggagagcaacctggtggccgagccccagaaggtgaacaagattgagatccactacgccaagacagccaagaagatggacatgaagaagctgaagcagagcatgtggagcctgctgacagccctgagcggcaaggaggctgatgctgaggccaaccaccgggaggccggcaaggaggccgccctggccgaggtggctgatgagaagatgctgagcggcctgaccaaggacctgcagaggagcctgccccctgtgatggcccagaacctgagcatccccctggcctttgcctgcctgctgcacctggccaatgagaagaacctgaagctggagggcacagaggacctgagtgatgtgctggtgcggcagggcgactag

SEQ ID NO: 18326 - DNA, 510 bp, Artificial Sequence
  Description of Artificial Sequence: Synthetic coding sequence
atgaagggcagccgcatcgagctgggagatgtgaccccccacaacatcaagcagctgaagaggctgaaccaggtgatcttccctgtgtcctacaatgacaagttctacaaggatgtgctggaggtgggggagctggccaagctggcctacttcaatgacattgctgtgggcgctgtgtgctgccgggtggaccacagccagaaccagaagaggctgtacatcatgaccctgggctgcctggccccctaccgccgcctgggcatcggcaccaagatgctgaaccacgtgctgaacatctgtgagaaggatggcacctttgacaacatctacctgcacgtgcagatcagcaatgaaagtgccatcgacttctacaggaagtttggatttgagatcatcgagaccaagaagaactactacaagagaattgaaccagcagatgcccacgtgctgcagaagaacctgaaggtgcccagcggccagaatgctgatgtgcagaagacagacaactag

SEQ ID NO: 18327 - DNA, 1245 bp, Artificial Sequence
  Description of Artificial Sequence: Synthetic coding sequence
atggctgctgcccctccttcctactgctttgtggccttccccccccgggccaaggatggcctggtggtgtttgggaagaacagcgcccggcccagagatgaggtgcaggaggtggtgtacttctctgctgctgaccacgagcctgagagcaaggtggagtgcacctacatcagcattgaccaggtgcccaggacctacgccatcatgatcagcaggcctgcctggctgtggggcgctgagatgggcgccaatgagcacggcgtgtgcatcgccaatgaggccatcaacacccgggagcctgctgctgagattgaggccctgctgggcatggacctggtgcggctgggcctggagcggggggagacagccaaggaggccctggatgtgattgtgtccctgctggaggagcacggccagggcggcaactactttgaagatgccaacagctgccacagcttccagagcgcctacctgattgtggacagagatgaggcctgggtgctggagaccatcggcaagtactgggccgctgagaaggtgacagaaggagtgcgctgcatctgcagccagctgagcctgaccaccaagatggatgctgagcaccctgagctgcggagctatgcccagagccagggctggtggacaggagagggggagttcaacttcagcgaggtgttcagccctgtggaggaccacctggactgtggggccggcaaggacagcctggagaagcaggaggagagcatcaccgtgcagaccatgatgaacaccctgcgggacaaggccagcggcgtgtgcattgattctgagttcttcctgaccacagccagcggcgtgtctgtgctgccccagaacagaagcagcccctgcatccactacttcaccggcaccccagaccccagccgcagcatcttcaagcccttcatctttgtggatgatgtgaagctggtgcccaagacccagagcccctgctttggagatgatgatcctgccaagaaggagccccgcttccaggagaagccagacagaagacatgagctgtacaaggcccacgagtgggcccgggccatcatcgagagtgaccaggagcagggcaggaagctgcggagcaccatgctggagctggagaagcagggcctggaggccatggaggagatcctgaccagcagcgagcccctggaccctgctgaggtgggggacctcttctatgactgtgtggacacagagatcaagttcttcaagtag

SEQ ID NO: 18328 - DNA, 2031 bp, Artificial Sequence
  Description of Artificial Sequence: Synthetic coding sequence
atgtctgaccagatcaagttcatcatggacagcctgaacaaggagcccttcaggaagaactacaacctgatcacctttgacagcctggagcccatgcagctgctgcaggtgctgagtgatgtgctggccgagattgaccccaagcagctggtggacatccgggaggagatgcctgagcagacagccaagaggatgctgagcctgctgggcatcctgaagtacaagcccagcggaaatgccacagacatgagcaccttccggcagggcctggtgattggcagcaagcctgtgatctaccctgtgctgcactggctgctgcagaggaccaatgagctgaagaagagggcctacctggcccgcttcctgatcaagctggaggtgcccagcgagttcctgcaggatgagaccgtggccgacaccaacaagcagtatgaggagctgatggaggccttcaagaccctgcacaaggagtatgagcagctgaagatcagcggcttcagcacagctgagatcaggaaggacatcagcgccatggaggaggagaaggaccagctgatcaagagggtggagcacctgaagaagagggtggagacagcccagaaccaccagtggatgctgaagatcgcccggcagctgcgggtggagaaggagcgggaggagtacctggcccagcagaagcaggagcagaagaaccagctgttccacgctgtgcagaggctgcagagggtgcagaaccagctgaagtccatgaggcaggccgctgctgatgccaagccagagagcctgatgaagaggctggaggaggagatcaagttcaacctgtacatggtgacagagaagttccccaaggagctggagaacaagaagaaggagctgcacttcctgcagaaggtggtgtctgagcccgccatgggccacagcgacctgctggagctggagagcaagatcaatgagatcaacacagagatcaaccagctgattgagaagaagatgatgagaaatgagcccatcgagggcaagctgagcctgtaccggcagcaggccagcatcatcagcaggaagaaggaggccaaggccgaggagctgcaggaggccaaggagaagctggccagcctggagcgggaggcctctgtgaagaggaaccagacccgggagtttgatggaacagaggtgctgaagggagatgagttcaagcgctacgtgaacaagctgcggagcaagagcacagtgttcaagaagaagcaccagatcatcgccgagctgaaggccgagtttggcctgctgcagaggacagaggagctgctgaagcagagacatgagaacatccagcagcagctgcagaccatggaggagaagaagggcatcagcggctacagctacacccaggaggagctggagcgggtgtctgccctgaagtctgaggtggatgagatgaagggccgcaccctggatgacatgtctgagatggtgaagaagctgtacagcctggtgtctgagaagaagagcgccctggccagcgtcatcaaggagctgcggcagctgcggcagaagtaccaggagctgacccaggagtgtgatgagaagaagagccagtatgacagctgtgccgccggcctggagagcaacagaagcaagctggagcaggaggtgcggcggctgcgggaggagtgcctgcaggaggagagccgctaccactacaccaactgcatgatcaagaacctggaggtgcagctgcggcgggccacagatgagatgaaggcctacatcagcagtgaccagcaggagaagaggaaggccatccgggagcagtacaccaagaacacagctgagcaggagaacctgggcaagaagctgcgggagaagcagaaggtgatccgggagagccacggccccaacatgaagcaggccaagatgtggagggacctggagcagctgatggagtgcaagaagcagtgcttcctgaagcagcagagccagaccagcatcggccaggtgatccaggagggcggagaagatagactcatcctgtag

SEQ ID NO: 18329 - DNA, 948 bp, Artificial Sequence
  Description of Artificial Sequence: Synthetic coding sequence
atggccttccctgagcccaagccccggcccccagagctgccccagaagaggctgaagaccctggactgtggccagggcgctgtgcgggctgtgcgcttcaacgtggatggcaactactgcctgacctgtggcagtgacaagaccctgaagctgtggaaccccctgcggggcaccctgctgcggacctacagcggccacggctatgaggtgctggatgctgctggcagctttgacaacagcagcctgtgcagcggcggcggggacaaggctgtggtgctgtgggatgtggccagcggccaggtggtgaggaagttccggggccatgctgggaaggtgaacacagtgcagttcaatgaggaggccaccgtcatcctgagcggcagcattgacagcagcatccgctgctgggactgccgcagcagaagacctgagcctgtgcagaccctggatgaggccagagatggagtgtcctctgtgaaggtgtctgaccacgagatcctggccggctctgtggatggccgggtgcggcgctatgacctgaggatgggccagctgttcagtgactatgtgggcagccccatcacctgcacctgcttcagcagagatggccagtgcaccctggtgagcagcctggacagcaccctgcggctgctggacaaggacaccggggagctgctgggggagtacaagggccacaagaaccaggagtacaagctggactgctgcctgtctgagcgggacacccacgtggtgtcctgcagtgaagatggcaaggtgttcttctgggacctggtggagggcgccctggccctggccctgcctgtgggcagcggcgtggtgcagagcctggcctaccaccccacagagccctgcctgctgacagccatgggcggctctgtgcagtgctggagggaggaggcctatgaagcagaagatggagctggatag

SEQ ID NO: 18330 - DNA, 1803 bp, Artificial Sequence
  Description of Artificial Sequence: Synthetic coding sequence
atggtgctgatcctgggccgccgcctgaaccgggaggacctgggcgtgcgggacagccctgccaccaagaggaaggtgtttgagatggaccccaagagcctgactggacatgagttctttgacttcagcagcggcagcagccatgctgagaacatcctgcagatcttcaatgagttccgggacagccgcctcttcacagatgtgatcatctgtgtggagggcaaggagttcccctgccacagagctgtgctgagcgcctgcagcagctacttccgggccatgttctgcaatgaccaccgggagagccgggagatgctggtggagatcaatggcatcctggccgaggccatggagtgcttcctgcagtatgtgtacaccgggaaggtgaagatcaccacagaaaatgtgcagtacctgtttgagaccagcagcctcttccagatctctgtgctgagagatgcctgtgccaagttcctggaggagcagctggacccctgcaactgcctgggcatccagagatttgctgacacccacagcctgaagaccctcttcaccaagtgcaagaactttgccctgcagacctttgaagatgtgtcccagcacgaggagttcctggagctggacaaggatgagctgattgactacatctgcagtgatgagctggtgattggcaaggaggagatggtgtttgaggccgtgatgcgctgggtgtacagagctgtggacctgcggcggcccctgctgcacgagctgctgacccacgtgcggctgcccctgctgcaccccaactactttgtgcagacagtggaggtggaccagctgatccagaacagccctgagtgctaccagctgctgcacgaggcccggcgctaccacatcctgggcaatgagatgatgagccccaggacccggccccggcgcagcacaggctacagcgaggtgattgtggtggtgggcggctgtgagcgggtgggcggcttcaacctgccctacacagaatgttatgaccctgtgactggagagtggaagagcctggccaagctgcctgagttcaccaagtcagaatatgctgtgtgtgccctgagaaatgacatcctggtgtctgggggccgcatcaacagcagagatgtgtggatctacaacagccagctgaacatctggatccgggtggccagcctgaacaagggccgctggaggcacaagatggctgtgctgctgggcaaggtgtatgtggtgggcggctatgatggccagaaccggctgagctctgtggagtgctatgacagcttcagcaaccgctggacagaggtggcccccctgaaggaggccgtgagcagccctgctgtgaccagctgtgtgggcaagctgtttgtgattggaggcggcccagatgacaacacctgcagcgacaaggtgcagagctatgaccctgagaccaacagctggctgctgcgggccgccatccccatcgccaagcgctgcatcacagctgtgtccctgaacaacctgatctacgtggccggcggcctgaccaaggccatctactgctatgaccctgtggaggactactggatgcacgtgcagaacaccttcagccggcaggagaactgtggcatgtctgtgtgcaatggcaagatctacatcctgggcggccggcgggagaatggagaggccacagacaccatcctgtgctatgaccctgccaccagcatcatcactggagtggccgccatgcccaggcctgtgtcctaccacggctgtgtgaccatccaccgctacaatgagaagtgcttcaagctgtag

SEQ ID NO: 18331 - DNA, 810 bp, Artificial Sequence
  Description of Artificial Sequence: Synthetic coding sequence
atgaaccaggaggacctggaccctgacagcaccacagatgtgggagatgtgaccaacacagaggaggagctgatcagagaatgtgaggagatgtggaaggacatggaggagtgccagaacaagctgagcctgattggaacagagaccctgacagacagcaatgcccagctgagcctgctgatcatgcaggtgaagtgcctgacagctgagctgagccagtggcagaagaagaccccagagaccatccccctgacagaagatgtgctgatcaccctgggcaaggaggagttccagaagctgcggcaggacctggagatggtgctgagcaccaaggagagcaagaatgagaagctgaaggaggacctggagcgggagcagcgctggctggatgagcagcagcagatcatggagagcctgaatgtgctgcacagcgagctgaagaacaaggtggagaccttcagcgagagccgcatcttcaatgagctgaagaccaagatgctgaacatcaaggagtacaaggagaagctgctgagcaccctgggggagttcctggaggaccacttccccctgcctgacagatctgtgaagaagaagaagaagaacatccaggagagctctgtgaacctgatcaccctgcacgagatgctggagatcctgatcaacagactctttgatgtgccccatgacccctacgtgaagatcagtgacagcttctggccaccctacgtggagctgctgctgagaaatggaattgccctgcggcaccctgaggaccccacccgcatccggctggaggccttccaccagtag

SEQ ID NO: 18332 - DNA, 1041 bp, Artificial Sequence
  Description of Artificial Sequence: Synthetic coding sequence
atgtgtgagggccccagccgcatcagcggccccatccccccagaccccaccctgtgcccagacaactaccgccggcccaccagcgcccagggccgcctggagggcaatgccctgaagctggacctgctgaccagtgaccgggccctggacaccacagccccccggggcccctgcatcggccctggagctggggagatcctggagcggggccagaggggcgtgggagatgtgctgctgcagctggagggcatcagcctgggccctggggccagcctgaagaggaaggaccccaaggaccacgagaaggagaacctgcggcgcatccgggagatccagaagcgcttccgggagcaggagaggagccgggagcagggccagccccggcccctgaaggccctgtggaggagccccaagtatgacaaggtggagagccgggtgaaggcccagctgcaggagcccggccctgccagcggcacagaaagtgcccacttcctgcgggcccacagccgctgtggccctggcctgcccccacctcatgtgagcagcccccagcccaccccacctggccctgaggccaaggagcccggcctgggcgtggacttcatccgccacaatgcccgggccgccaagagggccccccggcggcacagctgcagcctgcaggtgctggcccaggtgctggagcagcagaggcaggcccaggagcactacaatgccacccagaagggccacgtgccccactacctgctggagcggcgggacctgtggaggcgggaggccgaggccaggaagcagagccagcctgaccctgccatgcctcctggccacaccaggatgcctgagaaccagaggctggagaccctgaccaagctgctgcagagccagagccagctgctgcgggagctggtgctgctgcctgctggagctgacagcctgcgggcccagagccacagagctgagctggacaggaagctggtgcaggtggaggaggccatcaagatcttcagccggcccaaggtgtttgtgaagatggatgactag

SEQ ID NO: 18333 - DNA, 1824 bp, Artificial Sequence
  Description of Artificial Sequence: Synthetic coding sequence
atggccgccaacgtgttccccttcagagatgcccgggccgccccagaccctgtgctggaggccggccctgtggcccacggccccctgcctgtgcccctggtgctggacaatggcagcttccaggtgcgggccggctgggcctgccccggccaggaccccggccctgagccccggctgcagttccgggctgtgtgtgcccggggccggggcggggcccggggggccagcggcccccaggtgggcaatgccctgggcagcctggagcccctgcgctggatgctgcggagcccctttgacagaaatgtgcctgtgaacctggagctgcaggagctgctgctggactacagcttccagcacctgggcgtgagcagccagggctgtgtggaccaccccatcgtgctgacagaagctgtgtgcaaccccctgtacagccggcagatgatgtctgagctgctgtttgagtgctacggcatccccaaggtggcctatggaattgacagcctcttctccttctaccacaacaagcccaagaacagcatgtgcagcggcctcatcatcagcagcggctaccagtgcacccacgtgctgcccatcctggagggccgcctggatgccaagaactgcaagaggatcaacctgggcggcagccaggccgccggctacctgcagaggctgctgcagctgaagtacccaggccacctggccgccatcaccctgagcaggatggaggagatcctgcacgagcacagctacatcgccgaggactatgtggaggagctgcacaagtggcgctgcccagactactatgagaacaacgtgcacaagatgcagctgcccttcagcagcaagctgctgggcagcaccctgaccagcgaggagaagcaggagcggcggcagcagcagctgcggcggctgcaggagctgaatgcccggcggcgggaggagaagctgcagctggaccaggagcggctggaccggctgctgtatgtgcaggagctgctggaggatggccagatggaccagttccacaaggccctgattgagctgaacatggacagccctgaggagctgcagagctacatccagaagctgagcattgctgtggagcaggccaagcagaagatcctgcaggccgaggtgaacctggaggtggatgtggtggacagcaagccagagaccccagacctggagcagctggagcccagcctggaggatgtggagagcatgaatgactttgaccccctcttcagcgaggagaccccaggagtggagaagcctgtgaccaccgtgcagcccgtcttcaacctggccgcctaccaccagctgtttgtgggcacagagcgcatccgggcccctgagatcatcttccagcccagcctgattggagaggagcaggccggcattgctgagaccctgcagtacatcctggaccgctaccccaaggacatccaggagatgctggtgcagaatgtgttcctgaccggcggcaacaccatgtacccaggcatgaaggccaggatggagaaggagctgctggagatgaggcccttccgcagcagcttccaggtgcagctggccagcaaccctgtgctggatgcctggtatggagcccgggactgggccctgaaccacctggatgacaatgaggtgtggatcaccaggaaggagtatgaggagaagggcggggagtacctgaaggagcactgtgccagcaacatctacgtgcccatccggctgcccaagcaggccagccgcagcagtgatgcccaggccagcagcaagggcagcgctgctgggggcggcggggccggggagcaggcctag

SEQ ID NO: 18334 - DNA, 1383 bp, Artificial Sequence
  Description of Artificial Sequence: Synthetic coding sequence
atggccagccgggaggaggtgctggccctgcaggccgaggtggcccagcgggaggaggagctgaacagcctgaagcagaagctggccagcgccctgctggccgagcaggagccccagcctgagcggctggtgcctgtgagccccctgccccccaaggccgccctgagcagagatgagatcctgcgctacagccggcagctggtgctgcctgagctgggcgtgcacggccagctgcggctgggcacagcctgtgtgctgattgtgggctgcggcggcctgggctgccccctggcccagtacctggccgccgccggcgtgggccgcctgggcctggtggactatgatgtggtggagatgagcaacctggcccggcaggtgctgcacggggaggccctggccggccaggccaaggccttctctgctgctgccagcctgcggcggctgaacagcgctgtggagtgtgtgccctacacccaggccctgaccccagccacagccctggacctggtgagaagatatgatgtggtggccgactgcagcgacaacgtgcccacccgctacctggtgaatgatgcctgtgtgctggccggccggcccctggtgtctgccagcgccctgcgctttgagggccagatcaccgtgtaccactatgatggcggcccctgctaccgctgcatcttcccccagcccccacctgctgagaccgtgaccaactgtgctgatggaggagtgctgggcgtggtgactggagtgctgggctgcctgcaggccctggaggtgctgaagattgctgctggcctgggccccagctacagcggcagcctgctgctgtttgatgccctgcggggccacttccgcagcatccggctgcggagccggcggctggactgtgccgcctgtggggagcggcccaccgtgacagacctgctggactatgaggccttctgtggcagcagcgccacagacaagtgccgcagcctgcagctgctgagccctgaggagcgggtgtctgtgacagactacaagaggctgctggacagcggggccttccacctgctgctggatgtgcggccccaggtggaggtggacatctgccgcctgccccacgccctgcacatccccctgaagcacctggagaggagagatgctgagagcctgaagctgctgaaggaggccatctgggaggagaagcagggcacccaggagggcgctgctgtgcccatctacgtgatctgcaagctgggcaatgacagccagaaggctgtgaagatcctgcagagcctgtctgctgcccaggagctggaccccctgactgtgagagatgtggtgggcggcctgatggcctgggccgccaagattgatggcaccttcccccagtactag

SEQ ID NO: 18335 - DNA, 1041 bp, Artificial Sequence
  Description of Artificial Sequence: Synthetic coding sequence
atggagagcgtgtcctgcagcgctgctgctgtgaggactggagacatggagagccagagggacctgagcctggtgcctgagcggctgcagaggcgggagcaggagcggcagctggaggtggagaggaggaagcagaagaggcagaaccaggaggtggagaaggagaacagccacttctttgtggccacctttgtgcgggagagagctgctgtggaggagctgctggagcgggcagagagcgtggagcggctggaggaggccgccagccggctgcagggcctgcagaagctgatcaatgattctgtgttcttcctggccgcctatgacctgcggcagggccaggaggccctggcccggctgcaggccgccctggccgagcggcggcggggcctgcagcccaagaagagatttgccttcaagacccggggcaaggatgctgccagcagcaccaaggtggatgctgcccctggcatccccccagctgtggagagcatccaggacagccccctgcccaagaaggccgagggggacctgggccccagctgggtgtgtggcttcagcaacctggagagccaggtgctggagaagagggccagcgagctgcaccagagagatgtgctgctgacagagctgagcaactgcaccgtgcggctgtatggcaaccccaacaccctgcggctgaccaaggcccacagctgcaagctgctgtgtggccctgtgtccacctctgtgttcctggaggactgcagcgactgtgtgctggccgtggcctgccagcagctgcgcatccacagcaccaaggacacccgcatcttcctgcaggtgaccagccgggccatcgtggaggactgcagcggcatccagtttgccccctacacctggagctacccagaaattgacaaggactttgagagcagcggcctggacaggagcaagaacaactggaatgatgtggatgacttcaactggctggcccgggacatggccagccccaactggagcatcctgcctgaggaggagaggaacatccagtgggactag

SEQ ID NO: 18336 - DNA, 747 bp, Artificial Sequence
  Description of Artificial Sequence: Synthetic coding sequence
atgacccccaagggccctgccatgtgcagcatgcccctgaccagcgctgactgcttcagcaatgacatccacaagctggacaccagcaccatgacctggaccctcatctgcaccaagggcagccctgcccgctggagggacttccacagcgccaccatgctgggcagccacatgtatgtgtttggaggccgggctgaccgcttcggccccttccacagcaacaatgagatctactgcaaccgcatccgggtgtttgacaccaggacagaggcctggctggactgcccccccacccctgtgctgcctgagggcagaagaagccacagcgccttcggctacaacggggagctgtacatctttggaggctacaatgcccggctgaacagacacttccatgacctgtggaagttcaaccctgtgtccttcacctggaagaagattgagcccaagggcaagggcccctgcccccggcggcggcagtgctgctgcatcgtgggggacaagatcgtgctgtttggaggcaccagccccagccctgaggagggcctgggagatgaatttgacctgattgaccacagcgacctgcacatcctggacttcagccccagcctgaagaccctgtgcaagctggccgtcatccagtacaacctggaccagagctgcctgccccatgacatccgctgggagctgaatgccatgaccaccaacagcaacatcagccggcccatcgtgagcagccatggatag

SEQ ID NO: 18337 - DNA, 1401 bp, Artificial Sequence
  Description of Artificial Sequence: Synthetic coding sequence
atggagtatgagagctactactttgtgaagttccagaagtaccccaagatcgtgaagaagagcagtgacacagctgagaacaacctgccccagaggagccggggcaagaccaggaggatgatgaatgacagctgccagaacctgcccaagatcaaccagcagaggcccaggagcaagaccacagctgggaagacaggagacaccaagagcctgaacaaggagcaccccaaccaggaggtggtggacaacacccggctggagagcgccaactttggcctgcacatcagccgcatcaggaaggacagcggggaggagaatgcccacccccggcggggccagatcatcgacttccagggcctgctgacagatgccatcaagggggccaccagcgagctggccctgaacacctttgaccacaacccagaccccagcgagcggctgctgaagcccctgagcgccttcatcggcatgaacagcgagatgagggagctggccgctgtggtgtcccgggacatctacctgcacaaccccaacatcaagtggaatgacatcatcggcctggatgctgccaagcagctggtgaaggaggccgtggtgtaccccatccgctacccccagctgttcaccggcatcctgagcccctggaagggcctgctgctgtatggccccccaggcaccgggaagaccctgctggccaaggctgtggccacagagtgcaagaccaccttcttcaacatcagcgccagcaccatcgtgtccaagtggaggggggacagcgagaagctggtgcgggtgctgtttgagctggcccgctaccacgcccccagcaccatcttcctggatgagctggagagcgtgatgagccagaggggcacagccagcggcggggagcacgagggcagcctgaggatgaagacagagctgctggtgcagatggatggcctggcccggtctgaggacctggtgtttgtgctggccgccagcaacctgccctgggagctggactgtgccatgctgcggcggctggagaagaggatcctggtggacctgcccagccgggaggcccggcaggccatgatctaccactggctgccccctgtgtccaagagccgggccctggagctgcacacagagctggagtacagcgtgctgagccaggagacagagggctacagcggcagtgacatcaagctggtgtgccgggaggccgccatgaggcctgtgaggaagatctttgatgccctggagaaccaccagagcgagagcagtgacctgccccgcatccagctggacatcgtgaccacagctgacttcctggatgtgctgacccacaccaagcccagcgccaagaacctggcccagcgctacagcgactggcagcgggagtttgaatctgtgtag

SEQ ID NO: 18338 - DNA, 6402 bp, Artificial Sequence
  Description of Artificial Sequence: Synthetic coding sequence
atggatgaggtggagcaggaccagcacgaggcccggctgaaggagctgtttgacagctttgacaccactggaacaggcagcctgggccaggaggagctgacagacctgtgccacatgctgagcctggaggaggtggcccctgtgctgcagcagaccctgctgcaggacaacctgctgggccgggtgcactttgaccagttcaaggaggccctgatcctgatcctgagcaggaccctgagcaatgaggagcacttccaggagccagactgcagcctggaggcccagcccaagtatgtgcggggcggcaagagatatggaagaagaagcctgcctgagttccaggagagcgtggaggagttccctgaggtgaccgtcatcgagcccctggatgaggaggcccggcccagccacatcccagctggggactgcagcgagcactggaagacccagaggtctgaggagtatgaagctgagggccagctgcgcttctggaacccagatgacctgaatgccagccagagcggcagcagccccccccaggactggattgaggagaagctgcaggaggtgtgtgaggacctgggcatcaccagagatggccacctgaacaggaagaagctggtgtccatctgtgagcagtatggcctgcagaatgtggatggagagatgctggaggaggtgttccacaacctggaccctgatggcaccatgtctgtggaggacttcttctacggcctcttcaagaatggcaagagcctgacccccagcgccagcaccccctaccggcagctgaagaggcacctgtccatgcagagctttgatgagagcggccgccgcaccaccaccagcagcgccatgaccagcaccatcggcttccgggtcttcagctgcctggatgatggcatgggccacgcctctgtggagcgcatcctggacacctggcaggaggagggcatcgagaacagccaggagatcctgaaggccctggacttcagcctggatggcaacatcaacctgacagagctgaccctggccctggagaatgagctgctggtgaccaagaacagcatccaccaggccgccctggccagcttcaaggccgagatccgccacctgctggagcgggtggaccaggtggtgcgggagaaggagaagctgcggagtgacctggacaaggccgagaagctgaagagcctgatggccagcgaggtggatgaccaccacgccgccattgaaagaagaaatgagtacaacctgaggaagctggatgaggagtacaaggagagaattgctgccctgaagaatgagctgaggaaggagcgggagcagatcctgcagcaggccggcaagcagaggctggagctggagcaggagattgagaaggccaagacagaggagaactacatccgggaccggctggccctgagcctgaaggagaacagccggctggagaatgagctgctggagaatgctgagaagctggccgagtatgagaacctgaccaacaagctgcagaggaacctggagaatgtgctggccgagaagtttggagacctggaccccagcagcgctgagttcttcctgcaggaggagcggctgacccagatgagaaatgaatatgaaaggcagtgccgggtgctgcaggaccaggtggatgagctgcagagcgagctggaggagtaccgggcccagggccgggtgctgcggctgcccctgaagaacagccccagcgaggaggtggaggccaacagcggcggcatcgagcctgagcacggcctgggcagcgaggagtgcaaccccctgaacatgagcattgaagctgagctggtgattgagcagatgaaggagcagcaccaccgggacatctgctgcctgcggctggagctggaggacaaggtgcgccactatgagaagcagctggatgaaacagtggtgtcctgcaagaaggcccaggagaacatgaagcagagacatgaaaatgagacccacaccctggagaagcagatcagtgacctgaagaatgaaattgctgagctgcagggccaggccgctgtgctgaaggaggcccaccacgaggccacctgcagacatgaggaggagaagaagcagctgcaggtgaagctggaggaggagaagacccacctgcaggagaagctgcggctgcagcacgagatggagctgaaggcccggctgacccaggcccaggccagctttgagcgggagcgggagggcctgcagagcagcgcctggacagaggagaaggtgcggggcctgacccaggagctggagcagttccaccaggagcagctgaccagcctggtggagaagcacaccctggagaaggaggagctgaggaaggagctgctggagaagcaccagcgggagctgcaggagggccgggagaagatggagacagagtgcaacagaaggaccagccagatcgaggcccagttccagagcgactgccagaaggtgacagagcgctgtgagagcgccctgcagagcctggagggccgctaccggcaggagctgaaggacctgcaggagcagcagcgggaggagaagagccagtgggagtttgagaaggatgagctgacccaggagtgtgccgaggcccaggagctgctgaaggagaccctgaagcgggagaagaccaccagcctggtgctgacccaggagcgggagatgctggagaagacctacaaggagcacctgaacagcatggtggtggagcggcagcagctgctgcaggacctggaggacctgagaaatgtgtctgagacccagcagagcctgctgagtgaccagatcctggagctgaagagcagccacaagcgggagctgcgggagcgggaggaggtgctgtgccaggccggggccagcgagcagctggccagccagaggctggagcggctggagatggagcatgaccaggagcggcaggagatgatgagcaagctgctggccatggagaacatccacaaggccacctgtgaaacagctgaccgggagcgggcagagatgagcacagagatcagccggctgcagagcaagatcaaggagatgcagcaggccaccagccccctgtccatgctgcagagcggctgccaggtgattggagaggaggaggtggagggagatggagccctgagcctgctgcagcagggcgagcagctgctggaggagaatggagatgtgctgctgagcctgcagagggcccacgagcaggccgtgaaggaaaatgtgaagatggccacagagatcagccggctgcagcagaggctgcagaagctggagcccggcctggtgatgagcagctgcctggatgagcccgccacagagttcttcggcaacacagctgagcagacagagcagttcctgcagcagaacagaaccaagcaggtggagggcgtgacccggcggcacgtgctgagtgacctggaggatgatgaggtgcgggacctgggcagcacaggcaccagctctgtgcagaggcaggaggtgaagattgaggagagcgaggcctctgtggagggcttcagcgagctggagaacagcgaggagaccaggacagagagctgggagctgaagaaccagatcagccagctgcaggagcagctgatgatgctgtgtgccgactgtgaccgggccagcgagaagaagcaggacctgctgtttgatgtgtctgtgctgaagaagaagctgaagatgctggagcgcatccctgaggccagccccaagtacaagctgctgtatgaagatgtgtcccgggagaatgactgcctgcaggaggagctgaggatgatggagaccaggtatgatgaggccctggagaacaacaaggagctgacagctgaggtgttccggctgcaggatgagctgaagaagatggaggaggtgacagagaccttcctgagcctggagaagagctatgatgaggtgaagattgaaaatgaaggcctgaatgtgctggtgctgcggctgcagggcaagattgagaagctgcaggagagcgtggtgcagagatgtgactgctgcctgtgggaggccagcctggagaacctggagattgaaccagatggcaacatcctgcagctgaaccagaccctggaggagtgtgtgccccgggtgcgctctgtgcaccacgtgattgaggagtgcaagcaggagaaccagtacctggagggcaacacccagctgctggagaaggtgaaggcccatgaaattgcctggctgcacggcaccatccagacccaccaggagcggccccgggtgcagaaccaggtgatcctggaggagaacaccaccctgctgggcttccaggacaagcacttccagcaccaggccaccatcgccgagctggagctggagaagaccaagctgcaggagctgaccaggaagctgaaggagcgggtgaccatcctggtgaagcagaaggatgtgctgagccacggggagaaggaggaggagctgaaggccatgatgcatgacctgcagatcacctgcagcgagatgcagcagaaggtggagctgctgcgctatgagagcgagaagctgcagcaggagaacagcatcctgagaaatgagatcaccaccctgaatgaggaggacagcatcagcaacctgaagctgggcaccctgaatggcagccaggaggagatgtggcagaagacagagaccgtgaagcaggagaatgctgctgtgcagaagatggtggagaacctgaagaagcagatcagcgagctgaagatcaagaaccagcagctggacctggagaacacagagctgagccagaagaacagccagaaccaggagaagctgcaggagctgaaccagaggctgacagagatgctgtgccagaaggagaaggagcccggcaacagcgccctggaggagcgggagcaggagaagttcaacctgaaggaggagctggagcgctgcaaggtgcagagcagcaccctggtgagcagcctggaggccgagctgtctgaggtgaagatccagacccacatcgtgcagcaggagaaccacctgctgaaggatgagctggagaagatgaagcagctgcaccgctgcccagacctgagtgacttccagcagaagatcagctctgtgctgagctacaatgagaagctgctgaaggagaaggaggccctgtctgaggagctgaacagctgtgtggacaagctggccaagagcagcctgctggagcaccgcatcgccaccatgaagcaggagcagaagtcctgggagcaccagagcgccagcctgaagagccagctggtggccagccaggagaaggtgcagaacctggaggacacagtgcagaatgtgaacctgcagatgagcaggatgaagagtgacctgcgggtgacccagcaggagaaggaggccctgaagcaggaggtgatgagcctgcacaagcagctgcagaatgccggcggcaagtcctgggcccctgagatcgccacccaccccagcggcctgcacaaccagcagaagaggctgtcctgggacaagctggaccacctgatgaatgaggagcagcagctgctgtggcaggagaatgaaaggctgcagaccatggtgcagaacaccaaggccgagctgacccacagccgggagaaggtgcggcagctggagagcaacctgctgcccaagcaccagaagcacctgaaccccagcggcaccatgaaccccacagagcaggagaagctgagcctgaagagagaatgtgaccagttccagaaggagcagagccctgccaacaggaaggtgtcccagatgaacagcctggagcaggagctggagaccatccacctggagaatgaaggcctgaagaagaagcaggtgaagctggatgagcagctgatggagatgcagcacctgcggagcacagccacccccagccccagcccccacgcctgggacctgcagctgctgcagcagcaggcctgccccatggtgccccgggagcagttcctgcagctgcagaggcagctgctgcaggccgagcgcatcaaccagcacctgcaggaggagctggagaacagaaccagcgagaccaacaccccccagggcaaccaggagcagctggtgacagtgatggaggagaggatgattgaggtggagcagaagctgaagctggtgaagaggctgctgcaggagaaggtgaaccagctgaaggagcagctgtgcaagaacaccaaggcagatgccatggtgaaggacctgtatgtggagaatgcccagctgctgaaggccctggaggtgacagagcagaggcagaagacagctgagaagaagaactacctgctggaggagaagatcgccagcctgagcaacatcgtgaggaacctgaccccagcccccctgaccagcaccccacccctgcggagctag

SEQ ID NO: 18339 - DNA, 1713 bp, Artificial Sequence
  Description of Artificial Sequence: Synthetic coding sequence
atggccggcggggcccgggaggtgctgaccctgcagctgggccactttgctggctttgtgggcgcccactggtggaaccagcaggatgctgccctgggccgggccacagacagcaaggagcccccaggagagctgtgcccagatgtgctgtacagaactggaagaaccctgcacggccaggagacctacacccccaggctcatcctgatggacctgaagggcagcctgagcagcctgaaggaggagggcggcctgtacagagacaagcagctggatgctgccatcgcctggcagggcaagctgaccacccacaaggaggagctgtaccccaagaacccctacctgcaggacttcctgtctgctgagggcgtgctgagcagtgatggagtgtggagggtgaagagcatccccaacgggaagggcagcagccccctgcccacagccaccacccccaagcccctcatccccacagaggccagcatccgggtgtggagcgacttcctgcgggtgcacctgcaccccaggagcatctgcatgatccagaagtacaaccatgatggagaggccggccgcctggaggccttcggccagggcgagagcgtgctgaaggagcccaagtaccaggaggagctggaggaccggctgcacttctacgtggaggagtgtgactacctgcagggcttccagatcctgtgtgacctgcatgatggcttctctggagtgggcgccaaggctgctgagctgctgcaggatgagtacagcggccggggcatcatcacctggggcctgctgcccggcccctaccacagaggagaggcccagaggaacatctaccgcctgctgaacacagccttcggcctggtgcacctgacagcccacagcagcctggtgtgccccctgagcctgggcggcagcctgggcctgcggcctgagccccctgtgtccttcccctacctgcactatgatgccaccctgcccttccactgcagcgccatcctggccacagccctggacacagtgacagtgccctaccgcctgtgcagcagccctgtgtccatggtgcacctggccgacatgctgtccttctgtgggaagaaggtggtgacagctggggccatcatccccttccccctggcccctggccagagcctgcctgacagcctgatgcagtttggaggagccaccccctggacccccctgagcgcctgtggggagcccagcggcacccgctgctttgcccagagcgtggtgctgcggggcatcgaccgggcctgccacaccagccagctgaccccaggcaccccaccacccagcgccctgcacgcctgcaccactggagaggagatcctggcccagtacctgcagcagcagcagcccggggtgatgagcagcagccacctgctgctgaccccctgccgggtggccccaccctacccccacctgttcagcagctgcagccccccaggcatggtgctggatggcagccccaagggagctgctgtggagagcatccctgtgtttggagccctgtgcagcagcagcagcctgcaccagaccctggaggccctggcccgggacctgaccaagctggacctgcggcgctgggccagcttcatggatgctggggtggagcatgatgatgtggccgagctgctgcaggagctgcagagcctggcccagtgctaccagggcggggacagcctggtggactag

SEQ ID NO: 18340 - DNA, 1791 bp, Artificial Sequence
  Description of Artificial Sequence: Synthetic coding sequence
atgaacagaacctggccccggcgcatctggggcagcagccaggatgaagctgagctgatccgggaggacatccagggcgccctgcacaactacagaagtggccgcggggagcggcgggctgctgccctgcgggccacccaggaggagctgcagagggacaggagccctgctgctgagaccccacccctgcagaggcggcccagcgtgcgggctgtgatcagcacagtggagcggggggccggccggggccggccccaggccaagcccatccctgaggccgaggaggcccagaggcctgagcctgtgggcaccagcagcaatgctgacagcgccagcccagacctgggcccccggggccctgacctggccgtgctgcaggccgagcgggaggtggacatcctgaaccacgtgtttgatgatgtggagagctttgtgtcccggctgcagaagtctgctgaggccgcccgggtgctggagcaccgggagcggggcagaagaagcagaagaagagctgctggggagggcctgctgaccctgcgggccaagcccccatctgaggccgagtacacagatgtgctgcagaagatcaagtatgccttcagcctgctggcccggctgcggggcaacattgctgaccccagcagccctgagctgctgcacttcctgtttggccccctgcagatgattgtgaacaccagcggcggccctgagtttgccagctctgtgagaagaccccacctgaccagtgatgctgtggccctgctgcgggacaacgtgaccccaagagaaaatgagctgtggaccagcctgggggacagctggaccaggcctggcctggagctgagccctgaggagggccccccctacagacctgagttcttcagcggctgggagccccctgtgacagacccccagagccgggcctgggaggaccctgtggagaagcagctgcagcatgaaagaagaagacggcagcagagcgccccccaggtggccgtgaatggccaccgggacctggagcctgagagcgagccccagctggagagcgagacagctgggaagtgggtgctgtgcaactatgacttccaggccaggaacagcagcgagctgtctgtgaagcagagagatgtgctggaggtgctggatgacagcaggaagtggtggaaggtgcgggaccctgctggccaggagggctacgtgccctacaacatcctgaccccctacccaggcccccggctgcaccacagccagagccctgcccggagcctgaacagcaccccacctcctcctccagccccagccccagcccctcctccagccctggcccggccccgctgggaccggccccgctgggacagctgtgacagcctgaatggcctggaccccagcgagaaggagaagttcagccagatgctgattgtgaatgaggagctgcaggcccggctggcccagggccgcagcggccccagcagagctgtgcccggcccccgggcccctgagccccagctgagccctggcagtgatgccagcgaggtgcgggcctggctgcaggccaagggcttcagcagcggcaccgtggatgccctgggcgtgctgactggagcccagctgttcagcctgcagaaggaggagctgcgggctgtgtccccagaggagggcgcccgggtgtacagccaggtgacagtgcagaggagcctgctggaggacaaggagaaggtgtctgagctggaggccgtgatggagaagcagaagaagaaggtggagggggaggtggagatggaggtgatctag

SEQ ID NO: 18341 - DNA, 1950 bp, Artificial Sequence
  Description of Artificial Sequence: Synthetic coding sequence
atgagcagctttggagctgggaagaccaaggaggtgatcttctctgtggaggatggctctgtgaagatgttcctgcggggccggcctgtgcccatgatgatcccagatgagctggcccccacctacagcctggacaccaggtctgagctgcccagctgccgcctgaagctggagtgggtgtatggctaccggggccgggactgccgggccaacctgtacctgctgcccactggagagatcgtgtactttgtggcctctgtggccgtgctgtacagcgtggaggagcagaggcagaggcactacctgggccacaatgatgacatcaagtgcctggccatccacccagacatggtgaccatcgccaccggccaggtggccggcaccaccaaggagggcaagcccctgcccccccacgtgcgcatctgggacagcgtgtccctgagcaccctgcacgtgctgggcctgggcgtgtttgacagagctgtgtgctgcgtgggcttcagcaagagcaatggaggcaacctgctgtgtgctgtggatgagagcaatgaccacatgctgtctgtgtgggactgggccaaggagaccaaggtggtggatgtgaagtgcagcaatgaagctgtgctggtggccaccttccaccccacagaccccaccgtgctgatcacctgtgggaagagccacatctacttctggaccctggagggcggcagcctgagcaagaggcagggcctgtttgagaagcatgagaagcccaagtatgtgctgtgtgtgaccttcctggagggcggagatgtggtgactggagacagcggcggcaacctgtatgtgtggggcaagggcggcaaccgcatcacccaggccgtgctgggcgcccatgatggcggcgtgtttggcctgtgtgccctgagagatggcaccctggtgtctgggggcggccgggaccggcgggtggtgctgtggggcagtgactacagcaagctgcaggaggtggaggtgcctgaagattttggacctgtgaggacagtggccgagggccatggagacaccctgtatgtgggcaccaccagaaattccatcctgcagggctctgtgcacacaggcttcagcctgctggtgcagggccacgtggaggagctgtggggcctggccacccaccccagccgggcccagtttgtgacctgtggccaggacaagctggtgcacctgtggagcagtgacagccaccagcccctgtggagccgcatcatcgaggaccctgcccggtctgctggcttccaccccagcggctctgtgctggccgtgggcaccgtgacaggccgctggctgctgctggacacagagacccatgacctggtggccatccacacagatggaaatgagcagatctctgtggtgtccttctccccagatggagcctacctggccgtgggcagccatgacaacctggtgtatgtgtacacagtggaccagggcggcaggaaggtgtcccggctgggcaaatgttctggccacagcagcttcatcacccacctggactgggcccaggacagcagctgctttgtgaccaacagcggggactatgagatcctgtactgggaccctgccacctgcaagcagatcaccagcgcagatgctgtgaggaacatggagtgggccacagccacctgtgtgctgggctttggagtgtttggcatctggagcgagggcgcagatggaacagacatcaatgctgtggcccggagccatgatggcaagctgctggccagcgcagatgactttgggaaggtgcacctgttctcctacccctgctgccagccccgggccctgagccacaagtatggaggccacagcagccacgtgaccaacgtggccttcctgtgggatgacagcatggccctgaccaccggcggcaaggacacctctgtgctgcagtggagggtggtgtag

SEQ ID NO: 18342 - DNA, 792 bp, Artificial Sequence
  Description of Artificial Sequence: Synthetic coding sequence
atggccggcctggaggtgctgtttgccagcgctgccccagccatcacctgccggcaggatgccctggtgtgcttcctgcactgggaggtggtgacccacggctacttcggcctgggcgtgggggaccagcccggccccaatgacaagaagtctgagctgctgcctgctggctggaacaacaacaaggacctgtatgtgctgcgctatgagtacaaggatggcagcaggaagctgctggtgaaggccatcaccgtggagagctccatgatcctgaatgtgctggagtatggcagccagcaggtggccgacctgaccctgaacctggatgactacattgatgctgagcacctgggggacttccacaggacctacaagaacagcgaggagctgcggagccgcatcgtgtctggcatcatcacccccatccacgagcagtgggagaaggccaacgtgagcagcccccaccgggagttccccccagccacagcccgggaggtggaccccctgcgcatccccccccaccacccccacaccagccggcagcccccctggtgtgaccccctgggcccctttgtggtgggcggggaggacctggaccccttcggcccccggcggggcggcatgattgtggaccccctgcggagcggcttcccccgggccctgattgaccccagcagcggcctgcccaaccggctgcccccaggagctgtgcccccaggggccaggtttgaccccttcggccccatcggcaccagccccccaggccccaggccagaccggcggggccagtag

SEQ ID NO: 18343 - DNA, 273 bp, Artificial Sequence
  Description of Artificial Sequence: Synthetic coding sequence
atggacaacatgagcccccggctgcgggccttcctgtctgagcccatcggggagaaggatgtgtgctgggtggatggcatcagccatgagctggccatcaacctggtgaccaagggcatcaacaaggcctacatcctgctgggccagttcctgctgatgcacaagaatgaggccgagttccagcgctggctgatctgctgcttcggggccacagaatgtgaggcccagcagaccagccactgcctgaaggagtggtgtgcctgcttcctgtag

SEQ ID NO: 18344 - DNA, 888 bp, Artificial Sequence
  Description of Artificial Sequence: Synthetic coding sequence
atgcctgtgcacaccctgagccctggggcccccagcgccccagccctgccctgccgcctgcggaccagggtgcccggctacctgctgcggggccctgcagatggaggagccaggaagcccagcgctgtggagcggctggaggccgacaaggccaagtatgtgaagagcctgcacgtggccaacacccggcaggagcctgtgcagcccctgctgagcaagcagcccctcttcagccctgagaccaggagaacagtgctgacccccagccggcgggccctgcccggcccctgccggcggccccagctggacctggacatcctgagcagcctgattgacctgtgtgacagccctgtgtccccagctgaggccagcaggaccccaggccgggcagagggcgccggccggcccccaccagccaccccaccccggcccccacccagcaccagcgctgtgcggcgggtggatgtgcggcccctgcctgccagccctgcccggccctgccccagccctggccctgctgctgccagcagccctgcccggcccccaggcctgcagaggagcaagagtgacctgtctgagcgcttcagcagagctgctgctgacctggagcgcttcttcaacttctgtggcctggaccctgaggaggcccggggcctgggcgtggcccacctggcccgggccagcagtgacatcgtgtccctggccggccccagcgctggccctggcagcagcgagggcggctgcagccgccgcagctctgtgacagtggaggagcgggcccgggagcgggtgccctacggcgtgtctgtggtggagagaaatgcccgggtcatcaagtggctgtatggcctgcggcaggcccgggagagccctgctgctgagggctag

SEQ ID NO: 18345 - DNA, 582 bp, Artificial Sequence
  Description of Artificial Sequence: Synthetic coding sequence
atgcccaccaccagcaggcctgccctggatgtgaagggcggcaccagccctgccaaggaggatgccaaccaggagatgagctctgtggcctacagcaacctggccgtgaaggacaggaaggctgtggccatcctgcactacccaggagtggccagcaatggcaccaaggccagcggggcccccaccagcagcagcggcagccccatcggcagccccaccaccaccccacccaccaagccacccagcttcaacctgcacccagccccccacctgctggcctccatgcacctgcagaagctgaacagccagtaccagggcatggctgctgccaccccaggccagcctggagaggccggccccctgcagaactgggactttggagcccaggccggcggcgctgagagcctgagccccagcgctggggcccagagccctgccatcatcgacagcgaccctgtggatgaggaggtgctgatgagcctggtggtggagctgggcctggaccgggccaatgagctgcctgagctgtggctgggccagaatgaatttgacttcaccgctgacttccccagcagctgctag

SEQ ID NO: 18346 - DNA, 1077 bp, Artificial Sequence
  Description of Artificial Sequence: Synthetic coding sequence
atggctgctgtgctgaagcctgtgctgctgggcctgagagatgcccctgtgcacggcagccccaccggccctggggcctggacagccagcaagctgggcggcatcccagatgccctgcccaccgtggccgcccccaggcctgtgtgccagagatgtggccagcccctggccctggtggtgcaggtgtactgccccctggagggcagccccttccaccggctgctgcacgtgtttgcctgtgcctgccccggctgcagcactggaggagcccgctcctggaaggtgttccgcagccagtgcctgcaggtgcctgagcgggaggcccaggatgcccagaagcagggcaacagcctggccgctgaggactggtgtgagggcgcagatgactggggcagtgacacagaggagggccccagcccccagttcaccctggactttggaaatgatgccagcagcgccaaggatgtggactggacagcccggctgcaggacctgcggctgcaggatgctgtgctgggcgccgcccaccctgtgcccccaggcctgcccctcttcctgccctactacatctgtgtggctgatgaagatgactacagagactttgtgaacctggaccacgcccacagcctgctgcgggactaccagcagcgggagggcatcgccatggaccagctgctgagccagagcctgcccaatgatggagatgagaagtatgagaagaccatcatcaagagcggggaccagaccttctacaagttcatgaagagaattgctgcctgccaggagcagatcctgcgctacagctggagcggggagcccctcttcctgacctgccccaccagcgaggtgacagagctgcctgcctgcagccagtgtggcggccagaggatctttgagttccagctgatgcctgccctggtgtccatgctgaagagcgccaacctgggcctgtctgtggagtttggcaccatcctggtgtacacctgtgagaagagctgctggccacccaaccaccagacccccatggaggagttctgcatcatccaggaggaccctgatgagctgctcttcaagtag

SEQ ID NO: 18347 - DNA, 1779 bp, Artificial Sequence
  Description of Artificial Sequence: Synthetic coding sequence
atggcctctgtggtggtgaagaccatctggcagagcaaggagatccacgaggccggggacacccccactggagtggagagctgcagccagctggtgcctgaggcccccaggagagtgaccagccgggccaagggcatccccaagaagaagaaggctgtgtccttccacggcgtggagccccagatgagccaccagcccatgcactggtgcctgaacctgaagaggagcagcgcctgcaccaacgtgtccctgctgaacctggccgccatggagcccacagacagcactggaacagacagcacagtggaggacctgagcggccagctgaccctggccggccccccagccagccccaccctgccctgggaccctgatgatgctgacatcacagagatcctgagcggcgtgaacagcggcctggtgcgggccaaggacagcatcaccagcctgaaggagaagaccaacagagtgaaccagcacgtgcagagcctgcagagtgaatgttctgtgctgtctgagaacctggagcggcggcggcaggaggccgaggagctggagggctactgcatccagctgaaggagaactgctggaaggtgaccaggtctgtggaggatgctgagatcaagaccaacgtgctgaagcagaacagcgccctgctggaggagaagctgcgctacctgcagcagcagctgcaggatgagaccccccggcggcaggaggccgagctgcaggagcctgaggagaagcaggagcctgaggagaagcaggagcctgaggagaagcagaagccagaggccggcctgtcctggaacagcctgggccctgctgccaccagccagggctgccccggccccccaggcagcccagacaagcccagccggccccacggcctggtgcctgctggctggggcatgggccccagggctggggagggcccctacgtgtctgagcaggagctgcagaagctgttcaccggcatcgaggagctgcggcgggaggtgagcagcctgacagcccgctggcaccaggaggagggcgctgtgcaggaggccctgcggctgctgggcggcctgggcggccgggtggatggcttcctgggccagtgggagcgggcccagcgggagcaggcccagacagcccgggacctgcaggagctgcggggccgggcagatgagctgtgcaccatggtggagaggtctgctgtgtctgtggccagcctgcggtctgagctggagggcctgggccccctgaagcccatcctggaggagtttggccggcagttccagaacagccggcggggccctgacctgtccatgaacctggacaggagccaccagggcaactgtgcccgctgtgccagccagggcagccagctgagcacagagagcctgcagcagctgctggaccgggccctgaccagcctggtggatgaggtgaagcagaggggcctgaccccagcctgccccagctgccagaggctgcacaagaagatcctggagctggagcggcaggccctggccaagcacgtgcgggcagaggccctgagcagcaccctgcggctggcccaggatgaggccctgcgggccaagaacctgctgctgacagacaagatgaagccagaggagaagatggccaccctggaccacctgcacctgaagatgtgcagcctgcatgaccacctgagcaacctgcccctggagggcagcacaggcaccatgggcggcggcagcagcgctggcaccccacccaagcagggcggcagcgcccctgagcagtag

SEQ ID NO: 18348 - DNA, 2541 bp, Artificial Sequence
  Description of Artificial Sequence: Synthetic coding sequence
atgagcagcagccactttgccagccgccacaggaaggacatcagcacagagatgatccgcaccaagatcgcccacaggaagagcctgagccagaaggaaaatagacacaaggagtatgaaagaaacagacacttcggcctgaaggatgtgaacatccccaccctggagggccgcatcctggtggagctggatgagaccagccagggcctggtgcctgagaagaccaacgtgaagccccgggccatgaagaccatcctgggggaccagaggaagcagatgctgcagaagtacaaggaggagaagcagctgcagaagctgaaggagcagcgggagaaggccaagaggggcatcttcaaggtgggccgctacagaccagacatgccctgcttcctgctgagcaaccagaatgctgtgaaggccgagcccaagaaggccatccccagctctgtgcgcatcaccaggagcaaggccaaggaccagatggagcagaccaagattgacaatgaaagtgatgtgcgggccatccggcccggcccccggcagaccagcgagaagaaggtgtctgacaaggagaagaaggtggtgcagcctgtgatgcccaccagcctgaggatgaccaggtctgccacccaggccgccaagcaggtgcccaggacagtgagcagcaccacagccaggaagcctgtgacccgggccgccaatgaaaatgaacctgagggcaaggtgcccagcaagggccggcctgccaagaatgtggagaccaagccagacaagggcatcagctgcaaggtggacagcgaggagaacaccctgaacagccagaccaatgccaccagcggcatgaacccagatggagtgctgagcaagatggagaacctgcctgagatcaacacagccaagatcaagggcaagaacagctttgcccccaaggacttcatgttccagcccctggatggcctgaagacctaccaggtgacccccatgacccccaggtctgccaatgccttcctgacccccagctacacctggacccccctgaagacagaggtggatgagagccaggccaccaaggagatcctggcccagaagtgcaagacctacagcaccaagaccatccagcaggacagcaacaagctgccctgccccctgggccccctgactgtgtggcatgaggagcacgtgctgaacaagaatgaggccaccaccaagaacctgaatggcctgcccatcaaggaggtgcccagcctggagagaaatgaaggaagaattgcccagccccaccacggcgtgccctacttcaggaacatcctgcagagcgagacagagaagctgaccagccactgctttgagtgggacaggaagctggagctggacatcccagatgatgccaaggacctgatcagaacagctgtgggccagacccggctgctgatgaaggagcgcttcaagcagtttgagggcctggtggatgactgtgagtacaagaggggcatcaaggagaccacctgcacagacctggatggcttctgggacatggtgtccttccagattgaagatgtgatccacaagttcaacaacctgatcaagctggaggagagcggctggcaggtgaacaacaacatgaaccacaacatgaacaagaatgtgttcaggaagaaggtggtgtctggcatcgccagcaagcccaagcaggatgatgctggaagaattgctgccaggaaccggctggccgccatcaagaatgccatgagggagcgcatccggcaggaggagtgtgccgagacagctgtgtctgtcatccccaaggaggtggacaagatcgtgtttgatgctggcttcttccgggtggagagccctgtgaagctgttcagcggcctgtctgtgagcagcgagggccccagccagaggctgggcacccccaagtctgtgaacaaggctgtgtcccagagcagaaatgagatgggcatcccccagcagaccaccagcccagaaaatgccggcccccagaacaccaagtcagaacatgtgaagaagaccctcttcctgagcatccctgagagccgcagcagcattgaagatgcccagtgccccggcctgcctgacctgattgaagaaaatcatgtggtgaacaagacagacctgaaggtggactgcctgagcagcgagaggatgagcctgcccctgctggccggcggcgtggctgatgacatcaacaccaacaagaaggagggcatcagtgatgtggtggagggcatggagctgaacagcagcatcaccagccaggatgtgctgatgagcagccctgagaagaacacagccagccagaacagcatcctggaggagggggagaccaagatcagccagagcgagctgtttgacaacaagagcctgaccacagagtgccacctgctggacagccctggcctgaactgcagcaaccccttcacccagctggagcggcggcaccaggagcacgcccggcacatcagctttggaggcaacctgatcaccttcagccccctgcagcctggagagttctag

SEQ ID NO: 18349 - DNA, 1128 bp, Artificial Sequence
  Description of Artificial Sequence: Synthetic coding sequence
atggccagcgccccctggccagagcgggtgccccggctgctggccccccggctgcccagctacccacctcctccacccaccgtgggcctgcgctccatggagcaggaggagacctacctggagctgtacctggaccagtgtgccgcccaggacggcctggccccacccaggagccccctcttcagccctgtggtgccctatgacatgtacatcctgaatgccagcaacccagacacagccttcaacagcaaccctgaggtgaaggagaccagcggggacttcagctctgtggacctgtccttcctgcctgatgaggtgacccaggagaacaaggaccagcccgtcatcagcaagcatgaaacagaagaaaattctgagagccagagcccccagagccggctgcccagccccagcgagcaggatgtgggcctgggcctgaacagcagcagcctgagcaacagccacagccagctgcaccctggggacacagattctgtgcagcccagccctgagaagcccaacagcgacagcctgagcctggccagcatcacccccatgacccccatgacccccatcagcgagtgctgcggcatcgtgccccagctgcagaacatcgtgtccacagtgaacctggcctgcaagctggacctgaagaagatcgccctgcacgccaagaatgctgagtacaaccccaagagatttgctgctgtgatcatgaggatccgggagcccaggaccacagccctgatcttcagcagcggcaagatggtgtgcacaggagccaagtctgaggagcagagccggctggccgccaggaaatatgcccgggtggtgcagaagctgggcttccctgcccgcttcctggacttcaagatccagaacatggtgggcagctgtgatgtgcgcttccccatccggctggagggcctggtgctgacccaccagcagttcagcagctatgagcctgagctgtttcctggcctcatctacaggatggtgaagcccagaattgtgctgctgatctttgtgtctgggaaggtggtgctgaccggggccaaggagaggtctgagatctatgaggcctttgagaacatctaccccatcctgaagggcttcaagaaggcctag

SEQ ID NO: 18350 - DNA, 633 bp, Artificial Sequence
  Description of Artificial Sequence: Synthetic coding sequence
atgcaggccgagggccagggcaccggcggcagcactggagatgctgatggccctgggggccctggcatcccagatggccctggaggaaatgccggcggccctggagaggccggggccaccggcggccggggccccaggggggccggggccgcccgggccagcggcccccggggcggggccccccggggcccccatggaggagctgccagcgcccaggacggccgctgcccctgtggggcccggcggccagacagccggctgctgcagctgcacatcaccatgcccttcagcagccccatggaggccgagctggtgcggcgcatcctgagcagagatgctgcccccctgcccaggcctggagctgtgctgaaggacttcaccgtgtctggcaacctgctcttcatgtctgtgcgggaccaggaccgggagggcgccggccgcatgagggtggtgggctggggcctgggcagcgccagccctgagggccagaaggcccgggacctgcggacccccaagcacaaggtgtctgagcagaggcctggcaccccaggccccccacctcctgagggcgcccagggagatggctgccggggcgtggccttcaacgtgatgttcagcgccccccacatctag

SEQ ID NO: 18351 - DNA, 582 bp, Artificial Sequence
  Description of Artificial Sequence: Synthetic coding sequence
atggtggtgctgcgggccggcaagaagaccttcctgccccccctgtgccgggcctttgcctgccggggctgccagctggcccctgagagaggagctgagcggcgggacacagcccccagcggcgtgagccgcttctgcccccccaggaagagctgccacgactggattggccccccagacaagtacagcaacctgcggcctgtgcacttctacatcccagaaaatgaaagccccctggagcagaagctgaggaagctgcggcaggagacccaggagtggaaccagcagttctgggccaaccagaacctgaccttcagcaaggagaaggaggagttcatccacagccggctgaagaccaagggcctgggcctgaggacagagagcggccagaaggccaccctgaatgctgaggagatggctgacttctacaaggagttcctgagcaagaacttccagaagcacatgtactacaacagagactggtacaagaggaactttgccatcaccttcttcatgggcaaggtggccctggagcgcatctggaacaagctgaagcagaagcagaagaagaggagcaactag

SEQ ID NO: 18352 - DNA, 1383 bp, Artificial Sequence
  Description of Artificial Sequence: Synthetic coding sequence
atggccaatgaccccctggagggcttccacgaggtgaacctggccagccccaccagcccagacctgctgggcgtgtatgagagcggcacccaggagcagaccaccagccccagcgtcatctaccggccccaccccagcgccctgagctctgtgcccatccaggccaatgccctggatgtgtctgagctgcccacccagcctgtgtacagcagcccccggcggctgaactgtgccgagatcagcagcatctccttccacgtgacagatcctgccccctgcagcaccagcggcgtgacagctggcctgaccaagctgaccaccaggaaggacaactacaatgctgagcgggagttcctgcagggcgccaccatcacagaggcctgtgatggcagtgatgacatcttcggcctgagcacagacagcctgagccggctgcggagccccagcgtgctggaggtgcgggagaagggctatgaaaggctgaaggaggagctggccaaggcccagcgggagctgaagctgaaggatgaggagtgtgagcggctgagcaaggtgcgggaccagctgggccaggagctggaggagctgacagccagcctgtttgaggaggcccacaagatggtgcgggaggccaacatcaagcaggccacagctgagaagcagctgaaggaggcccagggcaagattgatgtgctgcaggccgaggtggccgccctgaagaccctggtgctgagcagcagccccaccagccccacccaggagcccctgcccggcggcaagacccccttcaagaagggccacaccaggaacaagagcaccagcagcgccatgagcggcagccaccaggacctgagcgtcatccagcccatcgtgaaggactgcaaggaggccgacctgagcctgtacaatgagttccggctgtggaaggatgagcccaccatggacaggacctgccccttcctggacaagatctaccaggaggacatcttcccctgcctgaccttcagcaagtctgagctggccagcgctgtgctggaggccgtggagaacaacaccctgagcattgagcctgtgggcctgcagcccatccgctttgtgaaggccagcgctgtggagtgtggcggccccaagaagtgtgccctgaccggccagagcaagagctgcaagcaccgcatcaagctgggggacagcagcaactactactacatcagccccttctgccgctaccgcatcacctctgtgtgcaacttcttcacctacatccgctacatccagcagggcctggtgaagcagcaggatgtggaccagatgttctgggaggtgatgcagctgaggaaggagatgagcctggccaagctgggctacttcaaggaggagctgtag

SEQ ID NO: 18353 - DNA, 981 bp, Artificial Sequence
  Description of Artificial Sequence: Synthetic coding sequence
atggccaccctggtggagctgcctgacagcgtgctgctggagatcttctcctacctgcctgtgcgggaccgcatccgcatcagccgggtgtgccaccgctggaagaggctggtggatgaccgctggctgtggaggcatgtggacctgaccctgtacaccatgaggcccaaggtgatgtggcacctgctgcggcgctacatggccagccggctgcacagcctgaggatgggcggctacctgttcagcggcagccaggccccccagctgagccctgccctgctgcgggccctgggccagaagtgccccaacctgaagaggctgtgcctgcacgtggccgacctgtccatggtgcccatcaccagcctgcccagcaccctgcggaccctggagctgcacagctgtgagatctccatggcctggctgcacaagcagcaggaccccaccgtgctgcccctgctggagtgcatcgtgctggacagagtgcctgccttcagagatgagcacctgcagggcctgacccgcttccgggccctgcggagcctggtgctgggcggcacctacagagtgacagagaccggcctggatgctggcctgcaggagctgagctacctgcagaggctggaggtgctgggctgcaccctgtctgctgacagcaccctgctggccatcagccgccacctgagagatgtgaggaagatccggctgactgtgcggggcctgagcgcccctggcctggccgtgctggagggcatgcctgccctggagagcctgtgcctgcagggccccctggtgaccccagagatgcccagccccacagagatcctgagcagctgcctgaccatgcccaagctgcgggtgctggagctgcagggcctgggctgggagggccaggaggccgagaagatcctgtgcaagggcctgccccactgcatggtgattgtgcgggcctgccccaaggagagcatggactggtggatgtag

SEQ ID NO: 18354 - DNA, 3090 bp, Artificial Sequence
  Description of Artificial Sequence: Synthetic coding sequence
atggccagcgaggccgtgaaggtggtggtgcgctgccggcccatgaaccagcgggagcgggagctgcgctgccagcctgtggtgacagtggactgtgcccgggcccagtgctgcatccagaaccctggagctgctgatgagccccccaagcagttcacctttgatggagcctaccacgtggaccacgtgacagagcagatctacaatgaaattgcctaccccctggtggagggcgtgacagagggctacaacggcaccatctttgcctacggccagacaggcagcggcaagagcttcaccatgcagggcctgcctgacccccccagccagaggggcatcatcccccgggcctttgagcacgtgtttgagagcgtgcagtgtgccgagaacaccaagttcctggtgcgggccagctacctggagatctacaatgaagatgtgcgggacctgctgggcgctgacaccaagcagaagctggagctgaaggagcaccctgagaagggcgtgtatgtgaagggcctgtccatgcacacagtgcacagcgtggcccagtgtgagcacatcatggagaccggctggaagaacagatctgtgggctacaccctgatgaacaaggacagcagccgcagccacagcatcttcaccatcagcattgagatgtctgctgtggatgagcggggcaaggaccacctgcgggccggcaagctgaacctggtggacctggccggcagcgagcggcagagcaagacaggagccactggagagcggctgaaggaggccaccaagatcaacctgagcctgagcgccctgggcaatgtcatcagcgccctggtggatggccgctgcaagcacgtgccctacagagacagcaagctgacccggctgctgcaggacagcctgggcggcaacaccaagaccctgatggtggcctgcctgagccctgctgacaacaactatgatgagaccctgagcaccctgcgctatgccaacagagccaagaacatccggaacaagccccgcatcaatgaagaccccaaggatgccctgctgcgggagtaccaggaggagatcaagaagctgaaggccatcctgacccagcagatgagccccagcagcctgagcgccctgctgagccggcaggtgcccccagaccctgtgcaggtggaggagaagctgctgccccagcccgtcatccagcatgatgtggaggccgagaagcagctgatccgggaggagtatgaggagcggctggcccggctgaaggctgactacaaggccgagcaggagagccgggcccggctggaggaggacatcacagccatgaggaacagctatgatgtgcggctgagcaccctggaggagaacctgaggaaggagacagaggccgtgctgcaggtgggcgtgctgtacaaggccgaggtgatgagcagagctgagtttgccagcagcgctgagtaccccccagccttccagtatgagaccgtggtgaagcccaaggtgttcagcaccacagacaccctgcccagtgatgatgtgtccaagacccaggtgagcagcagatttgctgagctgcccaaggtggagcccagcaagtctgagatcagcctgggcagcagcgagagcagcagcctggaggagacctctgtgtctgaggccttccctggccctgaggagcccagcaatgtggaggtgtccatgcccacagaggagagccgcagccgctacttcctggatgaatgtctgggccaggaggccgccggccacctgctgggggagcagaactacctgccccaggaggagccccaggaggtgcccctgcagggcctgctgggcctgcaggacccctttgctgaggtggaggccaagctggcccggctgagcagcacagtggccaggacagatgccccccaggctgatgtgcccaaggtgcctgtgcaggtgcctgcccccacagacctgctggagcccagtgatgcccggcctgaggccgaggccgcagatgacttcccccccaggcctgaggtggacctggccagcgaggtggccctggaggtggtgaggacagctgagcccggggtgtggctggaggcccaggcccctgtggccctggtggcccagcctgagcccctgcctgccacagctggggtgaagcgggagagcgtgggcatggaggtggccgtgctgacagatgaccccctgcctgtggtggaccagcagcaggtgctggcccggctgcagctgctggagcagcaggtggtgggcggggagcaggccaagaacaaggacctgaaggagaagcacaagaggaggaagagatatgcagatgaaagaaggaagcagctggtggccgccctgcagaacagtgatgaggacagcggggactgggtgctgctgaatgtgtatgacagcatccaggaggaggtgcgggccaagagcaagctgctggagaagatgcagaggaagctgcgggctgctgaggtggagatcaaggacctgcagagcgagttccagctggagaagattgactacctggccaccatccggcggcaggagcgggacagcatgctgctgcagcagctgctggagcaggtgcagcccctcatcagaagagactgcaactacagcaacctggagaagatcctgcgggagagctgctgggatgaggacaatggcttctggaagatcccccaccctgtgatcaccaagaccagcctgcctgtggccgtgtccacaggcccccagaacaagccagccaggaagaccagcgctgctgacaacggggagcccaacatggaggatgaccgctaccgcctgatgctgagccgcagcaacagcgagaacatcgccagcaactacttccgcagcaagagggccagccagatcctgagcacagatgccaggaagagcctgacccaccacaacagccccccaggcctgagctgccccctgagcaacaacagcgccatcccccccacccaggcccctgagatgccccagccccggcccttccggctggagagcctggacatccccttcaccaaggccaagaggaagaagagcaagagcaactttggcagcgagcccctgtag

SEQ ID NO: 18355 - DNA, 417 bp, Artificial Sequence
  Description of Artificial Sequence: Synthetic coding sequence
atgatcctgcagcagcccctgcagaggggcccccagggcggggcccagaggctgcccagggctgccctgggcgtgacctggggcctggatgccagcagccccctgcggggagctgtgcccatgagcaccaagaggcggctggaggaggagcaggagcccctgaggaagcagttcctgtctgaggagaacatggccacccacttcagccagctgagcctgcacaatgaccacccctactgcagcccccccatgaccttcagccctgccctgccccccctgcggagcccctgcagcgagctgctgctgtggagatacccaggcagcctcatccctgaggccctgcggctgctgcggctgggggacacccccagccccccctacccagccaccccagctggggacatcatggagctgtag

SEQ ID NO: 18356 - DNA, 573 bp, Artificial Sequence
  Description of Artificial Sequence: Synthetic coding sequence
atgttccaggtgcctgattctgagggcggccgggccggcagccgggccatgaagcccccaggaggagagagcagcaacctgtttggcagccctgaggaggccacccccagcagccggcccaacaggatggccagcaacatcttcggccccacagaggagccccagaacatccccaagaggaccaaccccccaggcggcaaaggaagtggcatctttgatgagagcacccctgtgcagacccggcagcacctgaaccccccaggcggcaagaccagtgacatcttcggcagccctgtgacagccaccagccggctggcccaccccaacaagcccaaggaccacgtgttcctgtgtgagggggaggagcccaagagtgacctgaaggccgcccggagcatcccagctggagctgagcctggagagaagggcagcgccaggaaggccggccctgccaaggagcaggagcccatgcccaccgtggacagccatgagccccggctgggcccccggcccaggagccacaacaaggtgctgaaccccccaggcggcaagagcagcatctccttctactag

SEQ ID NO: 18357 - DNA, 690 bp, Artificial Sequence
  Description of Artificial Sequence: Synthetic coding sequence
atgacctgctgcagccaggtgccccccaggagaagacccagcctggccctgagcccccggctggactgcaatggcctgaatggagtgcccggcagcatctgggactttgtgtctggcagcttcagccccagccccagccccatcctgtctgctggcccccccagcagcagcagcgccagccccaacggggctgagctggcccgggtgcggcggcagctggatgaggccaagaggaagatccggcagtgggaggagagctggcagcaggtgaagcaggtgtgtgatgcctggcagcgggaggcccaggaggccaaggagcgggcccgggtggccgacagcgaccggcagctggccctgcagaagaaggaggaggtggaggcccaggtgaagcagctgcaggaggagctggagggcctgggcgtggccagcaccctgcccggcctgcggggctgtggggacatcggcaccatccccctgcccaagctgcacagcctgcagagccagctgcggctggacctggaggccgtggatggagtcatcttccagctgcgggccaagcagtgtgtggcctgccgggagcgggcccacggggctgtgctgcggccctgccagcaccacatcctgtgtgagccctgtgccgccacagcccctgagtgcccctactgcaagggccagcccctgcagtggtag

SEQ ID NO: 18358 - DNA, 5460 bp, Artificial Sequence
  Description of Artificial Sequence: Synthetic coding sequence
atggccagcatcacccagctgtttgatgacctgtgtgaggccctgctgcctgctgccaagacccacctgggccagaggtctgtgaacaggaagagggccaagaggagcctgaagaaggtggcctacaatgccctcttcaccaacctcttccaggatgagacccagcagctgcagcctgacatgagcaagctgcctgccaggaacaagatcctgatgctgagctttgacctgcgggtgggcggcctgggccccaaggctgaccggctggaggagctggtggaggagctggaggccgccccctgctgccccctgctggaggtgggctctgtgctggacctgctggtgcagctggccggcagcggccccccccaggtgctgcccaggaagagggactacttcctgaacaacaagcacgtgggcagaaatgtgccctacagcggctatgactgtgatgacctgtctgtgtttgagatggatgtgcagagcctcatcagccgggaggagtgcctgtgccacagcatgatccaggagaccctgcaggtgatggaggccgcccctggcaccggcctgcccaccgtgggcctcttctcctttggagacccctgtggggacagatttgagcgggacaccagggtgtccctgtttggagccctggtgcacagcaggacctatgacatggatgtgcggctgggcctgccccctgtgcctgacaatgctgacctgagcggcctggccatcaaggtgcccccatctgtggaccagtgggaggatgagggcttccagagcgccagcaacctgaccccagacagccagagcgagcccagcgtgaccccagatgtggacctgtgggaggccgccctgacctatgaggccagcaagaggcgctgctgggagcgggtgggctgccccccaggccaccgggaggagccctacctgacagaagctggaagagatgcctttgacaagttctgccgcctgcaccagggcgagctgcagctgctggccggcggcgtgctgcaggccccccagcctgtgctggtgaaggaatgtgagctggtgaaggatgtgctgaatgtgctgattggagtggtgtctgccaccttcagcctgtgccagcctgcccaggcctttgtggtgaagaggggcgtgcacgtgtctggggccagccctgagagcatcagcagcctgctgtctgaggtggccgagtatggcacctgctacacccggctgagccacttcagcctgcagcctgtgctggacagcctgtacagcaagggcctggtgttccaggccttcaccagcggcctgcggcgctacctgcagtactaccgggcctgtgtgctgagcaccccacccaccctgagcctgctgaccatcggcttcctgttcaagaagctgggccggcagctgcgctacctggccgagctgtgtggggtgggcgctgtgctgcccggcacctgtggcggcggccccagggctgccttccccactggagtgaagctgctgagctacctgtaccaggaggccctgcacaactgcagcaatgagcactaccctgtgctgctgagcctgctgaagaccagctgtgagccctacacccgcttcatccatgactgggtgtacagcggggtcttcagagatgcctatggagagttcatgatccaggtgaaccacgagtacctgtccttccgggacaagctgtactggacccacggctacgtgctgatcagcaaggaggtggaggactgtgtgcctgtgttcctgaagcacatcgcccatgacatctacgtgtgtgggaagaccatcaacctgctgaagctgtgctgccccaggcactacctgtgctggagcgatgtgcctgtgccccgcatcagcgtcatcttcagcctggaggagctgaaggagattgagaaggactgtgctgtgtatgtgggccgcatggagcgggtggcccggcacagctctgtgtccaaggaggagaaggagctgaggatggagatcgccaagcaggagctgattgcccacgcccgggaggccgccagccgggtgctgagcgccctgagtgaccggcagatgtctgagaggatggccctggatgccaggaagcgggagcagttccagaggctgaaggagcagtttgtgaaggaccaggagcggcggcaggccgcccggcaggaggagctggatgatgacttctcctatgcccgggagctgcgggaccgggagcggcggctgaagagcctggaggaggagctggagaggaaggcccggcaggccctggtggaccactacagcaagctgtctgctgaggccgcccggcgggagcagaaggccctgtggaggatccagaggcaccggctggagagcgcccggctgcgcttcctgctggaggatgagaagcacatccaggagatgctgaaggctgtgtctgaggcccaccagccccaggagcccccagatgtgctgctgtctgtgcacccccaggtgaccagccctggccctgagcaccctgagggcggccagggctgtgacagcggcagcgctgagcagcacagccctgcctgggatggctggaacagacctggcctgctgaccccccagcccctgaagcccctggccgtgggcgctgggggccggggcctgcagcaggccgagggcgcccggcccttcagtgacagcctgagcatcggggacttcctgcctgtgggccctggagctgagcccagcgtgcagacaggcatggtgcccctgctggaggtggccctgcagaccatcaacctggacctgccccccagcgcccctggagaggccccagctgctgccagcacccagcccagccggccccaggagtatgacttcagcacagtgctgcggcctgctgtggccaccagccctgcccctggccccctgcaggccgctgagtgcagcctgggcagcagcggcctgcagctgtgggaggacagctgtgggaagatggatgcctgtggcagcgccagccgggagaccctgctgcccagccaccccccccggcgggccgccctggaggagggcagcagccagcccacagagcggctgtttggccaggtgtctgggggcggcctgcccaccggggactatgccagcgagatcgcccccacccggccccgctggaacacccacggccacgtgtctgatgccagcatccgggtgggagaaaatgtgtctgatgtggcccccacccagccccgctggaacacccacggccacgtgtccaatgccagcatcagcctgggggagagcgtgtctgatgtggcccccacccggccccgctggaacatccacggccacgtgtccaatgccagcatccgggtgggagaaaatgtgtctgatgtggcccccacccggccccgctggaacacccacggccacgtgtccaatgccagcatccgggtgggggagaatgtgtctgatgtggcccccacccggccccgctggaacacccacggccacgtgtctgatgccagcatcagcctgggggagagcgtgtctgacatggccccagcccggccccgctggaacacccacggccacgtgtctgatgccagcatcagcctgggggagagcgtgtctgacatggcccccacccggccccgctggaacacccacggccacgtgtctgacaccagcatccgggtgggagaaaatgtgtctgatgtggcccccatccgcagccgctgcaacacccacggccacgtgtctgatgccagcatcagcctgggggagcctgtgtctgatgtggtgtccacccggccccgctggaacacccacgtgcccatccccccaccccacatggtgctgggcgccctgagccctgaggccgagcccaacaccccccggccccagcagagccccccaggccacaccagccagagcgccctgagcctgggcgcccagagcacagtgctggactgtggcccccggctgcctgtggaggtgggccccagcctgagcagccccagcagcggctgtggggagggcagcatctctgtgggagaaaatgtgtctgatgtggcccccacccagccctggtggcccaacacccctggggacagcgtgtctgaggagctgggccctggccgcagcggggacacagaggacctgagccccaactggcccctgaacagccaggaggacacagctgcccagagcagccctggccgcggggaggaggccgaggccagcgctgctgaggcccagggcggggagcaggcctacctggccggcctggccggccagtaccacctggagcgctacccagacagctatgaatccatgtctgagccccccatcgcccacctgctgcggcctgtgctgccccgggcctttgccttccctgtggacccccaggtgcagagcgctgctgatgaaacagctgtgcagctgtctgagctgctgaccctgcctgtgctgatgaagaggagcatcacagcccccctggccgcccacatcagcctggtgaacaaggctgctgtggactacttctttgtggagctgcacctggaggcccactatgaggccctgcggcacttcctgctgatggaggatggagaatttgcccagagcctgagtgacctgctgtttgagaagctgggcgccggccagaccccaggagagctgctgaaccccctggtgctgaacagcgtgctgagcaaggccctgcagtgcagcctgcatggagacaccccccacgccagcaacctgagcctggccctgaagtacctgcctgaggtgtttgccccaaatgccccagatgtgctgagctgcctggagctgcgctacaaggtggactggcccctgaacatcgtcatcacagagggctgtgtgtccaagtacagcggggtcttctccttcctgctgcagctgaagctgatgatgtgggccctgaaggatgtgtgcttccacctgaagaggacagccctgctgagccacatggccggctctgtgcagttccggcagctgcagctgttcaagcatgagatgcagcactttgtgaaggtgatccagggctacatcgccaaccagatcctgcacgtgacctggtgtgagttccgggcccggctggccaccgtgggggacctggaggagatccagagggcccacgccgagtacctgcacaaggctgtgttccggggcctgctgacagagaaggccgcccctgtgatgaatgtcatccacagcatcttcagcctggtgctgaagttccgcagccagctgatcagccaggcctggggccccccaggcggccccagaggagctgagcaccccaactttgccctgatgcagcagagctacaacaccttcaagtactacagccacttcctgttcaaggtggtgaccaagctggtgaacagaggctaccagccccacctggaggacttcctgctgcgcatcaacttcaacaactactaccaggatgcctag

SEQ ID NO: 18359 - DNA, 2250 bp, Artificial Sequence
  Description of Artificial Sequence: Synthetic coding sequence
atgagcggcagccacaccccagcctgtggccccttcagcgccctgacccccagcatctggccccaggagatcctggccaagtacacccagaaggaggagagcgctgagcagcctgagttctactatgatgaatttggcttccgggtgtacaaggaggagggagatgagcccggcagcagcctgctggccaacagccccctgatggaggatgccccccagaggctgcgctggcaggcccacctggagttcacccacaaccatgatgtgggggacctgacctgggacaagattgctgtgtccctgcccaggtctgagaagctgcggagcctggtgctggccggcatcccccacggcatgaggccccagctgtggatgaggctgagcggggccctgcagaagaagagaaattctgagctgagctaccgggagatcgtgaagaacagcagcaatgatgagaccatcgccgccaagcagatcgagaaggacctgctgcggaccatgcccagcaatgcctgctttgcctccatgggcagcattggagtgccccggctgcggcgggtgctgcgggccctggcctggctgtacccagagatcggctactgccagggcaccggcatggtggccgcctgcctgctgctcttcctggaggaggaggatgccttctggatgatgtctgccatcatcgaggacctgctgcctgccagctacttcagcaccaccctgctgggcgtgcagacagaccagagggtgctgcggcacctgattgtgcagtacctgccccggctggacaagctgctgcaggagcatgacatcgagctgagcctcatcaccctgcactggttcctgacagcctttgcctctgtggtggacatcaagctgctgctgcgcatctgggacctcttcttctatgagggcagccgggtgctcttccagctgaccctgggcatgctgcacctgaaggaggaggagctgatccagagcgagaacagcgccagcatcttcaacaccctgagtgacatccccagccagatggaggatgctgagctgctgctgggcgtggccatgaggctggccggcagcctgacagatgtggccgtggagacccagaggaggaagcacctggcctacctgattgctgaccagggccagctgctgggcgccggcaccctgaccaacctgagccaggtggtgagaagaaggacccagaggaggaagagcaccatcacagccctgctgtttggagaagatgacctggaggccctgaaggccaagaacatcaagcagacagagctggtggccgacctgcgggaggccatcctgcgggtggcccggcacttccagtgcacagaccccaagaactgcagcgtggagctgaccccagactacagcatggagagccaccagagggaccacgagaactacgtggcctgcagccgcagccacagaagaagagccaaggccctgctggactttgaaagacatgatgatgatgagctgggcttcaggaagaatgacatcatcaccatcgtgtcccagaaggatgagcactgctgggtgggggagctgaatggcctgcggggctggttccctgccaagtttgtggaggtgctggatgagaggagcaaggagtacagcattgctggagatgattctgtgacagaaggagtgacagacctggtgcggggcaccctgtgcccagccctgaaggccctgtttgagcacggcctgaagaagcccagcctgctgggcggggcctgccacccctggctgttcatcgaggaggccgccggccgggaggtggagcgggactttgcctctgtgtacagccggctggtgctgtgcaagaccttccggctggatgaagatggcaaggtgctgaccccagaggagctgctgtacagagctgtgcagagcgtgaatgtgacccatgatgctgtgcacgcccagatggatgtgaagctgcggagcctcatctgtgtgggcctgaatgagcaggtgctgcacctgtggctggaggtgctgtgcagcagcctgcccaccgtggagaagtggtaccagccctggagcttcctgcggagccctggctgggtgcagatcaagtgtgagctgcgggtgctgtgctgctttgccttcagcctgagccaggactgggagctgcctgccaagcgggaggcccagcagcccctgaaggagggcgtgcgggacatgctggtgaagcaccacctgttctcctgggatgtggatggatag

SEQ ID NO: 18360 - DNA, 2097 bp, Artificial Sequence
  Description of Artificial Sequence: Synthetic coding sequence
atgctgagccccaagatccggcaggcccggcgggcccggagcaagagcctggtgatgggagagcagagccgcagccctggccgcatgccctgcccccaccggctgggccctgtgctgaaggccggctggctgaagaagcagaggagcatcatgaagaactggcagcagcgctggtttgtgctgcggggggaccagctgttctactacaaggacaaggatgagatcaagccccagggcttcatcagcctgcagggcacccaggtgacagagctgcccccaggccctgaggaccccgggaagcacctgtttgagatcagccctggaggagctggggagcgggagaaggtgcctgccaaccctgaggccctgctgctgatggccagcagccagagggacatggaggactgggtgcaggccatcagaagagtcatctgggcccccctgggcggcggcatcttcggccagaggctggaggagaccgtgcaccacgagaggaaatatggcccccggctggcccccctgctggtggagcagtgtgtggacttcatccgggagcggggcctgacagaggagggcctcttcaggatgcctggccaggccaacctggtgcgggacctgcaggacagctttgactgtggggagaagcccctgtttgacagcaccacagatgtgcacacagtggccagcctgctgaagctgtacctgcgggagctgcctgagcctgtggtgccctttgcccgctatgaggacttcctgagctgtgcccagctgctgaccaaggatgaaggagagggcaccctggagctggccaagcaggtgagcaacctgccccaggccaactacaacctgctgcgctacatctgcaagttcctggatgaggtgcaggcctacagcaatgtgaacaagatgtctgtgcagaacctggccaccgtgtttggccccaacatcctgcggccccaggtggaggaccctgtgaccatcatggagggcaccagcctggtgcagcacctgatgacagtgctgatcaggaagcacagccagctgttcaccgcccctgtgcctgagggccccaccagcccccggggcggcctgcagtgtgctgtgggctggggcagcgaggaggtgacccgggacagccagggcgagcccggcggccctggcctgcctgcccacaggaccagcagcctggatggagctgctgtggccgtgctgagcaggacagcccccaccggccctggcagccgctgcagccctgggaagaaggtgcagaccctgcccagctggaagagcagcttccggcagcccaggagcctgagcggcagccccaagggcggcggcagcagcctggaggtgcccatcatcagcagcggcggcaactggctgatgaatggcctgagcagcctgcggggccaccggcgggccagcagcggggaccggctgaaggacagcggctctgtgcagaggctgagcacctatgacaacgtgcctgcccctggcctggtgcccggcatccccagcgtggcctccatggcctggagcggggccagcagcagcgagagctctgtgggcggcagcctgagcagctgcacagcctgccgggccagtgacagcagcgcccggagcagcctgcacacagactgggccctggagcccagccccctgcccagcagcagcgaggaccccaagagcctggacctggaccacagcatggatgaagctggagctggggccagcaacagcgagcccagcgagccagacagccccacccgggagcacgcccggcgctctgaggccctgcagggcctggtgacagagctgcgggcagagctgtgccggcagaggacagaatatgaaagatctgtgaagagaattgaggagggcagcgctgacctgaggaagaggatgagccggctggaggaggagctggaccaggagaagaagaagtacatcatgctggagatcaagctgagaaattctgagcgggcccgggaggatgctgagaggaggaaccagctgctgcagcgggagatggaggagttcttcagcaccctgggcagcctgactgtgggcgccaagggggcccgggcccccaagtag

SEQ ID NO: 18361 - DNA, 180 bp, Artificial Sequence
  Description of Artificial Sequence: Synthetic coding sequence
atgacccggggcaaccagcgggagctggcccggcagaagaacatgaagaagcagagcgacagcgtgaagggcaagagaagagatgatggcctgtctgctgctgccaggaagcagagggacagcgagatcatgcagcagaagcagaagaaggccaatgagaagaaggaggagcccaagtag

SEQ ID NO: 18362 - DNA, 372 bp, Artificial Sequence
  Description of Artificial Sequence: Synthetic coding sequence
atggcccgctatgaggaggtgtctgtgtctggctttgaggagttccacagagctgtggagcagcacaacgggaagaccatctttgcctacttcaccggcagcaaggatgctgggggcaagtcctggtgcccagactgtgtgcaggccgagcctgtggtgcgggagggcctgaagcacatcagcgagggctgtgtgttcatctactgccaggtgggggagaagccctactggaaggaccccaacaatgacttcaggaagaacctgaaggtgacagctgtgcccaccctgctgaagtatggcaccccccagaagctggtggagagtgaatgtctgcaggccaacctggtggagatgctgttcagcgaggactag

SEQ ID NO: 18363 - DNA, 1401 bp, Artificial Sequence
  Description of Artificial Sequence: Synthetic coding sequence
atgggctggatcacagaggacctgatcagaagaaatgctgagcacaatgactgtgtgatcttcagcctggaggagctgagcctgcaccagcaggagattgagcggctggagcacatcgacaagtggtgccgggacctgaagatcctgtacctgcagaacaacctgattggcaagattgaaaatgtgtccaagctgaagaagctggagtacctgaacctggccctgaacaacatcgagaagattgagaacctggagggctgtgaggagctggccaagctggacctgactgtgaacttcatcggggagctgagcagcatcaagaacctgcagcacaacatccacctgaaggagctgttcctgatgggcaacccctgtgccagctttgaccactaccgggagtttgtggtggccaccctgccccagctgaagtggctggatggcaaggagattgagcccagcgagcgcatcaaggccctgcaggactacagcgtgattgagccccagatccgggagcaggagaaggaccactgcctgaagagggccaagctgaaggaggaggcccagaggaagcaccaggaggaggacaagaatgaagacaagaggagcaatgccggctttgatggccgctggtacacagacatcaatgccaccctgagcagcctggagagcaaggaccacctgcaggccccagacacagaggagcacaacaccaagaagctggacaacagtgaagatgacctggagttctggaacaagccctgcctcttcaccccagagagccggctggagaccctgcggcacatggagaagcagaggaagaagcaggagaagctgtctgagaagaagaagaaggtgaagccacccaggaccctcatcacagaagatggcaaggccctgaatgtgaatgagcccaagattgacttcagcctgaaggacaatgagaagcagatcatcctggacctggccgtgtaccgctacatggacaccagcctgattgatgtggatgtgcagcccacctacgtgcgggtgatgatcaagggcaagcccttccagctggtgctgcctgctgaggtgaagccagacagcagcagcgccaagaggagccagaccaccggccacctggtgatctgcatgcccaaggtgggggaggtgatcaccggcggccagagggccttcaagtccatgaagaccaccagtgacaggagccgggagcagaccaacaccaggagcaagcacatggagaagctggaggtggaccccagcaagcacagcttcccagatgtgaccaacatcgtgcaggagaagaagcacacccccaggagaagacctgagcccaagatcatccccagcgaggaggaccccacctttgaggacaaccctgaggtgcccccactcatctag

SEQ ID NO: 18364 - DNA, 1050 bp, Artificial Sequence
  Description of Artificial Sequence: Synthetic coding sequence
atggaggacccccagagcaaggagcctgctggggaggccgtggccctggccctgctggagagccccaggcctgagggcggggaggagcccccccggcccagccctgaggagacccagcagtgcaagtttgatggccaggagaccaagggcagcaagttcatcaccagcagcgccagtgacttcagtgaccctgtgtacaaggagatcgccatcaccaacggctgcatcaacaggatgagcaaggaggagctgcgggccaagctgtctgagttcaagctggagacccggggcgtgaaggatgtgctgaagaagaggctgaagaactactacaagaagcagaagctgatgctgaaggagagcaactttgctgacagctactatgactacatctgcatcatcgactttgaggccacctgtgaggagggcaaccccccagagtttgtgcatgagatcatcgagttccctgtggtgctgctgaacacccacaccctggagattgaggacaccttccagcagtatgtgcggcctgagatcaacacccagctgagtgacttctgcatcagcctgaccggcatcacccaggaccaggtggacagagctgacaccttcccccaggtgctgaagaaggtgattgactggatgaagctgaaggagctgggcaccaagtacaagtacagcctgctgacagatggctcctgggacatgagcaagttcctgaacatccagtgccagctgagccggctgaagtaccccccatttgccaagaagtggatcaacatcaggaagagctatggcaacttctacaaggtgcccaggagccagaccaagctgaccatcatgctggagaagctgggcatggactatgatggccggccccactgcggcctggatgacagcaagaacatcgccagaattgctgtgaggatgctgcaggacggctgtgagctgcgcatcaatgagaagatgcacgccggccagctgatgtctgtgagcagcagcctgcccatcgagggcaccccaccaccccagatgccccacttcaggaagtag

SEQ ID NO: 18365 - DNA, 843 bp, Artificial Sequence
  Description of Artificial Sequence: Synthetic coding sequence
atgctgtctgctgtggcccggggctaccagggctggttccacccctgtgcccggctgtctgtgaggatgagcagcacaggcatcgacagaaaaggagtgctggccaacagagtggccgtggtgacaggcagcaccagcggcatcggctttgccatcgcccggcggctggccagagatggagcccacgtggtgatcagcagcaggaagcagcagaatgtggaccgggccatggccaagctgcagggcgagggcctgtctgtggccggcatcgtgtgccacgtgggcaaggccgaggaccgggagcagctggtggccaaggccctggagcactgcggcggcgtggacttcctggtgtgcagcgctggggtgaaccccctggtgggcagcaccctgggcaccagcgagcagatctgggacaagatcctgtctgtgaatgtgaagagccctgccctgctgctgagccagctgctgccctacatggagaacagaagaggagctgtgatcctggtgagcagcattgctgcctacaaccctgtggtggccctgggcgtgtacaacgtgtccaagacagccctgctgggcctgaccaggaccctggccctggagctggcccccaaggacatccgggtgaactgtgtggtgcccggcatcatcaagacagacttcagcaaggtgttccatggaaatgaaagcctgtggaagaacttcaaggagcaccaccagctgcagagaattggagagagcgaggactgtgccggcatcgtgtccttcctgtgcagcccagatgccagctatgtgaatggagaaaatattgctgtggccggctacagcacccggctgtag

SEQ ID NO: 18366 - DNA, 909 bp, Artificial Sequence
  Description of Artificial Sequence: Synthetic coding sequence
atggtgacagagcaggaggtggatgccatcggccagaccctggtggaccccaagcagcccctgcaggcccgcttccgggccctcttcaccctgcggggcctgggcggccctggggccatcgcctggatcagccaggcctttgatgatgattctgccctgctgaagcatgagctggcctactgcctgggccagatgcaggatgcccgggccatccccatgctggtggatgtgctgcaggacacccggcaggagcccatggtgagacatgaagctggggaggccctgggcgccatcggggaccctgaggtgctggagatcctgaagcagtacagcagtgaccccgtcatcgaggtggccgagacctgccagctggccgtgcggcggctggagtggctgcagcagcacggcggggagcctgctgctggcccctacctgtctgtggaccctgcccctcctgctgaggagagagatgtgggccgcctgcgggaggccctgctggatgagagccggcccctgtttgagcgctaccgggccatgtttgccctgagaaatgccggcggggaggaggccgccctggccctggccgagggcctgcactgcggcagcgccctcttcagacatgaggtgggctacgtgctgggccagctgcagcacgaggccgctgtgccccagctggccgccgccctggcccgctgcacagagaaccccatggtgagacatgaatgtgccgaggccctgggcgccatcgcccggcctgcctgcctggccgccctgcaggcccacgcagatgatcctgagcgggtggtgcgggagagctgtgaggtggccctggacatgtatgagcacgagaccggccgggccttccagtatgcagatggcctggagcagctgcggggggcccccagctag

SEQ ID NO: 18367 - DNA, 3384 bp, Artificial Sequence
  Description of Artificial Sequence: Synthetic coding sequence
atggaggtgcaggtgtcccaggccagcctgggctttgagctgacctctgtggagaagagcctgcgggagtggagccggctgagccgggaggtgattgcctggctgtgccccagcagccccaacttcatcctgaacttccccccacctccttctgccagctctgtgtccatggtgcagctgttcagcagccccttcggctaccagagccccagcggccacagcgaggaggagcgggagggcaacatgaagagcgccaagccccaggtgaaccacagccagcacggggagagccagagggccctgagccccctgcagagcaccctgagcagcgctgccagccccagccaggcctatgagacctacattgaaaatggcctcatctgcctgaagcacaagatccggaacatcgagaagaagaagctgaagctggaggactacaaggaccggctgaagagcggggagcacctgaacccagaccagctggaggccgtggagaagtatgaggaggtgctgcacaacctggagtttgccaaggagctgcagaagaccttcagcggcctgagcctggacctgctgaaggcccagaagaaggcccagaggcgggagcacatgctgaagctggaggccgagaagaagaagctgcggaccatcctgcaggtgcagtatgtgctgcagaacctgacccaggagcacgtgcagaaggacttcaagggcggcctgaatggagctgtgtacctgcccagcaaggagctggactacctgatcaagttcagcaagctgacctgcccagagagaaatgaaagcctgtctgtggaggaccagatggagcagagcagcctgtacttctgggacctgctggagggcagcgagaaggctgtggtgggcaccacctacaagcacctgaaggacctgctgagcaagctgctgaacagcggctactttgagagcatccctgtgcccaagaatgccaaggagaaggaggtgcccctggaggaggagatgctgatccagagcgagaagaagacccagctgagcaagacagaatctgtgaaggagagcgagagcctgatggagtttgcccagcctgagatccagccccaggagttcctgaacagacgctacatgacagaggtggactacagcaacaagcagggcgaggagcagccctgggaggccgactatgccaggaagcccaacctgcccaagcgctgggacatgctgacagagccagatggccaggagaagaagcaggagagcttcaagtcctgggaggccagcggcaagcaccaggaggtgtccaagccagctgtgtccctggagcagaggaagcaggacaccagcaagctgcggagcaccctgcctgaggagcagaagaagcaggagatcagcaagagcaagcccagccccagccagtggaagcaggacacccccaagagcaaggccggctacgtgcaggaggagcagaagaagcaggagacccccaagctgtggcctgtgcagctgcagaaggagcaggaccccaagaagcagacccccaagtcctggacccccagcatgcagagcgagcagaacaccaccaagtcctggaccacccccatgtgtgaggagcaggacagcaagcagcctgagacccccaagtcctgggagaacaacgtggagagccagaagcacagcctgaccagccagagccagatcagccccaagtcctggggcgtggccacagccagcctcatccccaatgaccagctgctgcccaggaagctgaacacagagcccaaggatgtgcccaagcctgtgcaccagcctgtgggcagcagcagcaccctgcccaaggaccctgtgctgaggaaggagaagctgcaggacctgatgacccagatccagggcacctgcaacttcatgcaggagagcgtgctggactttgacaagcccagcagcgccatccccaccagccagcccccatctgccaccccaggcagccctgtggccagcaaggagcagaacctgagcagccagagcgacttcctgcaggagcccctgcaggccaccagcagccctgtgacctgcagcagcaatgcctgcctggtgaccacagaccaggccagcagcggcagcgagacagagttcatgaccagcgagaccccagaggccgccatccccccaggcaagcagcccagcagcctggccagccccaacccccccatggccaagggcagcgagcagggcttccagagccccccagccagcagcagctctgtgaccatcaacacagcccccttccaggccatgcagacagtgttcaacgtgaatgcccccctgccccccaggaaggagcaggagatcaaggagagcccctacagccctggctacaaccagagcttcaccacagccagcacccagaccccaccccagtgccagctgcccagcatccacgtggagcagacagtgcacagccaggagacagctgccaactaccacccagatggcaccatccaggtgtccaatggcagcctggccttctacccagcccagaccaacgtgttcccccggcccacccagccctttgtgaacagccggggctctgtgcggggctgcacccggggcggccgcctcatcaccaacagctaccgcagccctgggggctacaagggctttgacacctaccggggcctgcccagcatcagcaatggaaactacagccagctgcagttccaggcccgggagtacagcggggccccctacagccagagggacaacttccagcagtgctacaagagaggaggcaccagcggcggcccccgggccaacagcagagctggctggagcgacagcagccaggtgagcagccctgagcgggacaatgagaccttcaacagcggggacagcggccagggcgacagccgctccatgacccctgtggatgtgcctgtgaccaacccagctgccaccatcctgcctgtgcacgtgtaccccctgccccagcagatgagggtggccttctctgctgcccggaccagcaacctggcccctggcaccctggaccagcccatcgtgtttgacctgctgctgaacaacctgggggagacctttgacctgcagctgggccgcttcaactgccctgtgaatggcacctacgtgttcatcttccacatgctgaagctggccgtgaatgtgcccctgtatgtgaacctgatgaagaatgaggaggtgctggtgtctgcctatgccaatgatggagccccagaccatgaaacagccagcaaccacgccatcctgcagctgttccagggcgaccagatctggctgcggctgcacagaggagccatctacggcagctcctggaagtacagcaccttcagcggctacctgctgtaccaggactag

SEQ ID NO: 18368 - DNA, 2448 bp, Artificial Sequence
  Description of Artificial Sequence: Synthetic coding sequence
atggaggtgcgggccagcctgcagaaggtgtctggcagcagtgacagcgtggccaccatgaacagcgaggagtttgtgctggtgccccagtatgcagatgacaacagcaccaagcatgaggagaagccccagctgaagatcgtgtccaatggagatgagcagctggagaaggccatggaggagatcctgcgggacagcgagaagaggcccagcagcctgctggtggactgccagagcagcagcgagatcagtgaccacagctttggagacatcccagccagccagaccaacaagcccagcctgcagctgatcctggaccccagcaacacagagatcagcaccccccggcccagcagccctgggggcctgcctgaggaggacagcgtgctcttcaacaagctgacctacctgggctgcatgaaggtgagcagccccagaaatgaggtggaggccctgcgggccatggccaccatgaagagcagcagccagtaccccttccctgtgaccctgtatgtgcccaacgtgcctgagggctctgtgcgcatcatcgaccagagcagcaatgtggagatcgccagcttccccatctacaaggtgctcttctgtgcccggggccatgatggcaccacagagagcaactgctttgccttcacagagagcagccacggcagcgaggagttccagatccacgtgttcagctgtgagatcaaggaggccgtgagccgcatcctgtacagcttctgcacagccttcaagaggagcagccggcaggtgtctgatgtgaaggacagcgtcatccccaccccagacagtgatgtgttcaccttctctgtgtccctggaggtgaaggaggatgatggcaagggcaacttcagccctgtgcccaaggaccgggacaagttctacttcaagctgaagcagggcatcgagaagaaggtggtgatcaccgtgcagcagctgagcaacaaggagctggccatcgagcgctgcttcggcatgctgctgagccctggaagaaatgtgaagaacagcgacatgcacctgctggacatggagagcatgggcaagagctatgatggccgggcctacgtgatcaccggcatgtggaaccccaatgcccctgtgttcctggccctgaatgaggagacccccaaggacaagcaggtgtacatgacagtggccgtggacatggtggtgacagaggtggtggagcctgtgcgcttcctgctggagaccgtggtgcgggtgtacccagccaatgaacgcttctggtacttcagcaggaagaccttcacagagaccttcttcatgaggctgaagcagagcgagggcaagggccacaccaatgctggagatgccatctatgaggtggtgtccctgcagcgggagagtgacaaggaggagcctgtgacccccaccagcggcggcggccccatgagcccccaggatgatgaggccgaggaggagagtgacaatgagctgagcagcggcactggagatgtgtccaaggactgcccagagaagatcctgtacagctggggcgagctgctgggcaagtggcacagcaacctgggcgcccggcccaagggcctgagcaccctggtgaagtctggagtgcctgaggccctgcgggcagaggtgtggcagctgctggccggctgccacgacaaccaggccatgctggaccgctaccgcatcctgatcaccaaggacagcgcccaggagagcgtcatcacccgggacatccacaggaccttccctgcccatgactacttcaaggacacaggaggagatggccaggagagcctgtacaagatctgcaaggcctacagcgtgtatgatgaagatattggctactgccagggccagagcttcctggccgctgtgctgctgctgcacatgcctgaggagcaggccttctgtgtgctggtgaagatcatgtatgactatggcctgcgggacctgtacagaaacaactttgaggacctgcactgcaagttctaccagctggagcggctgatgcaggagcagctgcctgacctgcacagccacttcagtgacctgaacctggaggcccacatgtatgccagccagtggttcctgaccctcttcaccgccaagttccccctgtgcatggtgttccacatcatcgacctgctgctgtgtgagggcctgaacatcatcttccacgtggccctggccctgctgaagaccagcaaagaagacctgctgcaggccgactttgagggcgccctgaagttcttccgggtgcagctgcccaagcgctacagagcagaagaaaatgcccggcggctgatggagcaggcctgcaacatcaaggtgcccaccaagaagctgaagaagtatgagaaggagtaccagaccatgagggagagccagctgcagcaggaggaccccatggaccgctacaagtttgtgtacctgtag

SEQ ID NO: 18369 - DNA, 639 bp, Artificial Sequence
  Description of Artificial Sequence: Synthetic coding sequence
atggcccagacagacaagcccacctgcatccccccagagctgcccaagatgctgaaggagtttgccaaggccgccatccgggcccagccccaggacctgatccagtggggcgctgactactttgaggccctgagcagaggagagaccccacctgtgcgggagaggtctgagcgggtggccctgtgcaactgggccgagctgaccccagagctgctgaagatcctgcacagccaggtggccggccgcctcatcatccgggcagaggagctggcccagatgtggaaggtggtgaacctgcccacagacctcttcaacagcgtgatgaatgtgggccgcttcacagaggagattgagtggctgaagttcctggccctggcctgcagcgccctgggcgtgaccatcaccaagaccctgaagatcgtgtgtgaggtgctgagctgtgaccacaacggcggcctgccccgcatccccttcagcaccttccagttcctgtacacctacatcgccgaggtggatggagagatctgtgccagccacgtgtccaggatgctgaactacatcgagcaggaggtgattggaccagatggcctcatcaccgtgaatgacttcacccagaacccccgggtgtggctggagtag

SEQ ID NO: 18370 - DNA, 1938 bp, Artificial Sequence
  Description of Artificial Sequence: Synthetic coding sequence
atggccagcctgctgcaggaccagctgaccacagaccaggacctgctgctgatgcaggagggcatgcccatgaggaaggtgcgcagcaagtcctggaagaagctgcgctacttccggctgcagaatgatggcatgacagtgtggcacgcccggcaggcccggggcagcgccaagcccagcttcagcatcagtgatgtggagaccatcagaaatggacatgattctgagctgctgcggagcctggccgaggagctgcccctggagcagggcttcaccatcgtgttccacggccgccgcagcaacctggacctgatggccaacagcgtggaggaggcccagatctggatgaggggcctgcagctgctggtggacctggtgacctccatggaccaccaggagcggctggaccagtggctgagtgactggttccagagaggagacaagaaccaggacggcaagatgtccttccaggaggtgcagaggctgctgcacctgatgaatgtggagatggaccaggagtatgccttcagcctcttccaggccgctgacaccagccagagcggcaccctggagggggaggagtttgtgcagttctacaaggccctgaccaagagagctgaggtgcaggagctgtttgagagcttcagcgcagatggccagaagctgaccctgctggagttcctggacttcctgcaggaggagcagaaggagcgggactgcaccagcgagctggccctggagctgattgacagatatgagcccagcgacagcggcaagctgcggcacgtgctgtccatggatggcttcctgagctacctgtgcagcaaggatggagacatcttcaacccagcctgcctgcccatctaccaggacatgacccagcccctgaaccactacttcatctgcagcagccacaacacctacctggtgggggaccagctgtgtggccagagctctgtggagggctacatccgggccctgaagaggggctgccgctgtgtggaggtggatgtgtgggatggccccagcggggagcctgtggtgtaccacggccacaccctgaccagccgcatcctcttcaaggatgtggtggccaccgtggcccagtatgccttccagaccagtgactaccctgtgatcctgagcctggagacccactgctcctgggagcagcagcagaccatggcccggcacctgacagagatcctgggggagcagctgctgagcaccaccctggatggagtgctgcccacccagctgcccagccctgaggagctgcggaggaagatcctggtgaagggcaagaagctgaccctggaggaggacctggagtatgaggaggaggaggccgagcctgagctggaggagagcgagctggccctggagagccagtttgaaacagagcctgagccccaggagcagaacctgcagaacaaggacaagaagaagaagagcaagcccatcctgtgcccagccctgagcagcctggtgatctacctgaagtctgtgtccttccgctccttcacccacagcaaggagcactaccacttctatgagatcagcagcttcagcgagaccaaggccaagaggctcatcaaggaggccggaaatgaatttgtgcagcacaacacctggcagctgagccgggtgtaccccagcggcctgaggacagacagcagcaactacaacccccaggagctgtggaatgccggctgccagatggtggccatgaacatgcagacagctggcctggagatggacatctgtgatggccacttccggcagaatggaggctgcggctacgtgctgaagccagacttcctgcgggacatccagagcagcttccaccctgagaagcccatcagccccttcaaggcccagaccctgagcatcccctaccgccacctgcagctgatcttccccatcaacagcgtgtag

SEQ ID NO: 18371 - DNA, 7554 bp, Artificial Sequence
  Description of Artificial Sequence: Synthetic coding sequence
atggtgggggagagacatgctggggacctgatggtgcccctgggcccccggctgcaggcctacccagaggagctgatccggcagaggcctggccatgatggccaccctgagtacctgatccgctggagcgtgctgaagtgtggggaggtgggcaaggtgggcgtggaggagggcaaggccgagcacatcctgatgtggctgagcgcccctgaggtgtatgccaactgccccggcctgctgggggagcgggccctgagcaagggcctgcagcacgagcctgctggggtgtctggcagcttcccccgggaccccggcggcctggatgaggtggccatgggagagatggaggctgatgtgcaggccctggtgcggcgggccgcccggcagctggccgagagcggcacccccagcctgacagctgctgtgctgcacaccatccacgtgctgagcgcctatgccagcatcggccccctgactggagtcttccgggagactggagccctggacctgctgatgcacatgctgtgcaaccctgagccccagatcagaagatctgctgggaagatgctgcaggccctggccgcccatgatgctggcagccgggcccacgtgctgctgagcctgagccagcaggacggcatcgagcagcacatggactttgacagccgctacaccctgctggagctgtttgctgagaccaccagcagcgaggagcactgcatggcctttgagggcatccacctgccccagatccctgggaagctgctcttcagcctggtgaagcgctacctgtgtgtgaccagcctgctggaccagctgaacagcagccctgagctgggcgctggggaccagagcagcccctgtgccacccgggagaagagccggggccagcgggagctggagttctccatggctgtgggcaacctgatcagcgagctggtgcgctccatgggctgggccaggaacctgtctgagcagggcatgagccccccccggcccaccaggagcatcttccagccctacatcagcggccccagcctgctgctgcccaccatcgtgaccaccccccggcggcagggctgggtgttccggcagaggtctgagttcagcagccgcagcggctatggagaatatgtgcagcagaccctgcagcccggcatgagggtgaggatgctggatgattatgaggagatctctgctggagatgaaggagagttccggcagagcaacaacggcatcccccctgtgcaggtgttctggcagagcactggaagaacctactgggtgcactggcacatgctggagatcctgggccctgaggaggccacagaggacaaggccagcgctgctgtggagaagggagctggggccaccgtgctgggcacagccttccccagctgggactggaaccccatggatggcctgtaccccctgccctacctgcagcctgagccccagaagaatgaaagagtgggctacctgacccaggccgagtggtgggagctgctcttcttcatcaagaagctggacctgtgtgagcagcagcccatcttccagaacctgtggaagaacctggatgagaccctgggggagaaggccctgggggagatctctgtgtctgtggagatggccgagagcctgctgcaggtgctgagcagcagatttgagggcagcaccctgaatgacctgctgaacagccagatctacaccaagtatggcctgctgagcaatgagcccagcagcagcagcaccagcaggaaccacagctgcaccccagaccctgaggaggagagcaagtctgaggccagcttcagcgaggaggagacagagagcctgaaggccaaggccgaggcccccaagacagaagctgagcccaccaagaccaggacagagacccccatggcccagagcgacagccagctgttcaaccagctgctggtgacagagggcatgaccctgcccacagagatgaaggaggccgccagcgagatggcccgggccctgcggggccctggccccaggagcagcctggaccagcacgtggccgctgtggtggccaccgtgcagatcagcagcctggacaccaacctgcagctgagcggcctgagcgccctgagccaggccgtggaggaggtgacagagcgggaccaccccctggtgcggccagacaggagcctgcgggagaagctggtgaagatgctggtggagctgctgaccaaccaggtgggggagaagatggtggtggtgcaggccctgcggctgctgtacctgctgatgaccaagcatgagtggaggcccctgtttgcccgggagggcggcatctatgctgtgctggtgtgcatgcaggagtacaagacctctgtgctggtgcagcaggccggcctggccgccctgaagatgctggccgtggccagcagcagcgagatccccacctttgtgacaggccgggacagcatccacagcctgtttgatgcccagatgacccgggagatctttgccagcattgattctgccaccaggcctggcagcgagagcctgctgctgactgtgcctgctgctgtgatcctgatgctgaacacagagggctgcagcagcgctgccagaaatggcctgctgctgctgaacctgctgctgtgcaaccaccacaccctgggggaccagatcatcacccaggagctgcgggacaccctcttccgccacagcggcatcgcccccaggacagagcccatgcccaccaccaggaccatcctgatgatgctgctgaaccgctacagcgagcccccaggcagccctgagcgggccgccctggagacccccatcatccagggccaggacggcagccctgagctgctgatccgcagcctggtgggcggccccagcgctgagctgctgctggacctggagcgggtgctgtgccgggagggcagccctggaggagctgtgcggcccctgctgaagaggctgcagcaggagacccagcccttcctgctgctgctgcggaccctggatgcccctggccccaacaagaccctgctgctgtctgtgctgcgggtcatcacccggctgctggacttccctgaggccatggtgctgccctggcatgaggtgctggagccctgcctgaactgcctgagcggccccagcagtgacagcgagatcgtgcaggagctgacctgcttcctgcaccggctggcctccatgcacaaggactatgctgtggtgctgtgctgcctgggcgccaaggagatcctgagcaaggtgctggacaagcacagcgcccagctgctgctgggctgtgagctgcgggacctggtgacagaatgtgagaagtatgcccagctgtacagcaacctgaccagcagcatcctggccggctgcatccagatggtgctgggccagatcgaggaccacaggaggacccaccagcccatcaacatccccttctttgatgtgttcctgcggcacctgtgccagggcagctctgtggaggtgaaggaggacaagtgctgggagaaggtggaggtgagcagcaacccccaccgggccagcaagctgacagaccacaaccccaagacctactgggagagcaatggcagcacaggcagccactacatcaccctgcacatgcaccggggcgtgctggtgcggcagctgaccctgctggtggccagcgaggacagcagctacatgcctgcccgggtggtggtgtttggaggagacagcaccagctgcattggaacagagctgaacacagtgaatgtgatgcccagcgccagcagggtcatcctgctggagaacctgaaccgcttctggcccatcatccagatccgcatcaagcgctgccagcagggcggcatcgacaccagggtgcggggcgtggaggtgctgggccccaagcccaccttctggcccctcttccgggagcagctgtgcaggaggacctgcctcttctacaccatccgggcccaggcctggagccgggacattgctgaggaccaccggcggctgctgcagctgtgcccccggctgaacagagtgctgcggcatgagcagaactttgctgaccgcttcctgcctgatgatgaagctgcccaggccctgggcaagacctgctgggaggccctggtgagccccctggtgcagaacatcaccagcccagatgctgagggcgtgtctgccctgggctggctgctggaccagtacctggagcagcgggagaccagcaggaaccccctgagcagagctgccagctttgccagccgggtgcggcggctgtgccacctgctggtgcacgtggagcccccacctggccccagccctgagcccagcacccggcccttcagcaagaacagcaagggccgggacaggagccctgcccccagccctgtgctgcccagcagcagcctgaggaacatcacccagtgctggctgtctgtggtgcaggagcaggtgagccgcttcctggccgccgcctggagggccccagactttgtgccccgctactgcaagctgtatgagcacctgcagagagctggcagcgagctgtttggcccccgggccgccttcatgctggccctgcggagcggcttcagcggggccctgctgcagcagagcttcctgacagctgcccacatgtctgagcagtttgcccgctacatcgaccagcagatccagggcggcctcatcggcggggcccctggggtggagatgctgggccagctgcagaggcacctggagcccatcatggtgctgagcggcctggagctggccaccacctttgagcacttctaccagcactacatggctgaccggctgctgagctttggcagctcctggctggagggcgctgtgctggagcagatcggcctgtgcttccccaaccggctgccccagctgatgctgcagagcctgagcaccagcgaggagctgcagaggcagttccacctgttccagctgcagaggctggacaagctgttcctggagcaggaggatgaggaggagaagaggctggaggaggaggaggaggaggaggaggaggaggaggccgagaaggagctgttcatcgaggaccccagccctgccatcagcatcctggtgctgagcccccgctgctggcctgtgagccccctgtgctacctgtaccaccccaggaagtgcctgcccacagagttctgtgatgccctggaccgcttcagcagcttctacagccagagccagaaccaccctgtgctggacatgggcccccaccggcggctgcagtggacctggctgggccgggcagagctgcagtttgggaagcagatcctgcacgtgtccacagtgcagatgtggctgctgctgaagttcaaccagacagaggaggtgtctgtggagaccctgctgaaggacagcgacctgagccctgagctgctgctgcaggccctggtgcccctgaccagcggaaatggccccctgaccctgcacgagggccaggacttcccccacggcggcgtgctgcggctgcacgagcccggcccccagaggtctggagaggccctgtggctgatccccccccaggcctacctgaatgtggagaaggatgagggccgcaccctggagcagaagaggaacctgctgagctgcctgctggtgcgcatcctgaaggcccatggagagaagggcctgcacatcgaccagctggtgtgcctggtgctggaggcctggcagaagggccccaaccccccaggcaccctgggccacacagtggccggcggcgtggcctgcaccagcacagatgtgctgagctgcatcctgcacctgctgggccagggctacgtgaagagaagagatgaccggccccagatcctgatgtatgctgcccctgagcccatgggcccctgccggggccaggctgatgtgcccttctgtggcagccagagcgagaccagcaagcccagccctgaggccgtggccaccctggccagcctgcagctgcctgctggccgcaccatgagcccccaggaggtggagggcctgatgaagcagacagtgcggcaggtgcaggagaccctgaacctggagccagatgtggcccagcacctgctggcccacagccactggggcgctgagcagctgctgcagagctacagcgaggaccctgagcccctgctgctggccgccggcctgtgtgtgcaccaggcccaggccgtgcctgtgcggccagaccactgccctgtgtgtgtgagccccctgggctgtgatgatgacctgcccagcctgtgctgcatgcactactgctgcaagagctgctggaatgagtacctgaccaccagaattgagcagaacctggtgctgaactgcacctgccccatcgctgactgcccagcccagcccactggagccttcatccgggccatcgtgagcagccctgaggtgatcagcaaatatgagaaggccctgctgcggggctacgtggagagctgcagcaacctgacctggtgcaccaacccccagggctgtgaccgcatcctgtgccggcagggcctgggctgcggcaccacctgcagcaaatgtggctgggccagctgcttcaactgcagcttccctgaggcccactacccagccagctgtggccacatgagccagtgggtggatgatggcggctactatgatggcatgtctgtggaggcccagagcaagcacctggccaagctgatcagcaagcgctgccccagctgccaggcccccatcgagaagaatgaaggctgcctgcacatgacctgtgccaagtgcaaccacggcttctgctggcgctgcctgaagtcctggaagcccaaccacaaggactactacaactgcagcgccatggtgtccaaggccgcccggcaggagaagcgcttccaggactacaatgaacgctgcaccttccaccaccaggcccgggagtttgctgtgaacctgaggaacagagtgtctgccatccacgaggtgcccccacccaggagcttcaccttcctgaatgatgcctgccagggcctggagcaggccaggaaggtgctggcctatgcctgtgtgtacagcttctacagccaggatgctgagtacatggatgtggtggagcagcagacagagaacctggagctgcacaccaatgccctgcagatcctgctggaggagaccctgctgcgctgccgggacctggccagcagcctgcggctgctgcgggctgactgcctgagcacaggcatggagctgctgcggcgcatccaggagcggctgctggccatcctgcagcacagcgcccaggacttccgggtgggcctgcagagccccagcgtggaggcctgggaggccaagggccccaacatgcctggcagccagccccaggccagcagcggccctgaggccgaggaggaggaggaggatgatgaagatgatgtgcctgagtggcagcaggatgaatttgatgaggagctggacaatgacagcttctcctatgatgaaagtgagaacctggaccaggagaccttcttctttggagatgaggaggaggatgaagatgaggcctatgactag

SEQ ID NO: 18372 - DNA, 1476 bp, Artificial Sequence
  Description of Artificial Sequence: Synthetic coding sequence
atggaggagatcccagcccaggaggccgccggcagcccccgggtgcagttccagagcctggagacccagagtgaatgtctgagccctgagccccagtttgtgcaggacacagacatggagcagggcctgactggagatggagagacccgggaggagaacaagctgctgatccccaagcagaagatcagcgaggaggtgcacagctacaaggtgcgggtgggccgcctgaagcatgacatcacccaggtgcctgagacccgggaggtgtacaagtcagaagatcggctggagcggctgcaggagatcctgaggaagttcctgtacctggagcgggagttccggcagatcaccatcagcaaggagaccttcaccagcgagaagaacaatgaatgccacgagcctgagaagagcttcagcctggacagcaccattgatgctgaccagagggtgctgcgcatccagaacacagatgacaatgacaagtatgacatgtccttcaaccagaacagcgccagcggcaagcatgagcacctgaacctgacagaggacttccagagcagcgagtgcaaggagagcctgatggacctgagccacctgaacaagtgggagagcatccccaacacagagaagagctacaagtgtgatgtgtgtgggaagatcttccaccagagcagcgccctgaccaggcaccagaggatccacacccgggagaagccctacaagtgcaaggaatgtgagaagagcttcagccagagcagcagcctgagccgccacaagaggatccacacccgggagaagccctacaagtgtgaggccagtgacaagagctgtgaggccagtgacaagagctgcagccccagcagcggcatcatccagcacaagaagatccacacccgggccaagagctacaagtgcagcagctgtgagagggtcttcagccgctctgtgcacctgacccagcaccagaagatccacaaggagatgccctgcaagtgcaccgtgtgtggcagtgacttctgccacaccagctacctgctggagcaccagagggtgcaccacgaggagaaggcctatgaatatgatgaatatggcctggcctacatcaagcagcagggcatccacttccgggagaagccctacacctgcagtgaatgtgggaaggacttccggctgaacagccacctgatccagcaccagaggatccacactggagagaaggcccatgaatgtaatgaatgtgggaaggccttcagccagaccagctgcctgatccagcaccacaagatgcacaggaaggagaagagctatgaatgtaatgaatatgagggcagcttcagccacagcagtgacctgatcctgcagcaggaggtgctgacccggcagaaggcctttgactgtgatgtgtgggagaagaacagcagccagagggcccacctggtgcagcaccagagcatccacaccaaggagaacagctag

SEQ ID NO: 18373 - DNA, 2709 bp, Artificial Sequence
  Description of Artificial Sequence: Synthetic coding sequence
atgtctgagttccgcatccaccatgatgtgaatgagctgctgagcctgctgcgggtgcacggcggagatggagctgaggtgtacatcgacctgctgcagaagaacagaacaccctacgtgaccaccaccgtgtctgcccacagcgccaaggtgaagattgctgagttcagcaggaccccagaggacttcctgaagaagtatgatgagctgaagagcaagaacaccaggaacctggaccccctggtgtacctgctgagcaagctgacagaggacaaggagaccctgcagtacctgcagcagaatgccaaggagcgggcagagctggccgctgctgctgtgggcagcagcaccaccagcatcaacgtgcctgctgctgccagcaagatctccatgcaggagctggaggagctgaggaagcagctgggctctgtggccaccggcagcaccctgcagcagagcctggagctgaagaggaagatgctgcgggacaagcagaacaagaagaacagcggccagcacctgcccatcttccctgcctgggtgtatgaaagacctgccctgattggagacttcctgattggagctggcatcagcacagacacagccctgcccatcggcaccctgcccctggccagccaggagagcgctgtggtggaggacctgctgtatgtgctggtgggcgtggatggccgctacgtgtctgcccagcccctggccggccggcagagcaggaccttcctggtggaccccaacctggacctgagcatccgggagctggtgcaccgcatcctgcctgtggccgccagctacagcgctgtgacccgcttcatcgaggagaagagcagctttgaatatggccaggtgaaccacgccctggccgccgccatgaggaccctggtgaaggagcacctgatcctggtgtcccagctggagcagctgcaccggcagggcctgctgagcctgcagaagctgtggttctacatccagcctgccatgaggaccatggacatcctggccagcctggccacctctgtggacaagggagaatgtctgggcggcagcaccctgagcctgctgcatgaccgctccttctcctacacaggagacagccaggcccaggagctgtgcctgtacctgaccaaggccgccagcgccccctactttgaggtgctggagaagtggatctaccggggcatcatccatgacccctacagcgagttcatggtggaggagcacgagctgaggaaggagcgcatccaggaggactacaatgacaagtactgggaccagcgctacaccatcgtgcagcagcagatccccagcttcctgcagaagatggctgacaagatcctgagcacaggcaagtacctgaatgtggtgcgggagtgtggccatgatgtgacctgccctgtggccaaggagatcatctacaccctgaaggagcgggcctacgtggagcagatcgagaaggccttcaactatgccagcaaggtgctgctggacttcctgatggaggagaaggagctggtggcccacctgcggagcatcaagcgctacttcctgatggaccagggcgacttctttgtgcacttcatggacctggccgaggaggagctgaggaagcctgtggaggacatcaccccaccccggctggaggccctgctggagctggccctgaggatgagcacagccaacacagaccccttcaaggatgacctgaagattgacctgatgcctcatgacctgatcacccagctgctgcgggtgctggccatcgagaccaagcaggagaaggccatggcccatgctgaccccacagagctggccctgagcggcctggaggccttctcctttgactacatcgtgaagtggcccctgagcctcatcatcaacaggaaggccctgacccgctaccagatgctgttccgccacatgttctactgcaagcacgtggagcggcagctgtgcagcgtgtggatcagcaacaagacagccaagcagcacagcctgcacagcgcccagtggtttgctggggccttcaccctgcggcagaggatgctgaactttgtgcagaacatccagtactacatgatgtttgaggtgatggagcccacctggcacatcctggagaagaacctgaagagcgccagcaacattgatgatgtgctgggccaccacacaggcttcctggacacctgcctgaaggactgcatgctgaccaaccctgagctgctgaaggtgttcagcaagctgatgtctgtgtgtgtgatgttcaccaactgcatgcagaagttcacccagagcatgaagctggatggagagctgggcggccagaccctggagcacagcacagtgctgggcctgcctgctggagctgaggagcgggccaggaaggagctggccaggaagcacctggccgagcacgccgacacagtgcagctggtgtctggctttgaggccaccatcaacaagtttgacaagaacttcagcgcccacctgctggacctgctggcccggctgagcatctacagcaccagtgactgtgagcacggcatggccagcgtcatcagccggctggacttcaacggcttctacacagagcggctggagcggctgtctgctgagaggagccagaaggccaccccccaggtgcctgtgctgcggggccccccagccccagccccccgggtggccgtgacagcccagtag

SEQ ID NO: 18374 - DNA, 2289 bp, Artificial Sequence
  Description of Artificial Sequence: Synthetic coding sequence
atggccatgcaggagaagtaccccacagagggcatcagccacgtgaccagccccagcagtgatgtgatccagaagggcagcagcctgggcacagagtggcagacccctgtgatcagcgagcccttccgcagccgcttcagccgctgcagctctgtggccgacagcggggacacagccatcggcaccagctgcagcgacattgctgaggacttctgcagcagcagcggcagcccccccttccagcccatcaagagccacgtgaccatccccacagcccacgtgatgcccagcaccctgggcaccagccctgccaagcccaacagcacccctgtgggccccagcagcagcaagctgcccctgagcggcctggccgagagcgtgggcatgaccagaaatggagacctgggcgccatgaagcacagccctggcctgagccgggacctgatgtacttcagcggggccactggagaaaatggcatcgagcagagctggttccctgctgtgggccacgagcggcaggaggaggccaggaagtttgacatccccagcatggagagcaccctgaaccagagcgccatgatggagaccctgtacagcgacccccaccaccgggtgcgcttccacaaccccaggaccagcaccagcaaggagctgtacagagtgctgcctgaggccaagaaggcccctggcagcggggctgtgtttgaaagaaatggcccccacagcaacagcagtggagtgctgcccctgggcctgcagcctgcccctggcctgagcaagcccctgcccagccaggtgtggcagcccagcccagacacctggcacccccgggagcagagctgtgagctgagcacctgccggcagcagctggagctgatccggctgcagatggagcagatgcagctgcagaatggagccatctgccaccaccctgctgccttcggccccagcctgcccatcctggagcccgcccagtggatcagcatcctgaacagcaatgagcacctgctgaaggagaaggagctgctgattgacaagcagaggaagcacatcagccagctggagcagaaggtgcgggagagcgagctgcaggtgcacagcgccctgctgggccgcccagccccctttggagatgtgtgcctgctgcggctgcaggagctgcagcgggagaacaccttcctgcgggcccagtttgcccagaagacagaggccctgagccgggagaagattgacctggagaagaagctgagcgccagcgaggtggaggtgcagctgatccgggagagcctgaaggtggccctgcagaagcacagcgaggaggtgaagaagcaggaggagcgggtgaagggccgggacaagcacatcaacaacctgaagaagaagtgccagaaggagagcgagcagaaccgggagaagcagcagagaattgagaccctggagcgctacctggccgacctgcccaccctggaggaccaccagaagcagagccagcagctgaaggacagcgagctgaagagcacagagctgcaggagaaggtgacagagctggagagcctgctggaggagacccaggccatctgccgggagaaggagatccagctggagagcctgcggcagcgggaggccgagttcagcagcgctggccacagcctgcaggacaagcagagcgtggaggagaccagcggggagggccctgaggtggagatggagagctggcagaagagatatgacagcctgcagaagatcgtggagaagcagcagcagaagatggaccagctgcggagccaggtgcagagcctggagcaggaggtggcccaggaggagggcaccagccaggccctgcgggaggaggcccagaggcgggacagcgccctgcagcagctgaggacagctgtgaaggagctgtctgtgcagaaccaggacctgattgagaagaacctgaccctgcaggagcacctgcggcaggcccagcccggcagcccccccagcccagacacagcccagctggccctggagctgcaccaggagctggccagctgcctgcaggacctgcaggccgtgtgcagcatcgtgacccagagggcccagggccatgaccccaacctgagcctgctgctgggcatccacagcgcccagcaccctgagacccagctggacctgcagaagccagatgtgatcaagaggaagctggaggaggtgcagcagctgcggcgggacatcgaggacctgcggaccaccatgtctgacagatatgcccaggacatgggagagaactgtgtgacccagtag

SEQ ID NO: 18375 - DNA, 1443 bp, Artificial Sequence
  Description of Artificial Sequence: Synthetic coding sequence
atgattgtggccgacagtgaatgtagagctgagctgaaggactacctgcgctttgcccctgggggcgtgggggacagcggccctggagaggagcagcgggagagccgggcccggcggggcccccggggccccagcgccttcatccctgtggaggaggtgctgcgggagggcgctgagagcctggagcagcacctgggcctggaggccctgatgagcagcggccgggtggacaacctggccgtggtgatgggcctgcacccagactacttcaccagcttctggaggctgcactacctgctgctgcacacagatggccccctggccagctcctggaggcactacatcgccatcatggccgccgcccggcaccagtgcagctacctggtgggcagccacatggccgagttcctgcagacaggaggagaccctgagtggctgctgggcctgcaccgggcccctgagaagctgaggaagctgtctgagatcaacaagctgctggcccaccggccctggctgatcaccaaggagcacatccaggccctgctgaagacaggagagcacacctggagcctggccgagctgatccaggccctggtgctgctgacccactgccacagcctgagcagctttgtgtttggctgcggcatcctgcctgaaggagatgctgatggcagccctgccccccaggcccccaccccaccttctgagcagagcagcccccccagccgggaccccctgaacaacagcggcggctttgagagcgccagagatgtggaggccctgatggagaggatgcagcagctgcaggagagcctgctgagagatgagggcaccagccaggaggagatggagagcagatttgagctggagaagtctgagagcctgctggtgacccccagcgctgacatcctggagcccagcccccacccagacatgctgtgctttgtggaggaccccaccttcggctatgaggacttcacccggcggggggcccaggccccacccaccttccgggcccaggactacacctgggaggaccacggctacagcctcatccagaggctgtacccagagggcggccagctgctggatgagaagttccaggccgcctacagcctgacctacaacaccatcgccatgcacagcggcgtggacacctctgtgctgcggcgggccatctggaactacatccactgtgtgtttggcatccgctatgatgattatgactatggagaggtgaaccagctgctggagaggaacctgaaggtgtacatcaagacagtggcctgctacccagagaagaccaccaggaggatgtacaacctcttctggaggcacttccgccacagcgagaaggtgcacgtgaacctgctgctgctggaggccaggatgcaggccgccctgctgtatgccctgcgggccatcacccgctacatgacctag

SEQ ID NO: 18376 - DNA, 633 bp, Artificial Sequence
  Description of Artificial Sequence: Synthetic coding sequence
atgcctggggtgaagctgaccacccaggcctactgcaagatggtgctgcatggagccaagtacccccactgtgctgtgaatggcctgctggtggccgagaagcagaagcccaggaaggagcacctgcccctgggcggccctggggcccaccacaccctgtttgtggactgcatccccctcttccacggcaccctggccctggcccccatgctggaggtggccctgaccctgattgacagctggtgcaaggaccacagctatgtgattgctggctactaccaggccaatgaaagagtgaaggatgccagccccaaccaggtggccgagaaggtggccagcagaattgctgagggcttcagtgacacagccctgatcatggtggacaacaccaagttcaccatggactgtgtggcccccaccatccacgtgtatgagcaccacgagaaccgctggcgctgccgggacccccaccacgactactgtgaggactggccagaggcccagaggatcagcgccagcctgctggacagccgctcctatgagaccctggtggactttgacaaccacctggatgacatcagaaatgactggaccaaccctgagatcaacaaggctgtgctgcacctgtgctag

SEQ ID NO: 18377 - DNA, 1059 bp, Artificial Sequence
  Description of Artificial Sequence: Synthetic coding sequence
atgacagaggccggcaagctgcccctgcccctgcccccccggctggactggtttgtgcacacccagatgggccagctggcccaggatggagtgcctgagtggttccacggggccatcagccgggaggatgctgagaacctgctggagagccagcccctgggcagcttcctgatccgggtgagccacagccacgtgggctacaccctgagctacaaggcccagagcagctgctgccacttcatggtgaagctgctggatgatggcaccttcatgatccctggagagaaggtggcccacaccagcctggatgccctggtgaccttccaccagcagaagcccatcgagccccggcgggagctgctgacccagccctgccggcagaaggaccctgccaacgtggactatgaggacctcttcctgtacagcaatgctgtggccgaggaggccgcctgccctgtgtctgcccctgaggaggccagccccaagcctgtgctgtgccaccagagcaaggagaggaagcccagcgctgagatgaaccgcatcaccaccaaggaggccaccagcagctgcccccccaagagccccctgggggagacccggcagaagctgtggaggagcctgaagatgctgcctgagcggggccagagggtgcggcagcagctgaagagccacctggccaccgtgaacctgagcagcctgctggatgtgagaagaagcaccgtcatcagcggccctggcaccgggaagggcagccaggaccacagcggggaccccaccagcggggaccggggctacacagacccctgtgtggccaccagcctgaagagccccagccagccccaggcccccaaggacaggaaggtgcccaccaggaaggccgagaggtctgtgtcctgcatcgaggtgacccctggggaccgctcctggcaccagatggtggtgcgggccctgagcagccaggagagcaagccagagcaccagggcctggccgagccagaaaatgaccagctgcctgaggagtaccagcagcccccaccatttgcccctggctactgctag

SEQ ID NO: 18378 - DNA, 480 bp, Artificial Sequence
  Description of Artificial Sequence: Synthetic coding sequence
atgacccactgctgcagcccctgctgccagcccacctgctgcaggaccacctgctggaagcccaccaccgtgaccacctgcagcagcaccccctgctgccagcccagctgctgcgtgagcagctgctgccagccctgctgccggcccacctgctgccagaacacctgctgccagcccatctgtgtgaccagctgctgccagcccagctgctgcagcaccccctgctgccagcccacctgctgcggccagaccagctgtggcagcagctgtggccagagcagcagctgtgcccctgtgtactgcaggaggacctgctaccaccccaccaccgtgtgcctgcccggctgcctgaaccagagctgtggcagcaactgctgccagccctgctgcaggcctgcctgctgtgagaccacctgctgcaggaccacctgcttccagcccacctgtgtgagcagctgctgccagcccagctgctgctag

SEQ ID NO: 18379 - DNA, 615 bp, Artificial Sequence
  Description of Artificial Sequence: Synthetic coding sequence
atggaccccaaggacaggaagaagatccagttctctgtgcctgccccacccagccagctggacccccggcaggtggagatgatcagaagaagaagacccaccccagccatgctgttccggctgtctgagcacagcagccctgaggaggaggccagcccccaccagagggccagcggggagggccaccacctgaagagcaagaggcccaacccctgtgcctacaccccacccagcctgaaggctgtgcagagaattgctgagagccacctgcagagcatcagcaacctgaatgaaaaccaggccagcgaggaggaggatgagctgggggagctgcgggagctgggctacccccgggaggaggatgaggaggaggaggaggatgatgaggaggaggaggaggaggaggacagccaggccgaggtgctgaaggtgatccggcagagcgctggccagaagaccacctgtggccagggcctggagggcccctgggagcggcccccacccctggatgagagcgagagagatggcggcagcgaggaccaggtggaggaccctgccctgtctgagcccggggaggagccccagaggcccagccccagcgagcccggcacctag

SEQ ID NO: 18380 - DNA, 2061 bp, Artificial Sequence
  Description of Artificial Sequence: Synthetic coding sequence
atgacagatgccctgctgcctgctgccccccagcccctggagaaggaaaatgatggctacttcaggaagggctgcaaccccctggcccagacaggccgcagcaagctgcagaaccagagagctgccctgaaccagcagatcctgaaggctgtgaggatgaggactggagctgagaacctgctgaaggtggccaccaacagcaaggtgcgggagcaggtgcggctggagctgagctttgtgaacagcgacctgcagatgctgaaggaggagctggagggcctgaacatctctgtgggcgtgtaccagaacacagaggaggccttcaccatccccctcatccccctgggcctgaaggagaccaaggatgtggactttgctgtggtgctgaaggacttcatcctggagcactacagtgaagatggctacctgtatgaagatgaaattgctgacctgatggacctgcggcaggcctgcaggacccccagcagagatgaggccggcgtggagctgctgatgacctacttcatccagctgggctttgtggagagccgcttcttcccccccacccggcagatgggcctgctcttcacctggtatgacagcctgactggagtgcctgtgtcccagcagaacctgctgctggagaaggcctctgtgctcttcaacacaggagccctgtacacccagatcggcacccgctgtgaccggcagacccaggccggcctggagagcgccattgatgccttccagagagctgctggggtgctgaactacctgaaggacaccttcacccacacccccagctatgacatgagccctgccatgctgtctgtgctggtgaagatgatgctggcccaggcccaggagagcgtgtttgagaagatcagcctgcccggcatcagaaatgagttcttcatgctggtgaaggtggcccaggaggccgccaaggtgggggaggtgtaccagcagctgcacgccgccatgagccaggcccctgtgaaggagaacatcccctacagctgggccagcctggcctgtgtgaaggcccaccactatgctgccctggcccactacttcaccgccatcctgctgattgaccaccaggtgaagccaggcacagacctggaccaccaggagaagtgcctgagccagctgtatgaccacatgcctgagggcctgacccccctggccaccctgaagaatgaccagcagaggcggcagctgggcaagagccacctgcggcgggccatggcccaccacgaggagagcgtgcgggaggccagcctgtgcaagaagctgcggagcattgaggtgctgcagaaggtgctgtgtgccgcccaggagaggagccggctgacctacgcccagcaccaggaggaggatgacctgctgaacctgattgatgcccccagcgtggtggccaagacagagcaggaggtggacatcatcctgccccagttcagcaagctgactgtgacagacttcttccagaagctgggccccctgtctgtgttcagcgccaacaagcgctggaccccacccaggagcatccgcttcaccgctgaggagggggacctgggcttcaccctgcggggaaatgcccctgtgcaggtgcacttcctggacccctactgcagcgcctctgtggccggggcccgggagggggactacatcgtgtccatccagctggtggactgcaagtggctgaccctgtctgaggtgatgaagctgctgaagagctttggagaagatgaaattgagatgaaggtggtgtccctgctggacagcaccagctccatgcacaacaagagcgccacctacagcgtgggcatgcagaagacctacagcatgatctgcctggccattgatgatgatgacaagacagacaagaccaagaagatcagcaagaagctgtccttcctgtcctggggcaccaacaagaaccggcagaagagcgccagcaccctgtgcctgcccagcgtgggcgccgcccggccccaggtgaagaagaagctgcccagccccttcagcctgctgaacagcgacagctcctggtactag

SEQ ID NO: 18381 - DNA, 1254 bp, Artificial Sequence
  Description of Artificial Sequence: Synthetic coding sequence
atgcccctgtatgagggcctgggcagcggcggggagaagacagctgtggtgattgacctgggggaggccttcaccaagtgtggctttgctggggagaccggcccccgctgcatcatccccagcgtcatcaagagagctggcatgcccaagcctgtgcgggtggtgcagtacaacatcaacacagaggagctgtacagctacctgaaggagttcatccacatcctgtacttccgccacctgctggtgaacccccgggacagaagagtggtgatcatcgagagcgtgctgtgccccagccacttccgggagaccctgaccagggtgctcttcaagtactttgaggtgcccagcgtgctgctggcccccagccacctgatggccctgctgaccctgggcatcaacagcgccatggtgctggactgtggctaccgggagagcctggtgctgcccatctatgagggcatccctgtgctgaactgctggggcgccctgcccctgggcggcaaggccctgcacaaggagctggagacccagctgctggagcagtgcaccgtggacacctctgtggccaaggagcagagcctgcccagcgtgatgggctctgtgcctgagggcgtgctggaggacatcaaggcccggacctgctttgtgtctgacctgaagaggggcctgaagatccaggccgccaagttcaacattgatggcaacaatgaaagacccagccccccaccaaatgtggactaccccctggatggagagaagatcctgcacatcctgggcagcatccgggacagcgtggtggagatcctgtttgagcaggacaatgaggagcagagcgtggccaccctcatcctggacagcctcatccagtgccccatcgacaccaggaagcagctggccgagaacctggtggtgattggaggcacctccatgctgcccggcttcctgcaccggctgctggccgagatccgctacctggtggagaagcccaagtacaagaaggccctgggcaccaagaccttccgcatccacaccccaccagccaaggccaactgtgtggcctggctgggcggggccatctttggagccctgcaggacatcctgggcagccgctctgtgtccaaggagtactacaaccagacaggccgcatcccagactggtgcagcctgaacaacccccccctggagatgatgtttgatgtgggcaagacccagccccccctgatgaagagggccttcagcacagagaagtag

SEQ ID NO: 18382 - DNA, 2643 bp, Artificial Sequence
  Description of Artificial Sequence: Synthetic coding sequence
atgagccagcctgctgggggccgcaggaagcccaggaccctgggcccccctgtgtgcagcatccggcccttcaagagcagcgagcagtacctggaggccatgaaggaggacctggccgagtggctgcgggacctgtatggcctggacattgatgctgccaacttcctgcaggtgctggagaccggcctggtgctgtgccagcacgccaacgtggtgacagatgctgccctggccttcctggccgaggccccagcccaggcccagaagatccccatgccccgggtgggcgtgtcctgcaatggagctgcccagcccggcaccttccaggcccgggacaacgtgagcaacttcatccagtggtgcaggaaggagatgggcatccaggaggtgctgatgtttgaaacagaggacctggtgctgaggaagaatgtgaagaatgtggtgctgtgcctgctggagctgggccggcgggcctggaggtttggagtggccgcccccaccctggtgcagctggaggaggagattgaggaggaggtgcggcgggagctggccctgcccccaccagaccccagccccccagccccaccccggcggcagccctgccacttcaggaacctggaccagatggtgcagagcctggtgagccactgcacctgccctgtgcagttctccatggtgaaggtgtctgagggcaagtacagagtgggggacagcaacaccctcatcttcatccgcatcctgaggaaccacgtgatggtgcgggtgggcggcggctgggacaccctgggccactacctggacaagcatgacccctgccgctgcaccagcctgagccacaagccaggcagcttcctgaagcccccagcccctcctgtgcagcacgaggtgcgggtgcaggacggccccagccagacccagcccaccatgaccatcagccgcagccagagccccccacctcctgtggactggaagacctacaccagcagtgaccggcggctgcggccccccacccccagcagcccccggccccggcgggagagaggagctggcactggagccagccgggagatggcccccttcctgcgctgccaggagaggagcctcatccccagctggaggcagcccacagctggggacagcccccccagcccccagagcagcagcacccagaagggccgggacccccagtgcaccagcagcggcaagcgggaggagcgctacccacctgagctgccccggggccgcatccccacctcctgggtgcatgaggagacagacagctggggcacagatgctggcaaccccaccccccagaggctgcgggccatcgaggccaccaccaagggcatcagcgcccggggccccagccccctgcccaggagctttggacctgctgagtgcctgggcctgcggctgcccctgagagatgaggccaagggggccttcttccagttccgggagcctgagagcgtgcgcagccccacccctgtgcagggcctgaccaagatccccatccggctgcccccagcccggccccccaccccaggccgctccttccctggggccaccagcggcagccccaggacagagctgggccgggaccccatccccctgcgggctgtgacagtggacctggccggcagcacccacggggactgcagcgtggaggtgcggcaggaggaccagcagctggacatccaggtgatggccgaggcccgggagagctgggacctgggcctgcaggagcaggagggccgctacacccccctgcccctgggcggcaacaaggagcaggccatctactgcagcctggaggaggagatcctgggcaacatgaagctgctggaggtgcgcagcgcctgcccccagggcaccaggtctggagtcatccccaggtctggagtgtacatcccccggctggccggccagtggccagagcccggcggcccctatgacaaggccatccaggagctggcccagggcagccccagcctgctgaaggtggacctggaggcctggaaggccgcccccaccggcagccccaagccagctgtgaccccaggccctggcagcctgaagggcaagctgggcgcccggcagagcggccccaggaccaaggccagcctgagcgccaagggcacccacatgaggaaggtgcccccccagggcggccaggactgcagcgccagcacagtgtctgccagccctgaggcccccacccccagccccctggaccccaacagcgacaaggccaaggcctgcctgagcaaaggaagaaggaccctgaggaagcccaagagggtgcccagcatctacaagctgaagctgcggccccgcatccggccccggcgggaccacaggcctgagaagcagcccagccgcatcccccggcccctggcctacgtgttcctgggccctgcccggcagccccccaaggaccggctgctgcgggctgtgctgggcagcaaaggaggagaggccagccgggtggatggagcctctgtgggggaggaggaggaggagggcaaggaggagaaggagcctgctgcccccctggagagcagcccccagcccccagagggcctgcagccccactggctgaaccaggcccccctgcccccagaggaggagagctgggtgtag

SEQ ID NO: 18383 - DNA, 14262 bp, Artificial Sequence
  Description of Artificial Sequence: Synthetic coding sequence
atggtgcctgaggagcggcgggtgggcctgagcagtgatgagaccagcagtgacagcctgaagtcctggcacagcatctgtgtgctggacagcaaggagcagcccctggcctgccagcagaagcagaggcagtttgtgaagcctgtgacagagagcgagcagcccaccgtgctggagctgctgctggccgagctgcggaccctcttctctgctgtgctgcaggacagcagccctgctgcctggagatacctgcatgctgtgctgggcctgctgcccccctaccgggagctgctggtgggccacctggacctgctgcccttcctggagcagctgtactgctgggccccctgggtgcagacccacctgcacctggacctgctgggcgccatcgtgcaggccttccccccagacagcagcctgctggacagcgccagccatgctgactgctgcccccagaagaggcggctgcaccaccggcccccctgcccagcctgcccctttgtgcaggcccagtggagccggcagcaggtgaaggaggagctggccacctggctgcggcccctgaccctgcctgagctgcagcgctgcctgggcatcgtgggcgcccaggtggccctggaggaggccgtgtggctggatggcctgagcctgctgcccctggccctggccgctgacatccctgtgcgctatgagagcagtgacacagacaatgctgaggtggagcctgtgggcaggaaggagaccaggagccagctggactatgaggtgccccgggagaaggccttccagaagagcagcacaggcttcagccctgagaccagcttcctggacagccaggtgatgacagccctgaagatggagcgctacctgaagaagatccacttcctgtacctgaatgtggcccccagccgctacttccggccctacagcctgatggtggtgcccccagacaaggtgaaccctgagcactacatcttcagccccttcggcatcctgcacgtgcaccctgtggagggcagcgagaccatgaccctgggcacctggcaccaccactgtgtgctgtggcagcagctgcagttcatccccttcttcaagtactgcctgctgaggaagagcttcacctgctggaagaagaatgtgcggctgcagggcctgcaccggctgcagaagttcctggagaaccacctgctgctggccgtgccccactttggagctggcctgctgcacatcagccggctgctgcaggagctgcacagcgtgtcctggctgccccaggagctggaccgctgctatgagctgctggacctgcagacagccctggccgaggagaagcacaaggccctgcggctgctgcaccgctgcctgaacctgtgcaccagcatcctgcggctggtgcatgaggacacctaccacatgcagcagtgcctgcaggagcgggtgcagaactgtgaccgcatcagaacaggccagggcagcatctacctgcagagggtgcagcacaagcagctggagcagaagctgaagcaggccgaggcctggtggctgcagctgggcaagtttgcccggctggtggactacatgatctgccagagcctcatctctgtgctggaggagcagatcaccagctttgtggccaacatcctgcaggccccccggcagaagcccttcctgagcagccagctggtgtttgatgaccacggccagctgagccacgtgccctgtgtggagaacatgatccagaccctgactggaggcctgcagagcgtgaagaccagcgccctgcaggtggtgcagagcgctgacctgaagaccagcagtgacagcctgtacagcgaggaggaggatgaggaggaggacagcaaggatgagttcctgatgcccaagttccagggccagcccagtgatgctgtgtccatcttctgtggccccaacgtgggcctggtgtggccctggaagagccaccccatcgccggcatcctggaggtgcggggctgccgcctgcggggccagtacttcccccacaactacaagcagctggaggaggacctggacaacaaccccaagatccagcaggccctgaacatccagcaggtgctgctggagggcgtgctgtgcaaggtgcaggagttctgccgggagcaccactggatcaccggcatctatgagttcctgcagagctggggcccccagaagctggaggacatgagaggaggccccatcaagaactacgtgaccctggtgtcccggctgaatgtgtggcaggcccgggtgtcctccatgcccatcgagctgctgaccaagggcggcctgctgctgctgagctgccatgatgtgcaggccgagatggagagcaagctgaacagcatcaggaaggacatcctggcccacgtgcagaatgaatgctggaacctgagccagcagctgatgacagagctgacagacttcatgcacatcttccgcaccatcaacagcgacatccacgccatcgcccagtgcacccagaagctgaatgaggccaatgagcagtatgtggagctggaggagaggatggagtatgtgcgggccctgcacgagctgatccggaaccacttcagcctcttcagcgcagaaaatgaggccctggacatctctgtgcggcggcagtttggagagagccccatccccccctgccccccaccaccccagccccacctgctgcactgccccctgctggccccccagctgctggacatgtgggaggccttccagtttgagaagagccaggccagcgagttcctgctgagcaagagacatgccatcatgcccaagctgcagcagctgatggctgctgccctggccgagctggagggcctgctggccaaggccctgagcggccccttcatggaccccacccaggaccagaggagcacagagcaccagctggtgtccctggagcggcagttccagaacacagtgtctgacctgtctgagctgcaccacgcctatgccatcttcacagaagatgagacccctgtgcccctgcccatctgtggcacccggcccatcgtgcagcagcagaggatctggcacctgtacagagtcatcagcgagaacatcagcgagtggaagtgcatggcctttgccaagttctccccagccatggcccaggagaagacagagggctggctgacagaagctgccaggatgagcaccaccctggagctgcacagccctgtgctgcagcactgcatgaggatcctgggggagttccgcagctacctgcccctgctgaccaagctgggcagcctgcacccccagagcctgaactgccagtgcctgctgcgggccctgggcctgggcagcctgcagaccatcgagctgctgaccctgggccagctgctgacctaccccctgctggagtttgctgaccgcatcaaccaggtgtggcagaatgaaaatgaaagaatccacgcccaggagaccatccggcggctgcagcgctactgggaggcccggcagctgcggctgctgaacttcatcctgcacgtgccctatgagcccccagccagcgagaggagcaagaggcaggtgctgcggagcccccagtgggaggtggtggacaaggacagcggcaccttcatcctgagtgactacagcaacctgcaggacagcatccaggagagcctgcaggtgctgagcaagatcctggccatcgagaagagcggggacctgaacaagatcgccctggagtgggtggccatcatgcacggcctgggcgccctgctggaggtgtggctgaccttccagcagaagtggatcttcctgaacaaggtgctgcacgagatgaagatccagttccccaatgctgacctgaacagccgcttcaaggtgatggatgaccagtaccgcaccctgatgaggatctctgtggccgaccccatggtgctgagcctggtggtgcccagcgctgagaggagcccctacttccagggccagcagctgcagcagctgctgcaggccggctctgtggagctggagggcatcatcatgagcctggagagcgtgctgtatggagtgtgtgcccacttccccaggctcttcttcctgagtgacagcgagctggtggccctgctggccgcccggctggagagctgtgaggcccagctgtgggtgcggcgctgcttcccccacgtgcatgctgtgtccttccgcagctgccccactggagagaagaacacagatgactgggagagcagccccaacacccagacccaggtggaggccctggccgtgctgggcgccggcggggaggaggtgaagctgcagggccccctgcccctgcacccagacctgcccaagtggctggccagcctggagaagtgcctgcggctggccctggtgcacatgctgcagggctgtgtggccgcccggctggcccggggccccagcctgggggaggccctgaagcagctgcccaagcagaacaagctgtacctgcagctgtatgtgcagcactggattgacctggtgcaggccttcccctggcagtgtgtgctggtggccgaggaggtggtgtggagggctgagatggaggaggccctgctggagtggggcaccctggccatggtgtccatgcacatgaggaagctggaggtgctggtgaacttcatgagggcccagagggccagccagggcggccagagcctgcccagcgtgcggcagaccagcctgctgagcgccctgctggtgatggctgtgacccaccgggacatcgcccagctgctggagcagcaccaggtgtctgacctgacagacttccactgggtgcggcagctgaagtaccacctgggcagcccccacatcatccccaagagccccctgcagagcctgaagaccatcgccagcagcgagcccagcctgagccctgctgcctgctggattgatgtgctgggccgctccttcctgtacaactatgagtacctgggcccccggctgggccccctgcccagcctgctgcctgagaggcctgccctggtgctgctgctggccctggaggaggtggcctgtggcaccgtgctgggccccaatggagtgggcaagagggccatcgtgaacagcctggcccaggccctgggccggcagctggtgatgctgccctgcagcccccagatcgaggcccagtgcctgagcaactacctgaatggagccctgcagggcggggcctggctgctgctggagaaggtgcaccagctgcccccaggcctgctgagcgccctgggccagaggctgggggagctgcaccacctgtatgcccccctgtaccaggaggccagcaggaacaccagcaccatcgaccccacccagccccagctgctgggcagcagcttctttgagaagcaccacgtgtctgtgcggctgggctacggctgcctgctggtgctgcgggccctgagcagcgctgtgcctgccaacctgcacctgctgctgcggcctgtggccctggccctgcctgacctgcggcaggtggccgagctgaccctgctgggcgccggcatgagagatgccttccagatggccacccggctgagcaagttcttcagcctggagcgggagctggtgtctggccccctgccctgccgcctgcccctgctgaagcagatcctggaggacaccatccgcaccctgaatgtgaccaaggaggagcccaagtgccagaagcccaggagcctggccgccatcgaggaggccgccctgctgcggagccccctcttcagcatcctgaatggcctgcacctgcacaacctgcggggcctgctgtgtgccctcttccccagcgccagccaggtgctggccgagcccatgacctacaagctgatgaagcccctggtggtggaggagctgcagcaggtgggcctggaccccagcccagacatcctgggcagcctggagcagctgagccaggccctgagccgggccagcggcatcctgctgctgggccctgctggcagcggcaagaccacctgctggcacagcctcttcaagatccagaaccggctggccgccatggaggacaccagcacccagggctgccagcctgtggagatcacccacctgtaccccagcggcctgagcccccaggagttcctgggctggctggagggcagctgctggcaccacggcatcttccccaaggtgctgcgggccgccggccagtgcaacaacatgggccagaagaggcagacagaggagagcatcggcatccagcactggatcatctgtgatggagccagcaatggagcctggctggacagcatcacctgcctgctgtctgagctgccccagctgagcctgcccagcggccagcagatcgcccggcccccaggcaccttcctgctgatggaggtggccgacaccaccggcatcagccccaccgtggtgggctgctgtgccctggtgtggtgtggcggggagcagacctggcagtgcatcctgagcgccctgatggccagcctgccctatgagtaccgcctgcagcacaggacagtggccgagctgaaccacatggccgaggtgctggtgcctgccaccctgcgcttcctgacctgccagggcgtgagcagcctgctgcaggtgcacggccagcaggccgtgtgtgccggcgtggccgaggtgacctccatggcccgcatcctgcacagcctgctggacctgcacctgcggctgaaggaggagaaggcccctggccctgaggacctgagctacagcgaccctgtggcccagagcttccgcagcagcaagagcagcttcctgaacagaagccaggtggacagtgatgatgtgcctgacaagtgccgggagcacctgctggccgtgagcagcttcctgtttgccctgatctggggctttggagcccacctgcccagccgcttctggcccatctttgacaccttcatccgggacagcatcagccggctgagcaactacccagagcccccaccttctgccctggtgtttgacctgcacgtgtccccagaagatggcaccctggtgcccttcaccggccagtacctgagcagccacatcaagggcaccctgggcaccttccaccccagcatccagacagagcggctgctgtatgtggtggacctgctgctgagcggcggccagcctgtgctgctggccggggaggccgccaccgggaagagcgcctttgtggaggtgctggtggagccccaccacccctacatctacagccccatccacccagccttcagcagcagccacctgcggctgctgctgagccggggcatccagggccagacccaggccagcccccagcccggccaccaccaggacagcaagcccagcctgctcttcctgctggaggacctgcacctggccaccagtgaccctgagaagagctgccagcctgtgctggagaccctgcggcaggccatggatggcaccgtgtatgcccacagcaccctggagctgcagaccctgcagcccaccgtgaacttcctggccaccgtgacagtgcccggctactgtgagcggcccctgtgccccaggctcttccgcctcttcaccgtgctggccctggagagcatgacccaggccaccctgctggagagacatgtgcccatcatccaggcctggctggagcgcttccccagcgtggagcgggagcgggccctggcccggggcctggtgcgggcctctgtggaggcctgggaggccgtgtgcaactgcttcatgcccagccccctgcacccccactaccacttcagcctgcacagcgtgagccacctgctgagcagcctgcagctgctgcccaacagaacaggcagccggggctttgtggactaccccaaccaccaggagcacctgcggcgggtgtctggcctgcggggcacctgcctgactgtgatgatggccaccagaaatgtggtgcggctgtggctgcacgaggcccagaggaccttctgtgaccggctggacagcccccgggagaggagctactgtgccaagctgctgctggtggtggcccagagcgtcttctgctgcggccctggcccccagcacctgggcaaggaccaccaggagagcgaggaggaggaggaggaggagcgggtgcctgaggtggagagcgagggggagctggcccagtgggaggacttcagcaacagcaacagcgagacagaggaggaggaggagccctacggcctgcaggtggcccgggtgagcaacagccgggaccccagcctgacccccagcatcggccctgtgtcccggggcatgaaggagagcatcagccacaagatccggcaggagaagggcacccgggccagcaactaccgcctgcaggtgcggcgctccttcaagacctggtggcagaagaagccccagatggacctgatcagccccctgctgctgcctgtgctgctgctgcacccccaggagaagcccagcgacctggtgttcagccaggagctgatcctgggccccaacagcgagacccccaacctgtacctggagcggcagtgggagaagctggaggagcagctggccaccagcgctgcccagctgaagctgagcccccacctggcccgctgccacagcatggcccagcacgtggcccggctggtgcgggtgctggcccggccccggcagcacggcctgctgctgagcggggccctgggcaccggccgccacacagccatcaccctggccagcagcatctgccaggcccacttcttccacctgcccagcggcagcgaggaggccatcctgcagtgcctgagagatgcctcctggcacgccggcatgctgagccagcctgtggccctgctggtgcccagcggcgtggacctgaccaccctgcaccggctgctggccctggccaccagcggcagcttccctggccagtacacagaagctgacctggaccgcatcggggagcacctgccccgggagaacctgggcgtgaagcagaacatcaagaaggagatggtgctgcagcgcttccaccagcaggtgtgcagccacctgcacctgttcttcctgattggagacaagcaggcccacaagcagctgcccagcaccctcttcctgcggctgctgcagctggccacagccagcattgacagatatgagccctgggaccaggccgccctggccaaggtggcccagcaccacctggagggcgcccagagcgtgcccctggatgatggctcctggaagtacccagacctgcaggccagcatccccagcgtggccaaggccatggccctgatccacctgagcgccacccactaccacgagcacctgtgcccagccctgcccctggtgacccccaagaccttcctggacttcctggacaccttcctgatgctgcagcagcagaccatcctgaagatcaagaacaaggcccagagggtgcagaatgccctggagaacctgaggatgctgatcaaggagcacggcacccacgccaacctgatctttgacctggagcagcagctgaaggacagcggcaagagcctgtccatgttccagcagcagctggagcagagcaagctgctgtacaagcagcagctggaggagtgccgccaccaggagaacctgattgagaacctggcccggcagagagatgccctgcaggcccagcgggaggccttcctggagcagatgagcaaggccttcctggagcccctgagccagctgcaggtggccgactttgaggagatccgcagctaccgggcccctcctgagagcgtggtgcgggtgacagatgccatgtgtgacctcttccaccacgagaccggctgggccagcgccaagcagctgctgtgcacagaggacttctaccaggagctggtgttcttccccaaggagaagatcacagattctgagctgatcaagctgcacctgatcctgaaggcccctggcatggatgatgctgccctgcgggctgtgtccaggcctgctgccagcctggccgcctggctgtgggccgtgctgcactacggcctggcccactgccggggcctgcccacagacctgctgctgcagcaggtggaggccaccctgacccgggagcaggcccggctgggctactaccagttccaggcccaggagaccctggagcacaacctggccctggccaagatggtggaggatgcccaggccagccacaactgtgtggccaagaccctgagccaggcccagtgtggccagtaccacaagtggcccatgaaggccgccctgctgacccccatgagggcctggaccacccagctgcagaagctgaagggccgctgcatgacagtgtttggagacaccctgctgtgcagcgctgccatcatctacctgggccccttcccccccctgcggcggcaggagctgctggatgagtggctggccctgtgccggggcttccaggaggccctgggcccagatgatgtggcccaggccctgaagaggaagcagaagtctgtgtccatcccccccaagaaccccctgctggccacccacagccccttcagcatcctgagcctgctgagcagcgagagcgagcagtaccagtgggatggcaacctgaagccccaggccaagagcgcccacctggccggcctgctgctgcggagccccacccactacagcagctgccgctggcccctgctgctggaccccagcaatgaggccctgatctggctggaccccctgcccctggaggagaacagaagctttgccccagccctgacagagggccggggcaagggcctgatgaggaaccagaagcgggagagcaagacagacatgaaggaggaggatgatgagagcgaggagagcaatgaagctgaggaccagaccaaggagcagaaggccgaggagaggaagaatgagcaggagaaggagcaggaggagaatgaggagaaggaggaggagaagacagagagccagggcagcaagccagcctatgagacccagctgcccagcctgccctacctgtctgtgctgagcggggctgaccctgagctgggcagccagctgcaggaggccgccgcctgtggcctgcctgtgctgctgaccaacgtggagctgggcctgggctgtgaggagctgcagtggctgctgcagcgggagcagctgagccccccccaggtgcagcccggcttctgcctgtacctgagcaccaccctgagcctgtgtgccatggagaaggtgctgggctgtgagctgctgaagggcctgaatgtgctggacctgggcctgaacatggagatcctggaggagcagatgctgcacgagatcctgtgccgggagtacccagagctggagacccgctggcaggacctgaagatccgggccctggacacctgcaaggctgtggaggccgctgaggagcggctgctgaccatgctgctcttccagaaccccaagaggcagaagccagccaagttcctgagaaatattgtgcgggcccagggcaagctgtgccagctgcgggcccactgtgaggagctggagggccagaagctgcaggagatggtgctgtgggccccctacagacctgtggtgtggcacggcatggccatggtgaaggccctgagccagctgcagaacctgctgcccctcttctgcatgagccctgagaactggctggccgtgaccaagcaggccctggacagcatgaagccccgggagatcaaccacggggaggacctggccagccacctgctgcagctgcgggcccacctgacccggcagctgctgggcagcacagtgacagccctgggcctgacccaggtgcccctggtgggcgccctgggcgccctggccctgctgcaggccaccgggaaggccagcgagctggagcggctggccctgtggccaggcctggccgccagccccagcacagtgcacagcaagcctgtgtctgatgtggcccggcctgcctggctgggccccaaggcctggcatgaatgtgagatgctggagctgctgcccccatttgtgggcctgtgtgccagcctggccggccacagcagcgcctggcaggcctacctgagcctgagcagcacagtgctgggccctgcccctggccctggccctgagcccctgagcctgctgcagaagctgatcctgtggagggtgctgcggcctgagtgcctggccggggccctggccgacttcaccaccagcctgctgggccggcccctggatgagaacacctacgcccccaccatgcccttcaagcacagccaggccacccagcccatgctgatcctgctgcccccacctggccaccccagcgccaccctgcaccccctgaccgtcatccagaagctggccgccaagtaccagcagggccagaagcagctgcaggtgattgccctgggcagcgaggcctgggaccctgtgtctgtggtggtgtccaccctgagccaggccatgtatgagggccactggctggtgctggacaactgccacctgatgccccactggcccaaggagctgctgcagctgctgctggagctgctgggccgggccaaggtggtggccgacctggagagcgagcagctgctggaccagcctgagagcagaaatgtgtccacagtgcaccgggacttccggctgtggctgattgtgcctgctgagagcagcgccagcctgcctgctgtgctgacccagcacagcatgcctgtgttctggaaccagagcctggagctgggccacgtgctgattgattctgtggagctggcccagcaggtgctgtacatgcagccccccacccaggccctgcccctgctgctgctgcacggcctgctgctgcaccggcagctgtatggcacccggctgcaggcccaccggggccgctggagccaggtgaccctgacccaggtgctgcagacccaggaccagctgtgggccagcctgagcaacccccgggccgccatgcaggagctggccgccagcgtcttctatggaggccccctgggggacacagaagatcgggaggccctgatcagcctgacccaggcctgcctgagccccagcagcggctcctgggtgcagccccacaccccccagagcctgctggccaccctgatgcccctgcctgagctgcgggagctggatgccatggccgagtgcaaggcccagatgcacctgctgcccagccccccagagccccggctgtgtggcctgtctgagggcccccaggcctggctgctgcggcggcagagccgggccctgctgagcgccctgcagaggagcagccctgtgtgggtgcctgagagcagaagaggagcccagctggccgagcggcggctgcggcagaggctggtgcaggtgaacagaaggctggagagcctgcaggacctgctgacccacgtgatccggcaggatgaaagtgatgccccctggagcgtgctgggccccaatgcccggcggcccctggagggcgtgctggagacagaggccctggagctgagccagctggtgggcaccctgcagagggacctggactgcctgctgcagcagctgaagggggccccaccctgccccagcagaagatgtgccgctgtggcccacgccctgtggacaggccgcctgcccctgccctggaggccccacgccccagctggcccccagcccccctggcactggctgcggcagctgagcagaagaggccagctgctggtgcgctacctgggcgtgggcgcagatgccagcagtgatgtgcctgagagggtcttccacctgagcgccttccgccacccccggcggctgctgctggccctgcggggggaggccgccctggaccagaatgtgcccagcagcaacttccctggcagccggggctctgtgagcagccagctgcagtacaagaggctggagatgaacagcaaccccctgcacttccgggtggagaatggccccaaccccaccgtgcctgagcggggcctgctgctgattggcctgcaggtgctgcatgctgagtgggaccccatcgccggggccctgcaggacagccccagcagccagcccagccccctgccccctgtgtccatcagcacccaggcccctggcaccagtgacctgcctgccccagctgacctgactgtgtacagctgccctgtgtacatgggcggccccctgggcacagccaagctgcagagcagaaatattgtgatgcacctgcccctgcccaccaagctgacccccaacacctgtgtgcagaggagagtgcacgtgtgcagcccccccctgtcctag

SEQ ID NO: 18384 - DNA, 1179 bp, Artificial Sequence
  Description of Artificial Sequence: Synthetic coding sequence
atggacctgtttggagacctgcctgagcctgagaggagccccaggcctgctgctgggaaggaggcccagaagggccccctgctgtttgatgacctgcccccagccagcagcacagacagcggcagcggcggccccctgctgtttgatgacctgcccccagccagcagcggggacagcggcagcctggccaccagcatcagccagatggtgaagacagagggcaaaggagccaagaggaagaccagcgaggaggagaagaatggaagtgaggagctggtggagaagaaggtgtgcaaggccagcagcgtcatcttcggcctgaagggctacgtggccgagaggaaaggagagcgggaggagatgcaggatgcccacgtgatcctgaatgacatcacagaggagtgcaggcctcccagcagcctcatcaccagggtgtcctactttgctgtgtttgatggccacggcggcatccgggccagcaagtttgctgcccagaacctgcaccagaacctgatcaggaagttccccaagggagatgtgatctctgtggagaagacagtgaagcgctgcctgctggacaccttcaagcacacagatgaggagttcctgaagcaggccagcagccagaagccagcctggaaggatggcagcacagccacctgtgtgctggccgtggacaacatcctgtacatcgccaacctgggggacagccgggccatcctgtgccgctacaatgaggagagccagaagcacgccgccctgagcctgagcaaggagcacaaccccacccagtatgaggagaggatgaggatccagaaggccggcggcaatgtgagagatggccgggtgctgggcgtgctggaggtgagccgcagcattggagatggccagtacaagagatgtggggtgacctctgtgcctgacatccgccgctgccagctgaccccaaatgaccgcttcatcctgctggcctgtgatggcctcttcaaggtgttcaccccagaggaggccgtgaacttcatcctgagctgcctggaggatgagaagatccagacccgggagggcaagtctgctgctgatgcccgctatgaagctgcctgcaaccggctggccaacaaggctgtgcagaggggcagcgctgacaacgtgacagtgatggtggtgcgcatcggccactag

SEQ ID NO: 18385 - DNA, 2193 bp, Artificial Sequence
  Description of Artificial Sequence: Synthetic coding sequence
atgtttggaaggaagaggtctgtgtcctttggaggcttcggctggattgacaagaccatgctggccagcctgaaggtgaagaagcaggagctggccaacagcagtgatgccaccctgcctgaccggcccctgagcccccccctgacagccccacccaccatgaagagcagcgagttctttgagatgctggagaagatgcagggcatcaagctggaggagcagaagccaggcccccagaagaacaaggatgactacatcccctaccccagcattgatgaggtggtggagaagggcggcccctacccccaggtgatcctgccccagtttggaggctactggattgaagatcctgaaaatgtgggcacccccaccagcctgggcagcagcatctgtgaggaggaggaggaggacaacctgagccccaacaccttcggctacaagctggagtgcaagggggaggcccgggcctaccgccgccacttcctgggcaaggaccacctgaacttctactgcaccggcagcagcctgggcaacctgatcctgtctgtgaagtgtgaggaggccgagggcatcgagtacctgcgggtcatcctgcggagcaagctgaagacagtgcatgagcgcatccccctggccggcctgagcaagctgcccagcgtgccccagatcgccaaggccttctgtgatgatgctgtgggcctgcgcttcaaccctgtgctgtaccccaaggccagccagatgattgtgtcctatgatgagcacgaggtgaacaacaccttcaagtttggagtcatctaccagaaggcccggcagaccctggaggaggagctgtttggaaataatgaggagagccctgccttcaaggagttcctggacctgctgggggacaccatcaccctgcaggacttcaagggcttccggggcggcctggatgtgacccacggccagacaggagtggagagcgtgtacaccaccttccgggaccgggagatcatgttccacgtgtccaccaagctgcccttcacagatggagatgcccagcagctgcagaggaagaggcacatcggaaatgacatcgtggccatcatcttccaggaggagaacaccccatttgtgcctgacatgattgccagcaacttcctgcacgcctacatcgtggtgcaggtggagaccccaggcacagagacccccagctacaaggtgtctgtgacagccagagaagatgtgcccaccttcggcccccccctgcccagcccccctgtgttccagaagggccctgagttccgggagttcctgctgaccaagctgaccaatgcagaaaatgcctgctgcaagagtgacaagtttgccaagctggaggacaggacccgggccgccctgctggacaacctgcatgatgagctgcacgcccacacccaggccatgctgggcctgggccctgaggaggacaagtttgaaaatggaggccacggcggcttcctggagagcttcaagagggccatccgggtgcgcagccacagcatggagaccatggtgggcggccagaagaagagccacagcggcggcatccctggcagcctgagcggcggcatcagccacaacagcatggaggtgaccaagaccaccttcagcccccctgtggtggccgccaccgtgaagaaccagagccgcagccccatcaagaggaggagcggcctcttcccccggctgcacacaggcagcgagggccagggcgacagccgggcccgctgtgacagcaccagcagcacccccaagaccccagatggcggccacagcagccaggagatcaagtctgagaccagcagcaaccccagcagccctgagatctgccccaacaaggagaagcccttcatgaagctgaaggaaaatggccgggccatcagccgcagcagcagcagcaccagctctgtgagcagcacagctggggagggggaggccatggaggagggggacagcggcggcagccagcccagcaccaccagccccttcaagcaggaggtgtttgtgtacagccccagccccagcagcgagagccccagcctgggcgctgctgccacccccatcatcatgagccgcagccccacagatgccaagagcaggaacagccccaggagcaacctgaagttccgctttgacaagctgagccacgccagcagcggggccggccactag

SEQ ID NO: 18386 - DNA, 1110 bp, Artificial Sequence
  Description of Artificial Sequence: Synthetic coding sequence
atgtggagcggcaggaagctgggcagcagcggcggctggttcctgcgggtgctgggccctgggggctgcaacaccaaggccgcccggcccctcatcagcagcgctgtgtatgtgaagaaccagctgagcggcaccctgcagatcaagccaggagtcttcaatgagtaccgcaccatctggttcaagagctaccgcaccatcttcagctgcctgaaccgcatcaagagcttccgctacccctgggcccggctgtacagcaccagccagaccaccgtggacagcggggaggtgaagaccttcctggccctggcccacaagtggtgggatgagcagggcgtgtatgcccccctgcacagcatgaatgacctgcgggtgcccttcatccgggacaacctgctgaagaccatccccaaccaccagcccgggaagcccctgctgggcatgaagatcctggatgtgggctgcggcggcggcctgctgacagagcccctgggccgcctgggcgccagcgtcatcggcatcgaccctgtggatgagaacatcaagacagcccagtgccacaagagctttgatcctgtgctggacaagagaattgagtacagagtgtgcagcctggaggagatcgtggaggagacagctgagacctttgatgctgtggtggccagcgaggtggtggagcacgtgattgacctggagaccttcctgcagtgctgctgccaggtgctgaagccaggcggcagcctcttcatcaccaccatcaacaagacccagctgtcctatgccctgggcatcgtgttttctgagcagatcgccagcatcgtgcccaagggcacccacacctgggagaagtttgtgtccccagagaccctggagagcatcctggagagcaatggcctgtctgtgcagacagtggtgggcatgctgtacaaccccttcagcggctactggcactggagcgagaacaccagcctgaactatgctgcctatgctgtgaagagccgggtgcaggagcacccagccagcgctgagtttgtgctgaagggggagacagaggagctgcaggccaatgcctgcaccaacccagctgtgcatgagaagctgaagaagtag

SEQ ID NO: 18387 - DNA, 1782 bp, Artificial Sequence
  Description of Artificial Sequence: Synthetic coding sequence
atggagggctgcatgggagaggagagcttccagatgtgggagctgaacagaaggctggaggcctacctggcccgggtgaaggccctggaggagcagaatgagctgctgtctgctgagctgggcggcctgcgggcccagagcgctgacacctcctggagggcccacgcagatgatgagctggccgccctgcgggccctggtggaccagcgctggagggagaagcacgccgctgaggtggcccgggacaacctggccgaggagctggagggcgtggccggccgctgccagcagctgcggctggcccgggagaggaccacagaggaggtggccaggaacagaagagctgtggaggccgagaagtgtgcccgggcctggctgagcagccaggtggccgagctggagcgggagctggaggccctgcgggtggcccacgaggaggagcgggtgggcctgaatgcccaggccgcctgtgccccccgctgcccagccccaccccggggccccccagccccagcccctgaggtggaggagctggcccggcggctgggggaggcctggagaggagctgtgcggggctaccaggagcgggtggcccacatggagaccagcctgggccaggcccgggagcggctgggccgggctgtgcagggcgcccgggagggccgcctggagctgcagcagctgcaggccgagcggggcggcctgctggagcggcgggccgccctggagcagaggctggagggccgctggcaggagcggctgcgggccacagagaagttccagctggccgtggaggccctggagcaggagaagcagggcctgcagagccagatcgcccaggtgctggagggccggcagcagctggcccacctgaagatgagcctgagcctggaggtggccacctaccgcaccctgctggaggccgagaacagccggctgcagacccctgggggcggcagcaagaccagcctgtccttccaggaccccaagctggagctgcagttccccaggaccccagagggccggcggctgggcagcctgctgcctgtgctgagccccaccagcctgcccagccccctgcctgccaccctggagacccctgtgcctgccttcctgaagaaccaggagttcctgcaggcccggacccccaccctggccagcacccccatcccccccaccccccaggcccccagccctgctgtggatgctgagatccgggcccaggatgcccccctgagcctgctgcagacccagggcggcaggaagcaggcccctgagcccctgcgggcagaggcccgggtggccatcccagcctctgtgctgcccggccctgaggagcccggcggccagaggcaggaggccagcacaggccagagcccagaagatcatgccagcctggccccacccctgagcccagaccacagcagcctggaggccaaggatggagagagcggcggcagcagggtcttcagcatctgccgcggggagggggagggccagatctggggcctggtggagaaggagacagccatcgagggcaaggtggtgagcagcctgcagcaggagatctgggaggaggaggacctgaacaggaaggagatccaggacagccaggtgcccctggagaaggagaccctgaagagcctgggggaggagatccaggagagcctgaagaccctggagaaccagagccatgagaccctggagcgggagaaccaggagtgccccaggagcctggaggaggacctggagaccctgaagagcctggagaagaagaagtag

SEQ ID NO: 18388 - DNA, 3456 bp, Artificial Sequence
  Description of Artificial Sequence: Synthetic coding sequence
atgatggccgccgccctgggccccccagaggtgattgcccagctggagaatgctgccaaggtgctgatggcccctccttccatggtgaacaatgagcagaggcagcacgccgagcacatcttcctgtccttcaggaagagcaagagcccctttgctgtgtgcaagcacatcctggagaccagcaaggtggactatgtgctcttccaggccgccacagccatcatggaggccgtggtgcgggagtggatcctgctggagaagggcagcattgagagcctgcggaccttcctgctgacctacgtgctgcagaggcccaacctgcagaagtatgtgcgggagcagatcctgctggccgtggccgtcatcgtgaagaggggcagcctggacaagagcattgactgcaagagcatcttccacgaggtgtcccagctgatcagcagcggcaaccccaccgtgcagaccctggcctgcagcatcctgacagccctgctgtctgagttcagcagcagcagcaagaccagcaacatcggcctgtccatggagttccacggcaactgcaagagggtcttccaggaggaggacctgcggcagatcttcatgctgactgtggaggtgctgcaggagttcagcagaagagagaacctgaatgcccagatgagctctgtgttccagcgctacctggccctggccaaccaggtgctgtcctggaacttcctgccccccaacctgggccgccactacatcgccatgtttgagagcagccagaatgtgctgctgaagcccacagagagctggagggagaccctgctggacagccgggtgatggagctgttcttcaccgtgcacaggaagatcagagaagattctgacatggcccaggacagcctgcagtgcctggcccagctggccagcctgcacggccccatcttcccagatgagggcagccaggtggactacctggcccacttcatcgagggcctgctgaacaccatcaatggcatcgagattgaagattctgaggccgtgggcatcagcagcatcatcagcaacctgatcaccgtcttccccagaaatgtgctgacagccatccccagcgagctgttcagcagctttgtgaactgcctgacccacctgacctgcagctttggccgctctgctgccctggaggaggtgctggacaaggatgacatggtgtacatggaggcctatgacaagctgctggagagctggctgaccctggtgcaggatgacaagcacttccacaagggcttcttcacccagcacgctgtgcaggtgttcaacagctacatccagtgccacctggccgccccagatggcaccaggaacctgacagccaatggagtggccagccgggaggaggaggagatcagcgagctgcaggaggatgaccgggaccagttcagtgaccagctggcctctgtgggcatgctgggcagaattgctgctgagcactgcatccccctgctgaccagcctgctggaggagcgggtgacccggctgcacggccagctgcagaggcaccagcagcagctgctggccagccctggcagcagcacagtggacaacaagatgctggatgacctgtatgaggacatccactggctgatcctggtgacaggctacctgctggctgatgacacccagggcgagacccccctcatccccccagagatcatggagtacagcatcaagcacagcagcgaggtggacatcaacaccaccctgcagatcctgggcagccctggagagaaggccagcagcatccctggctacaacagaacagattctgtcatccggctgctgagcgccatcctgcgggtgtctgaggtggagagccgggccatccgggctgacctgacccacctgctgagcccccagatgggcaaggacatcgtgtggttcctgaagcgctgggccaagacctacctgctggtggatgagaagctgtatgaccagatcagcctgcccttcagcacagccttcggggctgacacagagggcagccagtggatcatcggctacctgctgcagaaggtgatcagcaacctgtctgtgtggagcagcgagcaggacctggccaatgacacagtgcagctgctggtgaccctggtggagcggcgggagcgggccaacctggtgatccagtgtgagaactggtggaacctggccaagcagtttgccagccgcagcccccccctgaacttcctgagcagccctgtgcagaggaccctgatgaaggccctggtgctgggcggctttgcccacatggacacagagaccaagcagcagtactggacagaggtgctgcagcccctgcagcagcgcttcctgcgggtcatcaaccaggagaacttccagcagatgtgccagcaggaggaggtgaagcaggagatcacagccaccctggaggccctgtgtggcattgctgaggccacccagattgacaacgtggccatcctcttcaacttcctgatggacttcctgaccaactgcatcggcctgatggaggtgtacaagaacaccccagagaccgtgaacctgatcatcgaggtgtttgtggaggtggcccacaagcagatctgctacctgggggagagcaaggccatgaacctgtatgaggcctgcctgaccctgctgcaggtgtacagcaagaacaacctgggccggcagagaattgatgtgacagctgaggaggagcagtaccaggacctgctgctgatcatggagctgctgaccaacctgctgagcaaggagttcatcgacttcagtgacacagatgaggtgttccggggccacgagcccggccaggccgccaacagatctgtgtctgctgctgatgtggtgctgtatggagtgaacctgatcctgcccctgatgagccaggacctgctgaagttccccaccctgtgcaaccagtactacaagctgatcaccttcatctgtgagatcttccctgagaagatcccccagctgcctgaggacctcttcaagagcctgatgtacagcctggagctgggcatgacctccatgagcagcgaggtgtgccagctgtgcctggaggccctgacccccctggccgagcagtgtgccaaggcccaggagacagacagccccctcttcctggccaccaggcacttcctgaagctggtgtttgacatgctggtgctgcagaagcacaacacagagatgaccacagctgctggggaggccttctacaccctggtgtgcctgcaccaggccgagtacagcgagctggtggagaccctgctgagcagccagcaggaccctgtgatctaccagaggctggctgatgccttcaacaagctgacagccagcagcaccccacccaccctggacaggaagcagaagatggccttcctgaagagcctggaggagttcatggccaacgtgggcggcctgctgtgtgtgaagtag

SEQ ID NO: 18389 - DNA, 1578 bp, Artificial Sequence
  Description of Artificial Sequence: Synthetic coding sequence
atggctgctgggggcagcggcggccgggccagctgccccccaggagtgggcgtgggccctggcaccggcggcagccctggccccagcgccaatgctgctgccaccccagcccctggaaatgctgctgctgctgctgctgctgctgctgctgctgctgctgcccctggccccaccccaccagcccctcctggccctggaacagatgcccaggccgccggggctgagagagctgaggaggccgccggccctggagctgctgccctgcagcgggaggccgcctacaactggcaggccagcaagcccaccgtgcaggagagatttgccttcctgttcaacaatgaggtgctgtgtgatgtgcacttcctggtgggcaagggcctgagcagccagaggatcccagcccacagatttgtgctggccgtgggcagcgctgtgtttgatgccatgtttaatggaggcatggccaccaccagcacagaaattgagctgcctgatgtggagcctgctgccttcctggccctgctgaagttcctgtacagtgatgaggtgcagatcggccctgagaccgtgatgaccaccctgtacacagccaagaagtatgctgtgcctgccctggaggcccactgtgtggagttcctgaagaagaacctgcgggctgacaatgccttcatgctgctgacccaggcccggctgtttgatgagccccagctggccagcctgtgcctggagaacatcgacaagaacacagcagatgccatcacagctgagggcttcacagacatcgacctggacaccctggtggccgtgctggagcgggacaccctgggcatccgggaggtgcggctcttcaatgctgtggtgcgctggagcgaggccgagtgccagaggcagcagctgcaggtgaccccagagaacagaaggaaggtgctgggcaaggccctgggcctcatccgcttccccctgatgaccatcgaggagtttgctgctggccctgcccagagcggcatcctggtggaccgggaggtggtgtccctcttcctgcacttcaccgtgaaccccaagccccgggtggagttcatcgaccggccccgctgctgcctgcggggcaaggaatgttccatcaaccgcttccagcaggtggagagccgctggggctacagcggcaccagtgaccgcatccgcttctctgtgaacaagaggatctttgtggtgggcttcggcctgtatggcagcatccacggccccacagactaccaggtgaacatccagatcatccacacagacagcaacacagtgctgggccagaatgacaccggcttcagctgtgatggcagcgccagcaccttccgggtgatgttcaaggagcctgtggaggtgctgcccaacgtgaactacacagcctgtgccaccctgaagggccctgacagccactacggcaccaagggcctgaggaaggtgacccatgagagccccaccactggagccaagacctgcttcaccttctgctacgccgccggcaacaacaacggcacctctgtggaggatggccagatccctgaggtgatcttctacacctag

SEQ ID NO: 18390 - DNA, 525 bp, Artificial Sequence
  Description of Artificial Sequence: Synthetic coding sequence
atggccaccgtggccgagctgaaggctgtgctgaaggacaccctggagaagaagggcgtgctgggccacctgaaggcccgcatccgggcagaggtgttcaatgccctggatgatgaccgggagccccggcccagcctgagccatgagaacctgctgatcaatgagctgatccgggagtacctggagttcaacaagtacaagtacacagcctctgtgctgattgctgagagcggccagcctgtggtgcccctggaccggcagttcctgattcatgagctgaatgcctttgaggagagcaaggacaacaccatccccctgctgtatggcatcctggcccacttcctgcggggcaccaaggatggcatccagaatgccttcctgaagggccccagcctgcagcccagcgaccccagcctgggccggcagcccagcaggaggaagcccatggatgaccacctgaggaaggaggagcagaagagcaccaacatcgaggacctgcacgtgtcccaggccgtgaacagatag

SEQ ID NO: 18391 - DNA, 1257 bp, Artificial Sequence
  Description of Artificial Sequence: Synthetic coding sequence
atggccggcagcctgcccccctgtgtggtggactgtggcaccggctacaccaagctgggctacgccggcaacacagagccccagttcatcatccccagctgcatcgccatccgggagagcgccaaggtggtggaccaggcccagaggagagtgctgcggggcgtggatgacctggacttcttcatcggagatgaggccatcgacaagcccacctacgccaccaagtggcccatccgccacggcatcatcgaggactgggacctgatggagcgcttcatggagcaggtggtgttcaagtacctgcgggcagagcctgaggaccactacttcctgatgacagagccccccctgaacaccccagaaaatcgggagtacctggccgagatcatgtttgagagcttcaacgtgcccggcctgtacatcgctgtgcaggccgtgctggccctggccgcctcctggaccagccggcaggtgggggagaggaccctgaccggcatcgtcatcgacagcggagatggagtgacccacgtgattcctgtggccgagggctacgtgattggcagctgcatcaagcacatccccatcgccggccgggacatcacctacttcatccagcagctgctgcgggagcgggaggtgggcatccccccagagcagagcctggagacagccaaggccatcaaggagaagtactgctacatctgcccagacatcgtgaaggagtttgccaagtatgatgtggaccccaggaagtggatcaagcagtacacaggcatcaatgccatcaaccagaagaagtttgtgattgatgtgggctatgagcgcttcctgggccctgagatcttcttccaccctgagtttgccaacccagacttcatggagagcatcagtgatgtggtggatgaagtcatccagaactgccccattgatgtgcggcggcccctgtacaagaatgtggtgctgagcggcggcagcaccatgttccgggactttggaagaaggctgcagagggacctgaagagggtggtggatgcccggctgcggctgtctgaggagctgagcggcggccgcatcaagcccaagcctgtggaggtgcaggtggtgacccaccacatgcagagatatgctgtgtggtttggaggctccatgctggccagcaccccagagttcttccaggtgtgccacaccaagaaggactatgaggagtatggccccagcatctgccgccacaaccctgtgtttggagtgatgtcctag

SEQ ID NO: 18392 - DNA, 1044 bp, Artificial Sequence
  Description of Artificial Sequence: Synthetic coding sequence
atggctgctgctgagcccgccagcagcggccagcaggccccagctggccagggccagggccagaggcccccaccccagcccccccaggcccaggccccccagcccccacctccaccccagctgggcggggccggcggcggcagcagcagacatgagaagagcctgggcctgctgaccaccaagtttgtgtccctgctgcaggaggccaaggatggagtgctggacctgaaggctgctgctgacaccctggccgtgcggcagaagaggcgcatctatgacatcaccaacgtgctggagggcatcgacctgattgagaagaagagcaagaacagcatccagtggaagggcgtgggcgccggctgcaacaccaaggaggtgattgaccggctgcgctacctgaaggccgagattgaggacctggagctgaaggagcgggagctggaccagcagaagctgtggctgcagcagagcatcaagaatgtgatggatgacagcatcaacaacagaaccttctcctatgtgacccatgaggacatctgcaactgcttcaacggggacaccctgctggccatccaggcccccagcggcacccagctggaggtgcccatccctgagatgggccagaatggccagaagaagtaccagatcaacctgaagagccacagcggccccatccacgtgctgctgatcaacaaggagagcagcagcagcaagcctgtggtgtttcctgtgcccccaccagatgacctgacccagcccagcagccagagcctgacccctgtgaccccccagaagagctccatggccacccagaacctgcctgagcagcacgtgtctgagaggagccaggccctgcagcagaccagcgccacagacatcagcagcgctggcagcatcagcggggacatcattgatgagctgatgagcagtgatgtgttccccctgctgcggctgagccccaccccagcagatgactacaacttcaacctggatgacaatgaaggagtgtgtgacctgtttgatgtgcagatcctgaactactag

SEQ ID NO: 18393 - DNA, 636 bp, Artificial Sequence
  Description of Artificial Sequence: Synthetic coding sequence
atgtgccccggcaactggctgtgggcctccatgaccttcatggcccgcttcagccgcagcagcagccgcagccctgtgaggacccggggcaccctggaggagatgcccaccgtgcagcaccccttcctgaatgtgtttgagctggagcggctgctgtacaccgggaagacagcctgcaaccacgcagatgaggtgtggccaggcctgtacctgggggaccaggacatggccaacaacagaagagagctgcggcggctgggcatcacccacgtgctgaatgccagccacagccgctggaggggcaccccagaggcctatgagggcctgggcatccgctacctgggcgtggaggcccatgacagccctgcctttgacatgagcatccacttccagacagctgctgacttcatccaccgggccctgagccagcccggcggcaagatcctggtgcactgtgctgtgggcgtgagccgcagcgccaccctggtgctggcctacctgatgctgtaccaccacctgaccctggtggaggccatcaagaaggtgaaggaccaccggggcatcatccccaacagaggcttcctgcggcagctgctggccctggaccggcggctgcggcagggcctggaggcctag

SEQ ID NO: 18394 - DNA, 948 bp, Artificial Sequence
  Description of Artificial Sequence: Synthetic coding sequence
atgcctggcctgagctgccgcttctaccagcacaagtttcctgaggtggaggatgtggtgatggtgaatgtgcgcagcattgctgagatgggcgcctacgtgtccctgctggagtacaacaacatcgagggcatgatcctgctgtctgagctgagcagaagacgcatccgcagcatcaacaagctgatcagaattggaagaaatgaatgtgtggtggtgatccgggtggacaaggagaagggctacatcgacctgagcaagagaagagtgtccccagaggaggccatcaagtgtgaggacaagttcaccaagagcaagacagtgtacagcatcctgcggcacgtggccgaggtgctggagtacaccaaggatgagcagctggagagcctcttccagaggacagcctgggtgtttgatgacaagtacaagaggcctggctatggagcctatgatgccttcaagcatgctgtgtctgaccccagcatcctggacagcctggacctgaatgaagatgagcgggaggtgctgatcaacaacatcaacagaaggctgaccccccaggccgtgaagatccgggctgacatcgaggtggcctgctacggctatgagggcattgatgctgtgaaggaggccctgcgggccggcctgaactgcagcacagagaacatgcccatcaagatcaacctgattgccccacccaggtatgtgatgaccaccaccaccctggagaggacagagggcctgtctgtgctgagccaggccatggccgtcatcaaggagaagattgaggagaagaggggcgtcttcaacgtgcagatggagcccaaggtggtgacagacacagatgaaacagagctggcccggcagatggagcggctggagcgggagaatgctgaggtggatggagatgatgatgctgaggagatggaggccaaggccgaggactag

SEQ ID NO: 18395 - DNA, 318 bp, Artificial Sequence
  Description of Artificial Sequence: Synthetic coding sequence
atggccggccaggaggaccctgtgcagcgggagatccaccaggactgggccaaccgggagtacatcgagatcatcaccagcagcatcaagaagattgctgacttcctgaacagctttgacatgagctgccgcagccggctggccaccctgaatgagaagctgacagccctggagaggagaattgagtacatcgaggcccgggtgaccaagggggagaccctgaggacagtgccctgctgctgctgggaggtggccctgcacaacacaggccacatgggcaaggccccagctgccttcagcagcttcctgagcccctag

SEQ ID NO: 18396 - DNA, 1902 bp, Artificial Sequence
  Description of Artificial Sequence: Synthetic coding sequence
atggctgctgctgctgctgctgccaccacagctgcctgcagcagcggcagcgctggaacagatgctgctggggccagcggcctgcagcagcccccaccccagccccagccccagcctgctgctgctgccccagcccagcccccacctgagccccccaggaagcccaggatggacccccggcggcggcaggccgccctgtccttcctgaccaacatcagcctggatggccgcctgcccccccaggatgctgagtggggcggcggggaggagggcggggccgccaagccaggggccggcggggcctgtggggcccggacccgcttcagcctgctggccgctgctgagcggggcggctgcatcgccctggccgcccctggcaccccagctgctggcctggccgccggcagcggcccctgcctgccccagcccagcagcctgcccccactcatccctgggggccacgccaccgtgtctggccctggggtggcccggggctttgccagccccctgggcgccggccgggccagcggggagcagtggcagccccccaggcctgcccccctggccgcctgtgcccagctgcagctgctggatggcagcggggctgctggccaggaggagctggaggaggatgatgccttcatctctgtgcaggtgcctgctgctgccttcctgggcagcggcaccccaggcagcggcagcggcagccggggccgcctgaacagcttcacccagggcatcctgcccatcgccttcagccggcccaccagccagaactactgcagcctggagcagcccggccagggcggcagcaccagcgcctttgagcagctgcagaggagcagaagaagactcatcagccagaggagcagcctggagaccctggaggacatcgaggagaatgcccccctgcggcgctgcaggaccctgagcggcagcccccggcccaagaacttcaagaagatccacttcatcaagaacatgaggcagcacgacaccagaaatggccgcatcgtgctgatcagcggccgccgctccttctgcagcatcttctctgtgctgccctacagagacagcacccaggtgggggacctgaagctggatggcggccggcagagcactggagctgtgtccctgaaggagatcatcggcctggagggcgtggagctgggcgcagatggcaagacagtgtcctacacccagttcctgctgcccaccaatgcctttggagcccggaggaacaccatcgacagcaccagcagcttcagccagttcaggaacctgagccacaggagcctgagcatcggccgggccagcggcacccagggcagcctggacaccggcagtgacctgggggacttcatggactatgaccccaacctgctggatgacccccagtggccctgtgggaagcacaagagggtgctgatcttccccagctacatgaccaccgtcatcgactatgtgaagcccagcgacctgaagaaggacatgaatgagaccttcaaggagaagttcccccacatcaagctgaccctgagcaagatccgcagcctgaagcgggagatgaggaagctggcccaggaggactgtggcctggaggagcccaccgtggccatggcctttgtgtactttgagaagctggccctgaagggcaagctgaacaagcagaacaggaagctgtgtgccggggcctgtgtgctgctggccgccaagattggaagtgacctgaagaagcatgaggtgaagcacctgattgacaagctggaggagaagttccggctgaacagaagagagctgattgcctttgagttccctgtgctggtggccctggagtttgccctgcacctgcctgagcacgaggtgatgccccactacagaaggctggtgcagagcagctag

SEQ ID NO: 18397 - DNA, 3423 bp, Artificial Sequence
  Description of Artificial Sequence: Synthetic coding sequence
atgaccacagctgtggagaggaagtacatcaacatcaggaagaggctggaccagctgggctaccggcagaccctgactgtggagtgcctgcccctggtggagaagctgttcagtgacctggtgcacaccacagagagcctgcggcagagcaagctgtctgctgtgaaggccgagaaggagagcgccaactttgattttgtgctggagccctacaagctggagaatgcccggctgagcagagaaaataatgagctgtacctggagctgatgaagctgcgggagcacagcgaccagcacgtgaaggagctgaagaccagcctgaagaagtgtgcccgggagacagctgacctgaagttcctgaacaaccagtatgcccacaagctgaagctgctggagaaggagagcaaggccaagaatgaaagaatccagcagctgcaggagaagaacctgcatgctgtggtgcagaccccaggcggcaagaagaggagcatcgccttccggcggcagaggatgcagattgatgagcctgtgccccccagcgaggtgagcagctaccctgtgccccagccagatgacccctacatcgctgacctgctgcaggtggccgacaaccgcatccaggagctgcagcaggaggtgcaccagctgcaggagaagctggccatgatggagagcggcgtgcgggactacagcaagcagatcgagctgcgggagcgggagattgagcggctgtctgtggccctggatggcggccgcagcccagatgtgctgagcctggagagcaggaacaagaccaatgagaagctgattgcccacctgaacatccaggtggacttcctgcagcaggccaacaaggacctggagaagaggatccgggagctgatggagaccaaggagaccgtgaccagcgaggtggtgaacctgagcaacaagaatgagaagctgtgccaggagctgacagaaattgaccagctggcccagcagctggagcggcacaaggaggaggtgctggagacagctgacaaggagctgggggaggccaagaaggagatcaagaggaagctgtctgagatgcaggacctggaggagaccatggccaagctgcagctggagctgaacctgtgccagaaggagaaggagcggctgagtgatgagctgctggtgaagagtgacctggagaccgtggtgcaccagctggagcaggagaagcagaggctgagcaagaaggtggagagctttgctgtgacagagcggcagctgaccctggaggtggagaggatgaggctggagcacggcatcaagagaagagacaggagccccagccggctggacaccttcctgaagggcatcgaggaggagcgggactactacaagaaggagctggagcggctgcagcacatcatccagaggaggagctgcagcaccagctacagcgcccgggagaagagcagcatcttccgcaccccagagaagggggactacaacagcgagatccaccagatcacccgggagagagatgagctgcagaggatgctggagagatttgagaagtacatggaggacatccagagcaatgtgaagctgctgacagctgagcgggacaagctgtctgtgctgtacaatgaggcccaggaggagctgagcgccctgaggaaggagagcacccagaccacagccccccacaacatcgtgtccctgatggagaaggagaaggagctggccctgagtgacctgcggcgcatcatggccgagaaggaggccctgcgggagaagctggagcacatcgaggaggtgtccctgtttgggaagtctgagctggagaagaccatcgagcacctgacctgtgtgaaccaccagctggagagcgagaagtatgagctgaagagcaaggtgctgatcatgaaggagaccatcgagagcctggagaacaagctgaaggtgcaggcccagaagttcagccacgtggccggggacagcagccaccagaagacagaggtgaacagcctgagaattgtgaatgagcagctgcagaggtctgtggatgactaccagcaccggctgagcatcaagagaggagagctggagagcgcccaggcccagatcaagatcctggaggagaagattgatgagctgaacctgaagatgaccagccaggatgaggaggcccacgtgatgaagaagaccatcggggtcatcgacaaggagaaggacttcctgcaggagaccgtggatgagaagacagagaagatcgccaacctgcaggagaacctggccaacaaggagaaggctgtggcccagatgaagatcatgatcagtgaatgtgagagctctgtgaaccagctgaaggagaccctggtgaacagagaccgggagatcaacagcctgcggcggcagctggatgctgcccacaaggagctggatgaggtgggccgcagccgggagatcgccttcaaggaaaatagaaggctgcaggatgacctggccaccatggcccgggagaaccaggagatcagcctggagctggaggccgctgtgcaggagaaggaggagatgaagagccgggtgcacaagtacatcacagaggtgagccgctgggagagcctgatggccgccaaggagaaggagaaccaggacctgctggaccgcttccagatgctgcacaacagagctgaggactgggaggtgaaggcccaccaggccgagggggagagcagctctgtgcggctggagctgctgagcattgacacagagcggcggcacctgcgggagcgggtggagctgctggagaaggagatccaggagcacatcaatgcccaccacgcctatgagagccagatcagctccatggccaaggccatgagccggctggaggaggagctgcggcaccaggaggatgagaaggccaccgtgctgaatgacctgagcagcctgcgggagctgtgcatcaagctggacagcggcaaggacatcatgacccagcagctgaacagcaagaacctggagtttgagcgggtggtggtggagctggagaatgtgaagtctgagagtgacctgctgaagaagcagctgagcaatgaaagacacacagtgaagaacctggagagcctgctggccaccaacagagacaaggagttccacagccacctgaccagccatgagaaggacacagagatccagctgctgaaggagaagctgaccctgtctgagagcaagctgaccagccagagccgggagaacaccatgctgcgggccaaggtggcccagctgcagacagattatgatgccctgaagaggcagatcagcacagaaagatatgagcgggagcgggccatccaggagatgagaagacatggcctggccaccccacccctgagcagcaccctgcggagccccagccacagccctgagcacagaaatgtgtag

SEQ ID NO: 18398 - DNA, 1512 bp, Artificial Sequence
  Description of Artificial Sequence: Synthetic coding sequence
atgcccaacgtggccgagacagagaggagcaatgattctggaaatggagagcacaagtctgagaggaagagccctgaggagaacctgcagggcgctgtgaagagcttctgcaccagcgccagcggggcccccctgggccccaagggagatggccactacccctggagctgccctgtgacccacacccgggagaagatctatgccatctgcagcgactatgccttcctgaaccaggccaccagcatctacaagacccccaaccccagccgcagcccctgcctgcctgacagcaccagcctgtctgctggcaacaacagcagccgctacatcggcatccccaccagcaccagcgagatcatctacaatgaggagaacagcctggagaacctgagcaacagcctgggcaagctgcccctggcctgggagattgacaagtcagaatttgatggagtgaccaccaacagcaagcacaagtctggaaatgccaagaagcaggtgtccaagaggaagaccagtgacaagaagggccgctaccagaaggaatgtccccagcacagccccctggaggacatcaagcagaggaaggtgctggacctgcggcgctggtactgcatcagccggccccagtacaagaccagctgtggcatcagcagcctcatcagctgctggaacttcctgtacagcaccatgggcgccggcaacctgccccccatcacccaggaggaggccctgcacatcctgggcttccagcccccatttgaggacatccgcttcggccccttcaccggcaacaccaccctgatgcgctggttccggcagatcaatgaccacttccacgtgaagggctgcagctatgtgctgtacaagccccacggcaagaacaagacagctggggagacagccagcggggccctgagcaagctgacccggggcctgaaggatgagagcctggcctacatctaccactgccagaaccactacttctgccccatcggctttgaggccacccctgtgaaggccaacaaggccttcagccggggccccctgagcccccaggaggtggagtactggatcctgattggagagagcagcaggaagcacccagccatccactgcaagaagtgggccgacatcgtgacagacctgaacacccagaaccctgagtacctggacatccgccacctggagcggggcctgcagtacaggaagaccaagaaggtgggcggcaacctgcactgcatcatcgccttccagaggctgaactggcagagatttggcctgtggaacttccccttcggcaccatccggcaggagagccagccccccacccacgcccagggcatcgccaagtctgagagcgaggacaacatcagcaagaagcagcacggccgcctgggccgctccttcagcgccagcttccaccaggacagcgcctggaagaagatgagcagcatccacgagaggagaaattctggctaccagggctacagcgactatgatggaaatgactag

SEQ ID NO: 18399 - DNA, 813 bp, Artificial Sequence
  Description of Artificial Sequence: Synthetic coding sequence
atggaggccgaggagctggagcaggagcgggagcagctgcggctgcagctgtgggaggcctactgccaggtgcgctacctgtgcagccacctgcggggaaatgacagcgctgacagcgctgtgtccacagacagctccatggatgagagcagcgagaccagcagcgccaaggatgtgcctgctggcagcctgaggacagccctgaatgagctgaagaggctcatccagagcatcgtggatggcatggagcccaccggcagccggcggctggatgatgacagcctggaggagcagatccggcagaccagcgaggacagccgggccctgcgggagctgatggagggggagcggggcaagctgcggcagagcctggaggagctgcagaggctgcacagccaggtgaccctgctgtctgtggagatgacagccctgaaggaggagcgggaccggctgcgggtgaccagcgaggacaaggagcccaaggagcagctgcagaaggccatccgggacagagatgaggccatcgccaagaagaatgctgtggagctggagctggccaagtgcaggatggacatgatgagcctgaacagccagctgctggatgccatccagcagaagctgaacctgagccagcagctggaggcctggcaggatgacatgcacagggtcatcgaccggcagctgatggacacccacctgaaggagaggagccagcctgctgctgccctgtgccggggccacagcgctggaagaggagatgagcccagcattgctgagggcaagaggctcttctccttcttcaggaagatctag

SEQ ID NO: 18400 - DNA, 2379 bp, Artificial Sequence
  Description of Artificial Sequence: Synthetic coding sequence
atgctgcctgctggggagattggagccagccctgctgccccctgctgcagcgagagcggagatgagaggaagaacctggaggagaagagtgacatcaacgtgacagtgctgattggcagcaagcaggtgtctgagggcacagacaatggagacctgcccagctatgtgtctgccttcatcgagaaggaggtgggcaatgacctgaagagcctgaagaagctggacaagctgattgagcagaggacagtgtccaagatgcagctggaggagcaggtgctgaccatcagcagcgagatccccaagaggatccgcagcgccctgaagaatgctgaggagagcaagcagttcctgaaccagttcctggagcaggagacccacctgttcagcgccatcaacagccacctgctgacagcccagccctggatggatgacctgggcaccatgatcagccagatcgaggagattgagcggcacctggcctacctgaagtggatcagccagatcgaggagctgagtgacaacatccagcagtacctgatgaccaacaacgtgcctgaggccgccagcaccctggtgtccatggccgagctggacatcaagctgcaggagagcagctgcacccacctgctgggcttcatgagggccaccgtgaagttctggcacaagatcctgaaggacaagctgaccagtgactttgaggagatcctggcccagctgcactggcccttcatcgccccaccccagagccagacagtgggcctgagcaggcctgccagcgcccctgagatctacagctacctggagaccctcttctgccagctgctgaagctgcagaccagtgatgagctgctgacagagcccaagcagctgcctgagaagtacagcctgcctgccagccccagcgtcatcctgcccatccaggtgatgctgacccccctgcagaagcgcttccgctaccacttccggggcaaccggcagaccaacgtgctgagcaagccagagtggtacctggcccaggtgctgatgtggattggcaaccacacagagttcctggatgagaagatccagcccatcctggacaaggtgggcagcctggtgaatgcccggctggagttcagccggggcctgatgatgctggtgctggagaagctggccacagacatcccctgcctgctgtatgatgacaacctcttctgccacctggtggatgaggtgctgctgtttgagcgggagctgcacagcgtgcacggctacccaggcacctttgccagctgcatgcacatcctgtctgaggagacctgcttccagcgctggctgactgtggagaggaagtttgccctgcagaagatggacagcatgctgagcagcgaggccgcctgggtgtcccagtacaaggacatcacagatgtggatgagatgaaggtgcctgactgtgccgagaccttcatgaccctgctgctggtgatcacagaccgctacaagaacctgcccacagccagcaggaagctgcagttcctggagctgcagaaggacctggtggatgacttccgcatccggctgacccaggtgatgaaggaggagacccgggccagcctgggcttccgctactgtgccatcctgaatgctgtgaactacatcagcacagtgctggccgactgggccgacaacgtgttcttcctgcagctgcagcaggccgccctggaggtgtttgctgagaacaacaccctgagcaagctgcagctgggccagctggcctccatggagagctctgtgtttgatgacatgatcaacctgctggagcggctgaagcatgacatgctgacccggcaggtggaccacgtgttccgggaggtgaaggatgctgccaagctgtacaagaaggagcgctggctgagcctgcccagccagagcgagcaggccgtgatgagcctgagcagcagcgcctgccccctgctgctgaccctgcgggaccacctgctgcagctggagcagcagctgtgcttcagcctcttcaagatcttctggcagatgctggtggagaagctggatgtgtacatctaccaggagatcatcctggccaaccacttcaatgaaggaggagctgcccagctgcagtttgacatgaccaggaacctcttccccctcttcagccactactgcaagaggcctgagaactacttcaagcacatcaaggaggcctgcatcgtgctgaacctgaatgtgggcagcgccctgctgctgaaggatgtgctgcagagcgccagcggccagctgcctgccacagctgccctgaatgaggtgggcatctacaagctggcccagcaggatgtggagatcctgctgaacctgcggaccaactggcccaacacaggcaagtag

SEQ ID NO: 18401 - DNA, 1068 bp, Artificial Sequence
  Description of Artificial Sequence: Synthetic coding sequence
gtgcggggcgtgcgggccgccacagctgctgctgtggccgccacagctgccagcggcctgagccggcgggaggccggcggccgggccggggctgctgctgctgtggtgcggcccccaggcaggaaatgtggccgctgccggcggctggccaacttccctggcaggaagagaagaagaagaagaaggaagggcctgggcgccaccactggaggctgtggggaggccgtgagcagcctgcacccagccccccacagccccagctctgtgcggcctgctggccggcgggcccggcggcagaggagaggagctggcagcgctgagcggcccatgtctggagctggggaggccctggcccctggccctgtgggcccccagagggtggccgaggccggcggcggccagctgggcagcacagcccagggcaaatgtgacaaggacaacacagagaaggacatcacccaggccaccaacagccacttcacccacggggagatgcaggaccagagcatctggggcaaccccagtgatggagagctgatccgcacccagccccagaggctgccccagctgcagaccagcgcccaggtgcccagcggggaggagatcggcaagatcaagaatggccacacaggcctgagcaatggaaatggcatccaccacggggccaagcacggcagcgctgacaacaggaagctgagcgcccctgtgtcccagaagatgcacaggaagatccagagcagcctgtctgtgaacagcgacatcagcaagaagagcaaggtgaatgctgtgttcagccagaagacaggcagcagccctgaggactgctgcgtgcactgcatcctggcctgcctcttctgtgagttcctgaccctgtgcaacatcgtgctgggccaggccagctgtggcatctgcaccagcgaggcctgctgctgctgctgcggagatgagatgggagatgactgcaactgcccctgtgacatggactgtggcatcatggatgcctgctgtgagagcagtgactgcctggagatctgcatggagtgctgcggcatctgcttccccagctag

SEQ ID NO: 18402 - DNA, 378 bp, Artificial Sequence
  Description of Artificial Sequence: Synthetic coding sequence
atgctgagccggctgctgaaggagcaccaggccaagcagaatgaaaggaaggagctgcaggagaagagaagaagagaggccatcacagctgccacctgcctgacagaggccctggtggaccacctgaatgtgggcgtggcccaggcctacatgaaccagaggaagctggaccacgaggtgaagaccctgcaggtgcaggccgcccagtttgccaagcagacaggccagtggattggcatggtggagaacttcaaccaggccctgaaggagattggagatgtggagaactgggcccggagcattgagctggacatgaggaccatcgccacagccctggagtatgtgtacaagggccagctgcagagcgcccccagctag

SEQ ID NO: 18403 - DNA, 2337 bp, Artificial Sequence
  Description of Artificial Sequence: Synthetic coding sequence
atgaccacccggcaggccaccaaggaccccctgctgcggggcgtgagccccacccccagcaagatccctgtgcgcagccagaagaggacccccttccccaccgtgaccagctgtgctgtggaccaggagaaccaggacccccggcgctgggtgcagaagccacccctgaacatccagaggcccctggtggacagcgctggcccccggcccaaggcccggcaccaggccgagaccagccagaggctggtgggcatcagccagcccaggaaccccctggaggagctgcggcccagcccccggggccagaatgtgggccctggccccccagcccagacagaggcccctggcaccatcgagtttgtggccgaccctgctgccctggccaccatcctgagcggggagggcgtgaagagctgccacctgggccggcagcccagcctggccaagagggtgctggtgcggggcagccagggcggcaccacccagagggtgcagggcgtgcgggccagcgcctacctggcccccaggacccccacccaccggctggaccctgcccgggccagctgcttcagccggctggagggccctggcccccggggccgcaccctgtgcccccagaggctgcaggccctgatcagccccagcggccccagcttccaccccagcacccggcccagcttccaggagctgcggcgggagacagctggcagcagcaggacctctgtgtcccaggccagcggcctgctgctggagacccctgtgcagcctgccttcagcctgcccaagggggagcgggaggtggtgacccacagtgatgagggcggcgtggccagcctgggcctggcccagagggtgcccctgagagaaaatcgggagatgagccacacccgggacagccatgacagccacctgatgcccagccctgcccctgtggcccagcccctgcccggccacgtggtgccctgccccagccccttcggccgggcccagagggtgcccagccctggcccccccaccctgaccagctacagcgtgctgcggcggctgactgtgcagcccaagacccgcttcacccccatgcccagcaccccccgggtgcagcaggcccagtggctgcggggcgtgagcccccagagctgcagcgaggaccctgccctgccctgggagcaggtggccgtgcggctgtttgaccaggagagctgcatccgcagcctggagggcagcggcaagccccctgtggccaccccatctggcccccacagcaacagaacacccagcctgcaggaggtgaagatccagagaattggcatcctgcagcagctgctgcggcaggaggtggagggcctggtgggcggccagtgtgtgcccctgaatggaggcagcagcctggacatggtggagctgcagcccctgctgacagagatcagcaggaccctgaatgccacagagcacaacagcggcaccagccacctgcccggcctgctgaagcacagcggcctgcccaagccctgcctgcctgaggagtgtggggagccccagccctgccccccagctgagcccggccccccagaggccttctgccgctctgagcctgagatccctgagcccagcctgcaggagcagctggaggtgcctgagccctacccacctgctgagccccggcccctggagagctgctgccgctctgagcctgagatccctgagagcagccggcaggagcagctggaggtgcctgagccctgccccccagctgagccccggcccctggagagctactgcagaattgagcctgagatccctgagagcagccggcaggagcagctggaggtgcctgagccctgccccccagctgagcccggccccctgcagcccagcacccagggccagagcggccccccaggcccctgcccccgggtggagctgggcgccagcgagccctgcaccctggagcacaggagcctggagagcagcctgcccccctgctgcagccagtgggccccagccaccaccagcctcatcttcagcagccagcaccccctgtgtgccagcccccccatctgcagcctgcagagcctgcggcccccagctggccaggccggcctgagcaacctggcccccaggaccctggccctgcgggagcggctgaagagctgcctgacagccatccactgcttccacgaggcccggctggatgatgaatgtgccttctacaccagccgggccccacccagcggccccaccagggtgtgcaccaaccctgtggccaccctgctggagtggcaggatgccctgtgcttcatccctgtgggcagcgctgccccccagggcagcccctag

SEQ ID NO: 18404 - DNA, 1803 bp, Artificial Sequence
  Description of Artificial Sequence: Synthetic coding sequence
atgagctgccgcagctacagagtgagcagcggccaccgggtgggcaacttcagcagctgcagcgccatgaccccccagaacctgaaccgcttccgggccaacagcgtgtcctgctggagcggccctggcttccggggcctgggcagctttggcagccgcagcgtcatcaccttcggcagctacagccccagaattgctgctgtgggcagccggcccatccactgcggcgtgcgctttggagctggctgcggcatgggctttggagatggccggggcgtgggcctgggccccagggctgacagctgtgtgggcctgggctttggagctggcagcggcatcggctacggctttggaggccctggcttcggctacagagtgggcggcgtgggcgtgcctgctgcccccagcatcacagctgtgacagtgaacaagagcctgctgacccccctgaacctggagattgaccccaatgcccagagggtgaagaaggatgagaaggagcagatcaagaccctgaacaacaagtttgccagcttcatcgacaaggtgcgcttcctggagcagcagaacaagctgctggagaccaagtggagcttcctgcaggagcagaagtgcatccgcagcaacctggagcccctgtttgagagctacatcaccaacctgcggcggcagctggaggtgctggtgtctgaccaggcccggctgcaggccgagaggaaccacctgcaggatgtgctggagggcttcaagaagaagtatgaggaggaggtggtgtgccgggccaatgcagaaaatgaatttgtggccctgaagaaggatgtggatgctgccttcatgaacaagagtgacctggaggccaacgtggacaccctgacccaggagattgacttcctgaagaccctgtacatggaggagatccagctgctgcagagccacatcagcgagacctctgtgattgtgaagatggacaacagccgggacctgaacctggatggcatcatcgccgaggtgaaggcccagtatgaggaggtggcccggcgcagcagagcagatgctgaggcctggtaccagaccaagtatgaggagatgcaggtgacagctggccagcactgtgacaacctgaggaacatcagaaatgagatcaatgagctgaccaggctcatccagaggctgaaggccgagattgaacatgccaaggcccagagggccaagctggaggccgctgtggccgaggccgagcagcagggcgaggccaccctgagtgatgccaagtgcaagctggccgacctggagtgtgccctgcagcaggccaagcaggacatggcccggcagctgtgtgagtaccaggagctgatgaatgccaagctgggcctggacatcgagatcgccacctaccgccgcctgctggagggggaggagagccggctgtgtgaaggagtgggccctgtgaacatctctgtgagcagcagccggggcggcctggtgtgtggccctgagcccctggtggccggcagcaccctgagccggggcggcgtgaccttcagcggcagcagctctgtgtgtgccaccagcggcgtgctggccagctgtggccccagcctgggcggggcccgggtggccccagccactggagacctgctgagcacaggcaccaggagcggctccatgctgatcagcgaggcctgtgtgcccagcgtgccctgccccctgcccacccagggcggcttcagcagctgcagcggcggccgcagcagctctgtgcgctttgtgtccaccaccaccagctgcaggaccaagtactag

SEQ ID NO: 18405 - DNA, 1542 bp, Artificial Sequence
  Description of Artificial Sequence: Synthetic coding sequence
atgagctaccacagcttccagcccggcagccgctgtggcagccagagcttcagcagctacagcgctgtgatgcccaggatggtgacccactatgctgtgtccaagggcccctgcaggcctgggggcggccggggcctgcgggccctgggctgcctgggcagccgcagcctgtgcaatgtgggcttcggccggccccgggtggccagccgctgtggcggcaccctgcccggcttcggctaccgcctgggcgccacctgtggccccagcgcctgcatcacccctgtgaccatcaatgaaagcctgctggtgcccctggccctggagattgaccccaccgtgcagagggtgaagagagatgagaaggagcagatcaagtgcctgaacaacagatttgccagcttcatcaacaaggtgcgcttcctggagcagaagaacaagctgctggagaccaagtggaacttcatgcagcagcagcgctgctgccagaccaacatcgagcccatctttgagggctacatcagcgccctgcggcggcagctggactgtgtgtctggggacagagtgcggctggagagcgagctgtgcagcctgcaggccgccctggagggctacaagaagaagtatgaggaggagctgagcctgcggccctgtgtggagaatgaatttgtggccctgaagaaggatgtggacacagccttcctgatgaaggctgacctggagaccaatgctgaggccctggtgcaggagattgacttcctgaagagcctgtatgaggaggagatctgcctgctgcagagccagatcagcgagaccagcgtcatcgtgaagatggacaacagccgggagctggatgtggatggcatcatcgccgagatcaaggcccagtatgatgacatcgccagccgcagcaaggccgaggccgaggcctggtaccagtgccgctatgaggagctgcgggtgacagctggcaaccactgtgacaacctgaggaacaggaagaatgagatcctggagatgaacaagctgatccagaggctgcagcaggagacagaaaatgtgaaggcccagcgctgcaagctggagggcgccatcgccgaggccgagcagcagggcgaggccgccctgaatgatgccaagtgcaagctggccggcctggaggaggccctgcagaaggccaagcaggacatggcctgcctgctgaaggagtaccaggaggtgatgaacagcaagctgggcctggacattgaaattgccacctacagaaggctgctggagggggaggagcaccggctgtgtgagggcatcggccctgtgaacatctctgtgagcagcagcaagggggccttcctgtatgagccctgtggggtgtccacccctgtgctgagcactggagtgctgcggagcaatggaggctgcagcatcgtgggcactggagagctgtatgtgccctgtgagccccagggcctgctgagctgtggcagcggcaggaagagctccatgaccctgggcgctgggggcagcagccccagccacaagcactag

SEQ ID NO: 18406 - DNA, 1632 bp, Artificial Sequence
  Description of Artificial Sequence: Synthetic coding sequence
atgatgcccacccctgtgatcctgctgaaggagggcacagacagcagccagggcatcccccagctggtgagcaacatcagcgcctgccaggtgattgctgaggccgtgaggaccaccctgggcccccggggcatggacaagctgattgtggatggccggggcaaggccaccatcagcaatgatggagccaccatcctgaagctgctggatgtggtgcaccctgctgccaagaccctggtggacatcgccaagagccaggatgctgaggtgggagatggcaccacctctgtgaccctgctggccgctgagttcctgaagcaggtgaagccctacgtggaggagggcctgcacccccagatcatcatccgggccttcagaacagccacccagctggccgtgaacaagatcaaggagattgctgtgacagtgaagaaggctgacaaggtggagcagaggaagctgctggagaagtgtgccatgacagccctgagcagcaagctgatcagccagcagaaggccttctttgccaagatggtggtggatgctgtgatgatgctggatgacctgctgcagctgaagatgattggcatcaagaaggtgcagggcggggccctggaggacagccagctggtggccggcgtggccttcaagaagaccttctcctatgccggctttgagatgcagcccaagaagtaccacaaccccaagatcgccctgctgaatgtggagctggagctgaaggccgagaaggacaatgctgagatccgggtgcacacagtggaggactaccaggccatcgtggatgctgagtggaacatcctgtatgacaagctggagaagatccaccacagcggggccaaggtggtgctgagcaagctgcccatcggagatgtggccacccagtactttgctgaccgggacatgttctgtgccggccgggtgcctgaggaggacctgaagaggaccatgatggcctgtggcggcagcatccagacctctgtgaatgccctgtctgcagatgtgctgggccgctgccaggtgtttgaggagacccagattggaggagagcgctacaacttcttcaccggctgccccaaggccaagacctgcaccttcatcctgcggggcggcgctgagcagttcatggaggagacagagaggagcctgcatgatgccatcatgattgtgagaagagccatcaagaatgacagcgtggtggccggcggcggggccatcgagatggagctgagcaagtacctgcgggactacagcaggaccatccctgggaagcagcagctgctgattggagcctatgccaaggccctggagatcatcccccggcagctgtgtgacaatgccggctttgatgccaccaacatcctgaacaagctgcgggcccggcatgcccagggcggcacctggtatggagtggacatcaacaatgaagatattgctgacaactttgaggcctttgtgtgggagcccgccatggtgcgcatcaatgccctgacagctgccagcgaggccgcctgcctgattgtgtctgtggatgagaccatcaagaaccccaggagcacagtggatgcccccacagctgctggccggggccggggccggggccggccccactag

SEQ ID NO: 18407 - DNA, 1479 bp, Artificial Sequence
  Description of Artificial Sequence: Synthetic coding sequence
atggcccctgtgggcgtggagaagaagctgctgctgggccccaatggacctgctgtggccgccgccggggacctgaccagcgaggaggaggagggccagagcctgtggagcagcatcctgtctgaggtgtccacccgggcccggagcaagctgcccagcggcaagaacatcctggtgtttggagaagatggcagcggcaagaccaccctgatgaccaagctgcagggcgctgagcacggcaagaagggccggggcctggagtacctgtacctgtctgtgcatgatgaggacagagatgaccacacccgctgcaatgtgtggatcctggatggagacctgtaccacaagggcctgctgaagtttgctgtgtctgctgagagcctgcctgagaccctggtgatctttgtggccgacatgagccggccctggacagtgatggagagcctgcagaagtgggcctctgtgctgcgggagcacatcgacaagatgaagatccccccagagaagatgagggagctggagaggaagtttgtgaaggacttccaggactacatggagcctgaggagggctgccagggcagcccccagaggcggggccccctgaccagcggcagtgatgaggagaatgtggccctgcccctgggggacaacgtgctgacccacaacctgggcatccctgtgctggtggtgtgcaccaagtgtgatgctgtgtctgtgctggagaaggagcatgactacagagatgagcacctggacttcatccagagccacctgcggcgcttctgcctgcagtatggagctgccctgatctacacctctgtgaaggaggagaagaacctggacctgctgtacaagtacatcgtgcacaagacctacggcttccacttcaccaccccagccctggtggtggagaaggatgctgtgttcatcccagctggctgggacaatgagaagaagatcgccatcctgcacgagaacttcaccaccgtgaagccagaagatgcctatgaggacttcatcgtgaagccccctgtgaggaagctggtgcatgacaaggagctggccgcagaagatgagcaggtgttcctgatgaagcagcagagcctgctggccaagcagcctgccacccccacccgggccagcgagagccctgcccggggccccagcggcagccccaggacccagggccggggcggccctgcctctgtgcccagcagcagccctggcacctctgtgaagaagccagaccccaacatcaagaacaatgctgccagcgagggcgtgctggccagcttcttcaacagcctgctgagcaagaagacaggcagccctggcagccctggagctggaggagtgcagagcacagccaagaagagcggccagaagacagtgctgagcaatgtgcaggaggagctggacaggatgaccaggaagccagacagcatggtgaccaacagcagcacagaaaatgaggcctag

SEQ ID NO: 18408 - DNA, 540 bp, Artificial Sequence
  Description of Artificial Sequence: Synthetic coding sequence
atggacaaggactttgacaagctgcatgaatttgtggagatcatgaaggagatgcagaaggacatggatgagaagatggacatcctgatcaacacccagaagaactacaagctgcccctgcggcgggcccccaaggagcagcaggagctgcggctgatgggcaagacccaccgggagccccagctgcggcccaagaagatggatggagccagcggcgtgaatggagccccctgtgccctgcacaagaagaccatggccccccagaagaccaagcagggcagcctggaccccctgcaccactgcggcacctgctgtgagaagtgcctgctgtgtgccctgaagaacaactacaacagagctgcccccctgaaggaggcccggcacctgctgacagccaacagcattgaccccagcgctgccctggtgctgctgattgagttcctgctgctgaccctggtgactggagctgctgcccctggcctggatgcctgtggccaccagaggaacatgagagatgagatcaacagcgagaggaggtag

SEQ ID NO: 18409 - DNA, 3600 bp, Artificial Sequence
  Description of Artificial Sequence: Synthetic coding sequence
atggccagcgctggcacccagcactacagcatcggcctgcggcagaagaacagcttcaagcagagcggccccagcggcaccgtgcctgccaccccacctgagaagcccagcgagggccgggtgtggccccaggcccaccagcaggtgaagcccatctggaagctggagaagaagcaggtggagaccctgtctgctggcctgggccctggcctgctgggcgtgcccccccagcctgcctacttcttctgccccagcaccctgtgcagcagcggcaccacagctgtgattgctggccacagcagcagctgctacctgcacagcctgcctgacctcttcaacagcaccctgctgtacagaagaagcagctaccggcagaagccctaccagcagctggagagcttctgcctgcggagcagccccagcgagaagagccccttcagcctgccccagaagagcctgcctgtgtccctgacagccaacaaggccaccagctccatggtgttctccatggcccagcccatggccagcagcagcacagagccctacctgtgcctggccgccgccggggagaaccccagcggcaagagcctggccagcgccatcagcggcaagatccccagccccctgagcagcagctacaagcccatgctgaacaacaacagcttcatgtggcccaacagcacccctgtgcccctgctgcagaccacccagggcctgaagcctgtgagcccccccaagatccagcctgtgtcctggcaccacagcggcggcaccggggactgtgccccccagcctgtggaccacaaggtgcccaagagcatcggcaccgtgcctgcagatgccagcgcccacatcgccctgagcacagccagcagccatgacaccagcaccacctctgtggccagctcctggtacaacagaaacaacctggccatgagagctgagcccctgagctgtgccctggatgacagcagtgacagccaggaccccaccaaggagatccgcttcacagaagctgtgaggaagctgacagcccggggctttgagaagatgccccggcagggctgccagctggagcagagcagcttcctgaaccccagcttccagtggaatgtgctgaacagaagccgccgctggaagcccccagctgtgaaccagcagttcccccaggaggatgctggctctgtgagaagagtgctgcccggggccagtgacaccctgggcctggacaacacagtgttctgcaccaagaggatcagcatccacctgctggccagccacgccagcggcctgaaccacaacccagcctgtgagagcgtgattgacagcagcgccttcggggagggcaaggcccctggcccccccttcccccagaccctgggcatcgccaacgtggccacccggctgagcagcatccagctgggccagagcgagaaggagaggcctgaggaggcccgggagctggacagcagtgaccgggacatcagcagcgccacagacctgcagcctgaccaggccgagacagaggacacagaggaggagctggtggatggcctggaggactgctgcagcagagatgaaaatgaggaggaggagggggacagcgagtgcagcagcctgtctgctgtgagccccagcgagagcgtggccatgatcagccgcagctgcatggagatcctgaccaagcccctgagcaaccacgagaaggtggtgcggcctgccctgatctacagcctcttccccaacgtgccccccaccatctacttcggcaccagagatgagcgggtggagaagctgccctgggagcagaggaagctgctgcgctggaagatgagcacagtgacccccaacatcgtgaagcagaccatcggccgcagccacttcaagatcagcaagagaaatgatgactggctgggctgctggggccaccacatgaagagccccagcttccgcagcatccgggagcaccagaagctgaaccacttccctggcagcttccagatcggcaggaaggaccggctgtggaggaacctgagcaggatgcagagcagatttgggaagaaggagttctccttcttcccccagagcttcatcctgccccaggatgccaagctgctgaggaaggcctgggagagcagcagccggcagaagtggatcgtgaagcccccagccagcgcccggggcatcggcatccaggtgatccacaagtggagccagctgcccaagagaagacccctgctggtgcagcgctacctgcacaagccctacctgatcagcggcagcaagtttgacctgcgcatctacgtgtatgtgaccagctatgaccccctgcgcatctacctgttcagtgatggcctggtgcgctttgccagctgcaagtacagccccagcatgaagagcctgggcaacaagttcatgcacctgaccaactacagcgtgaacaagaagaatgctgagtaccaggccaatgctgatgagatggcctgccagggccacaagtgggccctgaaggccctgtggaactacctgagccagaagggcgtgaacagtgatgccatctgggagaagatcaaggatgtggtggtgaagaccatcatcagcagcgagccctacgtgaccagcctgctgaagatgtatgtgagaagaccctacagctgccacgagctgtttggatttgacatcatgctggatgagaacctgaagccctgggtgctggaggtgaacatcagccccagcctgcacagcagcagccccctggacatcagcatcaagggccagatgatccgggacctgctgaacctggccggctttgtgctgcccaatgctgaggacatcatcagcagccccagcagctgcagcagcagcaccaccagcctgcccaccagccctggggacaagtgcaggatggcccctgagcacgtgacagcccagaagatgaagaaggcctactacctgacccagaagatcccagaccaggacttctacgcctctgtgctggatgtgctgaccccagatgatgtgcgcatcctggtggagatggaggatgagttcagcagaagaggccagtttgagcgcatcttccccagccacatcagcagccgctacctgcgcttctttgagcagccccgctacttcaacatcctgaccacccagtgggagcagaagtaccacggcaacaagctgaagggcgtggacctgctgcgctcctggtgctacaagggcttccacatgggcgtggtgtctgattctgcccctgtgtggagcctgcccaccagcctgctgaccatcagcaaggatgatgtgatcctgaatgccttcagcaagtctgagaccagcaagctgggcaagcagagcagctgtgaggtgtccctgctgctgtctgaagatggcaccacccccaagagcaagaagacccaggccggcctgagcccctacccccagaagcccagcagcagcaaggacagcgaggacaccagcaaggagcccagcctgagcacccagaccctgcccgtcatcaagtgcagcggccagaccagccggctgagcgccagcagcaccttccagagcatcagtgacagcctgctggccgtgagcccctag

SEQ ID NO: 18410 - DNA, 2772 bp, Artificial Sequence
  Description of Artificial Sequence: Synthetic coding sequence
atgctgcggcggggcagccaggccctgcggcgcttcagcacaggccgggtgtacttcaagaacaagctgaagctggccctgattggccagagcctgtttggccaggaggtgtacagccacctgaggaaggagggccaccgggtggtgggcgtcttcaccgtgcctgacaaggatggcaaggctgaccccctggccctggccgctgagaaggatggcacccctgtgttcaagctgcccaagtggagggtgaagggcaagaccatcaaggaggtggccgaggcctacagatctgtgggcgctgagctgaatgtgctgcccttctgcacccagttcatccccatggacatcatcgacagccccaagcacggcagcatcatctaccaccccagcatcctgcccaggcacagaggagccagcgccatcaactggaccctcatcatgggagacaagaaggccggcttctctgtgttctgggcagatgatggcctggacaccggccccatcctgctgcagaggagctgtgatgtggagcccaatgacacagtggatgccctgtacaaccgcttcctgtttcctgagggcatcaaggccatggtggaggccgtgcagctgattgctgatggcaaggccccccgcatcccccagcctgaggagggcgccacctatgagggcatccagaagaaggaaaatgctgagatctcctgggaccagagcgctgaggtgctgcacaactggatccggggccatgacaaggtgcctggggcctggacagagatcaatggccagatggtgaccttctacggcagcaccctgctgaacagctctgtgcccccaggagagcccctggagatcaagggggccaagaagccaggcctggtgaccaagaatggcctggtgctgtttggaaatgatggcaaggccctgactgtgaggaacctgcagtttgaagatggcaagatgatcccagccagccagtacttcagcactggagagacctctgtggtggagctgacagctgaggaggtgaaggtggccgagaccatcaaggtgatctgggccggcatcctgagcaatgtgcccatcatcgaggacagcacagacttcttcaagagcggggccagctccatggatgtggcccggctggtggaggagatccggcagaagtgtggcggcctgcagctgcagaatgaagatgtgtacatggccaccaagtttgagggcttcatccagaaggtggtgaggaagctgcggggggaggaccaggaggtggagctggtggtggactacatcagcaaggaggtgaatgagatcatggtgaagatgccctaccagtgcttcatcaatggccagttcacagatgctgatgatggcaagacctatgacaccatcaaccccacagatggcagcaccatctgcaaggtgtcctatgccagcctggctgatgtggacaaggctgtggccgccgccaaggatgcctttgaaaatggagagtggggccgcatgaatgcccgggagcggggccgcctgatgtaccgcctggccgacctgctggaggagaaccaggaggagctggccaccatcgaggccctggacagcggggctgtgtacaccctggccctgaagacccacatcggcatgtctgtgcagaccttccgctactttgctggctggtgtgacaagatccagggcagcaccatccccatcaaccaggcccggcccaacagaaacctgaccttcaccaagaaggagcccctgggcgtgtgtgccatcatcatcccctggaactaccccctgatgatgctggcctggaagtctgctgcctgcctggccgccggcaacaccctggtgctgaagccagcccaggtgacccccctgacagccctgaagtttgctgagctgtctgtgaaggccggcttccccaagggcgtcatcaacatcatccctggcagcggcggcattgctggccagaggctgtctgagcacccagacatcaggaagctgggcttcaccggcagcacccccatcggcaagcagatcatgaagagctgtgctgtgagcaacctgaagaaggtgtccctggagctgggcggcaagagccccctcatcatcttcaatgactgtgagctggacaaggctgtgaggatgggcatgggcgctgtgttcttcaacaagggggagaactgcatcgctgctggccgcctgtttgtggaggagagcatccatgatgaatttgtgaccagggtggtggaggagatcaagaagatgaagattggagaccccctggacaggagcacagaccacggcccccagaaccacaaggcccacctggagaagctgctgcagtactgtgaaacaggagtgaaggagggcgccaccctggtgtatggaggccggcaggtgcagaggcctggcttcttcatggagcccaccgtcttcacagatgtggaggactacatgtacctggccaaggaggagagctttggccccatcatggtgatcagcaagttccagaatggagacattgatggagtgctgcagagggccaacagcacagaatatggcctggccagcggggtcttcacccgggacatcaacaaggccatgtatgtgtctgagaagctggaggccggcaccgtcttcatcaacacctacaacaagacagatgtggccgccccctttggaggagtgaagcagagcggctttgggaaggacctgggggaggaggccctgaatgagtacctgaagaccaagacagtgaccctggagtactag

SEQ ID NO: 18411 - DNA, 1323 bp, Artificial Sequence
  Description of Artificial Sequence: Synthetic coding sequence
atggagggcgtgctgtacaagtggaccaactacctgagcggctggcagccccgctggttcctgctgtgtggcggcatcctgagctactatgacagcccagaagatgcctggaagggctgcaagggcagcatccagatggctgtgtgtgagatccaggtgcacagcgtggacaacaccaggatggacctgatcatccctggagagcagtacttctacctgaaggcccggtctgtggccgagcggcagcgctggctggtggccctgggcagcgccaaggcctgcctgacagacagcaggacccagaaggagaaggagtttgctgagaacacagagaacctgaagaccaagatgtctgagctgcggctgtactgtgacctgctggtgcagcaggtggacaagaccaaggaggtgaccaccaccggggtgagcaacagcgaggagggcattgatgtgggcaccctgctgaagagcacctgcaacaccttcctgaagaccctggaggagtgcatgcagatcgccaatgctgccttcaccagcgagctgctgtaccgcaccccacctggcagcccccagctggccatgctgaagagcagcaagatgaagcaccccatcatccccatccacaacagcctggagcggcagatggagctgagcacctgtgaaaatggcagcctgaacatggagatcaacggggaggaggagatcctgatgaagaacaagaacagcctgtacctgaagtctgctgagattgactgcagcatcagcagcgaggagaacacagatgacaacatcaccgtgcagggcgagatcagaaaagaagatggcatggagaacctgaagaaccacgacaacaacctgacccagagcggcagtgacagcagctgcagccctgagtgcctgtgggaggagggcaaggaggtgatccccaccttcttcagcaccatgaacaccagcttcagtgacatcgagctgctggaggacagcggcatccccacagaggccttcctggccagctgctatgctgtggtgcctgtgctggacaagctgggccccaccgtgtttgcccctgtgaagatggacctggtgggcaacatcaagaaggtgaaccagaagtacatcaccaacaaggaggagttcaccaccctgcagaagatcgtgctgcacgaggtggaggctgatgtggcccaggtgaggaacagcgccacagaggccctgctgtggctgaagaggggcctgaagttcctgaagggcttcctgacagaggtgaagaatggagagaaggacatccagacagccctgaggaaccccacagagaacacctag

SEQ ID NO: 18412 - DNA, 1272 bp, Artificial Sequence
  Description of Artificial Sequence: Synthetic coding sequence
atggccatctgccagttcttcctgcagggccgctgccgctttggagaccgctgctggaatgagcaccctggggcccggggggccggcggcggccggcagcagccccagcagcagcccagcggcaacaacagaagaggctggaacaccaccagccagcgctacagcaatgtcatccagcccagcagcttcagcaagagcaccccctggggcggcagccgggaccaggagaagccctacttcagcagctttgattctggggccagcaccaacaggaaggagggcttcggcctgtctgagaacccctttgccagcctgagcccagatgagcagaaggatgagaagaagctgctggagggcatcgtgaaggacatggaggtgtgggagagcagcggccagtggatgttttctgtgtacagccctgtgaagaagaagcccaacatcagcggcttcacagacatcagccctgaggagctgcggctggagtaccacaacttcctgaccagcaacaacctgcagagctacctgaacagcgtgcagaggctcatcaaccagtggaggaacagagtgaatgagctgaagagcctgaacatcagcaccaaggtggccctgctgagtgatgtgaaggatggagtgaaccaggccgccccagccttcggcttcggcagcagccaggccgccaccttcatgagccctggcttccctgtgaacaacagcagcagtgacaatgcccagaacttctccttcaagaccaacagcggctttgctgctgccagcagcggcagccctgctggcttcggcagcagccctgcctttggagctgctgccagcaccagcagcggcatcagcaccagcgccccagccttcggctttgggaagccagaggtgaccagcgctgccagcttctccttcaagagccctgctgccagcagctttggcagccctggcttcagcggcctgcctgccagcctggccactggacctgtgcgggcccctgtggccccagccttcggcggcggcagctctgtggccggcttcggcagccctggcagccacagccacacagccttcagcaagcccagcagtgacaccttcggcaacagcagcatcagcaccagcctgagcgccagcagcagcatcatcgccacagacaacgtgctcttcaccccccgggacaagctgactgtggaggagctggagcagttccagagcaagaagttcaccctgggcaagatccccctgaagcccccacccctggagctgctgaatgtgtag

SEQ ID NO: 18413 - DNA, 1323 bp, Artificial Sequence
  Description of Artificial Sequence: Synthetic coding sequence
atgatggctgatgaggaggaggaggtgaagcccatcctgcagaagctgcaggagctggtggaccagctgtacagcttccgggactgctactttgagacccacagcgtggaggatgctggcaggaagcagcaggatgtgcagaaggagatggagaagaccctgcagcagatggaggaggtggtgggctctgtgcagggcaaggcccaggtgctgatgctgaccgggaaggccctgaatgtgaccccagactacagccccaaggccgaggagctgctgagcaaggctgtgaagctggagcctgagctggtggaggcctggaaccagctgggggaggtgtactggaagaagggagatgtggccgccgcccacacctgcttcagcggggccctgacccactgcaggaacaaggtgtccctgcagaacctgtccatggtgctgcggcagctgaggacagacacagaagatgagcacagccaccacgtgatggacagcgtgcggcaggccaagctggccgtgcagatggatgtgcatgatggccgctcctggtacatcctgggcaacagctacctgagcctgtacttcagcacaggccagaaccccaagatcagccagcaggccctgagcgcctatgcccaggccgagaaggtggacaggaaggccagcagcaacccagacctgcacctgaacagagccaccctgcacaagtatgaggagagctatggagaggccctggagggcttcagcagagctgctgccctggaccctgcctggccagagccccggcagcgggagcagcagctgctggagttcctggaccggctgaccagcctgctggagagcaagggcaaggtgaagaccaagaagctgcagagcatgctgggcagcctgcggcctgcccacctgggcccctgcagtgatggccactaccagagcgccagcggccagaaggtgaccctggagctgaagcccctgagcaccctgcagcccggggtgaacagcggggctgtgatcctgggcaaggtggtgttcagcctgaccacagaggagaaggtgcccttcaccttcggcctggtggacagtgatggcccctgctatgctgtgatggtgtacaacatcgtgcagagctggggcgtgctgattggagacagcgtggccatccctgagcccaacctgcggctgcaccgcatccagcacaagggcaaggactacagcttcagctctgtgcgggtggagacccccctgctgctggtggtgaatggcaagccccagggcagcagcagccaggccgtggccaccgtggccagccggccccagtgtgagtag

SEQ ID NO: 18414 - DNA, 1341 bp, Artificial Sequence
  Description of Artificial Sequence: Synthetic coding sequence
atggaggagaccatcaaggacccccccaccagcgctgtgctgctggaccactgccacttcagccaggtgatcttcaacagcgtggagaagttctacatccctggaggagatgtgacctgccactacaccttcacccagcacttcatccccaggaggaaggactggattggcatcttccgggtgggctggaagaccacccgggagtactacaccttcatgtgggtgaccctgcccatcgacctgaacaacaagagcgccaagcagcaggaggtgcagttcaaggcctactacctgcccaaggatgatgagtactaccagttctgctacgtggatgaagatggagtggtgcggggggccagcatccccttccagttccggccagaaaatgaggaggacatcctggtggtgaccacccagggcgaggtggaggagattgagcagcacaacaaggagctgtgcaaggagaaccaggagctgaaggacagctgcatcagcctgcagaagcagaacagcgacatgcaggccgagctgcagaagaagcaggaggagctggagaccctgcagagcatcaacaagaagctggagctgaaggtgaaggagcagaaggactactgggagacagagctgctgcagctgaaggagcagaaccagaagatgagcagtgaaaatgagaagatgggcatccgggtggaccagctgcaggcccagctgagcacccaggagaaggagatggagaagctggtgcagggcgaccaggacaagacagagcagctggagcagctgaagaaggaaaatgaccacctgttcctgagcctgacagagcagaggaaggaccagaagaagctggagcagacagtggagcagatgaagcagaatgagaccacagccatgaagaagcagcaggagctgatggatgagaactttgacctgagcaagaggctgtctgaaaatgagatcatctgcaatgccctgcagaggcagaaggagcggctggagggggagaatgacctgctgaagcgggagaacagccggctgctgagctacatgggcctggacttcaacagcctgccctaccaggtgcccaccagtgatgagggcggggcccggcagaaccctggcctggcctacggcaacccctacagcggcatccaggagagcagcagccccagccccctgagcatcaagaagtgccccatctgcaaggcagatgacatctgtgaccacaccctggagcagcagcagatgcagcccctgtgcttcaactgccccatctgtgacaagatcttccctgccacagagaagcagatctttgaggaccacgtgttctgccacagcctgtag

SEQ ID NO: 18415 - DNA, 1329 bp, Artificial Sequence
  Description of Artificial Sequence: Synthetic coding sequence
atggccctgcccggggcccgggcccggggctgggccgccgccgcccgggccgcccagaggagaagaagagtggagaatgccggcggcagccccagccctgagcccgccggccggcgggccgccctgtatgtgcactggccctactgtgagaagcgctgcagctactgcaacttcaacaagtacatcccccggcggctggaggaggccgccatgcagaagtgcctggtgacagaggcccagaccctgctgcggctgagcggcgtgcagagggtggagagcgtcttcttcggcggcggcacccccagcctggccagcccccacacagtggccgctgtgctggaggccgtggcccaggccgcccacctgcctgctgacctggaggtgaccctggaggccaaccccaccagcgcccctggcagccggctggccgagtttggagctgctggggtgaaccggctgagcatcggcctgcagagcctggatgacacagagctgcggctgctgggccgcacccacagcgcctgtgatgccctgcggaccctggccgaggcccggcggctcttccctggccgggtgtctgtggacctgatgctgggcctgcctgcccagcaggtgggcccctggctgggccagctgcaggagctgctgcaccactgtgatgaccacctgagcctgtaccagctgagcctggagcggggcacagccctgtttgcccaggtgcagagaggagccctgcctgccccagaccctgagctggccgctgagatgtaccagaggggccgggctgtgctgcgggaggccggcttccaccagtatgaggtgagcaactttgccagaaatggagccctgagcacccacaactggacctactggcagtgtggccagtacctgggcgtgggccctggggcccacggccgcttcatgccccagggcgctgggggccacacccgggaggcccgcatccagaccctggagccagacaactggatgaaggaggtgatgctgtttggccacggcaccaggaagagggtgcccctgggccgcctggagctgctggaggaggtgctggccctgggcctgaggacagatgtgggcatcacccaccagcactggcagcagtttgagccccagctgaccctgtgggatgtgtttggagccaacaaggaggtgcaggagctgctggagcggggcctgctgcagctggaccaccggggcctgcgctgctcctgggagggcctggccgtgctggacagcctgctgctgaccctgctgccccagctgcaggaggcctggcagcagaggacccccagccctgtgcctgggggctag

SEQ ID NO: 18416 - DNA, 1278 bp, Artificial Sequence
  Description of Artificial Sequence: Synthetic coding sequence
atggacaagaacattggagagcagctgaacaaggcctatgaggccttccggcaggcctgcatggaccgggacagcgctgtgaaggagctgcagcagaagacagaaaattatgagcagaggatccgggagcagcaggagcagctgagcctgcagcagaccatcatcgacaagctgaagagccagctgctgctggtgaacagcacccaggacaacaactacggctgtgtgcccctgctggaggacagcgagaccaggaagaacaacctgaccctggaccagccccaggacaaggtgatcagcggcatcgcccgggagaagctgcccaaggtgcggcggcaggaggtgagcagccccaggaaggagaccagcgcccggagcctgggcagccccctgctgcacgagcggggcaacatcgagaagaccttctgggacctgaaggaggagttccacaagatctgcatgctggccaaggcccagaaggaccacctgagcaagctgaacatcccagacacagccacagagacccagtgcagcgtgcccatccagtgcacagacaagacagacaagcaggaggccctcttcaagccccaggccaaggatgacatcaacagaggagcccccagcatcacctctgtgaccccccggggcctgtgcagagatgaggaggacaccagctttgagagcctgagcaagttcaacgtgaagtttcctcccatggacaatgacagcaccttcctgcacagcaccccagagaggcctggcatcctgagccctgccaccagcgaggccgtgtgccaggagaagttcaacatggagttccgggacaaccctggcaactttgtgaagacagaggagaccctgtttgagatccagggcatcgaccccatcgccagcgccatccagaacctgaagaccacagacaagaccaagcccagcaacctggtgaacacctgcatccgcaccaccctggaccgggccgcctgcctgcccccaggggaccacaatgccctgtatgtgaacagcttccccctgctggaccccagtgatgcccccttccccagcctggacagccctgggaaggccatccggggcccccagcagcccatctggaagcccttccccaaccaggacagcgacagcgtggtgctgagcggcacagacagcgagctgcacatcccccgggtgtgtgagttctgccaggccgtgttcccccccagcatcaccagcagaggagacttcctgcggcacctgaacagccacttcaacggggagacctag

SEQ ID NO: 18417 - DNA, 2055 bp, Artificial Sequence
  Description of Artificial Sequence: Synthetic coding sequence
atggagaacctgcagaccaacttcagcctggtgcagggcagcaccaagaagctgaatggcatgggagatgatggcagccccccagccaagaagatgatcacagacatccacgccaacgggaagaccatcaacaaggtgcccaccgtgaagaaggagcacctggatgattatggagaggcccctgtggagacagatggagagcacgtgaagaggacctgcacctctgtgcctgagaccctgcacctgaaccccagcctgaagcacaccctggcccagttccacctgagcagccagagcagcctgggcggccctgctgccttcagcgcccggcacagccaggagagcatgagccccaccgtcttcctgcccctgcccagcccccaggtgctgcccggccccctgctgatccccagcgacagcagcacagagctgacccagacagtgctggagggggagagcatcagctgcttccaggtgggcggggagaagaggctgtgcctgccccaggtgctgaacagcgtgctgcgggagttcaccctgcagcagatcaacacagtgtgtgatgagctgtacatctactgcagccgctgcaccagtgaccagctgcacatcctgaaggtgctgggcatcctgcccttcaatgcccccagctgtggcctcatcaccctgacagatgcccagaggctgtgcaatgccctgctgcggcccaggaccttcccccagaatggatctgtgctgcctgccaagagcagcctggcccagctgaaggagaccggcagcgcctttgaggtggagcatgaatgtctgggcaagtgccagggcctgtttgccccccagttctacgtgcagccagatgccccctgcatccagtgcctggagtgctgcggcatgtttgccccccagacctttgtgatgcacagccacaggagcccagacaagaggacctgccactggggctttgagagcgccaagtggcactgctacctgcacgtgaaccagaagtacctgggcaccccagaggagaagaagctgaagatcatcctggaggagatgaaggagaagttctccatgaggtctgggaagaggaaccagagcaagacagatgcccccagcggcatggagctgcagagctggtaccctgtgatcaagcaggagggggaccacgtgtcccagacccacagcttcctgcaccccagctactacctgtacatgtgtgacaaggtggtggcccccaacgtgtccctgaccagcgctgtgtcccagagcaaggagctgaccaagacagaggccagcaagagcatcagccggcagagcgagaaggcccacagcagcggcaagctgcagaagacagtgtcctacccagatgtgtccctggaggagcaggagaagatggacctgaagaccagccgggagctgtgcagccggctggatgccagcatcagcaacaacagcaccagcaagaggaagtctgagagcgccacctgcaacctggtgcgggacatcaacaaggtgggcatcggcctggtggccgccgccagcagccccctgctggtgaaggatgtgatctgtgaagatgacaagggcaagatcatggaggaggtgatgaggacctacctgaagcagcaggagaagctgaacctgatcctgcagaagaagcagcagctgcagatggaggtgaagatgctgagcagcagcaagtccatgaaggagctgacagaggagcagcagaacctgcagaaggagctggagagcctgcagaatgaacatgcccagaggatggaggagttctacgtggagcagaaggacctggagaagaagctggagcagatcatgaagcagaagtgcacctgtgacagcaacctggagaaggacaaggaggccgagtatgccggccagctggccgagctgcggcagaggctggaccatgctgaggccgaccggcaggagctgcaggatgagctgcggcaggagcgggaggcccggcagaagctggagatgatgatcaaggagctgaagctgcagatcctgaagagcagcaagacagccaaggagtag

SEQ ID NO: 18418 - DNA, 1080 bp, Artificial Sequence
  Description of Artificial Sequence: Synthetic coding sequence
atgagctaccgccgggagctggagaagtacagagacctggatgaagatgagatcctgggcgccctgacagaggaggagctgcggaccctggagaatgagctggatgagctggaccctgacaatgccctgctgcctgctggcctgcggcagaaggaccagaccaccaaggcccccaccggccccttcaagcgggaggagctgctggaccacctggagaagcaggccaaggagttcaaggaccgggaggacctggtgccctacaccggggagaagaggggcaaggtgtgggtgcccaagcagaagcccctggaccctgtgctggagagcgtgaccctggagcctgagctggaggaggccctggccaatgccagtgatgctgagctgtgtgacattgctgccatcctgggcatgcacaccctgatgagcaaccagcagtactaccaggccctgagcagcagcagcatcatgaacaaggagggcctgaacagcgtcatcaagcccacccagtacaagcctgtgcctgatgaggagcccaacagcacagatgtggaggagaccctggagcgcatcaagaacaatgaccccaagctggaggaggtgaacctgaacaacatccggaacatccccatccccaccctgaaggcctatgcagaggccctgaaggagaacagctatgtgaagaagttcagcatcgtgggcaccaggagcaatgaccctgtggcctatgccctggccgagatgctgaaggagaacaaggtgctgaagaccctgaatgtggagagcaacttcatctctggagctggcatcctgcggctggtggaggccctgccctacaacaccagcctggtggagatgaagattgacaaccagagccagcccctgggcaacaaggtggagatggagatcgtgtccatgctggagaagaatgccaccctgctgaagtttggctaccacttcacccagcagggcccccggctgcgggccagcaatgccatgatgaacaacaatgacctggtgaggaagaggcggctggccgacctgaccggccccatcatccccaagtgccgctctggagtgtag

SEQ ID NO: 18419 - DNA, 1941 bp, Artificial Sequence
  Description of Artificial Sequence: Synthetic coding sequence
atggaggagcggggcagcccagatggagacctggcccggagcctggagcagggccctgagggccctgagacccccatccaggtggtgctgcgggtgcggcccatgtctgctgctgagctgcggcggggccagcagagcgtgctgcactgcagcggcaccaggaccctgcagggcggccctgaggtggccttccgctttggagctgtgctggatgctgcccggacccaggaggatgtgttccgggcctgtggggtgcggcggctgggggagctggccctgcggggcttcagctgcaccgtcttcaccttcggccagacaggcagcggcaagacctacaccctgactggacctccaccccagggcgagggcgtgcctgtgccccccagcctggccggcatcatgcagaggacctttgcctggctgctggacagagtgcagcacctgggcgcccctgtgaccctgcgggccagctacctggagatctacaatgagcaggtgcgggacctgctgagcctgggcagcccccggcccctgcctgtgcgctggaacaagacccggggcttctacgtggagcagctgcgggtggtggagtttggcagcctggaggccctgatggagctgctgcagacaggcctgagcagaagaagaaacagcgcccacaccctgaaccaggccagcagccgcagccacgccctgctgaccctgtacatcagccggcagacagcccagcagatgcccagcgtggaccccggggagccccctgtgggcggcaagctgtgctttgtggacctggccggcagcgagaaggtggccgccaccggcagcagaggagagctgatgctggaggccaacagcatcaacagaagcctgctggccctgggccactgcatcagcctgctgctggacccccagaggaagcagagccacatccccttccgggacagcaagctgaccaagctgctggccgacagcctgggcggccggggcgtgaccctgatggtggcctgtgtgagccccagcgcccagtgcctgcctgagaccctgagcaccctgcgctatgccagccgggcccagagggtgaccacccggccccaggcccccaagagccctgtggccaagcagccccagaggctggagacagagatgctgcagctgcaggaggagaacagaaggctgcagttccagctggaccagatggactgcaaggccagcggcctgagcggggcccgggtggcctgggcccagaggaacctgtatggcatgctgcaggagttcatgctggagaatgaaaggctgaggaaggagaagagccagctgcagaacagccgggacctggcccagaatgagcagaggatcctggcccagcaggtgcacgccctggagcggcggctgctgagcgcctgctaccaccaccagcagggccctggcctgaccccaccctgcccctgcctgatggccccagccccaccctgccacgccctgccccccctgtacagctgcccctgctgccacatctgccccctgtgccgggtgcccctggcccactgggcctgcctgcccggggagcaccacctgccccaggtgctggaccctgaggccagcggcggccggccccccagcgcccggcccccaccctgggccccaccctgcagccctggcagcgccaagtgcccccgggagaggagccacagcgactggacccagaccagggtgctggccgagatgctgacagaggaggaggtggtgcccagcgccccacccctgcctgtgcggccccccaagaccagccctggcctgcggggcggggccggcgtgcccaacctggcccagaggctggaggccctgcgggaccagatcggcagcagcctgcggcggggccgcagccagcccccctgcagcgagggcgcccggagccctggccaggtgctgcccccccactag

SEQ ID NO: 18420 - DNA, 462 bp, Artificial Sequence
  Description of Artificial Sequence: Synthetic coding sequence
atggccaggaacaccctgagcagccgcttcagaagagtggacattgatgaatttgatgagaacaagtttgtggatgagcaggaggaggccgctgctgctgctgctgagcccggccctgaccccagcgaggtggatggcctgctgcggcagggcgacatgctgcgggccttccacgccgccctgaggaacagccctgtgaacaccaagaaccaggccgtgaaggagcgggcccagggcgtggtgctgaaggtgctgaccaacttcaagagcagcgagattgagcaggccgtgcagagcctggacagaaatggagtggacctgctgatgaagtacatctacaagggctttgagaagcccacagagaacagcagcgctgtgctgctgcagtggcatgagaaggccctggccgtgggcggcctgggcagcatcatccgggtgctgacagccaggaagacagtgtag

SEQ ID NO: 18421 - DNA, 3318 bp, Artificial Sequence
  Description of Artificial Sequence: Synthetic coding sequence
atggccgccacagccagcgctggggtgcctgccaccgtgtctgagaagcaggagttctaccagctgctgaagaacctgatcaaccccagctgcatggtgcggcggcaggccgaggagatctatgagaacatccctggcctgtgcaagaccaccttcctgctggatgctgtgaggaacagaagagctggctatgaggtgcggcagatggctgctgccctgctgcggcggctgctgagcagcggctttgaggaggtgtaccccaacctgcctgcagatgtgcagagagatgtgaagattgagctgatcctggccgtgaagctggagacccacgcctccatgaggaagaagctgtgtgacatctttgctgtgctggccaggaacctgattgatgaagatggcaccaaccactggccagagggcctgaagttcctgattgacagcatctacagcaagaatgtggtgctgtgggaggtggccctgcacgtgttctggcacttccctggcatcttcggcacccaggagagacatgacctggacatcatcaagaggctgctggaccagtgcatccaggaccaggagcacccagccatccgcaccctgagcgcccgggctgctgctgcctttgtgctggccaatgaaaacaacatcgccctcttcaaggactttgctgacctgctgcccggcatcctgcaggccgtgaatgacagctgctaccaggatgatgattctgtgctggagagcctggtggagattgctgacacagtgcccaagtacctgggcccctacctggaggacaccctgcagctgagcctgaagctgtgtggggacagccggctgagcaacctgcagaggcagctggccctggaggtgattgtgaccctgtctgaaacagccacccccatgctgaagaagcacaccaacatcatcgcccaggccgtgccccacatcctggccatgatggtggacctgcaggatgatgaggactgggtgaatgctgatgagatggaggaggatgactttgacagcaatgctgtggccgctgagagcgccctggaccggctggcctgtggcctgggcggcaaggtggtgctgcccatgaccaaggagcacatcatgcagatgctgcagagcccagactggaagtacagacatgctggcctgatggccctgagcgccatcggggagggctgccaccagcagatggagagcatcctggatgagaccgtgaacagcgtgctgctcttcctgcaggacccccacccccgggtgcgggccgccgcctgcaccaccctgggccagatggccacagactttgcccccaacttccagaagaagttccatgaaacagtgattgctgccctgctgcggaccatggagaaccagggcaaccagagggtgcagagccacgccgccagcgccctgatcatcttcatcgaggactgccccaagagcctgctggtgctgtatgtggacagcatggtgaagaacctgcacagcgtgctggtgatcaagctgcaggagctgatcagaaatggcaccaagctggccctggagcagctggtgaccaccatcgcctctgtggccgacaccatcgaggagaagtttgtgccctactatgacatcttcatgcccagcctgaagcacatcgtggagctggccgtgcagaaggagctgaagctgctgcggggcaagaccatcgagtgcatcagccacatcggcctggccgtgggcaaggagaagttcatgcaggatgccagcaatgtgatgcagctgctgctgaagacccagagcgacctgaacaacatggaggatgatgacccccagaccagctacatggtgtctgcctgggccaggatgtgcaagatcctgggcaaggacttccagcagtacctgcccctggtgattgagcccctcatcaagacagccagcgccaagccagatgtggccctgctggacacccaggatgtggagaacatgtctgatgatgatggctggcagtttgtgaacctgggggaccagcagagctttggcatcaagaccagcggcctggaggccaaggccacagcctgccagatgctggtgtactatgccaaggagctgcgggagggctttgtggagtacacagagcaggtggtgaagctgatggtgcccctgctgaagttctacttccatgacaacgtgcgggtggccgctgctgagagcatgcccttcctgctggagtgtgcccgcatccggggccctgagtacctggcccagatgtggcagttcatctgtgaccccctcatcaaggccatcggcacagagccagacacagatgtgctgtctgagatcatgaacagctttgccaagagcattgaggtgatgggagatggctgcctgaatgatgagcacctggaggagctgggcggcatcctgaaggccaagctggagggccacttcaagaaccaggagctgcggcaggtgaagaggcaggaggagaactatgaccagcaggtggagatgagcctgcaggatgaagatgaatgtgatgtgtacatcctgaccaaggtgtctgacatcctgcacagcctcttcagcacctacaaggagaagatcctgccctggtttgagcagctgctgcccctcatcgtgaacctgatctgcagcagccggccctggccagaccggcagtggggcctgtgcatctttgatgacatcatcgagcactgcagccccaccagcttcaagtatgtggagtacttccgctggcccatgctgctgaacatgagggacaacaaccctgaggtgcggcaggccgccgcctacggcctgggcgtgatggcccagtttggaggagatgactaccgcagcctgtgcagcgaggccgtgcccctgctggtgaaggtgatcaagtgtgccaacagcaagaccaagaagaatgtgattgccacagagaactgcatcagcgccatcggcaagatcctgaagttcaagcccaactgtgtgaatgtggatgaggtgctgccccactggctgtcctggctgcccctgcacgaggacaaggaggaggccatccagaccctgtccttcctgtgtgacctgattgagagcaaccaccctgtggtgattggccccaacaacagcaacctgcccaagatcatcagcatcatcgccgagggcaagatcaatgagaccatcaactatgaggacccctgtgccaagaggctggccaacgtggtgcggcaggtgcagaccagcgaggacctgtggctggagtgtgtgtcccagctggatgatgagcagcaggaggccctgcaggagctgctgaactttgcctag

SEQ ID NO: 18422 - DNA, 1914 bp, Artificial Sequence
  Description of Artificial Sequence: Synthetic coding sequence
atggaggtgacaggcttcggcgtgaccaggcctgggaaggtgccccaggccaggatgagcggcctggtgctgggccagagagatgagcctgctggccaccggctgagccaggaggagatcctgggcagcacccggctggtgtcccagggcctggaggccctgcggtctgagcaccaggccgtgctgcagagcctgagccagaccatcgagtgcctgcagcagggcggccacgaggagggcctggtgcatgagaaggcccggcagctgcggcgctccatggagaacatcgagctgggcctgtctgaggcccaggtgatgctggccctggccagccacctgagcacagtggagagcgagaagcagaagctgcgggcccaggtgcggcggctgtgccaggagaaccagtggctgagagatgagctggccggcacccagcagaggctgcagaggtctgagcaggccgtggcccagctggaggaggagaagaagcacctggagttcctgggccagctgcggcagtatgatgaagatggccacaccagcgaggagaaggagggagatgccaccaaggacagcctggatgacctcttccccaatgaggaggaggaggaccccagcaatggcctgagccggggccagggcgccacagctgcccagcagggcggctatgagatcccagcccggctgcggaccctgcacaacctggtgatccagtatgctgcccagggccgctatgaggtggccgtgcccctgtgcaagcaggccctggaggacctggagaggaccagcggccggggccacccagatgtggccaccatgctgaacatcctggccctggtgtacagagaccagaacaagtacaaggaggccgcccacctgctgaatgatgccctgagcatccgggagagcaccctgggccctgaccaccctgctgtggccgccaccctgaacaacctggccgtgctgtatggcaagaggggcaagtacaaggaggccgagcccctgtgccagagggccctggagatccgggagaaggtgctgggcaccaaccacccagatgtggccaagcagctgaacaacctggccctgctgtgccagaaccagggcaagtatgaagctgtggagcgctactaccagagggccctggccatctatgagggccagctgggccctgacaaccccaacgtggcccggaccaagaacaacctggccagctgctacctgaagcagggcaagtatgcagaggccgagaccctgtacaaggagatcctgacccgggcccacgtgcaggagtttggatctgtggatgatgaccacaagcccatctggatgcacgccgaggagcgggaggagatgagcaagagccgccaccacgagggcggcaccccctatgcagaatatggaggctggtacaaggcctgcaaggtgagcagccccaccgtgaacaccaccctgaggaacctgggcgccctgtaccgccggcagggcaagctggaggccgctgagaccctggaggagtgtgccctgcggagccggcggcagggcacagaccccatcagccagaccaaggtggccgagctgctgggggagagtgatggccgccgcaccagccaggagggccctggggacagcgtgaagtttgaaggaggagaagatgcctctgtggccgtggagtggagcggagatggcagcggcaccctgcagaggagcggcagcctgggcaagatcagagatgtgctgcggcgcagcagcgagctgctggtgaggaagctgcagggcacagagccccggcccagcagcagcaacatgaagagagctgccagcctgaactacctgaaccagcccagcgctgcccccctgcaggtgtcccggggcctgagcgccagcaccatggacctgagcagcagcagctag

SEQ ID NO: 18423 - DNA, 3966 bp, Artificial Sequence
  Description of Artificial Sequence: Synthetic coding sequence
atgcagtgcctggccgccgccctgaaggatgagaccaacatgtctgggggcggggagcaggccgacatcctgcctgccaactacgtggtgaaggaccgctggaaggtgctgaagaagattggaggcggcggctttggagagatctatgaggccatggacctgctgacccgggagaatgtggccctgaaggtggagagcgcccagcagcccaagcaggtgctgaagatggaggtggccgtgctgaagaagctgcagggcaaggaccacgtgtgccgcttcatcggctgcggcagaaatgagaagttcaactacgtggtgatgcagctgcagggcaggaacctggccgacctgcggcgcagccagccccggggcaccttcaccctgagcaccaccctgcggctgggcaagcagatcctggagagcattgaggccatccacagcgtgggcttcctgcaccgggacatcaagcccagcaactttgccatgggccgcctgcccagcacctacaggaagtgctacatgctggactttggcctggcccggcagtacaccaacaccactggagatgtgcggcccccaagaaatgtggccggcttccggggcaccgtgcgctatgcctctgtgaatgcccacaagaaccgggagatgggcagacatgatgacctgtggagcctcttctacatgctggtggagtttgctgtgggccagctgccctggaggaagatcaaggacaaggagcaggtgggcatgatcaaggagaagtatgagcacaggatgctgctgaagcacatgcccagcgagttccacctgttcctggaccacatcgccagcctggactacttcaccaagccagactaccagctgatcatgtctgtgtttgagaacagcatgaaggagcggggcattgctgaaaatgaggcctttgactgggagaaggccggcacagatgccctgctgagcaccagcaccagcaccccaccccagcagaacacccggcagacagctgccatgtttggagtggtgaatgtgacccctgtgcctggggacctgctgagagaaaatacagaagatgtgctgcagggcgagcacctgagtgaccaggagaatgccccacccatcctgcccggccggcccagcgagggcctgggccccagcccccacctggtgccccaccctgggggccctgaggccgaggtgtgggaggagacagatgtgaacagaaacaagctgcgcatcaacatcggcaagagcccctgtgtggaggaggagcagagccggggcatgggcgtgcccagcagccctgtgcgggcccccccagacagccccaccacccctgtgcgcagcctgcgctaccgccgggtgaacagccctgagagcgagcggctgagcacagcagatggccgggtggagctgcctgagcggcgcagcaggatggacctgcccggcagccccagccggcaggcctgcagcagccagcctgcccagatgctgtctgtggacaccggccacgccgaccggcaggccagcggccgcatggatgtgtctgcctctgtggagcaggaggccctgagcaatgccttccgctctgtgcccctggccgaggaggaggactttgacagcaaggagtgggtgatcatcgacaaggagacagagctgaaggacttccccccaggagctgagcccagcaccagcggcaccacagatgaggagcctgaggagctgcggcccctgcctgaggagggggaggagcggcggcggctgggcgctgagcccaccgtgcggccccggggccgctccatgcaggccctggccgaggaggacctgcagcacctgcccccccagcccctgcccccccagctgagccagggagatggccgctctgagaccagccagccccccaccccaggcagccccagccacagccccctgcacagcggcccccggcccaggagaagagaaagtgaccccaccggcccccagaggcaggtgttttctgtggcccccccatttgaggtgaatggcctgcccagggctgtgcccctgagcctgccctaccaggacttcaagagggacctgagtgactaccgggagcgggcccggctgctgaacagagtgcggcgggtgggcttcagccacatgctgctgaccaccccccaggtgcccctggcccctgtgcagccccaggccaacgggaaggaggaggaggaggaggaggaggaggatgaggaggaggaggaggaggatgaggaggaggaggaggaggaggaggaggaggaggaggaggaggaggaggaggaggaggaggaggaggaggccgctgctgctgtggccctgggggaggtgctgggccccaggagcggcagcagcagcgagggcagcgagaggagcacagacaggagccaggagggcgcccccagcaccctgctggctgatgaccagaaggagagccggggccgggcctccatggctgatggagacctggagcctgaggagggcagcaagaccctggtgctggtgtcccctggggacatgaagaagagccctgtgacagctgagctggccccagaccctgacctgggcaccctggccgccctgaccccccagcacgagcggccccagcccaccggcagccagctggatgtgtctgagcccggcaccctgagctctgtgctgaagtctgagcccaagcccccaggccctggggccggcctgggcgccggcaccgtgaccactggagtgggcggcgtggccgtgaccagcagccccttcaccaaggtggagaggacctttgtgcacatcgccgagaagacccacctgaatgtgatgagcagcggcggccaggccctgcggtctgaggagttctctgctggaggagagctgggcctggagctggccagtgatggaggagctgtggaggagggcgcccgggcccccctggagaatggcctggccctgagcggcctgaatggagctgagattgagggcagcgccctgagcggggccccccgggagaccccatctgagatggccaccaacagcctgcccaacggccctgccctggctgatggccctgcccctgtgagccccctggagcccagccctgagaaggtggccaccatcagccccaggagacatgccatgcctggcagccggcccaggagccgcatccctgtgctgctgtctgaagaagatactggaagtgagcccagcggcagcctgagcgccaaggagcgctggagcaagagggcccggccccagcaggacctggcccggctggtgatggagaagaggcagggccgcctgctgctgcggctggccagcggggccagcagcagcagcagcgaggagcagaggcgggccagcgagaccctgtctggaactggaagtgaggaggacaccccagccagcgagcctgctgctgccctgcccaggaagagcggccgggccgccgccaccaggagccgcatcccccggcccatcggcctgaggatgcccatgcctgtggccgcccagcagcctgccagccgcagccacggggccgccccagccctggacacagccatcaccagccggctgcagctgcagaccccacctggcagcgccacagctgctgacctgcggcccaagcagcccccaggccggggcctgggccctggccgggcccaggccggggcccggcccccagcccccaggagcccccggctgcctgccagcaccagcgctgccagaaatgccagcgccagccccaggagccagagcctgagccggcgggagagccccagccccagccaccaggcccggcctggggtgcccccaccccggggcgtgcccccagcccgggcccagccagatggcacccccagccctgggggcagcaagaagggcccccggggcaagctgcaggcccagagggccaccaccaagggccgggccggcggcgctgagggccgggccggggccaggtag

SEQ ID NO: 18424 - DNA, 1818 bp, Artificial Sequence
  Description of Artificial Sequence: Synthetic coding sequence
atgagccagctgagcagcaccctgaagcgctacacagagagcgcccgctacacagatgcccactacgccaagagcggctatggagcctacacccccagcagctatggagccaacctggccgccagcctgctggagaaggagaagctgggcttcaagcctgtgcccaccagcagcttcctgacccggcccaggacctacggccccagcagcctgctggactatgaccggggccggcccctgctgcggccagacatcaccggcggcggcaagagagctgagagccagacccggggcacagagcggcccctgggcagcggcctgagcggcggcagcggcttcccctatggagtgaccaacaactgcctgagctacctgcccatcaatgcctatgaccagggcgtgaccctgacccagaagctggacagccagagcgacctggcccgggacttcagcagcctgcggaccagtgacagctacagaattgaccccaggaacctgggccgcagccccatgctggcccggaccaggaaggagctgtgcaccctgcagggcctgtaccagacagccagctgcccagagtacctggtggactacctggagaactacggcaggaaaggaagtgccagccaggtgcccagccaggccccacccagccgggtgcctgagatcatcagccccacctaccggcccatcggccgctacaccctgtgggagaccgggaagggccaggcccctggccccagccgcagcagcagccctggaagagatggcatgaacagcaagagcgcccagggcctggccggcctgaggaacctgggcaacacctgcttcatgaacagcatcctgcagtgcctgagcaacacccgggagctgcgggactactgcctgcagaggctgtacatgagggacctgcaccacggcagcaatgcccacacagccctggtggaggagtttgccaagctgatccagaccatctggaccagcagccccaatgatgtggtgagccccagcgagttcaagacccagatccagagatatgcccccaggtttgtgggctacaaccagcaggatgcccaggagttcctgcgcttcctgctggatggcctgcacaatgaggtgaacagagtgaccctgcggcccaagagcaaccctgagaacctggaccacctgcctgatgatgagaagggccggcagatgtggaggaagtacctggagcgggaggacagcagaattggagacctgtttgtgggccagctgaagagcagcctgacctgcacagactgtggctactgcagcacagtgtttgaccccttctgggacctgagcctgcccatcgccaagaggggctacccagaggtgaccctgatggactgcatgaggctcttcaccaaggaggatgtgctggatggagatgagaagcccacctgctgccgctgccggggcaggaagcgctgcatcaagaagttcagcatccagcgcttccccaagatcctggtgctgcacctgaagcgcttcagcgagagccgcatccgcaccagcaagctgaccacctttgtgaacttccccctgcgggacctggacctgcgggagtttgccagcgagaacaccaaccacgctgtgtacaacctgtatgctgtgagcaaccacagcggcaccaccatgggcggccactacacagcctactgccgcagccctggcactggagagtggcacaccttcaatgacagctctgtgacccccatgagcagcagccaggtgaggaccagtgatgcctacctgctcttctatgagctggccagcccccccagcaggatgtag

SEQ ID NO: 18425 - DNA, 1353 bp, Artificial Sequence
  Description of Artificial Sequence: Synthetic coding sequence
atggtgcccctggtggccgtggtgtctggcccccgggcccagctgtttgcctgcctgctgcggctgggcacccagcaggtgggccccctgcagctgcacactggagccagccatgctgccaggaaccactatgaggtgctggtgctgggcggcggcagcggcggcatcaccatggccgccaggatgaagaggaaggtgggcgcagaaaatgtggccatcgtggagcccagcgagcggcacttctaccagcccatctggaccctggtgggcgctggggccaagcagctgagcagcagcggccggcccacagccagcgtcatccccagcggcgtggagtggatcaaggcccgggtgacagagctgaacccagacaagaactgcatccacacagatgatgatgagaagatctcctaccgctacctgatcatcgccctgggcatccagctggactatgagaagatcaagggcctgcctgagggctttgcccaccccaagattggcagcaactacagcgtgaagacagtggagaagacctggaaggccctgcaggacttcaaggagggcaatgccatcttcaccttccccaacacccctgtgaagtgtgccggggccccccagaagatcatgtacctgtctgaggcctacttcaggaagacaggcaagaggagcaaggccaacatcatcttcaacaccagcctgggcgccatctttggagtgaagaagtatgcagatgccctgcaggagatcatccaggagaggaacctgactgtgaactacaagaagaacctgattgaggtgcgggctgacaagcaggaggccgtgtttgagaacctggacaagccaggagagacccaggtgatctcctatgagatgctgcacgtgaccccacccatgagccccccagatgtgctgaagaccagccctgtggctgatgctgctggctgggtggatgtggacaaggagaccctgcagcaccggcgctaccccaacgtgtttggcatcggggactgcaccaacctgcccaccagcaagacagctgctgctgtggccgcccagagcggcatcctggacaggaccatcagcgtcatcatgaagaaccagacccccaccaagaagtatgatggctacaccagctgccccctggtgacaggctacaacagagtcatcctggccgagtttgactacaaggccgagcccctggagaccttcccctttgaccagagcaaggagcggctgtccatgtacctgatgaaggctgacctgatgcccttcctgtactggaacatgatgctgcggggctactggggcggccctgccttcctgaggaagctgttccacctgggcatgtcctag

SEQ ID NO: 18426 - DNA, 5244 bp, Artificial Sequence
  Description of Artificial Sequence: Synthetic coding sequence
atggatggagtgagcagcgaggccaatgaagaaaatgacaacatcgagaggcctgtgagaagaagacacagcagcatcctgaagcccccaagaagccccctgcaggacctgcggggcggcaatgaaagagtgcaggagagcaatgccctgaggaacaagaagaacagcagaagagtgtcctttgctgacaccatcaaggtgttccagacagagagccacatgaagatcgtgaggaagtctgagatggaggagacagaaacaggagagaacctgctgctgatccagaacaagaagctggaggacaactactgtgagatcaccggcatgaacaccctgctgagcgcccccatccacacccagatgcagcagaaggagttcagcatcatcgagcacacccgggagaggaagcacgccaatgaccagaccgtcatcttcagtgatgagaaccagatggacctgaccagcagccacacagtgatgatcaccaagggcctgctggacaaccccatcagcgagaagagcaccaagattgacaccaccagcttcctggccaacctgaagctgcacacagaggacagcaggatgaagaaggaggtgaacttctctgtggaccagaacaccagcagcgagaacaagattgacttcaatgacttcatcaagaggctgaagacaggcaagtgcagcgccttcccagatgtgcctgacaaggaaaattttgagatccccatctacagcaaggagcccaacagcgccagcagcacccaccagatgcacgtgtccctgaaggaggatgagaacaacagcaacatcaccaggctcttccgggagaaggatgatggcatgaacttcacccagtgccacacagccaacatccagaccctcatccccaccagcagcgagaccaacagccgggagagcaaaggaaatgacatcaccatctatggaaatgacttcatggacctgaccttcaaccacaccctgcagatcctgcctgccactggaaacttcagcgagattgagaaccagacccagaatgccatggatgtgaccaccggctacggcaccaaggccagcggcaacaagacagtgttcaagagcaagcagaacacagccttccaggacctgagcatcaacagcgctgacaagatccacatcaccaggagccacatcatgggcgctgagacccacatcgtgtcccagacctgcaaccaggatgcccgcatcctggccatgaccccagagagcatctacagcaaccccagcatccagggctgcaagacagtgttctacagcagctgcaatgatgccatggagatgaccaagtgcctgagcaacatgagggaggagaagaacctgctgaagcatgacagcaactatgccaagatgtactgcaacccagatgccatgagcagcctgacagagaagaccatctacagcggggaggagaacatggacatcaccaagagccacacagtggccatcgacaaccagatcttcaagcaggaccagagcaatgtgcagattgctgctgcccccaccccagagaaggagatgatgctgcagaacctgatgaccaccagtgaagatggcaagatgaatgtgaactgcaacagcgtgccccacgtgtccaaggagcgcatccagcagagcctgagcaaccccctgagcatcagcctgacagacaggaagacagagctgctgagcggggagaacatggacctgacagagagccacaccagcaacctgggcagccaggtgcccctggccgcctacaacctggcccctgagagcaccagcgagagccacagccagagcaagagcagcagtgatgaatgtgaggagatcaccaagagcagaaatgagcccttccagaggagtgacatcatcgccaagaacagcctgacagacacctggaacaaggacaaggactgggtgctgaagatcctgccctacctggacaaggacagcccccagagcgctgactgcaaccaggagatcgccaccagccacaacatcgtgtactgcggcggcgtgctggacaagcagatcaccaacagaaacacagtgtcctgggagcagagcctcttcagcaccaccaagcccctcttcagcagcggccagttctccatgaagaaccacgacacagccatcagcagccacacagtgaagtctgtgctgggccagaacagcaagctggccgagcccctgaggaagagcctgagcaaccccaccccagactactgccacgacaagatgatcatctgcagcgaggaggagcagaacatggacctgaccaagagccacacagtggtgattggcttcggccccagcgagctgcaggagctgggcaagaccaacctggagcacaccaccggccagctgaccaccatgaaccggcagattgctgtgaaggtggagaagtgtgggaagagccccatcgagaagagcggcgtgctgaagagcaactgcatcatggatgtgctggaggatgagagcgtgcagaagcccaagttccccaaggagaagcagaatgtgaagatctggggcaggaagtctgtgggcggccccaagattgacaagaccatcgtgttttctgaagatgacaagaatgacatggacatcaccaagagctacaccatcgagatcaaccaccggcccctgctggagaagagggactgccacctggtgcccctggccggcaccagcgagaccatcctgtacacctgccggcaggatgacatggagatcaccaggagccacaccacagccctggagtgcaagacagtgtccccagatgagatcaccacccggcccatggacaagacagtggtgtttgtggacaaccacgtggagctggagatgacagagagccacacagtgttcatcgactaccaggagaaggagaggacagaccggcccaactttgagctgagccagaggaagagcctgggcacccccaccgtcatctgcacccccacagaggagagcgtcttcttccctggaaatggagagagtgaccggctggtggccaatgacagccagctgacccccctggaggagtggagcaacaacagaggccctgtggaggtggccgacaacatggagctgagcaagagcgccacctgcaagaacatcaaggatgtgcagagccctggcttcctgaatgagcccctgagcagcaagagccagaggaggaagagcctgaagctgaagaatgacaagaccatcgtgttttctgagaaccacaagaatgacatggacatcacccagagctgcatggtggagattgacaatgaaagtgccctggaggacaaggaggacttccacctggccggggccagcaagaccatcctgtacagctgtggccaggatgacatggagatcaccaggagccacaccacagccctggagtgcaagaccctgctgcccaatgagatcgccatccggcccatggacaagacagtgctcttcacagacaactacagcgacctggaggtgacagacagccacacagtgttcatcgactgccaggccacagagaagatcctggaggagaaccccaagtttggaattggcaagggcaagaacctgggcgtgtccttccccaaggacaacagctgtgtgcaggagattgctgagaagcaggccctggccgtgggcaacaagatcgtgctgcacacagagcagaagcagcagctgtttgctgccaccaacagaaccaccaatgagatcatcaagttccacagcgctgccatggatgagaaggtgattggcaaggtggtggaccaggcctgcaccctggagaaggcccaggtggagagctgccagctgaacaacagagacagaagaaatgtggacttcaccagcagccacgccacagctgtgtgtggcagcagtgacaactacagctgcctgcccaacgtcatcagctgcacagacaacctggagggcagcgccatgctgctgtgtgacaaggatgaggagaaggccaactactgccctgtgcagaatgacctggcctatgccaatgactttgccagcgagtactacctggagagcgagggccagcccctgagcgccccctgccccctgctggagaaggaggaggtgatccagaccagcaccaagggccagctggactgtgtgatcaccctgcacaaggaccaggacctgatcaaggaccccaggaacctgctggccaaccagaccctggtgtacagccaggacctgggggagatgaccaagctgaacagcaagagggtgtccttcaagctgcccaaggaccagatgaaggtgtatgtggatgacatctacgtgatcccccagccccacttcagcacagaccagccccccctgcccaagaagggccagagcagcatcaacaaggaggaggtgatcctgagcaaggccggcaacaagagcctgaacatcatcgagaacagcagcgcccccatctgtgagaacaagcccaagatcctgaacagcgaggagtggtttgctgctgcctgcaagaaggagctgaaggagaacatccagaccaccaactacaacacagccctggacttccacagcaacagtgatgtgaccaagcaggtgatccagacccacgtgaatgctggggaggccccagaccctgtgatcaccagcaatgtgccctgcttccacagcatcaagcccaacctgaacaacctgaatggcaagacaggagagttcctggccttccagacagtgcacctgccccccctgcctgagcagctgctggagctgggcaacaaggcccacaatgacatgcacatcgtgcaggccacagagatccacaacatcaacatcatcagcagcaatgccaaggacagcagagatgaggagaacaagaagagccacaacggggctgagaccaccagcctgccccccaagacagtgttcaaggacaaggtgcggcgctgcagcctgggcatcttcctgccccggctgcccaacaagaggaactgcagcgtgactggaattgatgacctggagcagatcccagctgacaccacagacatcaaccacctggagacccagcctgtgagcagcaaggacagcggcatcggctctgtggccggcaagctgaacctgagccccagccagtacatcaatgaggagaacctgcctgtgtacccagatgagatcaacagcagtgacagcatcaacattgaaacagagcccaagaagaatgtgggcaccaggagaagacgctacagctag

SEQ ID NO: 18427 - DNA, 2061 bp, Artificial Sequence
  Description of Artificial Sequence: Synthetic coding sequence
atgatccctgggaagtacagatctgtgtctggccgggccgccaacaacgtgaactgtggcctgcacctggtgatccagaccagcagcctgcctgagaagaacaaggtggagttcaagctgaacaaggacaccagcagcttccctggccgcctgctgcagcacgacctggagaggaactacagcagccggcagggcgaccacatcaacctggtgagcagcagcctgagcagcttccccatcctgcagaggagcagcgaggagaagatcctgtacagcgaccggctgagcctggagcggcagaagctgactgtgtgccccatcatcaatggagaggaccacctgcggctgctgaacttccagcacaacttcatcacccgcatccagaacatcagcaacctgcagaagctgatcagcctggacctgtatgacaaccagatcgaggagatcagcggcctgagcaccctgcgctgcctgcgggtgctgctgctgggcaagaaccgcatcaagaagatcagcaacctggagaacctgaagagcctggatgtgctggacctgcacggcaaccagatcaccaagattgagaacatcaaccacctgtgtgagctgcgggtgctgaacctggccaggaacttcctgagccacgtggacaacctgaatggcctggacagcctgacagagctgaacctgcggcacaaccagatcacctttgtgagagatgtggacaacctgccctgcctgcagcacctgttcctgtccttcaacaacatcagcagctttgattctgtgtcctgcctggccgacagcagcagcctgagtgacatcacctttgatggcaaccccatcgcccaggagagctggtacaagcacacagtgctgcagaacatgatgcagctgcggcagctggacatgaagaggatcacagaggaggagaggaggatggcctctgtgctggccaagaaggaggaggagaagaagcgggagagccacaagcagagcctgctgaaggagaagaagaggctgaccatcaacaacgtggcccggcagtgggacctgcagcagcagagggtggccaacatcgccaccaatgaagacaggaaggacagcgacagcccccaggacccctgccagattgatggcagcaccctgagcgccttccctgaggagaccggccccctggacagcggcctgaacaatgccctgcagggcctgagcgtcatcgacacctacctggtggaggtggatggagacaccctgagcctgtatggcagcggggccctggagagcctggacaggaactggagcgtgcagacagctggcatgatcaccaccgtgtccttcaccttcattgaatttgatgagatcgtgcaggtgctgcccaagctgaagatcaagttccccaacagcctgcacctgaagttcaaggagaccaacctggtgatgctgcagcagttcaatgccctggcccagctgcggagaattgaccagctgaccatcgacccccagggcaaccctgtggtgaacttcaccctgtggaagtactacgtgctcttccggctgagccacttctccatgcagaagatcaatggaacagaggtgacccagaatgacatgatcatggccgagcggctgtttggcatcctggcccacgtggccagcagcgagctgccccagtaccgcctcatcagcatcctgggagatgccaggaagaagcagttccgctacctgctggagagcaagggcaagaagccaggcatcatcaatgaagaaaataatgacagcaagaggctggtgggggagaacaccaacagagccaccctgaactacaccacccgggacttctacaatgagaagctggaggagatcaaggagaagaagaagttctgcaagacctacatcgaggacctggtgaaggaggccacagagatcaacatgaagaatgaggccctgcagaagctgtggccccagatgttcatcgagctggtgagagatgctgtgattgagatccggaacaagaacagctacatgaagctgtgcctgcagcagatcacagaccagaagtag

SEQ ID NO: 18428 - DNA, 255 bp, Artificial Sequence
  Description of Artificial Sequence: Synthetic coding sequence
atgccctacctgctgatcagcacccagatccgcatggaggtgggccccaccatggtgggagatgagcagagcgaccctgagctgatgcagcacctgggcgccagcaagagaagagccctgggcaacaacttctatgagtactacgtggatgaccccccaagaattgtgctggacaagctggagcggcggggcttccgggtgctgtccatgactggagtgggccagaccctggtgtggtgcctgcacaaggagtag

SEQ ID NO: 18429 - DNA, 2664 bp, Artificial Sequence
  Description of Artificial Sequence: Synthetic coding sequence
atgcccagcctgccccaggagggcgtcatccagggccccagccccctggacctgaacacagagctgccctaccagagcaccatgaagaggaaggtgaggaagaagaagaagaagggcaccatcacagccaacgtggccggcaccaagtttgagatcgtgcggctggtgattgatgagatgggcttcatgaagaccccagatgaagatgagaccagcaacctgatctggtgtgacagcgctgtgcagcaggagaagatcagcgagctgcagaactaccagaggatcaaccacttccctggcatgggagagatctgcaggaaggacttcctggccaggaacatgaccaagatgatcaagagccggcccctggactacacctttgtgcccaggacctggatcttccctgctgagtacacccagttccagaactacgtgaaggagctgaagaagaagaggaagcagaagaccttcatcgtgaagccagccaatggagccatgggccacggcatcagcctcatcagaaatggagacaagctgcccagccaggaccacctgattgtgcaggagtacatcgagaagcccttcctgatggagggctacaagtttgacctgcgcatctacatcctggtgaccagctgtgaccccctgaagatcttcctgtaccatgatggcctggtgaggatgggcacagagaagtacatccccccaaatgaaagcaacctgacccagctgtacatgcacctgaccaactacagcgtgaacaagcacaatgagcactttgaaagagatgaaacagagaacaagggcagcaagaggagcatcaagtggttcacagagttcctgcaggccaaccagcatgatgtggccaagttctggagcgacatcagcgagctggtggtgaagaccctcatcgtggccgagccccacgtgctgcacgcctacaggatgtgcaggcctggccagcccccaggcagcgagagcgtgtgctttgaggtgctgggctttgacatcctgctggacaggaagctgaagccctggctgctggagatcaacagagcccccagctttggaacagaccagaagattgattatgatgtgaagaggggcgtgctgctgaatgccctgaagctgctgaacatccgcaccagtgacaagagaagaaacctggccaagcagaaggccgaggcccagaggcggctgtatggccagaacagcatcaagaggctgctgcccggcagcagtgactgggagcagcagaggcaccagctggagaggaggaaggaggagctgaaggagcggctggcccaggtgaggaagcagatcagccgggaggagcatgaaaatagacacatgggcaactaccgccgcatctaccccccagaggacaaggccctgctggagaagtatgagaacctgctggccgtggccttccagaccttcctgagcggccgggccgccagcttccagcgggagctgaacaaccccctgaagaggatgaaggaggaggacatcctggacctgctggagcagtgtgaaattgatgatgagaagctgatgggcaagaccaccaagacccggggccccaagcccctgtgcagcatgcctgagagcacagagatcatgaagaggcccaagtactgcagcagtgacagcagctatgacagcagcagcagcagcagcgagagtgatgaaaatgagaaggaggagtaccagaacaagaagcgggagaagcaggtgacctacaacctgaagcccagcaaccactacaagctgatccagcagcccagcagcatcagaagatctgtgtcctgccccaggagcatcagcgcccagagccccagcagcggggacacccggcccttcagcgcccagcagatgatctctgtgtcccggcccaccagcgccagccgcagccacagcctgaacagagccagcagctacatgaggcacctgccccacagcaatgatgcctgcagcaccaacagccaggtgtctgagagcctgcggcagctgaagaccaaggagcaggaggatgacctgaccagccagaccctgtttgtgctgaaggacatgaagatccgcttccctgggaagagtgatgctgagagcgagctgctgattgaggacatcatcgacaactggaagtaccacaagaccaaggtggccagctactggctgatcaagctggacagcgtgaagcagaggaaggtgctggacatcgtgaagaccagcatcagaacagtgctgccccgcatctggaaggtgcctgatgtggaggaggtgaacctgtaccgcatcttcaacagagtcttcaaccggctgctgtggagccggggccagggcctgtggaactgcttctgtgacagcggcagctcctgggagagcatcttcaacaagagccctgaggtggtgacccccctgcagctgcagtgctgccagaggctggtggagctgtgcaagcagtgcctgctggtggtgtacaagtatgccacagacaagaggggcagcctgagcggcatcggccctgactggggcaacagccgctacctgctgcccggcagcacccagttcttcctgcggacccccacctacaacctgaagtacaacagccctggcatgaccaggagcaatgtgctcttcaccagccgctatggccacctgtag

SEQ ID NO: 18430 - DNA, 1140 bp, Artificial Sequence
  Description of Artificial Sequence: Synthetic coding sequence
atggccggcccccgggtggaggtggatggcagcatcatggagggcggcggccagatcctgcgggtgtccacagccctgagctgcctgctgggcctgcccctgcgggtgcagaagatccgggccggccgcagcaccccaggcctgagcagcggcggctggaagagcaagatcaaggtgctgacccggccccagcacctgagcggcctggagatgatccgggacctgtgtgatggccagctggagggcgctgagatcggcagcacagagatcaccttcaccccagagaagatcaagggcggcatccacacagctgacaccaagacagctggctctgtgtgcctgctgatgcaggtgtccatgccctgtgtgctgtttgctgccagccccagcgagctgcacctgaagggcggcaccaatgctgagatggccccccagattgactacacagtgatggtgttcaagcccatcgtggagaagtttggcttcatcttcaactgtgacatcaagacccggggctactaccccaagggcggcggggaggtgattgtgaggatgagccctgtgaagcagctgaaccccatcaacctgacagagcggggctgtgtgaccaagatctacggccgggcctttgtggccggcgtgctgcccttcaaggtggccaaggacatggctgctgctgctgtgcgctgcatcaggaaggagatccgggacctgtatgtgaacatccagcctgtgcaggagcccaaggaccaggcctttggaaatggaaatggcatcatcatcatcgccgagaccagcacaggctgcctgtttgctggcagcagcctgggcaagaggggcgtgaatgctgacaaggtgggcatcgaggccgctgagatgctgctggccaacctgcggcacggcggcaccgtggatgagtacctgcaggaccagctgattgtgttcatggccctggccaacggggtgagccgcatcaagacaggccctgtgaccctgcacacccagacagccatccactttgctgagcagatcgccaaggccaagttcatcgtgaagaagtcagaagatgaggaggatgctgccaaggacacctacatcatcgagtgccagggcatcggcatgaccaaccccaacctgtag

SEQ ID NO: 18431 - DNA, 1056 bp, Artificial Sequence
  Description of Artificial Sequence: Synthetic coding sequence
atgcccagcgagaccctgtgggagatcgccaaggccgaggtggagaagaggggcatcaatggaagtgaaggagatggagctgagattgctgagaagtttgtgttcttcatcggcagcaagaatggaggcaagaccaccatcatcctgcgctgcctggacagagatgagccccccaagcccaccctggccctggagtacacctacggccggcgggccaagggccacaacacccccaaggacatcgcccacttctgggagctgggcggcggcaccagcctgctggacctgatcagcatccccatcaccggggacaccctgcggaccttcagcctggtgctggtgctggacctgagcaagcccaatgacctgtggcccaccatggagaacctgctgcaggccaccaagagccacgtggacaaggtgatcatgaagctgggcaagaccaatgccaaggctgtgtctgagatgaggcagaagatctggaacaacatgcccaaggaccacccagaccacgagctgattgaccccttccctgtgcccctggtgatcatcggcagcaaatatgatgtgttccaggactttgagagcgagaagaggaaggtgatctgcaagaccctgcgctttgtggcccactactatggagccagcctgatgttcaccagcaagtctgaggccctgctgctgaagatccggggcgtcatcaaccagctggcctttggaattgacaagagcaagagcatctgtgtggaccagaacaagcccctcttcatcacagctggcctggacagctttggccagatcggcagcccccctgtgcctgaaaatgacatcggcaagctgcacgcccacagccccatggagctgtggaagaaggtgtatgagaagctgttcccccccaagagcatcaacaccctgaaggacatcaaggaccctgcccgggacccccagtatgcagaaaatgaggtggatgagatgaggatccagaaggacctggagctggagcagtacaagaggagcagcagcaagtcctggaagcagatcgagctggacagctag

SEQ ID NO: 18432 - DNA, 798 bp, Artificial Sequence
  Description of Artificial Sequence: Synthetic coding sequence
atgtgcaccagcgagaccttccaggccctggacacctttgaggcccggcatgatgacatcgtgctggccagctaccccaagtgtggcagcaactggatcctgcacatcgtgtctgagctgatctatgctgtgtccaagaagaagtacaagtacccagagttccctgtgctggagtgtggggacagcgagaagtaccagaggatgaagggcttccccagcccccgcatcctggccacccacctgcactatgacaagctgcccggcagcatctttgagaacaaggccaagatcctggtgatcttcaggaaccccaaggacacagctgtgtccttcctgcacttccacaatgatgtgcctgacatccccagctatggctcctgggatgagttcttccggcagttcatgaagggccaggtgtcctggggccgctactttgattttgccatcaactggaacaagcacctggatggagacaacgtgaagttcatcctgtatgaggacctgaaggagaacctggccgccggcatcaagcagattgctgagttcctgggcttcttcctgaccggggagcagatccagaccatctctgtgcagagcaccttccaggccatgagggccaagagccaggacacccacggggctgtgggccccttcctgttcaggaagggggaggtgggggactggaagaacctcttcagcgagatccagaaccaggagatggatgagaagttcaaggagtgcctggccggcaccagcctgggcgccaagctgaagtatgagagctactgccagggctag

SEQ ID NO: 18433 - DNA, 5343 bp, Artificial Sequence
  Description of Artificial Sequence: Synthetic coding sequence
atggagagcaacttcaaccaggagggcgtgccccggcccagctatgtgttttctgctgaccccatcgcccggcccagcgagatcaactttgatggcatcaagctggacctgagccatgagttcagcctggtggcccccaacacagaggccaacagctttgagagcaaggactacctgcaggtgtgcctgcgcatccggcccttcacccagagcgagaaggagctggagagcgagggctgtgtgcacatcctggacagccagacagtggtgctgaaggagccccagtgcatcctgggccgcctgtctgagaagagcagcggccagatggcccagaagttctccttcagcaaggtgtttggacctgccaccacccagaaggagttcttccagggctgcatcatgcagcctgtgaaggacctgctgaagggccagagccgcctcatcttcacctacggcctgaccaacagcggcaagacctacaccttccagggcacagaagaaaatattggcatcctgcccaggaccctgaatgtgctgtttgacagcctgcaggagcggctgtacaccaagatgaacctgaagccccacaggagccgggagtacctgcggctgagcagcgagcaggagaaggaggagatcgccagcaagagcgccctgctgcggcagatcaaggaggtgacagtgcacaatgacagtgatgacaccctgtatggcagcctgaccaacagcctgaacatcagcgagtttgaggagagcatcaaggactatgagcaggccaacctgaacatggccaacagcatcaagttctctgtgtgggtgtccttctttgagatctacaatgagtacatctatgacctgtttgtgcctgtgagcagcaagttccagaagaggaagatgctgcggctgagccaggatgtgaagggctacagcttcatcaaggacctgcagtggatccaggtgtctgacagcaaggaggcctaccgcctgctgaagctgggcatcaagcaccagagcgtggccttcaccaagctgaacaatgccagcagccgcagccacagcatcttcaccgtgaagatcctgcagattgaagattctgagatgagcagggtcatccgggtgtctgagctgagcctgtgtgacctggccggcagcgagaggaccatgaagacccagaatgaaggagagcggctgcgggagaccggcaacatcaacaccagcctgctgaccctgggcaagtgcatcaacgtgctgaagaacagcgagaagagcaagttccagcagcacgtgcccttccgggagagcaagctgacccactacttccagagcttcttcaacgggaagggcaagatctgcatgattgtgaacatcagccagtgctacctggcctatgatgagaccctgaatgtgctgaagttcagcgccatcgcccagaaggtgtgtgtgcctgacaccctgaacagcagccaggagaagctgtttggacctgtgaagagcagccaggatgtgtccctggacagcaacagcaacagcaagatcctgaatgtgaagagggccaccatctcctgggagaacagcctggaggacctgatggaggatgaggacctggtggaggagctggagaatgctgaggagacccagaatgtggagaccaagctgctggatgaggacctggacaagaccctggaggagaacaaggccttcatcagccatgaggagaagaggaagctgctggacctgattgaggacctgaagaagaagctgatcaatgagaagaaggagaagctgaccctggagttcaagatccgggaggaggtgacccaggagttcacccagtactgggcccagcgggaggccgacttcaaggagaccctgctgcaggagcgggagatcctggaggagaatgctgagcggcggctggccatcttcaaggacctggtgggcaaatgtgacacccgggaggaggccgccaaggacatctgtgccaccaaggtggagacagaggaggccacagcctgcctggagctgaagttcaaccagatcaaggccgagctggccaagaccaagggggagctgatcaagaccaaggaggagctgaagaagcgggagaatgaaagtgacagcctcatccaggagctggagaccagcaacaagaagatcatcacccagaaccagaggatcaaggagctgatcaacatcatcgaccagaaggaggacaccatcaatgagttccagaacctgaagagccacatggagaacaccttcaagtgcaatgacaaggctgacaccagcagcctcatcatcaacaacaagctgatctgcaatgagaccgtggaggtgcccaaggacagcaagagcaagatctgcagcgagaggaagagggtgaatgaaaatgagctgcagcaggatgagcccccagccaagaagggcagcatccacgtgtcctctgccatcacagaggaccagaagaagtctgaggaggtgcggcccaacattgctgagattgaggacatccgggtgctgcaggagaacaatgaaggcctgcgggccttcctgctgaccattgaaaatgagctgaagaatgagaaggaggagaaggccgagctgaacaagcagatcgtgcacttccagcaggagctgagcctgtctgagaagaagaacctgaccctgagcaaggaggtgcagcagatccagagcaactatgacatcgccatcgccgagctgcacgtgcagaagagcaagaaccaggagcaggaggagaagatcatgaagctgagcaatgaaattgaaacagccaccaggagcatcaccaacaacgtgtcccagatcaagctgatgcacaccaagattgatgagctgcggaccctggacagcgtgtcccagatcagcaacatcgacctgctgaacctgcgggacctgagcaatggcagcgaggaggacaacctgcccaacacccagctggacctgctgggcaatgactacctggtgtccaagcaggtgaaggagtaccgcatccaggagcccaaccgggagaacagcttccacagcagcattgaggccatctgggaggagtgcaaggagatcgtgaaggccagcagcaagaagagccaccagatcgaggagctggagcagcagatcgagaagctgcaggccgaggtgaagggctacaaggatgagaacaaccggctgaaggagaaggagcacaagaaccaggatgacctgctgaaggagaaggagaccctcatccagcagctgaaggaggagctgcaggagaagaatgtgaccctggatgtgcagatccagcacgtggtggagggcaagagggccctgtctgagctgacccagggcgtgacctgctacaaggccaagatcaaggagctggagaccatcctggagacccagaaggtggagtgcagccacagcgccaagctggagcaggacatcctggagaaggagagcatcatcctgaagctggagaggaacctgaaggagttccaggagcacctgcaggacagcgtgaagaacaccaaggacctgaatgtgaaggagctgaagctgaaggaggagatcacccagctgaccaacaacctgcaggacatgaagcacctgctgcagctgaaggaggaggaggaggagaccaaccggcaggagacagagaagctgaaggaggagctgagcgccagcagcgcccggacccagaacctgaaggctgacctgcagaggaaggaggaggactatgctgacctgaaggagaagctgacagatgccaagaagcagatcaagcaggtgcagaaggaggtgtctgtgatgagagatgaggacaagctgctgcgcatcaagatcaatgagctggagaagaagaagaaccagtgcagccaggagctggacatgaagcagaggaccatccagcagctgaaggagcagctgaacaaccagaaggtggaggaggccatccagcagtatgaaagagcctgcaaggacctgaatgtgaaggagaagatcatcgaggacatgaggatgaccctggaggagcaggagcagacccaggtggagcaggaccaggtgctggaggccaagctggaggaggtggagcggctggccacagagctggagaagtggaaggagaagtgcaatgacctggagaccaagaacaaccagaggagcaacaaggagcacgagaacaacacagatgtgctgggcaagctgaccaacctgcaggatgagctgcaggagagcgagcagaagtacaatgctgacaggaagaagtggctggaggagaagatgatgctgatcacccaggccaaggaggccgagaacatccggaacaaggagatgaagaagtatgcagaagatcgggagcgcttcttcaagcagcagaatgagatggagatcctgacagcccagctgacagagaaggacagcgacctgcagaagtggagggaggagcgggaccagctggtggccgccctggagatccagctgaaggccctgatcagcagcaatgtgcagaaggacaatgaaattgagcagctgaagaggatcatcagcgagaccagcaagattgagacccagatcatggacatcaagcccaagaggatcagcagcgctgaccctgacaagctgcagacagagcccctgagcaccagctttgagatcagcaggaacaagattgaagatggctctgtggtgctggacagctgtgaggtgtccacagaaaatgaccagagcacccgcttccccaagccagagctggagatccagttcacccccctgcagcccaacaagatggctgtgaagcaccctggctgcaccacccctgtgacagtgaagatccccaaggccaggaagaggaagagcaatgagatggaggaggacctggtgaagtgtgagaacaagaagaatgccacccccaggaccaacctgaagttccccatcagtgatgacaggaacagctctgtgaagaaggagcagaaggtggccatccggcccagcagcaagaagacctacagcctgcggagccaggccagcatcattggagtgaacctggccaccaagaagaaggagggcaccctgcagaagtttggagacttcctgcagcacagccccagcatcctgcagagcaaggccaagaagatcatcgagaccatgagcagcagcaagctgagcaatgtggaggccagcaaagaaaatgtgtcccagcccaagagggccaagaggaagctgtacaccagcgagatcagcagccccatcgacatcagcggccaggtgatcctgatggaccagaagatgaaggagagtgaccaccagatcatcaagaggcggctgcggaccaagacagccaagtag

SEQ ID NO: 18434 - DNA, 1371 bp, Artificial Sequence
  Description of Artificial Sequence: Synthetic coding sequence
atgaacagcagtgatgaggagaagcagctgcagctgatcaccagcctgaaggagcaggccatcggggagtatgaggacctgcgggcagagaaccagaagaccaaggagaagtgtgacaagatccggcaggagagagatgaggccgtgaagaagctggaggagttccagaagatcagccacatggtgattgaggaggtgaacttcatgcagaaccacctggagattgagaagacctgccgggagagcgctgaggccctggccaccaagctgaacaaggagaacaagaccctgaagaggatctccatgctgtacatggccaagctgggcccagatgtgatcacagaggagatcaacattgatgatgaggacagcaccacagacacagatggagctgctgagacctgtgtgtctgtgcagtgccagaagcagatcaaggagctgcgggaccagatcgtgtctgtgcaggaggagaagaagatcctggccatcgagctggagaacctgaagagcaagctggtggaggtgattgaggaggtgaacaaggtgaagcaggagaagacagtgctgaacagcgaggtgctggagcagaggaaggtgctggagaagtgcaacagagtgtccatgctggccgtggaggagtatgaggagatgcaggtgaacctggagctggagaaggacctgaggaagaaggccgagagctttgcccaggagatgttcatcgagcagaacaagctgaagaggcagagccacctgctgctgcagagcagcatcccagaccagcagctgctgaaggccctggatgaaaatgccaagctgacccagcagctggaggaggagcgcatccagcaccagcagaaggtgaaggagctggaggagcagctggagaatgagaccctgcacaaggagatccacaacctgaagcagcagctggagctgctggaggaggacaagaaggagctggagctgaagtaccagaacagcgaggagaaggccaggaacctgaagcacagcgtggatgagctgcagaagagggtgaaccagagtgaaaattctgtgcccccacctcctcctcctcctccacccctgcccccacctccacccaaccccatccgcagcctgatgtccatgatcaggaagaggagccaccccagcggcagcggggccaagaaggagaaggccacccagcctgagaccacagaggaggtgacagacctgaagaggcaggccgtggaggagatgatggaccgcatcaagaagggcgtgcacctgcggcctgtgaaccagacagcccggcccaagaccaagccagagagcagcaagggctgtgagagcgctgtggatgagctgaagggcatcctggccagccagtag

SEQ ID NO: 18435 - DNA, 630 bp, Artificial Sequence
  Description of Artificial Sequence: Synthetic coding sequence
atgaagaaggtgcggctgaaggagctggagagccggctgcagcaggtggatggctttgagaagcccaagctgctgctggagcagtaccccacccggccccacatcgccgcctgcatgctgtacaccatccacaacacctatgatgacatcgagaacaaggtggtggccgacctgggctgcggctgcggcgtgctgagcattggaacagccatgctgggcgccggcctgtgtgtgggctttgatattgatgaagatgccctggagatcttcaacagaaatgctgaggagtttgagctgaccaacatcgacatggtgcagtgtgatgtgtgcctgctgagcaacaggatgagcaagagctttgacaccgtcatcatgaaccccccatttggcaccaagaacaacaagggcacagacatggccttcctgaagacagccctggagatggccaggacagctgtgtacagcctgcacaagagcagcacccgggagcacgtgcagaagaaggctgctgagtggaagatcaagattgacatcatcgccgagctgcgctatgacctgcctgccagctacaagttccacaagaagaagtctgtggacatcgaggtggacctgatccgcttctccttctag

SEQ ID NO: 18436 - DNA, 4719 bp, Artificial Sequence
  Description of Artificial Sequence: Synthetic coding sequence
atggccagcagcgcccgggagcacctgctgtttgtgagaagaagaaacccccagatgagatacaccctgagccctgagaacctgcagagcctggccgcccagagctccatgcctgagaacatgaccctgcagagggccaacagcgacacagacctggtgaccagcgagagccgcagcagcctgacagcctccatgtatgagtacaccctgggccaggcccagaacctgatcatcttctgggacatcaaggaggaggtggaccccagcgactggattggcctgtaccacattgatgagaacagccctgccaacttctgggacagcaagaacagaggagtgacaggcacccagaagggccagatcgtgtggagaattgagcccggcccctacttcatggagcctgagatcaagatctgcttcaagtactaccacggcatcagcggggccctgcgggccaccaccccctgcatcaccgtgaagaacccagctgtgatgatgggcgctgagggcatggagggcggggccagcggcaacctgcacagcaggaagctggtgtccttcaccctgagtgacctgcgggctgtgggcctgaagaagggcatgttcttcaacccagacccctacctgaagatgagcatccagcccgggaagaagagcagcttccccacctgtgcccaccacggccaggagaggaggagcaccatcatcagcaacaccaccaaccccatctggcaccgggagaagtacagcttctttgccctgctgacagatgtgctggagattgagatcaaggacaagtttgccaagagccggcccatcatcaagcgcttcctgggcaagctgaccatccctgtgcagaggctgctggagcggcaggccatcggggaccagatgctgagctacaacctgggccgccgcctgcctgctgaccacgtgtctggctacctgcagttcaaggtggaggtgaccagctctgtgcatgaagatgccagccctgaggccgtgggcaccatcctgggcgtgaacagcgtgaatggagacctgggcagccccagtgatgatgaggacatgcctggcagccaccacgacagccaggtgtgcagcaatggacctgtgtctgaggacagcgctgctgatggcacccccaagcacagcttccgcaccagcagcaccctggagattgacacagaggagctgaccagcaccagcagcaggaccagccccccccggggccggcaggacagcctgaatgactacctggatgccatcgagcacaacggccacagcaggcctggaacagccacctgcagcgagaggtccatgggcgccagccccaagctgcggagcagcttccccacagacacccggctgaatgccatgctgcacatcgacagtgatgaggaggaccacgagttccagcaggacctgggctaccccagcagcctggaggaggagggcggcctcatcatgttcagccgggccagcagagcagatgatggcagcctgaccagccagaccaagctggaggacaaccctgtggagaatgaggaggccagcacccatgaagctgccagctttgaggacaagccagagaacctgcctgagctggccgagagcagcctgcctgctggccctgcccctgaggagggggagggcggccctgagccccagcccagcgctgaccagggcagcgctgagctgtgtggcagccaggaggtggaccagcccaccagcggggctgacaccggcaccagtgatgccagcggcggcagccggcgggctgtgtctgaaacagagagcctggaccagggcagcgagcccagccaggtgagcagcgagacagagcccagcgaccctgccaggacagagagcgtgtctgaggccagcaccaggcctgagggggagagtgacctggagtgtgccgacagcagctgcaatgaatctgtgaccacccagctgagctctgtggacacccgctgcagcagcctggagagcgcccgcttccctgagaccccagccttcagcagccaggaggaggaggatggagcctgtgccgctgagcccaccagcagcggccctgctgagggcagccaggagagcgtgtgcacagctggcagcctgcctgtggtgcaggtgcccagcggggaggatgagggccctggagctgagagcgccaccgtgcctgaccaggaggagctgggggaggtgtggcagaggcggggcagcctggagggcgctgctgctgctgctgagagccccccccaggaggagggcagcgctggggaggcccagggcacctgtgagggcgccacagcccaggaggagggcgccaccggcggcagccaggccaacggccaccagcccctgcggagcctgcccagcgtgcggcaggatgtgagccgctaccagagggtggatgaggccctgccccccaactgggaggccagaattgacagccacggccgcatcttctacgtggaccacgtgaacagaaccaccacctggcagaggcccacagcccccccagccccccaggtgctgcagaggagcaacagcatccagcagatggagcagctgaacagacgctaccagagcatccggaggaccatgaccaatgaaagacctgaggagaacaccaatgccattgatggagctggggaggaggccgacttccaccaggccagcgctgacttcagaagagagaacatcctgccccacagcaccagccgcagccgcatcaccctgctgctgcagagcccccctgtgaagttcctgatcagccctgagttcttcaccgtgctgcacagcaaccccagcgcctacaggatgttcaccaacaacacctgcctgaagcacatgatcaccaaggtgcggcgggacacccaccactttgagcgctaccagcacaacagagacctggtgggcttcctgaacatgtttgccaacaagcagctggagctgccccggggctgggagatgaagcatgaccaccagggcaaggccttctttgtggaccacaacagcaggaccaccaccttcatcgacccccggctgcccctgcagagcagccggcccaccagcgccctggtgcaccggcagcacctgacccggcagaggagccacagcgctggggaggtgggggaggacagcagacatgctggcccccctgtgctgccccggcccagcagcaccttcaacacagtgtcccggccccagtaccaggacatggtgcctgtggcctacaatgacaagatcgtggccttcctgcggcagcccaacatctttgagatcctgcaggagcggcagcctgacctgaccaggaaccacagcctgcgggagaagatccagttcatcagaacagagggcaccccaggcctggtgcggctgagcagtgatgctgacctggtgatgctgctgagcctgtttgaggaggagatcatgtcctatgtgccccctcatgccctgctgcaccccagctactgccagagcccccggggcagccctgtgagcagcccccagaacagccctggcacccagagggccaatgcccgggccccagccccctacaagagggactttgaggccaagctgaggaacttctacaggaagctggagaccaagggctacggccagggccctgggaagctgaagctgatcatcagaagagaccacctgctggaggatgccttcaaccagatcatgggctacagcaggaaggacctgcagaggaacaagctgtatgtgacctttgtgggggaggagggcctggactacagcggccccagccgggagttcttcttcctggtgtcccgggagctgttcaacccctactacggcctgtttgagtacagcgccaatgacacctacacagtgcagatcagccccatgtctgcctttgtggacaaccaccacgagtggttccgcttcagcggccgcatcctgggcctggccctgatccaccagtacctgctggatgccttcttcacccggcccttctacaaggccctgctgcgcatcctgtgtgacctgagtgacctggagtacctggatgaggagttccaccagagcctgcagtggatgaaggacaatgacatccatgacatcctggacctgaccttcaccgtgaatgaggaggtgtttggccagatcacagagcgggagctgaagccaggaggagccaacatccctgtgacagagaagaacaagaaggagtacatcgagaggatggtgaagtggagaattgaaagaggagtggtgcagcagacagagagcctggtgcggggcttctatgaggtggtggatgcccggctggtgtctgtgtttgatgcccgggagctggagctggtgattgctggaacagctgagattgacctgagtgactggaggaacaacacagagtacagaggaggctaccatgacaaccacatcgtcatccgctggttctgggccgctgtggagcgcttcaacaatgagcagaggctgcggctgctgcagtttgtgacaggcaccagcagcatcccctatgagggctttgccagcctgcggggcagcaatggcccccggcgcttctgtgtggagaagtggggcaagatcacagccctgccccgggcccacacctgcttcaaccggctggacctgcccccctaccccagcttctccatgctgtatgagaagctgctgacagctgtggaggagaccagcaccttcggcctggagtag

SEQ ID NO: 18437 - DNA, 1206 bp, Artificial Sequence
  Description of Artificial Sequence: Synthetic coding sequence
atgagctgccgctgctggatcagccgccaccccagctatgagggctggaacctgcagagcatcatcttccacaagcagatccggggcgtggacctggagagcacctttgtgaccaagtttggaaacaactgcagcctgcggctgaatgaaacagtggacatccacaaggagaaggtggcccggcgggagatcggcatcctgaccaccaacaagaacaccagcaggacccacaagatcatcgccccagccaacctggagaggcctgtgcgctacatcaggaagcccatcgactacaccatcctggatgacatcggccacggcgtgaaggtgtccacccagaacatgaagatgggcggcctgcccaggaccaccccacccacccagaagccacccagcccccccatgtctgggaagggcaccctgggccgccacagcccctaccgcaccctggagcctgtgcggccccctgtggtgcccaatgactatgtgcccagccccaccaggaacatggcccccagccagcagagccctgtgaggacagcctctgtgaaccagaggaacagaacctacagcagcagcggcagcagcggcggcagccaccccagcagccgcagcagcagcagagaaaattctggcagcggctctgtgggcgtgcccatcgctgtgcccacccccagccccccatctgtgtttcctggccaccctgtgcagttctacagcatgaacagacctgccagccgccacaccccacccaccatcggcggcagcctgccctaccgccggccccccagcatcaccagccagaccagcctgcagaaccagatgaatggaggccccttctacagccagaaccctgtgtctgacaccccacctcctcctcctcctgtggaggagcctgtgtttgatgagagccccccacctcctcctcctcctgaggactatgaggaggaggaggccgctgtggtggagtacagcgacccctatgcagaagaagatcctccctgggcccccaggagctacctggagaaggtggtggccatctatgactacaccaaggacaaggaggatgagctgtccttccaggagggcgccatcatctacgtgatcaagaagaatgatgatggctggtatgaaggagtgatgaatggagtgacaggcctcttccctggcaactacgtggagagcatcatgcactacagcgagtag

SEQ ID NO: 18438 - DNA, 1428 bp, Artificial Sequence
  Description of Artificial Sequence: Synthetic coding sequence
atggccgagctgcagatgctgctggaggaggagatccctgggggccggcgggccctgtttgacagctacaccaacctggagcgggtggccgactactgtgagaacaactacatccagagcgctgacaagcagagggccctggaggagaccaaggcctacaccacccagagcctggcctctgtggcctacctgatcaacaccctggccaacaacgtgctgcagatgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacctggagaggcctgtgcgctacatcaggaagcccatcgactacaccatcctggatgacattggacatggagtgaaggtgtccacccagaacatgaagatgggcggcctgcccaggaccaccccacccacccagaagccacccagcccccccatgtctgggaagggcaccctgggccgccacagcccctaccgcaccctggagcctgtgcggccccctgtggtgcccaatgactatgtgcccagccccaccaggaacatggcccccagccagcagagccctgtgaggacagcctctgtgaaccagaggaacagaacctacagcagcagcggcagcagcggcggcagccaccccagcagccgcagcagcagccgggagaacagcggcagcggctctgtgggcgtgcccatcgctgtgcccacccccagcccccccagcgtcttccctggccaccctgtgcagttctacagcatgaacagacctgccagccgccacaccccacccaccatcggcggcagcctgccctacagaagacctccttccatcaccagccagaccagcctgcagaaccagatgaatggaggccccttctacagccagaaccctgtgtccctggcccctcctcctccttccatcctgcaggtgaccccccagctgcccctgatgggctttgtggcccgggtgcaggagaacatcagtgacaccccacctcctcctcctcctgtggaggagcctgtgtttgatgagagccccccacctcctcctcctcctgaggactatgaggaggaggaggccgctgtggtggagtacagcgacccctatgcagaagaagatcctccctgggcccccaggagctacctggagaaggtggtggccatctatgactacaccaaggacaaggaggatgagctgtccttccaggagggcgccatcatctacgtgatcaagaagaatgatgatggctggtatgaaggagtgatgaatggagtgacaggcctcttccctggcaactacgtggagagcatcatgcactacagcgagtag

SEQ ID NO: 18439 - DNA, 900 bp, Artificial Sequence
  Description of Artificial Sequence: Synthetic coding sequence
atgaagatgggcggcctgcccaggaccaccccacccacccagaagccacccagcccccccatgtctgggaagggcaccctgggcagcagcggcagcagcggcggcagccaccccagcagccgcagcagcagccgggagaacagcggcagcggctctgtgggcgtgcccatcgctgtgcccacccccagcccccccagcgtcttccctgccccagctggcagcgctggcaccccacccctgcctgccaccagcgccagcgccccagcccccctggtgcctgccaccgtgcccagcagcacagccccagatgctgctgctgggggcgcccagaccctggctgatggcttcaccagccccaccccacctgtggtgagcagcaccccacccaccggccaccctgtgcagttctacagcatgaacagacctgccagccgccacaccccacccaccatcggcggcagcctgccctaccgccggccccccagcatcaccagccagaccagcctgcagaaccagatgaatggaggccccttctacagccagaaccctgtgtctgacaccccacctcctcctcctcctgtggaggagcctgtgtttgatgagagccccccacctcctcctcctcctgaggactatgaggaggaggaggccgctgtggtggagtacagcgacccctatgcagaagaagatcctccctgggcccccaggagctacctggagaaggtggtggccatctatgactacaccaaggacaaggaggatgagctgtccttccaggagggcgccatcatctacgtgatcaagaagaatgatgatggctggtatgaaggagtgatgaatggagtgacaggcctcttccctggcaactacgtggagagcatcatgcactacagcgagtag

SEQ ID NO: 18440 - DNA, 1926 bp, Artificial Sequence
  Description of Artificial Sequence: Synthetic coding sequence
atgggcagaagaagcaccagcagcaccaagagcggcaagttcatgaaccccacagaccaggccaggaaggaggccaggaagcgggagctgaagaagaacaagaagcagaggatgatggtgcgggctgctgtgctgaagatgaaggaccccaagcagatcatccgggacatggagaagctggatgagatggagttcaaccctgtgcagcagccccagctgaatgagaaggtgctgaaggacaagaggaagaagctgcgggagacctttgagcgcatcctgcggctgtatgagaaggaaaatccagacatctacaaggagctgaggaagctggaggtggagtatgagcagaagagggcccagctgagccagtactttgatgctgtgaagaatgcccagcacgtggaggtggagagcatccccctgcctgacatgccccacgcccccagcaacatcctgatccaggacatccccctgcccggggcccagcccccatccatcctgaagaagaccagcgcctacggcccccccaccagggctgtgtccatcctgcccctgctgggccacggcgtgccccggctgcccccaggcaggaagcccccaggccccccacctggccccccaccaccccaggtggtgcagatgtatggcaggaaggtgggctttgccctggacctgccccccaggagaagagatgaggacatgctgtacagccctgagctggcccagaggggccatgatgatgatgtgagcagcaccagtgaagatgatggctacccagaggacatggaccaggacaagcatgatgacagcacagatgacagcgacacagacaagagtgatggagagagtgatggagatgaatttgtgcaccgggacaatggagagcgggacaacaatgaggagaagaagagcggcctgtctgtgcgctttgctgacatgcctgggaagagcaggaagaagaagaagaacatgaaggagctgacccccctgcaggccatgatgctgaggatggccggccaggagatccctgaggagggccgggaggtggaggagttctctgaagatgatgatgaagatgacagtgatgacagcgaggccgagaagcagagccagaagcagcacaaggaggagagccacagtgatggcaccagcacagccagcagccagcagcaggccccaccccagagcgtgccccccagccagatccaggccccacccatgcctggccccccacccctgggccccccaccagccccacccctgcggcccccaggcccccccaccggcctgcccccaggccccccacctggggccccacccttcctgcggcccccaggcatgcctggcctgcggggccccctgccccggctgctgcccccaggccccccacctggccggcccccaggccccccacctggccccccacctggcctgcccccaggccccccaccccggggccccccaccccggctgcccccaccagcccctcctggcatccccccaccccggcccggcatgatgaggcctcccctggtgccccccctgggccctgcccctcctggcctcttccccccagcccccctgcccaaccctggggtgctgagcgccccacccaacctgatccagaggcccaaggcagatgacaccagcgctgccaccatcgagaagaaggccacagccaccatcagcgccaagccccagatcaccaaccccaaggccgagatcaccaggtttgtgcccacagccctgcgggtgcggcgggagaacaagggggccacagctgccccccagaggaagtcagaagatgacagcgctgtgcccctggccaaggccgcccccaagagcggccccagcgtgcctgtgtctgtgcagaccaaggatgatgtgtatgaggccttcatgaaggagatggagggcctgctgtag

SEQ ID NO: 18441 - DNA, 4419 bp, Artificial Sequence
  Description of Artificial Sequence: Synthetic coding sequence
atgaagggcagcgaggtgtccctggagaagaagaagaagatcaagatgcctgtgaagaggctgcgggaggtggtgtcccagaaccacggggaccacctggtgctgctgaaggatgagctgccctgtgtgcccccagccctgagcgccaacaagaggctgcctgtgggcaccggcaccagcctgaatggcaccagccggggcagcagtgacctgaccagcgccaggaactgctaccagcccctgctggagaaccccatggtgtctgagagtgacttcagcaaggatgtggccgtgcaggtgctgcccctggacaagattgaggagaacaacaagcagaaggccaatgacatcttcatcagccagtacaccatgggccagaaggatgccctgaggacagtgctgaagcagaaggcccagagcatgcctgtgttcaaggaggtgaaggtgcacctgctggaggatgctggcatcgagaaggatgctgtgacccaggagacccgcatcagccccagcggcattgattctgccaccaccgtggccgccgccacagctgctgccatcgccacagctgcccccctcatcaaggtgcagagcgacctggaggccaaggtgaacagcgtgacagagctgctgagcaagctgcaggagacagacaagcacctgcagagggtgacagagcagcagaccagcatccagaggaagcaggagaagctgcactgccacgaccacgagaagcagatgaatgtgttcatggagcagcacatccgccacctggagaagctgcagcagcagcagattgacatccagacccacttcatctctgctgccctgaagaccagcagcttccagcctgtgtccatgcccagcagcagagctgtggagaagtacagcgtgaagccagagcaccccaacctgggcagctgcaaccccagcctgtacaacacctttgccagcaagcaggcccccctgaaggaggtggaggacaccagctttgacaagcagaagagccccctggagaccccagcccccaggagatttgcccctgtgcctgtgtccagagatgatgagctgagcaagcgggagaacctgctggaggagaaggagaacatggaggtgtcctgccacagaggaaatgtgcggctgctggagcagatcctgaacaacaatgacagcctgaccaggaagtctgagagcagcaacaccaccagcctgaccaggagcaagattggctggaccccagagaagaccaaccgcttccccagctgtgaggagctggagaccaccaaggtgaccatgcagaagagtgatgatgtgctgcatgacctgggccagaaggagaaggagaccaacagcatggtgcagcccaaggagagcctgtccatgctgaagctgcctgacctgccccagaacagcgtgaagctgcagaccaccaacaccaccaggtctgtgctgaaggatgctgagaagatcctgcggggcgtgcagaacaacaagaaggtgctggaggagaacctggaggccatcatccgggccaaggatggagctgccatgtacagcctcatcaatgccctgagcaccaaccgggagatgtctgagaagatccgcatcaggaagacagtggatgagtggatcaagaccatctctgctgagatccagggcctgctgaaggccaccaccgtcatccaggatgaggactacatgctgcaggtgtatggcaagcctgtgtaccagggccacaggagcaccctgaagaagggcccctacctgcgcttcaacagccccagccccaagagccggccccagaggcccaaggtgattgaaagagtgaagggcaccaaggtgaagagcatccgcacccagacagacttctacgccaccaagcccaagaagatggacagcaagatgaagcacagcgtgcctgtgctgccccacggggaccagcagtacctgttcagccccagccgggagatgcccaccttcagcggcaccctggagggccacctgatccccatggccatcctgctgggccagacccagagcaacagcgacaccatgcccccagctggggtgattgtgtccaagccccaccctgtgacagtgaccaccagcatcccccccagcagcaggaaggtggagactggagtgaagaagcccaacatcgccatcgtggagatgaagtctgagaagaaggaccccccccagctgactgtgcaggtgctgcccagcgtggacatcgacagcatcagcaacagcagcgcagatgtgctgagccccctgagcagccccaaggaggccagcctgccccctgtgcagacctggatcaagaccccagagatcatgaaggtggatgaggaggaggtgaagtttcctggcaccaactttgatgagatcattgatgtgatccaggaggaggagaagtgtgatgagatcccagattctgagcccatcctggagttcaacagatctgtgaaggctgacagcaccaagtacaatggaccacccttcccccctgtggccagcaccttccagcccacagctgacatcctggacaaggtgattgaaaggaaggagaccctggagaacagcctcatccagtgggtggagcaggagatcatgagccgcatcatcagcggcctcttccctgtgcagcagcagatcgcccccagcatctctgtgtctgtgtctgagaccagcgagcccctgaccagtgacatcgtggagggcaccagcagcggggccctgcagctgtttgtggatgctggggtgcctgtgaacagcaatgtcatcaagcactttgtgaatgaggccctggccgagaccatcgctgtgatgctgggggaccgggaggccaagaagcagggccctgtggccaccggggtgtctggagatgccagcaccaatgagacctacctgcctgcccgggtgtgcacccccctgcccaccccccagcccaccccaccctgcagccccagcagccctgccaaggaatgtgtgctggtgaagaccccagacagcagcccctgtgacagcgaccatgacatggccttccctgtgaaggagatctgtgccgagaagggagatgacatgcctgccatcatgctggtgaacacccccaccgtgacccccaccaccaccccacctcctgctgctgctgtgttcacccccaccctgagtgacatcagcattgacaagctgaaggtgagcagccctgagctgcccaagccctggggagatggagacctgcccctggaggaggagaaccccaacagcccccaggaggagctgcacccccgggccatcgtgatgtctgtggccaaggatgaggagcctgagagcatggacttccctgcccagcccccacctcctgagcctgtgcccttcatgcccttccctgctggcaccaaggcccccagccccagccagatgcctggcagtgacagcagcaccctggagagcaccctgtctgtgacagtgacagaaacagagaccctggacaagcccatcagcgagggggagatcctcttcagctgtggccagaagctggcccccaagatcctggaggacatcggcctgtacctgaccaacctgaatgacagcctgagcagcaccctgcatgatgctgtggagatggaggatgacccccccagcgagggccaggtgatccgcatgagccacaagaagttccacgcagatgccatcctgagctttgccaagcagaaccaggagagcgctgtgtcccagcaggccgtgtaccacagcgaggacctggagaacagcgtgggggagctgtctgagggccagaggccccagctgacagctgctgctgagaacatcctgatgggccacagcctgtacatgcagccccctgtgaccaacacccagagcctggaccagcagtgtgaccccaagcccctgagccggcagtttgacacagtgtctggcagcatctatgaggacagctgtgccagccacggccccatgagcctgggggagctggagctggagcccaacagcaagctggtgctgcccaccaccctgctgacagcccaggagaatgatgtgaacctgcctgtggccgctgaggacttcagccagtaccagctgaagcagaaccaggatgtgaagcaggtggagcacaagcccagccagagctacctgcgggtgaggaacaagagtgacatcgcccccagccagcagcaggtgtcccctggggacatggacaggacccagatcgagctgaacccctacctgacctgtgtgttcagcggcggcaaggctgtgcccctgagcgccagccagatgcccccagccaagatgtctgtgatgctgcccagcgtgaacctggaggactgcagccagagcctgagcctgagcaccatgcaggaggacatggagagcagtggagctgacaccttctag

SEQ ID NO: 18442 - DNA, 1986 bp, Artificial Sequence
  Description of Artificial Sequence: Synthetic coding sequence
atggagggcgctgctgcccctgtggccggggacagaccagacctgggcctgggcgcccctggcagcccccgggaggccgtggccggggccacagctgccctggagcccaggaagccccacggcgtgaagaggcaccaccacaagcacaacctgaagcacagatatgagctgcaggagaccctgggcaagggcacctacggcaaggtgaagagggccacagagcgcttcagcggccgggtggtggccatcaagagcatcaggaaggacaagatcaaggatgagcaggacatggtgcacatcagaagagaaattgagatcatgagcagcctgaaccacccccacatcatcagcatctatgaggtgtttgagaacaaggacaagatcgtcatcatcatggagtatgccagcaaaggagagctgtatgactacatcagcgagcggcggcggctgtctgagcgggagaccaggcacttcttccggcagatcgtgtctgctgtgcactactgccacaagaatggagtggtgcaccgggacctgaagctggagaacatcctgctggatgacaactgcaacatcaagattgctgactttggcctgagcaacctgtaccagaaggacaagttcctgcagaccttctgtggcagccccctgtatgccagccctgagatcgtgaatggccggccctaccggggccctgaggtggacagctgggccctgggcgtgctgctgtacaccctggtgtatggcaccatgccctttgatggctttgaccacaagaacctgatccggcagatcagcagtggagagtaccgggagcccacccagcccagtgatgcccggggcctcatccgctggatgctgatggtgaacccagacagaagagccaccatcgaggacatcgccaaccactggtgggtgaactggggctacaagagctctgtgtgtgactgtgatgccctgcatgattctgagagccccctgctggcccgcatcatcgactggcaccacaggagcacaggcctgcaggccgacacagaggccaagatgaagggcctggccaagcccaccaccagcgaggtgatgctggagcggcagaggagcctgaagaagagcaagaaggaaaatgactttgcccagagcggccaggatgctgtgcctgagagccccagcaagctgagcagcaagaggcccaagggcatcctgaagaagaggagcaacagcgagcacaggagccacagcacaggcttcattgaaggagtggtgggccctgccctgcccagcaccttcaagatggagcaggacctgtgcaggactggagtgctgctgcccagcagccctgaggccgaggtgcctgggaagctgagccccaagcagagcgccaccatgcccaagaagggcatcctgaagaagacccagcagcgggagagcggctactacagcagccctgagaggtctgagagcagcgagctgctggacagcaatgatgtgatgggcagcagcatccccagccccagccccccagaccctgcccgggtgaccagccacagcctgagctgcaggaggaagggcatcctgaagcacagcagcaagtacagcgctggcaccatggaccctgccctggtgtccccagagatgcccaccctggagagcctgtctgagcccggggtgcctgctgagggcctgagccgcagctacagccggcccagcagcgtcatcagtgatgacagcgtgctgagcagtgacagctttgacctgctggacctgcaggagaacagacctgcccggcagaggatccgcagctgtgtgtctgctgagaacttcctgcagatccaggactttgagggcctgcagaaccggccccggccccagtacctgaagcgctacagaaaccggctggccgacagcagcttcagcctgctgacagacatggatgatgtgacccaggtgtacaagcaggccctggagatctgcagcaagctgaactag

SEQ ID NO: 18443 - DNA, 603 bp, Artificial Sequence
  Description of Artificial Sequence: Synthetic coding sequence
atggccaacattgctgtgcagaggatcaagcgggagttcaaggaggtgctgaagtctgaggagaccagcaagaaccagatcaaggtggacctggtggatgagaacttcacagagctgcggggggagattgctggccccccagacaccccctatgaaggaggccgctaccagctggagatcaagatccctgagacctaccccttcaacccccccaaggtgcgcttcatcaccaagatctggcaccccaacatcagctctgtgactggagccatctgcctggacatcctgaaggaccagtgggccgccgccatgaccctgaggacagtgctgctgagcctgcaggccctgctggccgctgctgagccagatgacccccaggatgctgtggtggccaaccagtacaagcagaaccctgagatgttcaagcagacagcccggctgtgggcccacgtgtatgctggggcccctgtgagcagccctgagtacaccaagaagattgagaacctgtgtgccatgggctttgacagaaatgctgtgattgtggccctgagcagcaagtcctgggatgtggagacagccacagagctgctgctgagcaactag

SEQ ID NO: 18444 - DNA, 5313 bp, Artificial Sequence
  Description of Artificial Sequence: Synthetic coding sequence
atgcccaggaggaggaagaacctgggcggcaaccccttcaggaagacagccaaccccaaggaggtggtggtgtcctctgtggccagccgggaggagcccaccaccaccctgcccagcatgggagagaccaaggtggaccaggaggagctgttcaccagcatcagcgagatcttcagtgacctggaccctgatgtggtgtacctgatgctgtctgaatgtgacttcaaggtggagaatgccatggactgcctgctggagctgagcgccacagacaccaagattgaggagagcagcagccagagctttgtggccagcgagaaccaggtgggcgctgctgagagcaagatcatggagaagaggcctgaggaggagagcgaggacagcaagatggacagcttcctggacatgcagctgacagaggacctggacagcctcatccagaatgcctttgagaagctgaacagcagcccagatgaccaggtgtacagcttcctgcccagccaggatgtgaacagcttcaatgacagcagcgagttcatcaacccagacagcagcaacatgacccccatcttcagcacccagaacatgaacctgaatggagagaacctggagaacagcggcagcaccctgagcctgaaccccctgcccagccacagcgtgctgaatgaaagcaagtgcttcatcaaggacaacaccctggccctggagagcaactacccagaggacagcctgctgagcagcagcctgaatgtggccagtgacagcattgctggctgcagcagcctgaaccagaagcagaaggagctgctggagagtgaatgtgtggaggcccagttcagcgaggcccctgtggacctggatgccagcgagccccaggcctgcctgaacctgcccggcctggacctgcccggcactggaggagaccagaagagcaccagggtgtctgatgtgttcctgcccagcgagggcttcaacttcaagccccacaagcaccctgagctgcccaccaagggcaaggatgtgtcctactgccctgtgctggcccccctgcccctgctgctgcccccacctcctcctccacccatgtggaaccccatgatcccagcctttgacctcttccagggcaaccacggctttgtggcccctgtggtgaccacagctgcccactggaggtctgtgaactacaccttcccccccagcgtcatcagccacaccagccccaccaaggtgtggaggaacaaggatggcaccagcgcctaccaggtgcaggagacccctgtgtcccaggtggtgaggaagaagaccagctatgtgggcctggtgctggtgctgctgcggggcctgcccggcagcggcaagagcttcctggcccggaccctgcaggaggacaaccccagcggggtcatcctgagcacagatgactacttctacatcaatggccagtaccagtttgatgtgaagtacctgggggaggcccacgagtggaaccagaacagagccaaggaggcctttgagaagaagatcagccccatcatcatcgacaacaccaacctgcaggcctgggagatgaagccctacgtggccctgagccagaagcacaagtacaaggtgctcttccgggagccagacacctggtggaagttcaagcccaaggagctggcccggaggaacatccatggagtgtccaaggagaagatcaccaggatgctggagcactaccagagatttgtgtctgtgcccatcatcatgagcagctctgtgcctgagaagattgagcgcatcgagctgtgtgcctacagctgtgaggacaggagcaccagccccagagatgatgaggacatcatcagcgagaaggaggagaacatcctgagcctgagcctgaagcacctggagttcacagaggagaagaacctggatgtgaccaaggagaccatgctgcctgaaaatgtggcctacctgagcaatgctgacctgaacaagaggaggaaggagatcagtgacatgaaccccagcatccagagcgccctgatcctggagaccccccacatgtacttcagtgacagcgagagcaagctgcaggccacagacaagtcagaaaatgagcagatcgagatggtggccgtgaagggctacagcaagacagacacagacagctccatggagcgggtgagccccagcacctgctgcagcgagaacaaccaggaggactgtgacctggccaacagcggccccctgcagaatgagaagagcagccctggagaaattgtggaggagcgggccaccgtgaccaagaaggccttcggcaagcagaagagcaagagcaccctggagaagttccccaggcatgagctgagcaactttgtgggggactggcctgtggacaagaccatcggccagaggaccaagaggaacaggaagacagagaagaccagctctgtgcagagcgacaagaagtacaactacccccagagccacaagctggtgaacagcgtgtctgtgaacacagactgtgtgcagcagaggggcagcccccatgaatctgtggaggatggcaggaagagccagtgtgatgatgccagcgagcccctgaacagctacaagtatgatgcctacaagaacatcgacaagaacagcttcaacatcatgggagactggcccagcagtgacagcctggcccagcgggagcacaggagcaggatgcccaagacaggcctgtctgagcccaacctggagatcggcaccaatgacaagatgaatgagatcagcctgagcacagcccacgaggcctgctggggcaccagcagccagaagctgaagaccctgggcagcagcaacctgggcagcagcgagatgctgctgtctgagatgacctgtgagagccagacctgcctgagcaagaagagccacggccagcacaccagcctgcccctgaccttcaccaacagcgcccccaccgtgtctggagtggtggagccccagaccctggccgagtgccaggagcagatgcccaagagggaccccgggaaggaggtgggcatgtgcacccagacagagccccaggactttgccctgctgtggaagattgagaagaacaagatcagcatcagtgacagcatcaaggtgctgaccggccgcctggatggcttcaagcccaaggtgttcaacatcaacaccaagagtgatgtgcaggaggccatcccctacagagtgatgtatgacaagagcacctttgtggaggagagcgagctgaccagcgcagatgaaagtgagaacctgaacatcctgtgcaagctgtttggcagcttcagcctggaggccctgaaggacctgtatgagcgctgcaacaaggacatcatctgggccaccagcctgctgctggacagcgagaccaagctgtgtgaggacacagaatttgagaacttccagaagagctgtgatggcagccagatcggccccttcagcctgggcctgaacctgaaggagatcatcagccagaggggcaccctggagaacagcaacagccctgtgcctgagttcagccatggaattggcatcagcaatgctgacagccagagcacctgtgatgctgagcggggcaacagcgagcaggccgagatgagagctgtgaccccagagaaccacgagagcatgaccagcatcttccccagcgctgctgtgggcctgaagaacaacaatgacatcctgcccaacagccaggaggagctgctgtacagcagcaagcagagcttccctggcatcctgaaggccaccacccccaaggacatgtctgaaacagagaagaacctggtggtgacagagaccggggacaacatccacagccccagccacttcagtgacatcttcaactttgtgagcagcaccagcaacctggagctgaatgaggagatctacttcacagacagcctggagatcaagagaaatgaaaacttccccaaggactatgtgaagttcagtgatgaggaggagttcatgaatgaagatgagaaggagatgaaggagatcctgatggccggcagcagcctgtctgctggggtgtctggagaggacaagacagagatcctgaaccccaccccagccatggccaagagcctgaccatcgactgcctggagctggccctgcccccagagctggccttccagctgaatgagctgtttggacctgtgggcattgattctggcagcctgactgtggaggactgtgtggtgcacatcgacctgaacctggccaaggtgatccacgagaagtggaaggagagcgtgatggagcggcagaggcaggaggaggtgtcctgtgggaagttcatgcaggaccccagcctggtgggccacacaggcctggacaaccctgagcagaagagcagccagaggacaggcaagaagctgctgaagaccctgacagccagcgagatgctgcccctgctggaccactggaacacccagaccaagaaggtgtccctgcgggagatcatgtctgaggagatcgccctgcaggagaagcacaacctgaagcgggagaccctgatgtttgagaaggactgtgccaccaagctgaaggagaagcagctgttcaagatcttccctgccatcaaccagaacttcctggtggacatcttcaaggaccacaactacagcctggagcacacagtgcagttcctgaactgtgtgctggagggggaccctgtgaagacagtggtggcccaggagtttgtgcaccagaatgaaaatgtgaccagccacacaggccagaagagcaaggagaagaagcccaagaagctgaaggagacagaggagaccccatctgagctgtccttccaggactttgagtacccagactatgatgactacagagctgaggccttcctgcaccagcagaagaggatggagtgctacagcaaggccaaggaggcctaccgcatcggcaagaagaatgtggccaccttctacgcccagcagggcaccctgcacgagcagaagatgaaggaggccaaccacctggccgccatcgagatctttgagaaggtgaatgccagcctgctgccccagaatgtgctggacctgcacggcctgcacgtggatgaggccctggagcacctgatgagggtgctggagaagaagacagaggagttcaagcagaatggaggcaagccctacctgagcgtcatcaccggccggggcaaccacagccagggcggcgtggcccgcatcaagccagctgtgatcaagtacctgatcagccacagcttccgcttcagcgagatcaagccaggctgcctgaaggtgatgctgaagtag

SEQ ID NO: 18445 - DNA, 1362 bp, Artificial Sequence
  Description of Artificial Sequence: Synthetic coding sequence
atggactggaaggaggtgctgcggcggcggctggccacccccaacacctgccccaacaagaagaagtctgagcaggagctgaaggatgaggagatggacctcttcaccaagtactacagcgagtggaagggcggcaggaagaacaccaatgagttctacaagaccatcccccgcttctactaccgcctgcctgcagaagatgaggtgctgctgcagaagctgcgggaggagagcagagctgtgttcctgcagaggaagagccgggagctgctggacaatgaggagctgcagaacctgtggttcctgctggacaagcaccagaccccacccatgattggagaggaggccatgatcaactatgagaacttcctgaaggtgggggagaaggccggggccaagtgcaagcagttcttcaccgccaaggtgtttgccaagctgctgcacacagacagctatggccgcatcagcatcatgcagttcttcaactacgtgatgaggaaggtgtggctgcaccagaccagaattggcctgagcctgtatgatgtggccggccagggctacctgcgggagagtgacctggagaactacatcctggagctgatccccaccctgccccagctggatggcctggagaagagcttctacagcttctacgtgtgcacagctgtgaggaagttcttcttcttcctggaccccctgaggacaggcaagatcaagatccaggacatcctggcctgcagcttcctggatgacctgctggagctgagagatgaggagctgagcaaggagagccaggagaccaactggttcagcgcccccagcgccctgcgggtgtatggccagtacctgaacctggacaaggaccacaacggcatgctgagcaaggaggagctgagccgctatggaacagccaccatgaccaacgtgttcctggacagagtcttccaggagtgcctgacctatgatggagagatggactacaagacctacctggactttgtgctggccctggagaacaggaaggagcctgctgccctgcagtacatcttcaagctgctggacatcgagaacaagggctacctgaatgtgttcagcctgaactacttcttccgggccatccaggagctgatgaagatccacggccaggaccctgtgtccttccaggatgtgaaggatgagatctttgacatggtgaagcccaaggaccccctgaagatcagcctgcaggacctgatcaacagcaaccagggcgacacagtgaccaccatcctgattgacctgaatggcttctggacctatgagaaccgggaggccctggtggccaatgacagtgaaaattctgctgacctggatgacacctag

SEQ ID NO: 18446 - DNA, 3348 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggagacctatgagaacatccctggccagagcaagatcaccttcctgctgcaggccatccggaacaccacagctgctgaggaggcccggcagatggctgctgtgctgctgcggcggctgctgagcagcgcctttgatgaggtgtacccagccctgcccagtgatgtgcagacagccatcaagtctgagctgctgatgatcatccagatggagacccagagctccatgaggaagaaggtgtgtgacattgctgctgagctggccaggaacctgattgatgaagatggcaacaaccagtggccagagggcctgaagttcctgtttgattctgtgagcagccagaatgtgggcctgcgggaggccgccctgcacatcttctggaacttccctggcatcttcggcaaccagcagcagcactacctggatgtgatcaagaggatgctggtgcagtgcatgcaggaccaggagcaccccagcatccgcaccctgagcgcccgggccacagctgccttcatcctggccaatgagcacaacgtggccctcttcaagcactttgctgacctgctgcccggcttcctgcaggccgtgaatgacagctgctaccagaatgatgattctgtgctgaagagcctggtggagattgctgacacagtgcccaagtacctgcggccccacctggaggccaccctgcagctgagcctgaagctgtgtggggacaccagcctgaacaacatgcagaggcagctggccctggaggtgattgtgaccctgtctgaaacagctgctgccatgctgaggaagcacaccaacatcgtggcccagaccatcccccagatgctggccatgatggtggacctggaggaggatgaggactgggccaatgctgatgagctggaggatgatgactttgacagcaatgctgtggccggggagagcgccctggacaggatggcctgtggcctgggcggcaagctggtgctgcccatgatcaaggagcacatcatgcagatgctgcagaacccagactggaagtacagacatgctggcctgatggccctgagcgccatcggggagggctgccaccagcagatggagggcatcctgaatgagatcgtgaactttgtgctgctcttcctgcaggacccccacccccgggtgcgctatgctgcctgcaatgctgtgggccagatggccacagactttgcccctggcttccagaagaagttccacgagaaggtgattgctgccctgctgcagaccatggaggaccagggcaaccagagggtgcaggcccacgccgccgccgccctgatcaacttcacagaggactgccccaagagcctgctgatcccctacctggacaacctggtgaagcacctgcacagcatcatggtgctgaagctgcaggagctgatccagaagggcaccaagctggtgctggagcaggtggtgaccagcatcgcctctgtggccgacacagctgaggagaagtttgtgccctactatgacctcttcatgcccagcctgaagcacatcgtggagaatgctgtgcagaaggagctgcggctgctgcggggcaagaccatcgagtgcatcagcctcatcggcctggccgtgggcaaggagaagttcatgcaggatgccagtgatgtgatgcagctgctgctgaagacccagacagacttcaatgacatggaggatgatgacccccagatctcctacatgatcagcgcctgggccaggatgtgcaagatcctgggcaaggagttccagcagtacctgcctgtggtgatgggccccctgatgaagacagccagcatcaagccagaggtggccctgctggacacccaggacatggagaacatgtctgatgatgatggctgggagtttgtgaacctgggggaccagcagagctttggcatcaagacagctggcctggaggagaagagcacagcctgccagatgctggtgtgctacgccaaggagctgaaggagggctttgtggagtacacagagcaggtggtgaagctgatggtgcccctgctgaagttctacttccatgatggagtgcgggtggccgctgctgagagcatgcccctgctgctggagtgtgcccgggtgcggggccctgagtacctgacccagatgtggcacttcatgtgtgatgccctgatcaaggccatcggcacagagccagacagtgatgtgctgtctgagatcatgcacagctttgccaagtgcatcgaggtgatgggagatggctgcctgaacaatgagcactttgaggagctgggcggcatcctgaaggccaagctggaggagcacttcaagaaccaggagctgcggcaggtgaagaggcaggatgaggactatgatgagcaggtggaggagagcctgcaggatgaagatgacaatgatgtgtacatcctgaccaaggtgtctgacatcctgcacagcatcttcagcagctacaaggagaaggtgctgccctggtttgagcagctgctgcccctcatcgtgaacctgatctgcccccaccggccctggccagaccggcagtggggcctgtgcatctttgatgatgtgattgagcactgcagccctgccagcttcaagtatgcagagtacttcctgcggcccatgctgcagtatgtgtgtgacaacagccctgaggtgcggcaggccgccgcctacggcctgggcgtgatggcccagtatggaggagacaactaccggcccttctgcacagaggccctgcccctgctggtgcgggtcatccagagcgctgacagcaagaccaaggaaaatgtgaatgccacagagaactgcatctctgctgtgggcaagatcatgaagttcaagccagactgtgtgaatgtggaggaggtgctgccccactggctgtcctggctgcccctgcacgaggacaaggaggaggccgtgcagaccttcaactacctgtgtgacctgattgagagcaaccaccccatcgtgctgggccccaacaacaccaacctgcccaagatcttcagcatcatcgccgagggggagatgcatgaggccatcaagcatgaggacccctgtgccaagaggctggccaacgtggtgcggcaggtgcagaccagcggcggcctgtggacagaatgtattgcccagctgagccctgagcagcaggccgccatccaggagctgctgaacagcgcctag

SEQ ID NO: 18447 - DNA, 1929 bp, Artificial Sequence
  Description of Artificial Sequence: Synthetic coding sequence
atgaagaggagctctgtgagcagcggcggggccggccgcctgtccatgcaggagctgcggagccaggatgtgaacaagcagggcctgtacaccccccagaccaaggagaagcccaccttcggcaagctgagcatcaacaagcccaccagcgagaggaaggtgtccctgtttgggaagaggaccagcggccacggcagcaggaacagccagctgggcatcttcagcagcagcgagaagatcaaggacccccggcccctgaatgacaaggccttcatccagcagtgcatccggcagctgtgtgagttcctgacagaaaatggctacgcccacaacgtgtccatgaagagcctgcaggcccccagcgtgaaggacttcctgaagatcttcaccttcctgtatggcttcctgtgccccagctatgagctgcctgacaccaagtttgaggaggaggtgccccgcatcttcaaggacctgggctacccctttgccctgagcaagagctccatgtacacagtgggcgccccccacacctggccccacatcgtggccgccctggtgtggctgattgactgcatcaagatccacacagccatgaaggagagcagccccctgtttgatgatggccagccctggggcgaggagacagaagatggcatcatgcacaacaagctgttcctggactacaccatcaagtgctatgagagcttcatgtctggagctgacagctttgatgagatgaatgctgagctgcagagcaagctgaaggacctcttcaacgtggatgccttcaagctggagagcctggaggccaagaacagagccctgaatgagcagatcgcccggctggagcaggagcgggagaaggagcccaaccggctggagagcctgaggaagctgaaggccagcctgcagggagatgtgcagaagtaccaggcctacatgagcaacctggagagccacagcgccatcctggaccagaagctgaatggcctgaatgaggagatcgcccgggtggagctggagtgtgagaccatcaagcaggagaacacccggctgcagaacatcatcgacaaccagaagtacagcgtggccgacatcgagcgcatcaaccatgaaagaaatgagctgcagcagaccatcaacaagctgaccaaggacctggaggccgagcagcagaagctgtggaatgaggagctgaagtatgcccggggcaaggaggccatcgagacccagctggccgagtaccacaagctggccaggaagctgaagctgatccccaagggagctgagaacagcaagggctatgactttgagatcaagttcaaccctgaggccggggccaactgcctggtgaagtaccgggcccaggtgtatgtgcccctgaaggagctgctgaatgaaacagaggaggagatcaacaaggccctgaacaagaagatgggcctggaggacaccctggagcagctgaatgccatgatcacagagagcaagaggtctgtgaggaccctgaaggaggaggtgcagaagctggatgacctgtaccagcagaagatcaaggaggccgaggaggaggatgagaagtgtgccagcgagctggagagcctggagaagcacaagcacctgctggagagcacagtgaaccagggcctgtctgaggccatgaatgagctggatgctgtgcagcgggagtaccagctggtggtgcagaccaccacagaggagaggaggaaggtgggcaacaacctgcagaggctgctggagatggtggccacccacgtgggctctgtggagaagcacctggaggagcagatcgccaaggtggaccgggagtatgaggagtgcatgtctgaggacctgtctgagaacatcaaggagatccgggacaagtatgagaagaaggccaccctcatcaagagcagcgaggagtag

SEQ ID NO: 18448 - DNA, 4770 bp, Artificial Sequence
  Description of Artificial Sequence: Synthetic coding sequence
atgagcctgcccttctaccagcgctgccaccagcactatgacctgagctacagaaacaaggatgtgcgcagcacagtgagccactaccagcgggagaagaagaggtctgctgtgtacacccagggcagcacagcctacagcagccgcagcagcgctgcccacagaagagagagcgaggccttccggcgggccagcgccagcagcagccagcagcaggccagccagcacgccctgagcagcgaggtgtccaggaaggccgccagcgcctatgactatggcagcagccacggcctgacagacagcagcctgctgctggatgactacagcagcaagctgagccccaagcccaagagggccaagcacagcctgctgtctggagaggagaaggagaacctgcccagcgactacatggtgcccatcttcagcggccggcagaagcacgtgtctggcatcacagacacagaggaggagcgcatcaaggaggccgccgcctacatcgcccagaggaacctgctggccagcgaggagggcatcaccaccagcaagcagagcacagccagcaagcagaccacagccagcaagcagagcacagccagcaagcagagcacagccagcaagcagagcacagccagccggcagagcacagccagccggcagagcgtggtgtccaagcaggccaccagcgccctgcagcaggaggagaccagcgagaagaagagcaggaaggtggtgatccgggagaaggccgagcggctgagcctgaggaagaccctggaggagacagagacctaccacgccaagctgaatgaagaccacctgctgcacgcccctgagttcatcatcaagcccaggagccacacagtgtgggagaaggaaaatgtgaagctgcactgcagcattgctggctggccagagccccgggtgacctggtacaagaaccaggtgcccatcaacgtgcacgccaaccctgggaagtacatcatcgagagccgctatggcatgcacaccctggagatcaatggctgtgactttgaggacacagcccagtaccgggccagcgccatgaatgtgaagggggagctgagcgcctatgcctctgtggtggtgaagcgctacaagggggagtttgatgagacccgcttccacgccggggccagcaccatgcccctgagctttggagtgaccccctacggctacgccagcagatttgagatccactttgatgacaagtttgatgtgtcctttggccgggagggggagaccatgagcctgggctgccgggtggtgatcaccccagagatcaagcacttccagcctgagatccagtggtacagaaatggagtgcccctgagccccagcaagtgggtgcagaccctgtggagcggggagcgggccaccctgaccttcagccacctgaacaaggaggatgagggcctgtacaccatccgggtgaggatgggagagtactatgagcagtacagcgcctacgtgtttgtgagagatgctgatgctgagattgagggcgccccagctgcccccctggatgtgaagtgcctggaggccaacaaggactacatcatcatctcctggaagcagcctgctgtggatggcggcagccccatcctgggctacttcatcgacaagtgtgaggtgggcacagacagctggagccagtgcaatgacacccctgtgaagtttgcccgcttccctgtgacaggcctgattgagggccgcagctacatcttccgggtgcgggctgtgaacaagatgggcatcggcttccccagccgggtgtctgagcctgtggccgccctggaccctgctgagaaggcccggctgaagagccggcccagcgccccctggacaggccagatcatcgtgacagaggaggagcccagcgagggcatcgtgcccggccccccaacagacctgtctgtgacagaggccaccaggagctatgtggtgctgtcctggaagcccccaggccagaggggccacgagggcatcatgtactttgtggagaagtgtgaggccggcacagagaactggcagagggtgaacacagagctgcctgtgaagagccccaggtttgccctgtttgacctggccgagggcaagagctactgcttccgggtgcgctgcagcaacagcgctggggtgggggagcccagcgaggccacagaggtgacagtggtgggggacaagctggacatccccaaggcccctgggaagatcatccccagcaggaacacagacacctctgtggtggtgtcctgggaggagagcaaggatgccaaggagctggtgggctactacatcgaggcctctgtggccggcagcggcaagtgggagccctgcaacaacaaccctgtgaagggcagccgcttcacctgccacggcctggtgacaggccagagctacatcttccgggtgcgggctgtgaatgctgctggcctgtctgagtacagccaggacagcgaggccatcgaggtgaaggccgccatcgccccacccagccccccctgtgacatcacctgcctggagagcttccgggacagcatggtgctgggctggaagcagcctgacaagattggaggagctgagatcaccggctactacgtgaactaccgggaggtgattgatggagtgcctgggaagtggagggaggccaacgtgaaggctgtgtctgaggaggcctacaagatcagcaacctgaaggagaacatggtgtaccagttccaggtggccgccatgaacatggccggcctgggcgcccccagcgctgtgtctgagtgcttcaagtgtgaggagtggaccatcgctgtgcccggccccccccacagcctgaagtgcagcgaggtgaggaaggacagcctggtgctgcagtggaagccccctgtgcacagcggccgcacccctgtgacaggctactttgtggacctgaaggaggccaaggccaaggaggaccagtggaggggcctgaatgaagctgccatcaagaatgtgtacctgaaggtgcggggcctgaaggagggcgtgtcctatgtgttccgggtgcgggccatcaaccaggccggcgtgggcaagcccagcgacctggccggccctgtggtggccgagaccaggcctggcaccaaggaggtggtggtgaatgtggatgatgatggagtcatcagcctgaactttgaatgtgacaagatgacccccaagtctgagttctcctggagcaaggactatgtgtccacagaggacagcccccggctggaggtggagagcaaaggaaacaagaccaagatgaccttcaaggacctgggcatggatgacctgggcatctacagctgtgatgtgacagacacagatggcatcgccagcagctacctgattgatgaggaggagctgaagaggctgctggccctgagccatgagcacaagttccccaccgtgcctgtgaagtctgagctggccgtggagatcctggagaagggccaggtgcgcttctggatgcaggccgagaagctgtctggaaatgccaaggtgaactacatcttcaatgagaaggagatctttgagggccccaagtacaagatgcacatcgacaggaacacaggcatcatcgagatgttcatggagaagctgcaggatgaagatgagggcacctacaccttccagctgcaggacggcaaggccaccaaccacagcacagtggtgctggtgggagatgtgttcaagaagctgcagaaggaggccgagttccagaggcaggagtggatcaggaagcagggcccccactttgtggagtacctgtcctgggaggtgactggagaatgtaatgtgctgctgaagtgcaaggtggccaacatcaagaaggagacccacatcgtgtggtacaaggatgagcgggagatctctgtggatgagaagcatgacttcaaggatggcatctgcaccctgctgatcacagagttcagcaagaaggatgctggcatctatgaggtgatcctgaaggatgaccggggcaaggacaagagccggctgaagctggtggatgaggccttcaaggagctgatgatggaggtgtgcaagaagatcgccctgagcgccacagacctgaagatccagagcacagctgagggcatccagctgtacagctttgtgacctactacgtggaggacctgaaggtgaactggagccacaatggaagtgccatccgctacagcgacagagtgaagacaggagtgactggagagcagatctggctgcagatcaatgagcccaccccaaatgacaagggcaagtatgtgatggagctgtttgatggcaagacaggccaccagaagacagtggacctgagcggccaggcctatgatgaggcctatgcagagttccagaggctgaagcaggccgccatcgccgagaagaacagagcccgggtgctgggcggcctgcctgatgtggtgaccatccaggagggcaaggccctgaacctgacctgcaatgtgtggggagaccccccacctgaggtgtcctggctgaagaatgagaaggccctggccagtgatgaccactgcaacctgaagtttgaagctggccgcacagcctacttcaccatcaacggggtgtccacagctgacagcggcaagtatggcctggtggtgaagaacaagtatggcagcgagaccagtgacttcaccgtgtctgtgttcatccctgaggaggaggccaggatggccgccctggagagcctgaagggcggcaagaaggccaagtag

SEQ ID NO: 18449 - DNA, 546 bp, Artificial Sequence
  Description of Artificial Sequence: Synthetic coding sequence
atgggcggcttcttcagcagcatcttcagcagcctgtttggcacccgggagatgaggatcctgatcctgggcctggatggagctgggaagaccaccatcctgtaccgcctgcaggtgggggaggtggtgaccaccatccccaccatcggcttcaacgtggagaccgtgacctacaagaacctgaagttccaggtgtgggacctgggcggccagaccagcatccggccctactggcgctgctactacagcaacacagatgctgtgatctacgtggtggacagctgtgaccgggaccgcatcggcatcagcaagtctgagctggtggccatgctggaggaggaggagctgaggaaggccatcctggtggtgtttgccaacaagcaggacatggagcaggccatgaccagcagcgagatggccaacagcctgggcctgcctgccctgaaggacaggaagtggcagatcttcaagaccagcgccaccaagggcaccggcctggatgaggccatggagtggctggtggagaccctgaagagccggcagtag

SEQ ID NO: 18450 - DNA, 1269 bp, Artificial Sequence
  Description of Artificial Sequence: Synthetic coding sequence
atggctgctgctgctgtggtggagttccagagggcccagagcctgctgagcacagaccgggaggccagcattgacatcctgcacagcatcgtgaagagggacatccaggagaatgatgaggaggccgtgcaggtgaaggagcagagcatcctggagctgggcagcctgctggccaagacaggccaggccgctgagctgggcggcctgctgaagtatgtgcggcccttcctgaacagcatcagcaaggccaaggccgcccggctggtgcgcagcctgctggacctcttcctggacatggaggccgccaccggccaggaggtggagctgtgcctggagtgcatcgagtgggccaagtctgagaagaggaccttcctgcggcaggccctggaggcccggctggtgtccctgtactttgacaccaagcgctaccaggaggccctgcacctgggcagccagctgctgcgggagctgaagaagatggatgacaaggccctgctggtggaggtgcagctgctggagagcaagacctaccacgccctgagcaacctgcccaaggcccgggccgccctgaccagcgcccggaccacagccaatgccatctactgcccccccaagctgcaggccaccctggacatgcagagcggcatcatccatgctgctgaggagaaggactggaagacagcctacagctacttctatgaggcctttgagggctatgacagcattgacagccccaaggccatcaccagcctgaagtacatgctgctgtgcaagatcatgctgaacaccccagaagatgtgcaggccctggtgtctgggaagctggccctgcgctatgccggccggcagacagaggccctgaagtgtgtggcccaggccagcaagaacagaagcctggccgactttgagaaggccctgacagactacagagctgagctgagagatgaccccatcatcagcacccacctggccaagctgtatgacaacctgctggagcagaacctgatccgggtgattgagcccttcagccgggtgcagatcgagcacatcagcagcctcatcaagctgagcaaggcagatgtggagaggaagctgagccagatgatcctggacaagaagttccacggcatcctggaccagggcgagggcgtgctgatcatctttgatgagccccctgtggacaagacctatgaagctgccctggagaccatccagaacatgagcaaggtggtggacagcctgtacaacaaggccaagaagctgacctag

SEQ ID NO: 18451 - DNA, 1449 bp, Artificial Sequence
  Description of Artificial Sequence: Synthetic coding sequence
atggccagcctgggccctgctgctgctggggagcaggccagcggggctgaggccgagcccggccctgctggccccccacctccacccagccccagcagcctgggccccctgctgcccctgcagcgggagcccctgtacaactggcaggccaccaaggccagcctgaaggagagatttgccttcctgttcaacagcgagctgctgagtgatgtgcgctttgtgctgggcaagggcagaggagctgctgctgctgggggcccccagaggatcccagcccacagatttgtgctggccgccggcagcgctgtgtttgatgccatgtttaatggaggcatggccaccaccagcgctgagattgagctgcctgatgtggagcctgctgccttcctggccctgctgcgcttcctgtacagtgatgaggtgcagatcggccctgagaccgtgatgaccaccctgtacacagccaagaagtatgctgtgcctgccctggaggcccactgtgtggagttcctgaccaagcacctgcgggctgacaatgccttcatgctgctgacccaggcccggctgtttgatgagccccagctggccagcctgtgcctggacaccatcgacaagagcaccatggatgccatctctgctgagggcttcacagacattgatattgacaccctgtgtgctgtgctggagcgggacaccctgagcatccgggagagccggctgtttggagctgtggtgcgctgggccgaggccgagtgccagaggcagcagctgcctgtgacctttggaaacaagcagaaggtgctgggcaaggccctgagcctcatccgcttccccctgatgaccatcgaggagtttgctgctggccctgcccagagcggcatcctgagtgaccgggaggtggtgaacctcttcctgcacttcaccgtgaaccccaagccccgggtggagtacatcgaccggccccgctgctgcctgcggggcaaggagtgctgcatcaaccgcttccagcaggtggagagccgctggggctacagcggcaccagtgaccgcatccgcttcaccgtgaacagacgcatcagcatcgtgggcttcggcctgtatggcagcatccacggccccacagactaccaggtgaacatccagatcattgaatatgagaagaagcagaccctgggccagaatgacaccggcttcagctgtgatggaacagccaacaccttccgggtgatgttcaaggagcccatcgagatcctgcccaacgtgtgctacacagcctgtgccaccctgaagggccctgacagccactacggcaccaagggcctgaagaaggtggtgcatgagaccccagctgccagcaagacagtgttcttcttcttcagcagccctggcaacaacaacggcaccagcattgaagatggccagatccctgagatcatcttctacacctag

SEQ ID NO: 18452 - DNA, 2883 bp, Artificial Sequence
  Description of Artificial Sequence: Synthetic coding sequence
atgagccggctgattgtgaagaacctgcccaacggcatgaaggaggagcgcttccggcagctgtttgctgccttcggcaccctgacagactgcagcctgaagttcaccaaggatggcaagttcaggaagtttggcttcatcggcttcaagtctgaggaggaggcccagaaggcccagaagcacttcaacaagagcttcatcgacaccagccgcatcaccgtggagttctgcaagagctttggagaccctgccaagccccgggcctggagcaagcacgcccagaagcccagccagcccaagcagccccccaaggacagcaccaccccagagatcaagaaggatgagaagaagaagaaggtggccggccagctggagaagctgaaggaggacacagagttccaggagttcctgtctgtgcaccagaggcgggcccaggccgccacctgggccaatgatggcctggatgctgagcccagcaagggcaagagcaagccagccagtgactacctgaactttgacagcgacagcggccaggagagcgaggaggagggcgctggggaggacctggaggaggaggccagcctggagcccaaggctgctgtgcagaaggagctgagtgacatggactacctgaagagcaagatggtgaaggccggcagcagcagcagcagcgaggaggaggagagtgaagatgaagctgtgcactgtgatgagggcagcgaggccgaggaggaggacagcagcgccacccctgtgctgcaggagcgggacagcaaaggagctggccaggagcagggcatgcctgctgggaagaagaggcctcctgaggcccgggcagagacagagaagccagccaaccagaaggagcccaccacctgccacacagtgaagctgcggggggcccccttcaacgtgacagagaagaatgtgatggagttcctggcccccctgaagcctgtggccatccgcatcgtgagaaatgcccacggcaacaagacaggctacatctttgtggacttcagcaatgaggaggaggtgaagcaggccctgaagtgcaaccgggagtacatgggcggccgctacatcgaggtgttccgggagaagaatgtgcccaccaccaagggggcccccaagaacaccaccaagtcctggcagggccgcatcctgggagaaaatgaggaggaggaggacctggccgagagcggccgcctgtttgtgaggaacctgccctacaccagcacagaggaggacctggagaagctgttcagcaaatatggccccctgtctgagctgcactaccccatcgacagcctgaccaagaagcccaagggctttgccttcatcaccttcatgtttcctgagcacgctgtgaaggcctacagcgaggtggatggccaggtgttccagggccgcatgctgcacgtgctgcccagcaccatcaagaaggaggcctctgaagatgccagcgccctgggcagcagcagctacaagaagaagaaggaggcccaggacaaggccaacagcgccagcagccacaactggaacaccctcttcatgggccccaatgctgtggctgatgccatcgcccagaagtacaatgccaccaagagccaggtgtttgaccacgagaccaagggctctgtggccgtgcgggtggccctgggggagacccagctggtgcaggaggtgcggcgcttcctgattgacaacggggtgtccctggacagcttcagccaggccgctgctgagaggagcaagacagtcatcctggtgaagaacctgcctgctggcaccctggccgcccagctgcaggagaccttcggccacttcggcagcctgggccgggtgctgctgcctgagggcggcatcacagccatcgtggagttcctggagcccctggaggccaggaaggccttccgccacctggcctacagcaagttccaccacgtgcccctgtacctggagtgggcccctgtgggcgtcttcagcagcacagccccccagaagaagaagctgcaggacaccccatctgagcccatggagaaggaccctgctgagcctgagaccgtgcctgatggagagaccccagaagatgagaaccccacagaggagggcgctgacaacagcagcgccaagatggaggaggaggaggaggaggaggaggaggaggaggagagcctgcccggctgcaccctcttcatcaagaacctgaactttgacaccacagaggagaagctgaaggaggtgttcagcaaggtgggcaccgtgaagagctgcagcatcagcaagaagaagaacaaggccggcgtgctgctgtccatgggcttcggctttgtggagtacaggaagccagagcaggcccagaaggccctgaagcagctgcagggccacgtggtggatggccacaagctggaggtgcgcatcagcgagcgggccaccaagccagctgtgaccctggccaggaagaagcaggtgcccaggaagcagaccaccagcaagatcctggtgaggaacatccccttccaggcccacagccgggagatccgggagctgttcagcacctttggagagctgaagacagtgcggctgcccaagaagatgacaggcaccggcacccaccggggcttcggctttgtggacttcctgaccaagcaggatgccaagagggccttcaatgccctgtgccacagcacccacctgtatggaagaaggctggtgctggagtgggccgacagcgaggtgaccctgcaggccctgcggaggaagacagctgcccacttccacgagccccccaagaagaagaggtctgtggtgctggatgagatcctggagcagctggagggcagtgacagcgacagcgaggagcagaccctgcagctgtag

SEQ ID NO: 18453 - DNA, 2919 bp, Artificial Sequence
  Description of Artificial Sequence: Synthetic coding sequence
atggccacccggggccacgtgcaggaccccaatgaccggcggctgcggcccatctatgactacctggacaatggaaacaacaagatggccatccagcaggccgacaagctgctgaagaagcacaaggacctgcactgtgccaaggtgctgaaggccatcggcctgcagaggacaggcaagcaggaggaggccttcaccctggcccaggaggtggccgccctggagcccacagatgacaacagcctgcaggccctgaccatcctgtaccgggagatgcacaggcctgagctggtgaccaagctgtatgaggccgctgtgaagaaggtgcccaacagcgaggagtaccacagccacctgttcatggcctatgcccgggtgggggagtacaagaagatgcagcaggccggcatggccctgtacaagatcgtgcccaagaacccctactacttctggagcgtgatgagcctcatcatgcagagcatcagcgcccaggatgagaacctgagcaagaccatgttcctgcccctggccgagaggatggtggagaagatggtgaaggaggacaagattgaggccgaggccgaggtggagctgtactacatgatcctggagcggctgggcaagtaccaggaggccctggatgtgatccggggcaagctgggggagaagctgaccagcgagatccagagccgggagaacaagtgcatggccatgtacaagaagctgagccgctggccagaatgtaatgccctgagccggcggctgctgctgaagaacagtgatgactggcagttctacctgacctactttgacagcgtcttccggctgattgaggaggcctggagccccccagctgagggggagcacagcctggagggggaggtgcactacagcgctgagaaggctgtgaagttcattgaagatcgcatcacagaggagagcaagagcagccgccacctgcggggcccccacctggccaagctggagctgatccggcggctgcggagccagggctgcaatgatgagtacaagctgggggaccctgaggagctgatgttccagtacttcaagaagtttggagacaagccctgctgcttcacagacctgaaggtgtttgtggacctgctgcctgccacccagtgcaccaagttcatcaaccagctgctgggcgtggtgcccctgagcacccccacagaggacaagctggccctgcctgctgacatccgggccctgcagcagcacctgtgtgtggtgcagctgacccggctgctgggcctgtaccacaccatggacaagaaccagaagctgtctgtggtgcgggagctgatgctgcgctaccagcacggcctggagtttgggaagacctgcctgaagacagagctgcagttcagtgactactactgcctgctggccgtgcacgccctgattgatgtgtggagggagactggagatgagaccaccgtgtggcaggccctgaccctgctggaggagggcctgacccacagccccagcaatgcccagttcaagctgctgctggtgcgcatctactgcatgctgggcgcctttgagcctgtggtggacctgtacagcagcctggatgccaagcacatccagcacgacaccatcggctacctgctgaccaggtatgcagagagcctgggccagtatgctgctgccagccagagctgcaactttgccctgcgcttcttccacagcaaccagaaggacaccagcgagtacatcatccaggcctacaagtatggagcctttgagaagatccctgagttcatcgccttcaggaaccggctgaacaacagcctgcactttgcccaggtgaggacagagaggatgctgctggacctgctgctggaggccaacatcagcaccagcctggccgagagcatcaagtccatgaacctgcggcctgaggaggatgacatcccctgggaggacctgcgggacaacagagacctgaatgtgttcttctcctgggaccccaaggacagagatgtgtctgaggagcacaagaagctgagcctggaggaggagaccctgtggctgcgcatccgcagcctgaccctgcggctcatcagcggcctgcccagcctgaaccaccctgtggagcccaagaacagcgagaagacagcagaaaatggagtgagcagcagaattgacatcctgcggctgctgctgcagcagctggaggccaccctggagaccgggaagcgcttcatcgagaaggacatccagtaccccttcctgggccctgtgcccaccaggatgggcggcttcttcaacagcggctgcagccagtgccagatcagcagcttctacctggtgaatgacatctatgagctggacaccagcggcctggaggacaccatggagatccaggagagaattgagaacagcttcaagagcctgctggaccagctgaaggatgtgttcagcaagtgcaagggggacctgctggaggtgaaggatggcaacctgaagacccaccccaccctgctggagaacctggtgttctttgtggagaccatcagcgtcatcctgtgggtgagcagctactgtgagagcgtgctgcggccctacaagctgaacctgcagaagaagaagaagaagaagaaggagaccagcatcatcatgcctcctgtgttcaccagcttccaggactatgtgacaggcctgcagaccctcatcagcaatgtggtggaccacatcaagggcctggagacccacctgattgccctgaagctggaggagctgatcctggaggacaccagcctgagccctgaggagaggaagttcagcaagacagtgcagggcaaggtgcagagcagctacctgcacagcctgctggagatgggagagctgctgaagaagaggctggagaccaccaagaagctgaagatctag

SEQ ID NO: 18454 - DNA, 2166 bp, Artificial Sequence
  Description of Artificial Sequence: Synthetic coding sequence
atggccgagaagtttgagagcctgatgaacatccacggctttgacctgggcagccgctacatggacctgaagcccctgggctgcggcggcaatggcctggtgttttctgctgtggacaatgactgtgacaagagggtggccatcaagaagatcgtgctgacagacccccagagcgtgaagcacgccctgcgggagatcaagatcatccggcggctggaccatgacaacatcgtgaaggtgtttgagatcctgggccccagcggcagccagctgacagatgatgtgggcagcctgacagagctgaacagcgtgtacatcgtgcaggagtacatggagacagacctggccaacgtgctggagcagggccccctgctggaggagcacgcccggctcttcatgtaccagctgctgcggggcctgaagtacatccacagcgccaacgtgctgcaccgggacctgaagccagccaacctcttcatcaacacagaggacctggtgctgaagattggagactttggcctggcccgcatcatggacccccactacagccacaagggccacctgtctgagggcctggtgaccaagtggtaccgcagcccccggctgctgctgagccccaacaactacaccaaggccatcgacatgtgggccgccggctgcatctttgctgagatgctgaccgggaagaccctgtttgctggggcccacgagctggagcagatgcagctgatcctggagagcatccctgtggtgcatgaggaggaccggcaggagctgctgagcgtcatccctgtgtacatcagaaatgacatgacagagccccacaagcccctgacccagctgctgcccggcatcagccgggaggccctggacttcctggagcagatcctgaccttcagccccatggaccggctgacagctgaggaggccctgagccacccctacatgagcatctacagcttccccatggatgagcccatcagcagccaccccttccacattgaagatgaggtggatgacatcctgctgatggatgagacccacagccacatctacaactgggagcgctaccatgactgccagttcagcgagcatgactggcctgtgcacaacaactttgatattgatgaggtgcagctggacccccgggccctgagtgatgtgacagatgaggaggaggtgcaggtggaccccaggaagtacctggatggagaccgggagaagtacctggaggaccctgcctttgacaccaactacagcacagagccctgctggcagtacagcgaccaccacgagaacaagtactgtgacctggagtgcagccacacctgcaactacaagaccaggagcagcagctacctggacaacctggtgtggagggagagcgaggtgaaccactactatgagcccaagctgatcatcgacctgagcaactggaaggagcagagcaaggagaagagtgacaagaagggcaagagcaaatgtgaaagaaatggcctggtgaaggcccagatcgccctggaggaggccagccagcagctggccggcaaggagcgggagaagaaccagggctttgattttgacagcttcatcgccggcaccatccagctgagcagccagcacgagcccacagatgtggtggacaagctgaatgacctgaacagctctgtgtcccagctggagctgaagagcctcatcagcaagtctgtgtcccaggagaagcaggagaagggcatggccaacctggcccagctggaggccctgtaccagagctcctgggacagccagtttgtgtctggaggagaggactgcttcttcatcaaccagttctgtgaggtgaggaaggatgagcaggtggagaaggagaacacctacaccagctacctggacaagttcttcagcaggaaagaagacacagagatgctggagacagagcctgtggaggatggcaagctgggggagcggggccacgaggagggcttcctgaacaacagcggggagttcctgttcaacaagcagctggagagcatcggcatcccccagttccacagccctgtgggcagccccctgaagagcatccaggccaccctgacccccagcgccatgaagagcagcccccagatcccccaccagacctacagcagcatcctgaagcacctgaactag

SEQ ID NO: 18455 - DNA, 948 bp, Artificial Sequence
  Description of Artificial Sequence: Synthetic coding sequence
atggctgctggggtgccctgtgccctggtgaccagctgcagctctgtgttcagcggggaccagctggtgcagcacatcctgggcacagaggacctgattgtggaggtgaccagcaatgatgctgtgcgcttctacccctggaccatcgacaacaagtactacagcgctgacatcaacctgtgtgtggtgcccaacaagttcctggtgacagctgagattgctgagagcgtgcaggcctttgtggtgtactttgacagcacccagaagagcggcctggacagcgtgtcctcctggctgcccctggccaaggcctggctgcctgaggtgatgatcctggtgtgtgacagagtgtctgaagatggcatcaaccggcagaaggcccaggagtggtgcatcaagcacggctttgagctggtggagctgagccctgaggagctgcctgaagaagatgatgacttccctgagagcactggagtgaagagaattgtgcaggccctgaatgccaacgtgtggagcaatgtggtgatgaagaatgacaggaaccagggcttcagcctgctgaacagcctgaccggcaccaaccacagcatcggcagcgctgacccctgccaccctgagcagccccacctgcctgctgctgacagcacagagagcctgagtgaccaccggggcggggccagcaacaccacagatgcccaggtggacagcatcgtggaccccatgctggacctggacatccaggagctggccagcctgaccaccggcggcggagatgtggagaactttgagcggctcttcagcaagctgaaggagatgaaggacaaggccgccaccctgccccatgagcagaggaaggtgcacgccgagaaggtggccaaggccttctggatggccatcggcggggacagagatgaaattgagggcctgagcagtgatgaggagcactag

SEQ ID NO: 18456 - DNA, 1338 bp, Artificial Sequence
  Description of Artificial Sequence: Synthetic coding sequence
atggccgcccctgaggagcgggacctgacccaggagcagacagagaagctgctgcagttccaggacctgaccggcatcgagagcatggaccagtgccgccacaccctggagcagcacaactggaacattgaagctgctgtgcaggaccggctgaatgagcaggagggcgtgcccagcgtcttcaaccccccacccagccggcccctgcaggtgaacacagctgaccaccgcatctacagctatgtggtgtcccggccccagccccggggcctgctgggctggggctactacctgatcatgctgcccttccgcttcacctactacaccatcctggacatcttccgctttgccctgcgcttcatccggccagaccccaggagccgggtgacagatcctgtgggggacatcgtgtccttcatgcacagctttgaggagaagtatggccgggcccaccctgtgttctaccagggcacctacagccaggccctgaatgatgccaagcgggagctgcgcttcctgctggtgtacctgcatggagatgaccaccaggacagtgatgagttctgcaggaacaccctgtgtgcccctgaggtgatcagcctcatcaacaccaggatgctgttctgggcctgcagcaccaacaagccagagggctacagagtgtcccaggccctgcgggagaacacctaccccttcctggccatgatcatgctgaaggacaggaggatgacagtggtgggccgcctggagggcctcatccagccagatgacctgatcaaccagctgaccttcatcatggatgccaaccagacctacctggtgtctgagcggctggagcgggaggagaggaaccagacccaggtgctgcggcagcagcaggatgaggcctacctggccagcctgcgggctgaccaggagaaggagaggaagaagcgggaggagcgggagaggaagaggaggaaggaggaggaggtgcagcagcagaagctggccgaggagcggcggcggcagaacctgcaggaggagaaggagaggaagctggagtgcctgcccccagagcccagcccagatgatcctgagagcgtgaagatcatcttcaagctgcccaatgacagccgggtggagcggcgcttccacttcagccagagcctgaccgtcatccatgacttcctgttcagcctgaaggagagccctgagaagttccagatcgaggccaacttccccaggagagtgctgccctgcatccccagcgaggagtggcccaacccccccaccctgcaggaggccggcctgagccacacagaggtgctgtttgtgcaggacctgacagatgaatag

SEQ ID NO: 18457 - DNA, 2724 bp, Artificial Sequence
  Description of Artificial Sequence: Synthetic coding sequence
atggccaccccagaccagaagagccccaacgtgctgctgcagaacctgtgctgccgcatcctgggccgctctgaggctgatgtggcccagcagttccagtatgctgtgcgggtgattggcagcaactttgcccccaccgtggagagagatgagttcctggtggccgagaagatcaagaaggagctgatccggcagaggcgggaggctgatgctgccctcttcagcgagctgcacaggaagctgcacagccagggcgtgctgaagaacaagtggagcatcctgtacctgctgctgagcctgtctgaggacccccggcggcagcccagcaaggtgtcctcctatgccaccctgtttgcccaggccctgcccagagatgcccacagcaccccctactactatgcccggccccagaccctgcccctgagctaccaggacagaagtgcccagagcgcccagagcagcggctctgtgggcagcagcggcatcagcagcatcggcctgtgtgccctgagcggccctgccccagccccccagagcctgctgcccggccagagcaaccaggcccctggggtgggggactgcctgcggcagcagctgggcagccggctggcctggaccctgacagccaaccagcccagcagccaggccaccaccagcaagggcgtgcccagcgctgtgtccaggaacatgaccaggagccggcgggagggggacacaggaggcaccatggagatcacagaggccgccctggtgcgggacatcctgtatgtgttccagggcattgatggcaagaacatcaagatgaacaacacagagaactgctacaaggtggagggcaaggccaacctgagccgcagcctgcgggacacagctgtgcggctgtctgagctgggctggctgcacaacaagatccgccgctacacagaccagaggagcctggacaggagctttggcctggtgggccagagcttctgtgccgccctgcaccaggagctgcgggagtactaccgcctgctgtctgtgctgcacagccagctgcagctggaggatgaccagggcgtgaacctgggcctggagagcagcctgaccctgcggcggctgctggtgtggacctatgaccccaagatccggctgaagaccctggccgccctggtggaccactgccagggcaggaagggcggggagctggccagcgctgtgcacgcctacaccaagacaggagacccctacatgaggagcctggtgcagcacatcctgagcctggtgagccaccctgtgctgtccttcctgtaccgctggatctatgatggagagctggaggacacctaccacgagttctttgtggccagtgaccccaccgtgaagacagaccggctgtggcatgacaagtacaccctgaggaagtccatgatccccagcttcatgaccatggaccagagcaggaaggtgctgctgattggcaagagcatcaacttcctgcaccaggtgtgccacgaccagacccccaccaccaagatgattgctgtgaccaagtctgctgagagcccccaggatgctgctgacctcttcacagacctggagaatgccttccagggcaagattgatgctgcctactttgagaccagcaagtacctgctggatgtgctgaacaagaagtacagcctgctggaccacatgcaggccatgaggcgctacctgctgctgggccagggcgacttcatccgccacctgatggacctgctgaagccagagctggtgcggcctgccaccaccctgtaccagcacaacctgaccggcatcctggagacagctgtgcgggccaccaatgcccagtttgacagccctgagatcctgcggcggctggatgtgcggctgctggaggtgtcccctggggacaccggctgggatgtgttcagcctggactaccacgtggatggccccatcgccaccgtcttcacccgggagtgcatgagccactacctgcgggtcttcaacttcctgtggagggccaagaggatggagtacatcctgacagacatcaggaagggccacatgtgcaatgccaagctgctgaggaacatgcctgagttcagcggcgtgctgcaccagtgccacatcctggccagcgagatggtgcacttcatccaccagatgcagtactacatcacctttgaggtgctggagtgctcctgggatgagctgtggaacaaggtgcagcaggcccaggacctggaccacatcatcgccgcccacgaggtgttcctggacaccatcatcagccgctgcctgctggacagcgacagccgggccctgctgaaccagctgcgggctgtgtttgaccagatcatcgagctgcagaatgcccaggatgccatctacagagctgccctggaggagctgcagaggcggctgcagtttgaggagaagaagaagcagcgggagattgagggccagtggggcgtgacagctgctgaggaggaggaggagaacaagagaattggagagttcaaggagagcatccccaagatgtgcagccagctgcgcatcctgacccacttctaccagggcatcgtgcagcagttcctggtgctgctgaccaccagcagtgatgagagcctgcgcttcctgtccttccggctggacttcaatgagcactacaaggcccgggagccccggctgcgggtgtccctgggcacccggggccgccgcagcagccacacctag

SEQ ID NO: 18458 - DNA, 1086 bp, Artificial Sequence
  Description of Artificial Sequence: Synthetic coding sequence
atgaccgggaaggccggggaggccctgagcaagcccaagtctgagaccgtggccaagagcaccagcggcggggccccagcccgctgcaccggcttcggcatccaggagatcctgggcctgaacaaggagccccccagcagccaccccagggctgccctggatggcctggcccctggccacctgctggccgcccggtctgtgctgagccctgctggggtgggcggcatgggcctgctgggccctgggggcctgcccggcttctacacccagcccaccttcctggaggtgctgagtgacccccagagcgtgcacctgcagcccctgggccgggccagcggccccctggacaccagccagacagccagcagtgacagtgaagatgtgagcagcagtgacaggaagatgagcaagagcgccctgaaccagaccaagaagaggaagaagagaagacacaggaccatcttcaccagctaccagctggaggagctggagaaggccttcaatgaggcccactacccagatgtgtatgcccgggagatgctggccatgaagacagagctgcctgaagatcgcatccaggtgtggttccagaacagaagagccaagtggaggaagcgggagaagtgctggggccgcagctctgtgatggccgagtatggcctgtatggagccatggtgcgccacagcatccccctgcctgagagcatcctgaagagcgccaaggatggcatcatggacagctgtgccccctggctgctgggcatgcacaagaagagcctggaggccgctgctgagagcggcaggaagccagagggggagcggcaggccctgcccaagctggacaagatggagcaggatgagcggggcccagatgcccaggccgccatcagccaggaggagctgagagaaaattccattgctgtgctgcgggccaaggcccaggagcacagcaccaaggtgctgggcaccgtgtctggccctgacagcctggcccggagcacagagaagccagaggaggaggaggccatggatgaagatagacctgctgagcggctgagccccccccagctggaggacatggcctag

SEQ ID NO: 18459 - DNA, 2073 bp, Artificial Sequence
  Description of Artificial Sequence: Synthetic coding sequence
atggaggagagccccctgagccgggcccccagcagaggaggagtgaacttcctgaatgtggcccggacctacatccccaacaccaaggtggagtgccactacaccctgcccccaggcaccatgcccagcgccagtgactggattggcatcttcaaggtggaggccgcctgtgtgcgggactaccacacctttgtgtggagctctgtgcctgagagcaccacagatggcagccccatccacacctctgtgcagttccaggccagctacctgcccaagccaggggcccagctgtaccagttccgctacgtgaaccggcagggccaggtgtgtggccagagcccccccttccagttccgggagccccggcccatggatgagctggtgaccctggaggaggctgatggcggcagtgacatcctgctggtggtgcccaaggccaccgtgctgcagaaccagctggatgagagccagcaggagagaaatgacctgatgcagctgaagctgcagctggagggccaggtgacagagctgcggagccgggtgcaggagctggagcgggccctggccacagcccggcaggagcacacagagctgatggagcagtacaagggcatcagccgcagccatggagagatcacagaggagcgggacatcctgagccggcagcagggcgaccacgtggcccgcatcctggagctggaggatgacatccagaccatcagcgagaaggtgctgaccaaggaggtggagctggaccggctgcgggacacagtgaaggccctgacccgggagcaggagaagctgctgggccagctgaaggaggtgcaggccgacaaggagcagagcgaggccgagctgcaggtggcccagcaggagaaccaccacctgaacctggacctgaaggaggccaagtcctggcaggaggagcagagcgcccaggcccagaggctgaaggacaaggtggcccagatgaaggacaccctgggccaggcccagcagagggtggccgagctggagcccctgaaggagcagctgcggggggcccaggagctggccgccagcagccagcagaaggccaccctgctgggggaggagctggccagcgctgctgctgcccgggacaggaccatcgccgagctgcacaggagccggctggaggtggccgaggtgaatggccgcctggccgagctgggcctgcacctgaaggaggagaagtgccagtggagcaaggagagagctggcctgctgcagagcgtggaggccgagaaggacaagatcctgaagctgtctgctgagatcctgcggctggagaaggctgtgcaggaggagaggacccagaaccaggtgttcaagacagagctggcccgggagaaggacagcagcctggtgcagctgtctgagagcaagcgggagctgacagagctgcggagcgccctgcgggtgctgcagaaggagaaggagcagctgcaggaggagaagcaggagctgctggagtacatgaggaagctggaggcccggctggagaaggtggctgatgagaagtggaatgaagatgccaccacagaagatgaggaggccgctgtgggcctgagctgcccagctgccctgacagattctgaagatgagagccctgaggacatgaggctgcccccctacggcctgtgtgagcggggggaccccggcagcagccctgctggcccccgggaggccagccccctggtggtgatcagccagcctgcccccatcagcccccacctgagcggccctgctgaggacagcagcagtgacagcgcagaagatgagaagtctgtgctgatggctgctgtgcagagcggcggggaggaggccaacctgctgctgcctgagctgggcagcgccttctatgacatggccagcggcttcaccgtgggcaccctgtctgagaccagcactggaggccctgccacccccacctggaaggagtgccccatctgcaaggagcgcttccctgctgagagtgacaaggatgccctggaggaccacatggatggccacttcttcttcagcacccaggaccccttcacctttgaatag

SEQ ID NO: 18460 - DNA, 1980 bp, Artificial Sequence
  Description of Artificial Sequence: Synthetic coding sequence
atgagcctgcccccagagaaggccagcgagctgaagcagctgatccaccagcagctgagcaagatggatgtgcacggccgcatccgggagatcctggccgagaccatccgggaggagctggccccagaccagcagcacctgagcacagaggacctgatcaaggccctgcggcggcggggcatcattgatgatgtgatgaaggagctgaactttgtgacagattctgtggagcaggagctgcccagcagccccaagcagcccatctgctttgaccggcagagcaccctgaagaagaccaacatcgaccccacccggcgctacctgtacctgcaggtgctgggcggcaaggccttcctggagcacctgcaggagcctgagcccctgcccggccaggtgtgcagcaccttcaccctgtgcctgcactacagaaaccagcgcttccgcagcaagcctgtgccctgtgcctgtgagccagacttccatgatggcttcctgctggaggtgcaccgggagagcctgggagatggcaccaggatggctgacagcaccaccatgctgagcatcagtgaccccatccacatggtgctgatcaagacagacatctttggagagaccaccctggtggccagctacttcctggagtggaggtctgtgctgggctctgaaaatggagtgaccagcctgactgtggagctgatgggcgtgggcacagagagcaaggtgtctgtgggcatcctgaacatcaagctggagatgtacccacccctgaaccagaccctgagccaggaggtggtgaacacccagctggccctggagcggcagaagacagctgagaaggagcggctcttcctggtgtatgccaagcagtggtggagggagtacctgcagatccggcccagccacaacagccggctggtgaagatctttgcccaggatgaaaatggcatcaacagacctgtgtgcagctatgtgaagcccctgcgggccggccgcctgctggacaccccccggcaggccgccaggtttgtgaatgtgctgggctatgaaagagcccctgtgattggaggcggcggcaagcaggagcagtggtgcaccctgctggccttcctgtgcaggaacaagggggactgtgaggaccacgccaacctgctgtgcagcctgctgctgggctacggcctggaggcctttgtgtgtgtgggcaccaaggccaagggcgtgccccacgcctgggtgatgacctgtggcacagatggagccatcaccttctgggagagcctgaccggccaccgctacatccacaagcccaccaacccagatgagccccctgtggccgagcagcccaagcccctgtacccctaccgcaccatcggctgtgtgttcaaccaccagatgttcctgggcaactgccagcccagtgatgctgtggagacctgtgtgtttgacctgaatgatgagagcaagtggaagcccatgtctgaggaggccatcaagtctgtgtgtgcccctggggccaccaccagcctgccccccttcccccccctgtgtgccagcaccattgatgcctctgtgaccagcaatgaaattgagatgcagctgcggctgctggtgtctgagcacaggaaggacctgggcctgaccaccgtgtgggaggaccagctgagctacctgctgagccctgccctggccagctatgaatttgagaggaccaccagcatctctgctggaaatgaggagttccaggatgccatccggcgggctgtgcctgatggccacaccttcaagggcttccccatccactttgtgtacagaaatgcccggcgggcctttgccacctgcctgcggagccccttctgtgaggagatcatctgctgccgcggggaccaggtgcggctggccgtgcgggtgcgggtcttcacctacccagagagcgcctgtgctgtgtggatcatgtttgcctgcaagtacagatctgtgctgtag

SEQ ID NO: 18461 - DNA, 1500 bp, Artificial Sequence
  Description of Artificial Sequence: Synthetic coding sequence
atgctggagcggcccccagccctggccatgcccatgcccacagagggcaccccaccacccctgagcggcacccccatccctgtgcctgcctacttcagacatgctgagcccggcttcagcctgaagaggccccggggcctgagccgcagcctgcccccacctcctccagccaagggcagcatccccatcagccgcctcttcccccccaggaccccaggctggcaccagctgcagccccggcgggtgtccttccggggggaggccagcgagaccctgcagagccctggctatgaccccagcaggcctgagagcttcttccagcagagcttccagaggctgagccggctgggccacggcagctatggagaggtgttcaaggtgcgcagcaaagaagatggccgcctgtatgctgtgaagaggtccatgagccccttccggggccccaaggaccgggccaggaagctggccgaggtgggcagccatgagaaggtgggccagcacccctgctgcgtgcggctggagcaggcctgggaggagggcggcatcctgtacctgcagacagagctgtgtggccccagcctgcagcagcactgtgaggcctggggcgccagcctgcctgaggcccaggtgtggggctacctgcgggacaccctgctggccctggcccacctgcacagccagggcctggtgcacctggatgtgaagccagccaacatcttcctgggcccccggggccgctgcaagctgggggactttggcctgctggtggagctgggcacagctggagctggggaggtgcaggagggggacccccgctacatggcccctgagctgctgcagggcagctatggaacagctgctgatgtgttcagcctgggcctgaccatcctggaggtggcctgcaacatggagctgccccatggaggagagggctggcagcagctgcggcagggctacctgcccccagagttcaccgctggcctgagcagcgagctgcggtctgtgctggtgatgatgctggagccagaccccaagctgcgggccacagctgaggccctgctggccctgcctgtgctgcggcagccccgggcctggggcgtgctgtggtgcatggctgctgaggccctgagccggggctgggccctgtggcaggccctgctggccctgctgtgctggctgtggcacggcctggcccacccagcctcctggctgcagcccctgggccccccagccaccccacctggcagccccccctgcagcctgctgctggacagcagcctgagcagcaactgggatgatgacagcctgggccccagcctgagccctgaggccgtgctggccaggacagtgggcagcaccagcacccccaggagccgctgcaccccaagagatgccctggacctgagtgacatcaacagcgagcccccccggggcagcttccccagctttgagcccaggaacctgctgagcctgtttgaggacaccctggaccccacctag

SEQ ID NO: 18462 - DNA, 486 bp, Artificial Sequence
  Description of Artificial Sequence: Synthetic coding sequence
atggatgtgttcctgatgatccgccgccacaagaccaccatcttcacagatgccaaggagagcagcacagtgtttgagctgaagagaattgtggagggcatcctgaagaggcccccagatgagcagaggctgtacaaggatgaccagctgctggatgatggcaagaccctgggagaatgtggcttcaccagccagacagcccggccccaggccccagccaccgtgggcctggccttccgggcagatgacacctttgaggccctgtgcatcgagcccttcagcagccccccagagctgcctgatgtgatgaagccccaggacagcggcagcagcgccaatgagcaggccgtgcacctgcacgtgcacagccagaccatggccaagagcaggaacacctcctggagccagtgccccggcctgacagcctgcagcacccgggagccccaggacggccccacccaggtgcacccccgctggggcctgtag

SEQ ID NO: 18463 - DNA, 1521 bp, Artificial Sequence
  Description of Artificial Sequence: Synthetic coding sequence
atgaccggggagaagatccgcagcctgcggcgggaccacaagcccagcaaggaggagggggacctgctggagcctggagatgaggaggccgccgccgccctgggcggcaccttcaccaggagcagaattggaaaaggaggcaaggcctgccacaagatcttcagcaaccaccaccaccggctgcagctgaaggccgccccagccagcagcaaccccccaggggccccagccctgcccctgcacaacagctctgtgacagccaacagccagagccctgccctgctggccggcaccaaccctgtggccgtggtggctgatggcggcagctgcccagcccactaccctgtgcatgaatgtgtgttcaagggagatgtgcggcggctgagcagcctcatccgcacccacaacatcggccagaaggacaaccacggcaacacccccctgcacctggccgtgatgctgggcaacaaggtgacagccctgctgaggaagctgaagcagcagagccgggagagcgtggaggagaagaggccccggctgctgaaggccctgaaggagctgggggacttctacctggagctgcactgggacttccagagctgggtgcccctgctgagccgcatcctgcccagtgatgcctgcaagatctacaagcagggcatcaacatccggctggacaccaccctgattgacttcacagacatgaagtgccagagaggagacctgtccttcatcttcaatggagatgctgcccccagcgagagctttgtggtgctggacaatgagcagaaggtgtaccagaggatccaccacgaggagagcgagatggagacagaggaggaggtggacatcctgatgagcagtgacatctacagcgccaccctgagcaccaagagcatctccttcacccgggcccagacaggctggctgttccgggaggacaagacagagcgggtgggcaacttcctggccgacttctacctggtgaatggcctggtgctggagagcaggaagagaagagagcacctgtctgaggaggacatcctgaggaacaaggccatcatggagagcctgagcaagggcggcaacatcatggagcagaactttgagcccatccggcggcagagcctgaccccaccaccccagaacaccatcacctgggaggagtacatctctgcagaaaatggcaaggccccccacctgggccgggagctggtgtgcaaggagagcaagaagaccttcaaggccaccatcgccatgagccaggagttccccctgggcatcgagctgctgctgaatgtgctggaggtggtggcccccttcaagcacttcaacaagctgcgggagtttgtgcagatgaagctgcccccaggcttccctgtgaagctggacatccctgtgttccccaccatcacagccaccgtgaccttccaggagttccgctatgatgaatttgatggcagcatcttcaccatcccagatgactacaaggaggaccccagccgcttcccagacctgtag

SEQ ID NO: 18464 - DNA, 699 bp, Artificial Sequence
  Description of Artificial Sequence: Synthetic coding sequence
atgcagcccccagcccccccagctgagctggccgcccccctgcccagccccctgcctgagcagcccctggacagccctgctgccccagccctgagccccagcggcctgggcctgcagcccggccctgagaggaccagcaccaccaagagcaaggagctgagccctggcagcgcccagaagggcagccctggcagcagccagggcacagcctgtgccggcacccagcccggggcccagcccggggcccagcccggggccagccccagccccagccagcccccagctgaccagagcccccacaccctgaggaaggtgtccaagaagctggcccccatcccccccaaggtgcccttcggccagcccggggccatggctgaccagagcgctggccagcccagccctgtgtccctgagccccaccccacccagcacccccagcccctacggcctgagctacccccagggctacagcctggccagcggccagctgagccctgctgctgccccacccctggccagccccagcgtcttcaccagcaccctgagcaagagccggcccacccccaagccccggcagaggcccaccctgcccccaccccagcccccaacagtgaacctgagcgccagcagcccccagagcacagaggcccccatgctggatggcatgagccctggagagagcatgagcacagctgtgtag

SEQ ID NO: 18465 - DNA, 1221 bp, Artificial Sequence
  Description of Artificial Sequence: Synthetic coding sequence
atgcaccctgctgtgttcctgagcctgcctgacctgcgctgcagcctgctgctgctggtgacctgggtgttcacccctgtgaccacagagatcaccagcctggacacagaaaatattgatgagatcctgaacaatgctgatgtggccctggtgaacttctatgctgactggtgccgcttcagccagatgctgcaccccatctttgaggaggccagtgatgtgatcaaggaggagttccccaatgaaaaccaggtggtgtttgcccgggtggactgtgaccagcacagcgacatcgcccagcgctaccgcatcagcaagtaccccaccctgaagctgttcagaaatggcatgatgatgaagcgggagtaccggggccagaggtctgtgaaggccctggccgactacatccggcagcagaagagtgaccccatccaggagatccgggacctggccgagatcaccaccctggacaggagcaagaggaacatcatcggctactttgagcagaaggacagcgacaactacagagtgtttgagcgggtggccaacatcctgcatgatgactgtgccttcctgagcgcctttggagatgtgtccaagccagagcgctacagcggggacaacatcatctacaagcccccaggccacagcgccccagacatggtgtacctgggcgccatgaccaactttgatgtgacctacaactggatccaggacaagtgtgtgcccctggtgcgggagatcacctttgaaaatggagaggagctgacagaggagggcctgcccttcctgatcctcttccacatgaaggaggacacagagagcctggagatcttccagaatgaggtggcccggcagctgatcagcgagaagggcaccatcaacttcctgcatgctgactgtgacaagttccgccaccccctgctgcacatccagaagaccccagctgactgccctgtgattgccatcgacagcttccgccacatgtatgtgtttggagacttcaaggatgtgctgatccctgggaagctgaagcagtttgtgtttgacctgcacagcggcaagctgcaccgggagttccaccacggccctgaccccacagacacagcccctggagagcaggcccaggatgtggccagcagccccccagagagcagcttccagaagctggcccccagcgagtaccgctacaccctgctgcgggacagagatgagctgtag

SEQ ID NO: 18466 - DNA, 5601 bp, Artificial Sequence
  Description of Artificial Sequence: Synthetic coding sequence
atggaccctgtgggcctgcagctgggcaacaagaacctgtggagctgcctggtgcggctgctgaccaaggaccctgagtggctgaatgccaagatgaagttcttcctgcccaacacagacctggacagcagaaatgagaccctggaccctgagcagagggtcatcctgcagctgaacaagctgcacgtgcagggcagtgacacctggcagagcttcatccactgtgtgtgcatgcagctggaggtgcccctggacctggaggtgctgctgctgagcaccttcggctatgatgatggcttcaccagccagctgggcgctgagggcaagagccagcctgagagccagctgcaccacggcctgaagaggccccaccagagctgtggcagcagccccaggaggaagcagtgcaagaagcagcagctggagctggccaagaagtacctgcagctgctgcggaccagcgcccagcagcgctaccgcagccagatccctggcagcggccagccccacgccttccaccaggtgtatgtgccccccatcctgcggcgggccacagccagcctggacaccccagagggcgccatcatgggagatgtgaaggtggaggatggagcagatgtgtccatcagtgacctcttcaacaccagggtgaacaagggcccccgggtgacagtgctgctgggcaaggccggcatgggcaagaccaccctggcccaccggctgtgccagaagtgggccgagggccacctgaactgcttccaggccctcttcctgtttgagttccggcagctgaacctgatcacccgcttcctgacccccagcgagctgctgtttgacctgtacctgagccctgagagtgaccatgacaccgtcttccagtacctggagaagaatgctgaccaggtgctgctgatctttgatggcctggatgaggccctgcagcccatgggcccagatggccctggccctgtgctgaccctcttcagccacctgtgcaatggcaccctgctgcccggctgccgggtgatggccaccagcaggcctgggaagctgcctgcctgcctgcctgctgaggccgccatggtgcacatgctgggctttgatggcccccgggtggaggagtatgtgaaccacttcttcagcgcccagcccagccgggagggcgccctggtggagctgcagaccaacggccgcctgcggagcctgtgtgctgtgcctgccctgtgccaggtggcctgcctgtgcctgcaccacctgctgcctgaccacgcccctggccagagcgtggccctgctgcccaacatgacccagctgtacatgcagatggtgctggccctgagccccccaggccacctgcccaccagcagcctgctggacctgggggaggtggccctgcggggcctggagaccgggaaggtgatcttctacgccaaggacatcgccccacccctgattgcctttggagccacccacagcctgctgaccagcttctgtgtgtgcaccggccctggccaccagcagacaggctacgccttcacccacctgagcctgcaggagttcctggccgccctgcacctgatggccagccccaaggtgaacaaggacaccctgacccagtatgtgaccctgcacagccgctgggtgcagaggaccaaggcccggctgggcctgagtgaccacctgcccaccttcctggccggcctggccagctgcacctgccggcccttcctgagccacctggcccagggcaatgaagactgtgtgggcgccaagcaggccgctgtggtgcaggtgctgaagaagctggccaccaggaagctgaccggccccaaggtggtggagctgtgccactgtgtggatgagacccaggagcctgagctggccagcctgacagcccagagcctgccctaccagctgcccttccacaacttccccctgacctgcacagacctggccaccctgaccaacatcctggagcaccgggaggcccccatccacctggactttgatggctgccccctggagccccactgcccagaggccctggtgggctgcggccagatcgagaacctgtccttcaagagcaggaaatgtggagatgcctttgctgaggccctgagccgcagcctgcccaccatgggccgcctgcagatgctgggcctggccggcagcaagatcacagcccggggcatcagccacctggtgaaggccctgcccctgtgcccccagctgaaggaggtgtccttccgggacaaccagctgagtgaccaggtggtgctgaacatcgtggaggtgctgccccacctgccccggctgaggaagctggacctgagcagcaacagcatctgtgtgtccaccctgctgtgcctggcccgggtggccgtgacctgccccaccgtgaggatgctgcaggcccgggaggccgacctgatcttcctgctgagccccccaacagagaccacagctgagctgcagagggccccagacctgcaggagagtgatggccagaggaagggggcccagagccgcagcctgaccctgcggctgcagaagtgccagctgcaggtgcatgatgctgaggccctgattgccctgctgcaggagggcccccacctggaggaggtggacctgagcggcaaccagctggaggatgagggctgccgcctgatggccgaggccgccagccagctgcacatcgccaggaagctggacctgagcaacaacggcctgtctgtggccggcgtgcactgtgtgctgcgggctgtgtctgcctgctggaccctggccgagctgcacatcagcctgcagcacaagacagtcatcttcatgtttgcccaggagcctgaggagcagaagggcccccaggagcgggccgccttcctggacagcctgatgctgcagatgcccagcgagctgcccctgagcagcaggaggatgaggctgacccactgcggcctgcaggagaagcacctggagcagctgtgcaaggccctgggcggcagctgccacctgggccacctgcacctggacttctctggaaatgccctgggagatgagggcgccgcccggctggcccagctgctgcccggcctgggcgccctgcagagcctgaacctgtctgaaaatggcctgagcctggatgctgtgctgggcctggtgcgctgcttcagcaccctgcagtggctgttccggctggacatcagctttgagagccagcacatcctgctgcggggggacaagaccagccgggacatgtgggccaccggcagcctgcctgacttccctgctgctgccaagttcctgggcttccggcagcgctgcatccccaggagcctgtgcctgtctgagtgccccctggagccccccagcctgacccggctgtgtgccaccctgaaggactgccccggccccctggagctgcagctgagctgtgagttcctgagtgaccagagcctggagaccctgctggactgcctgccccagctgccccagctgagcctgctgcagctgagccagacaggcctgagccccaagagccccttcctgctggccaacaccctgagcctgtgcccccgggtgaagaaggtggacctgcggagcctgcaccacgccaccctgcacttccgcagcaatgaggaggaggagggcgtgtgctgcggccgcttcaccggctgcagcctgagccaggagcacgtggagagcctgtgctggctgctgagcaagtgcaaggacctgagccaggtggacctgagcgccaacctgctgggggacagcggcctgcgctgcctgctggagtgcctgccccaggtgcccatcagcggcctgctggacctgagccacaacagcatcagccaggagagcgccctgtacctgctggagaccctgcccagctgcccccgggtgcgggaggcctctgtgaacctgggcagcgagcagagcttccgcatccacttcagccgggaggaccaggccggcaagaccctgcggctgtctgagtgcagcttccggcctgagcacgtgtcccggctggccaccggcctgagcaagagcctgcagctgacagagctgaccctgacccagtgctgcctgggccagaagcagctggccatcctgctgagcctggtgggccggcctgctggcctcttcagcctgcgggtgcaggagccctgggccgaccgggcccgggtgctgagcctgctggaggtgtgtgcccaggccagcggctctgtgacagagatcagcatcagcgagacccagcagcagctgtgtgtgcagctggagttcccccggcaggaggagaaccctgaggccgtggccctgcggctggcccactgtgacctgggcgcccaccacagcctgctggtgggccagctgatggagacctgtgcccggctgcagcagctgagcctgagccaggtgaacctgtgtgaagatgatgatgccagcagcctgctgctgcagagcctgctgctgagcctgtctgagctgaagaccttccggctgaccagcagctgtgtgtccacagagggcctggcccacctggccagcggcctgggccactgccaccacctggaggagctggacctgagcaacaaccagtttgatgaggagggcaccaaggccctgatgagggccctggagggcaagtggatgctgaagaggctggacctgagccacctgctgctgaacagcagcaccctggccctgctgacccaccggctgagccagatgacctgcctgcagagcctgcggctgaacagaaattccattggagatgtgggctgctgccacctgtctgaggccctgcgggccgccaccagcctggaggagctggacctgagccacaaccagattggagatgctggggtgcagcacctggccaccatcctgcccggcctgcctgagctgaggaagattgacctgagcggcaacagcatcagcagcgctggaggagtgcagctggccgagagcctggtgctgtgccggcggctggaggagctgatgctgggctgcaatgccctgggggaccccacagccctgggcctggcccaggagctgccccagcacctgcgggtgctgcacctgcccttcagccacctgggccctgggggcgccctgagcctggcccaggccctggatggcagcccccacctggaggagatcagcctggccgagaacaacctggccggcggcgtgctgcgcttctgcatggagctgcccctgctgcggcagattgacctggtgtcctgcaagattgacaaccagacagccaagctgctgaccagcagcttcaccagctgcccagccctggaggtgatcctgctgtcctggaacctgctgggagatgaggccgctgctgagctggcccaggtgctgccccagatgggccgcctgaagagggtggacctggagaagaaccagatcacagccctgggcgcctggctgctggccgagggcctggcccagggcagcagcatccaggtgatccggctgtggaacaaccccatcccctgtgacatggcccagcacctgaagagccaggagccccggctggactttgccttctttgacaaccagccccaggccccctggggcacctag

SEQ ID NO: 18467 - DNA, 897 bp, Artificial Sequence
  Description of Artificial Sequence: Synthetic coding sequence
atgatgaatgtgaacacccggggcacctacctggccagcaaggcctgcatcccctacctgaagaagagcaaggtggcccacatcctgaacatcagcccccccctgaacctgaaccctgtgtggttcaagcagcactgtgcctacaccatcgccaagtatggcatgtccatgtatgtgctgggcatggccgaggagttcaagggggagattgctgtgaatgccctgtggcccaagacagccatccacacagctgccatggacatgctgggcggccctggcatcgagagccagtgcaggaaggtggacatcatcgcagatgctgcctacagcatcttccagaagcccaagagcttcaccggcaactttgtgattgatgagaacatcctgaaggaggagggcattgaaaattttgatgtgtatgccatcaagccaggccaccccctgcagcctgacttcttcctggatgagtacccagaggccgtgtccaagaaggtggagagcactggagctgtgcctgagttcaaggaggagaagctgcagctgcagcccaagcccaggtctggagctgtggaggagaccttccgcatcgtgaaggacagcctgagtgatgatgtggtgaaggccacccaggccatctacctgtttgagctgagcggggaggatggcggcacctggttcctggacctgaagagcaagggcggcaatgtgggctacggggagcccagcgaccaggctgatgtggtgatgtccatgaccacagatgactttgtgaagatgttttctgggaagctgaagcccaccatggccttcatgtctgggaagctgaagatcaagggcaacatggccctggccatcaagctggagaagctgatgaaccagatgaatgcccggctgtag

SEQ ID NO: 18468 - DNA, 4026 bp, Artificial Sequence
  Description of Artificial Sequence: Synthetic coding sequence
atgtggaggaggaagcaccccaggaccagcggcggcacccggggcgtgctgagcggcaacagaggagtggagtatggcagcggccggggccacctgggcacctttgagggccgctggaggaagctgcccaagatgcctgaggccgtgggcacagaccccagcaccagcaggaagatggccgagctggaggaggtgaccctggatggcaagcccctgcaggccctgcgggtgacagacctgaaggccgccctggagcagaggggcctggccaagagcggccagaagagcgccctggtgaagaggctgaagggggccctgatgctggagaacctgcagaagcacagcacccctcatgctgccttccagcccaacagccagattggagaggagatgagccagaacagcttcatcaagcagtacctggagaagcagcaggagctgctgcggcagaggctggagcgggaggcccgggaggccgctgagctggaggaggccagcgctgagagtgaagatgagatgatccaccctgagggcgtggccagcctgctgcccccagacttccagagcagcctggagaggcctgagctggagctgagccgccacagccccaggaagagcagcagcatcagcgaggagaagggggacagtgatgatgagaagcccaggaaaggagagcggcgcagcagccgggtgcggcaggcccgggccgccaagctgtctgagggcagccagcctgctgaggaggaggaggaccaggagacccccagcaggaacctgcgggtgcgggctgacaggaacctgaagacagaggaggaggaggaggaggaggaggaggaggaggaggatgatgaggaggaggagggagatgatgagggccagaagagccgggaggcccccatcctgaaggagttcaaggaggagggggaggagatcccccgggtgaagccagaggagatgatggatgagcggcccaagaccaggagccaggagcaggaggtgctggagcggggcggccgcttcaccaggagccaggaggaggccaggaagagccacctggcccggcagcagcaggagaaggagatgaagaccaccagccccctggaggaggaggagcgggagatcaagagcagccagggcctgaaggagaagagcaagagccccagccccccccggctgacagaggacaggaagaaggccagcctggtggccctgcctgagcagacagccagcgaggaggagaccccaccacccctgctgaccaaggaggccagcagccccccaccccacccccagctgcacagcgaggaggagattgagcccatggagggccctgccccagctgtgctgatccagctgagcccccccaacacagatgctgacacccgggagctgctggtgtcccagcacacagtgcagctggtgggcggcctgagccccctgagcagccccagcgacaccaaggccgagagccctgctgagaaggtgcctgaggagagcgtgctgcccctggtgcagaagagcaccctggccgactacagcgcccagaaggacctggagcctgagagtgacagaagtgcccagcccctgcccctgaagattgaggagctggccctggccaagggcatcacagaagaatgtctgaagcagcccagcctggagcagaaggagggccggcgggccagccacaccctgctgcccagccaccggctgaagcagagcgctgacagcagcagcagccgcagcagcagcagcagcagcagcagcagccgcagccgcagccgcagcccagacagcagcggcagccgcagccacagccccctgcggagcaagcagagagatgtggcccaggcccggacccacgccaacccccggggccggcccaagatgggcagccgcagcaccagcgagagccgcagccgcagccgcagccgcagccgcagcgccagcagcaacagcaggaagagcctgagccctggggtgtcccgggacagcagcaccagctacacagagaccaaggaccccagcagcggccaggaggtggccaccccacctgtgccccagctgcaggtgtgtgagcccaaggagaggaccagcaccagcagcagctctgtgcaggcccggcggctgagccagcctgagagcgctgagaagcacgtgacccagaggctgcagcctgagcggggcagccccaagaagtgtgaggccgaggaggccgagcccccagctgccacccagccccagaccagcgagacccagaccagccacctgcctgagagcgagcgcatccaccacacagtggaggagaaggaggaggtgaccatggacaccagcgagaacagaccagaaaatgatgtgcctgagccccccatgcccatcgctgaccaggtgtccaatgatgacaggcctgagggctctgtggaggatgaggagaagaaggagagcagcctgcccaagagcttcaagaggaagatctctgtggtgtctgccaccaagggcgtgcctgctggcaacagcgacacagagggcggccagcccggcaggaagaggcgctggggcgccagcacagccaccacccagaagaagcccagcatcagcatcaccacagagagcctgaagagcctcatcccagacatcaagcccctggccggccaggaggccgtggtggacctgcacgcagatgacagccgcatcagtgaagatgaaacagaaagaaatggagatgatggcacccatgacaagggcctgaagatctgcaggacagtgacccaggtggtgcctgctgagggccaggagaatggccagcgggaggaggaggaggaggagaaggagcctgaggccgagccccctgtgcccccccaggtgtctgtggaggtggccctgcccccacctgctgagcacgaggtgaagaaggtgaccctgggggacaccctgaccaggaggagcatcagccagcagaagtctggagtgtccatcaccattgatgatcctgtgaggacagcccaggtgcccagccccccccggggcaagatcagcaacatcgtgcacatcagcaacctggtgcggcccttcaccctgggccagctgaaggagctgctgggccgcacaggcaccctggtggaggaggccttctggattgacaagatcaagagccactgctttgtgacctacagcacagtggaggaggccgtggccaccaggacagccctgcacggcgtgaagtggccccagagcaaccccaagttcctgtgtgccgactatgcagagcaggatgagctggactaccaccggggcctgctggtggaccggcccagcgagaccaagacagaggagcagggcatcccccggcccctgcaccccccacctcctcctcctgtgcagcccccccagcaccccagggctgagcagcgggagcaggagagagctgtgcgggagcagtgggccgagcgggagcgggagatggagcggcgggagaggaccaggtctgagcgggagtgggaccgggacaaggtgcgggagggccccaggagccgcagccgcagccgggacagaagaaggaaggagcgggccaagagcaaggagaagaagtctgagaagaaggagaaggcccaggaggagcccccagccaagctgctggatgacctcttcaggaagaccaaggccgccccctgcatctactggctgcccctgacagacagccagatcgtgcagaaggaggccgagcgggcagagcgggccaaggagcgggagaagaggaggaaggagcaggaggaggaggagcagaaggagcgggagaaggaggccgagcgggagaggaaccggcagctggagcgggagaagaggcgggagcacagccgggagcgggaccgggagcgggagcgggagcgggagcgggacagaggagaccgggaccgggaccgggagcgggaccgggagcggggccgggagcgggaccggcgggacaccaagaggcacagccgcagccgcagccgcagcacccctgtgcgggaccggggcggcagaagatag

SEQ ID NO: 18469 - DNA, 600 bp, Artificial Sequence
  Description of Artificial Sequence: Synthetic coding sequence
atgagcagtggaaatgccaagattggccacccagcccccaacttcaaggccacagctgtgatgccagatggccagttcaaggacatcagcctgagtgactacaagggcaagtatgtggtgttcttcttctaccccctggacttcacctttgtgtgccccacagagatcatcgccttcagtgacagagctgaggagttcaagaagctgaactgccaggtgattggagcctctgtggacagccacttctgccacctggcctgggtgaacacccccaagaagcagggcggcctgggccccatgaacatccccctggtgtctgaccccaagaggaccatcgcccaggactatggagtgctgaaggcagatgagggcatctccttccggggcctcttcatcattgatgacaagggcatcctgcggcagatcaccgtgaatgacctgcctgtgggccgctctgtggatgagaccctgcggctggtgcaggccttccagttcacagacaagcatggagaggtgtgcccagctggctggaagccaggcagtgacaccatcaagccagatgtgcagaagagcaaggagtacttcagcaagcagaagtag

SEQ ID NO: 18470 - DNA, 1077 bp, Artificial Sequence
  Description of Artificial Sequence: Synthetic coding sequence
atggagaagaagaagatggtgacccagggcaaccaggagcccaccaccaccccagatgccatggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgaccacagaaggaggagcccagacagatggccagcagagccagacccagagcagcgagaacagcgagagcaagagcacccccaagaggctgcacgtgagcaacatccccttccgcttccgggaccctgacctgcggcagatgtttggaggcttcggctttgtgacctttgagaacagcgcagatgctgaccgggcccgggagaagctgcatggaacagtggtggagggcaggaagattgaggtgaacaatgccacagcccgggtgatgaccaacaagaagatggtgaccccctatgccaacggctggaagctgagccctgtggtgggcgctgtgtatggccctgagctgtatgctgccagcagcttccaggctgatgtgtccctgggcaatgatgctgctgtgcccctgagcggccggggcggcatcaacacctacatccccctcatcatccctggcttcccctaccccacagctgccaccacagctgctgccttccggggggcccacctgcggggccggggccgcacagtgtatggagctgtgcgggctgtgcccccaacagccatcccagcctacccaggagtggtgtaccaggacggcttctatggagctgacctgtatggaggctacgccgcctaccgctatgcccagcctgccacagccacagctgccacagctgctgctgctgctgctgctgcctacagtgatggctacggccgggtgtacacagctgacccctaccacgccctggccccagctgccagctatggagtgggcgctgtggccagcctgtaccggggcggctacagcagatttgccccctactag

SEQ ID NO: 18471 - DNA, 1596 bp, Artificial Sequence
  Description of Artificial Sequence: Synthetic coding sequence
atgagctacccagcagatgattatgagagcgaggccgcctatgacccctatgcctaccccagcgactatgacatgcacactggagaccccaagcaggacctggcctatgaaaggcagtatgagcagcagacctaccaggtgattcctgaggtgatcaagaacttcatccagtacttccacaagacagtgtctgacctgattgaccagaaggtgtatgagctgcaggccagccgggtgtccagtgatgtgattgaccagaaggtgtatgagatccaggacatctatgagaacagctggaccaagctgacagagcgcttcttcaagaacaccccctggccagaggccgaggccatcgccccccaggtgggcaatgatgctgtgttcctgatcctgtacaagatcctgcaggcccacggccctgcccccctggagctgcccaaccagtggctgtgggacatcattgatgagttcatctaccagttccagagcttcagccagtaccgctgcaagacagccaagaagtctgaggaggagattgacttcctgcggagcaaccccaagatctggaatgtgcacagcgtgctgaatgtgctgcacagcctggtggacaagagcaacatcaaccggcagctggaggtgtacaccagcggcggggaccctgagagcgtggccggggagtatggccgccacagcctgtacaagatgctgggctacttcagcctggtgggcctgctgcggctgcacagcctgctgggggactactaccaggccatcaaggtgctggagaacatcgagctgaacaagaagtccatgtacagccgggtgcctgagtgccaggtgaccacctactactacgtgggctttgcctacctgatgatgaggcgctaccaggatgccatccgggtgtttgccaacatcctgctgtacatccagaggaccaagtccatgttccagaggaccacctacaagtatgagatgatcaacaagcagaatgagcagatgcacgccctgctggccatcgccctgaccatgtaccccatgagaattgatgagagcatccacctgcagctgcgggagaagtatggagacaagatgctgaggatgcagaagggggacccccaggtgtatgaggagctgttctcctacagctgccccaagttcctgagccctgtggtgcccaactatgacaacgtgcaccccaactaccacaaggagcccttcctgcagcagctgaaggtgttcagtgatgaggtgcagcagcaggcccagctgagcaccatccgctccttcctgaagctgtacaccaccatgcctgtggccaagctggccggcttcctggacctgacagagcaggagttccgcatccagctgctggtgttcaagcacaagatgaagaacctggtgtggaccagcggcatcagcgccctggatggagagttccagagcgccagcgaggtggacttctacatcgacaaggacatgatccacatcgctgacaccaaggtggcccggcgctacggggacttcttcatccggcagatccacaagtttgaggagctgaacagaaccctgaagaagatgggccagaggccctag

SEQ ID NO: 18472 - DNA, 5952 bp, Artificial Sequence
  Description of Artificial Sequence: Synthetic coding sequence
atgagcggcaacaagaggggcagccgggccagctgcccccacagaggagctgagtgcctgctgccctgggccgccctgaacctgcagggcttccagctgctgctgctgcaccccagcgccacagccatgatggatgtgtctgagctgggggagagcgcccgctacctgcggcagggctaccaggagatgaccaaggtgcacaccatcccctgggatggcaagaagagggtgtgggtgcctgatgagcaggatgcctacgtggaggccgaggtgaagtctgaggccaccggcggccgggtgacagtggagaccaaggaccagaaggtgctgatggtgcgggaggccgagctgcagcccatgaacccccccaggtttgacctgctggaggacatggccatgatgacccacctgaatgaggcctctgtgctgcacaacctgcggcagagatatgcccgctggatgatctacacctacagcggcctcttctgtgtgaccatcaacccctacaagtggctgcctgtgtacacagcctctgtggtggccgcctacaagggcaagagaagaagtgacagccccccccacatctatgctgtggccgacaatgcctacaatgacatgctgaggaacagagacaaccagagcatgctgatcaccggggagagcggggccggcaagacagtgaacaccaagagggtcatccagtactttgccatcgtggccgccctgggagatggccctgggaagaaggcccagttcctggccaccaagacaggaggcaccctggaggaccagatcatcgaggccaacccagccatggaggcctttggaaatgccaagaccctgagaaatgacaacagcagcagatttgggaagttcatccgcatccacttcggccccagcggcaagctggccagcgctgacatcgacagctacctgctggagaagagcagggtcatcttccagctgcctggagagaggagctaccacgtgtactaccagatcctgagcggcaggaagccagagctgcaggacatgctgctgctgtccatgaacccctatgactaccacttctgcagccagggcgtcatcaccgtggacaacatgaatgatggagaggagctgattgccacagaccacgccatggacatcctgggcttctctgtggatgagaagtgtgcctgctacaagatcgtgggcgccctgctgcacttcggcaacatgaagttcaagcagaagcagcgggaggagcaggccgaggctgatggaacagaatctgctgacaaggccgcctacctgatgggcgtgtcctctggggacctgctgaagggcctgctgcacccccgggtgcgggtgggcaatgaatatgtgaccaagggccagagcgtggagcaggtggtgtttgctgtgggcgccctggccaaggccacctatgacaggctcttccgctggctggtgagccgcatcaaccagaccctggacaccaagctgccccggcagttcttcatcggcgtgctggacattgctggctttgagatctttgagttcaacagctttgagcagctgtgcatcaacttcaccaatgagaagctgcagcagttcttcaaccagcacatgtttgtgctggagcaggaggagtacaagcgggagggcatcgactgggtgttcatcgactttggcctggacctgcagccctgcatcgacctgattgagaagcccctgggcatcctgagcatcctggaggaggagtgcatgttccccaaggccagtgatgccagcttccgggccaagctgtatgacaaccacgccggcaagagccccaacttccagcagcccaggccagacaagaagaggaagtaccaggcccactttgaggtggtgcactacgccggcgtggtgccctacagcatcgtgggctggctggagaagaacaaggaccccctgaatgagaccgtggtgcccatcttccagaagagccagaaccggctgctggccaccctgtatgagaactatgccggcagctgcagcacagagccccccaagtctggagtgaaggagaagaggaagaaggccgccagcttccagacagtgtcccagctgcacaaggagaacctgaacaagctgatgaccaacctgcgggccacccagccccactttgtgcgctgcatcgtgcccaatgaaaacaagaccccaggagtgatggatgccttcctggtgctgcaccagctgcgctgcaatggagtgctggagggcatccgcatctgccggcagggcttccccaaccggctgctgtacacagacttccggcagcgctaccgcatcctgaaccccagcgccatcccagatgacaccttcatggacagcaggaaggccacagagaagctgctgggcagcctggacctggaccacacccagtaccagtttggccacaccaaggtgttcttcaaggccggcctgctgggcgtgctggaggagctgcgggaccagaggctggccaaggtgctgaccctgctgcaggcccggagccggggccgcctgatgaggctggagtaccagaggctgctgggcggcagagatgccctcttcaccatccagtggaacatccgggccttcaatgctgtgaagaactggagctggatgaagctgttcttcaagatgaagcccctgctgcggagcgcccaggccgaggaggagctggccgccctgcgggcagagctgcggggcctgcggggggccctggccgctgctgaggccaagaggcaggagctggaggagacccacgtgtccatcacccaggagaagaatgacctggccctgcagctgcaggccgagcaggacaacctggctgatgctgaggagcgctgccacctgctgatcaagagcaaggtgcagctggagggcaaggtgaaggagctgtctgagcggctggaggatgaggaggaggtgaatgctgacctggccgcccggcggaggaagctggaggatgaatgtacagagctgaagaaggacattgatgacctgaagctgaccctggccaaggccgagaaggagaagcaggccacagagaacaaggtgaagaacctgacagaggagatggccgccctggatgaatctgtggcccggctgaccaaggagaagaaggccctgcaggaggcccaccagcaggccctgggggacctgcaggccgaggaggacagagtgtctgccctgaccaaggccaagctgcggctggagcagcaggtggaggacctggagtgcagcctggagcaggagaagaagctgaggatggacacagagcgggccaagaggaagctggagggggacctgaagctgacccaggagagcgtggctgatgctgcccaggacaagcagcagctggaggagaagctgaagaagaaggacagcgagctgagccagctgagcctgcgggtggaggatgagcagctgctgggcgcccagatgcagaagaagatcaaggagctgcaggcccgggcagaggagctggaggaggagctggaggccgagcgggccgcccgggcccgggtggagaagcagagagctgaggccgcccgggagctggaggagctgtctgagcggctggaggaggccggcggggccagcgctggccagcgggagggctgcaggaagcgggaggccgagctgggccgcctgcggcgggagctggaggaggccgccctgcggcatgaggccaccgtggccgccctgcggaggaagcaggccgagggcgctgctgagctgggggagcaggtggacagcctgcagagggtgcggcagaagctggagaaggagaagtctgagctgaggatggaggtggatgacctggccgccaacgtggagaccctgacccgggccaaggccagcgctgagaagctgtgcaggacctatgaggaccagctgtctgaggccaagatcaaggtggaggagctgcagaggcagctggctgatgccagcacccagaggggccgcctgcagacagaaagtggagagctgagccggctgctggaggagaaggagtgcctgatcagccagctgagccggggcaaggccctggccgcccagagcctggaggagctgcggcggcagctggaggaggagagcaaggccaagagcgccctggcccatgctgtgcaggccctgcggcatgactgtgacctgctgcgggagcagcacgaggaggaggccgaggcccaggccgagctgcagaggctgctgagcaaggccaatgctgaggtggcccagtggaggagcaaatatgaagcagatgccatccagaggacagaggagctggaggaggccaagaagaagctggccctgcggctgcaggaggccgaggagggcgtggaggccgccaatgccaagtgcagcagcctggagaaggccaagctgcggctgcagacagaaagtgaagatgtgaccctggagctggagcgggccaccagcgctgctgctgccctggacaagaagcagaggcacctggagcgggccctggaggagcggcggcggcaggaggaggagatgcagcgggagctggaggccgcccagcgggagagccggggcctgggcacagagctgttccggctgcggcacggccacgaggaggccctggaggccctggagaccctgaagcgggagaacaagaacctgcaggaggagatcagtgacctgacagaccaggtgtccctgagcggcaagagcatccaggagctggagaagaccaagaaggccctggagggggagaagtctgagatccaggccgccctggaggaggccgagggcgccctggagctggaggagaccaagaccctgcgcatccagctggagctgagccaggtgaaggccgaggtggacaggaagctggccgagaaggatgaagaatgtgccaacctgcggaggaaccaccagagagctgtggagagcctgcaggccagcctggatgctgagacccgggccagaaatgaggccctgcggctgaagaagaagatggagggggacctgaatgacctggagctgcagctgggccacgccacccggcaggccacagaggcccaggccgccacccggctgatgcaggcccagctgaaggaggagcaggccggcagagatgaggagcagaggctggccgctgagctgcacgagcaggcccaggccctggagcggcgggccagcctgctggccgctgagctggaggagctgcgggccgccctggagcagggcgagaggagccggcggctggccgagcaggagctgctggaggccacagagcggctgaacctgctgcacagccagaacacaggcctgctgaaccagaagaagaagctggaggccgacctggcccagctgtctggagaggtggaggaggccgcccaggagcggcgggaggccgaggagaaggccaagaaggccatcacagatgctgccatgatggccgaggagctgaagaaggagcaggacaccagcgcccacctggagaggatgaagaagaccctggagcagacagtgcgggagctgcaggcccggctggaggaggccgagcaggccgccctgcggggcggcaagaagcaggtgcagaagctggaggccaaggtgcgggagctggaggccgagctggatgctgagcagaagaagcatgctgaggccctgaagggcgtgaggaagcatgagcggcgggtgaaggagctggcctaccaggccgaggaggacaggaagaacctggccaggatgcaggacctggtggacaagctgcagagcaaggtgaagagctacaagaggcagtttgaggaggccgagcagcaggccaacaccaacctggccaagtacaggaaggcccagcacgagctggatgatgctgaggagagagctgacatggccgagacccaggccaacaagctgcgggcccggaccagagatgccctgggccccaagcacaaggagtag

SEQ ID NO: 18473 - DNA, 2730 bp, Artificial Sequence
  Description of Artificial Sequence: Synthetic coding sequence
atggagcgggccatggagcagctgaaccggctgaccaggagcctgcggcgggccaggacagtggagctgcctgaagataatgaaacagctgtgtacaccctgatgcccatggtgatggctgaccagcacaggtctgtgtctgagctgctgagcaacagcaagtttgatgtgaactatgccttcggccgggtgaagaggagcctgctgcacatcgccgccaactgtggctctgtggagtgcctggtgctgctgctgaagaagggggccaaccccaactaccaggacatcagcggctgcacccccctgcacctggccgccagaaatggccagaagaagtgcatgagcaagctgctggagtacagcgcagatgtgaacatctgcaacaatgaaggcctgacagccatccactggctggccgtgaatggaagaacagagctgctgcatgacctggtgcagcacgtgtctgatgtggatgtggaggatgccatgggccagacagccctgcacgtggcctgccagaatggccacaagaccaccgtgcagtgcctgctggacagcggggctgacatcaaccggcccaacgtgtctggggccacccccctgtactttgcctgcagccacggccagagggacacagcccagatcctgctgctgcggggggccaagtacctgcctgacaagaatggagtgacccccctggacctgtgtgtgcagggcggctatggagagacctgtgaggtgctgatccagtaccaccccaggctcttccagaccatcatccagatgacccagaatgaagacctgcgggagaacatgctgcggcaggtgctggagcacctgagccagcagagcgagagccagtacctgaagatcctgaccagcctggccgaggtggccaccaccaacggccacaagctgctgagcctgagcagcaactatgatgcccagatgaagagcctgctgagaattgtgaggatgttctgccacgtgttcagaattggccccagcagccccagcaatggcatcgacatgggctacaatggaaacaagacccccaggagccaggtgttcaagcccctggagctgctgtggcacagcctggatgagtggctggtgctgattgccacagagctgatgaagaacaagagggacagcacagagatcaccagcatcctgctgaagcagaagggccaggaccaggatgctgccagcatccccccatttgagcccccaggccctggcagctatgagaacctgagcacaggcacccgggagagcaagccagatgccctggccggccggcaggaggccagcgctgactgccaggatgtgatctccatgacagccaaccggctgtctgctgtgatccaggccttctacatgtgctgcagctgccagatgcctcctggcatgaccagcccccgcttcattgaatttgtgtgcaagcatgatgaggtgctgaagtgctttgtgaacagaaaccccaagatcatctttgaccacttccacttcctgctggagtgcccagagctgatgagccgcttcatgcacatcatcaaggcccagcccttcaaggacagatgtgagtggttctatgagcacctgcacagcggccagcctgacagcgacatggtgcacaggcctgtgaatgaaaatgacatcctgctggtgcaccgggacagcatcttccgcagcagctgtgaggtggtgtccaaggccaactgtgccaagctgaagcagggcattgctgtgcgcttccatggagaggagggcatgggccagggcgtggtgcgggagtggtttgacatcctgagcaatgagatcgtgaacccagactatgccctcttcacccagagcgcagatggcaccaccttccagcccaacagcaacagctatgtgaacccagaccacctgaactacttccgctttgctggccagatcctgggcctggccctgaaccaccggcagctggtgaacatctacttcaccaggagcttctacaagcacatcctgggcatccctgtgaactaccaggatgtggccagcattgatcctgaatatgccaagaacctgcagtggatcctggacaatgacatcagtgacctgggcctggagctgaccttctctgtggagacagatgtgtttggagccatggaggaggtgcccctgaagccaggcggcggcagcatcctggtgacccagaacaacaaggccgagtatgtgcagctggtgacagagctgaggatgacccgggccatccagccccagatcaatgccttcctgcagggcttccacatgttcatcccccccagcctcatccagctgtttgatgaatatgagctggagctgctgctgagcggcatgcctgagattgatgtgtctgactggatcaagaacacagagtacaccagcggctatgaaagagaagatcctgtgatccagtggttctgggaggtggtggaggacatcacccaggaggagcgggtgctgctgctgcagtttgtgacaggcagcagccgggtgccccatggaggctttgccaacatcatgggcggcagcggcctgcagaacttcaccatcgctgctgtgccctacacccccaacctgctgcccaccagcagcacctgcatcaacatgctgaagctgcctgagtaccccagcaaggagatcctgaaggaccggctgctggtggccctgcactgcggcagctatggctacaccatggcctag

SEQ ID NO: 18474 - DNA, 2679 bp, Artificial Sequence
  Description of Artificial Sequence: Synthetic coding sequence
atgaggaaggtgaagaagctgcggctggacaaggagaacacaggctcctggaggagcttcagcctgaacagcgagggcgctgagaggatggccaccaccggcacccccacagctgacagaggagatgctgctgccacagatgatcctgctgcccgcttccaggtgcagaagcacagctgggatggcctgcggagcatcatccacggcagcaggaagtacagcggcctgattgtgaacaaggcccctcatgacttccagtttgtgcagaagacagatgagagcggcccccacagccaccggctgtactacctgggcatgccctacggcagccgggagaacagcctgctgtacagcgagatccccaagaaggtgaggaaggaggccctgctgctgctgtcctggaagcagatgctggaccacttccaggccaccccccaccacggcgtgtacagccgggaggaggagctgctgcgggagaggaagaggctgggcgtgtttggcatcaccagctatgacttccacagcgagagcggcctcttcctgttccaggccagcaacagcctcttccactgcagagatggcggcaagaatggcttcatggtgagccccatgaagcccctggagatcaagacccagtgcagcggccccaggatggaccccaagatctgcccagctgaccctgccttcttctccttcatcaacaacagcgacctgtgggtggccaacattgaaacaggagaggagcggcggctgaccttctgccaccagggcctgagcaatgtgctggatgaccccaagtctgctggggtggccacctttgtgatccaggaggagtttgaccgcttcaccggctactggtggtgccccacagcctcctgggagggcagcgagggcctgaagaccctgcgcatcctgtatgaggaggtggatgagagcgaggtggaggtgatccacgtgcccagccctgccctggaggagaggaagacagacagctaccgctaccccaggacaggcagcaagaaccccaagatcgccctgaagctggccgagttccagacagacagccagggcaagatcgtgtccacccaggagaaggagctggtgcagcccttcagcagcctcttccccaaggtggagtacatcgcccgggccggctggaccagagatggcaagtatgcctgggccatgttcctggaccggccccagcagtggctgcagctggtgctgctgcccccagccctcttcatccccagcacagaaaatgaggagcagaggctggccagcgcccgggctgtgcccagaaatgtgcagccctacgtggtgtatgaggaggtgaccaacgtgtggatcaacgtgcatgacatcttctaccccttcccccagagtgaaggagaagatgagctgtgcttcctgcgggccaatgaatgcaagacaggcttctgccacctgtacaaggtgacagctgtgctgaagagccagggctatgactggagcgagcccttcagccctggagaagatgagttcaagtgccccatcaaggaggagatcgccctgaccagcggggagtgggaggtgctggcccggcacggcagcaagatctgggtgaatgaggagaccaagctggtgtacttccagggcaccaaggacacccccctggagcaccacctgtatgtggtgtcctatgaagctgctggggagatcgtgcggctgaccaccccaggcttcagccacagctgcagcatgagccagaactttgacatgtttgtgagccactacagctctgtgtccaccccaccctgtgtgcacgtgtacaagctgagcggcccagatgatgaccccctgcacaagcagccccgcttctgggcctccatgatggaggccgccagctgccccccagactatgtgcccccagagatcttccacttccacaccaggagtgatgtgcggctgtatggcatgatctacaagccccacgccctgcagcccgggaagaagcaccccaccgtgctgtttgtgtatggaggcccccaggtgcagctggtgaacaacagcttcaagggcatcaagtacctgcggctgaacaccctggccagcctgggctatgctgtggtggtgattgatggccggggcagctgccagaggggcctgcgctttgagggcgccctgaagaaccagatgggccaggtggagattgaggaccaggtggagggcctgcagtttgtggccgagaagtatggcttcatcgacctgagccgggtggccatccacggctggagctatggaggcttcctgagcctgatgggcctcatccacaagccccaggtgttcaaggtggccatcgccggggcccctgtgacagtgtggatggcctatgacaccggctacacagagcgctacatggatgtgcctgagaacaaccagcacggctatgaggccggctctgtggccctgcacgtggagaagctgcccaatgagcccaaccggctgctgatcctgcacggcttcctggatgaaaatgtgcacttcttccacaccaacttcctggtgtcccagctgatccgggccggcaagccctaccagctgcagatctacccaaatgaaagacacagcatccgctgcccagagagcggggagcactatgaggtgaccctgctgcacttcctgcaggagtacctgtag

SEQ ID NO: 18475 - DNA, 1533 bp, Artificial Sequence
  Description of Artificial Sequence: Synthetic coding sequence
atggctgctgagctggtggaggccaagaacatggtgatgtccttccgggtgtctgacctgcagatgctgctgggctttgtgggccgcagcaagagcggcctgaagcatgagctggtgacccgggccctgcagctggtgcagtttgactgcagccctgagctgttcaagaagatcaaggagctgtatgagaccaggtatgccaagaagaacagcgagcccgccccccagccccaccggcccctggaccccctgaccatgcacagcacctatgacagagctggagctgtgcccaggacccccctggccggccccaacatcgactaccctgtgctgtatggcaagtacctgaatggcctgggccgcctgcctgccaagaccctgaagccagaggtgcggctggtgaagctgcccttcttcaacatgctggatgagctgctgaagcccacagagctggtgccccagaacaatgagaagctgcaggagagcccctgcatctttgccctgaccccccggcaggtggagctgatccggaacagccgggagctgcagcccggggtgaaggctgtgcaggtggtgctgcgcatctgctacagcgacaccagctgcccccaggaggaccagtacccacccaacattgctgtgaaggtgaaccacagctactgcagcgtgcccggctactaccccagcaacaagccaggagtggagcccaagaggccctgccggcccatcaacctgacccacctgatgtacctgagcagcgccaccaaccgcatcaccgtgacctggggcaactacggcaagagctacagcgtggccctgtacctggtgcggcagctgaccagcagcgagctgctgcagaggctgaagaccatcggcgtgaagcaccctgagctgtgcaaggccctggtgaaggagaagctgcggctggaccctgattctgaaattgccaccaccggggtgcgggtgtccctcatctgccccctggtgaagatgaggctgtctgtgccctgcagagctgagacctgtgcccacctgcagtgctttgatgctgtgttctacctgcagatgaatgagaagaagcccacctggatgtgccctgtgtgtgacaagccagccccctatgaccagctgatcattgatggcctgctgagcaagatcctgtctgaatgtgaagatgctgatgaaattgagtacctggtggatggctcctggtgccccatccgggcagagaaggagaggagctgcagcccccagggcgccatcctggtgctgggccccagtgatgccaacggcctgctgcctgcccccagcgtgaatggaagtggggccctgggcagcactggaggcggcggccctgtgggctccatggagaatggcaagccaggagcagatgtggtggacctgaccctggacagcagcagcagcagtgaagatgaggaggaggaggaggaggaggaggaggatgaagatgaggagggcccccggcccaagaggcgctgccccttccagaagggcctggtgcctgcctgctag

SEQ ID NO: 18476 - DNA, 684 bp, Artificial Sequence
  Description of Artificial Sequence: Synthetic coding sequence
atggccgcccagaggcccctgcgggtgctgtgcctggccggcttccggcagagcgagcggggcttccgggagaagacaggagccctgaggaaggccctgcggggccgggcagagctggtgtgcctgagcggcccccaccctgtgcctgaccccccaggccctgagggcgcccggagtgactttggcagctgccccccagaggagcagccccggggctggtggttcagcgagcaggaggctgatgtgttcagcgccctggaggagcctgctgtgtgccggggcctggaggagagcctgggcatggtggcccaggccctgaaccggctgggcccctttgatggcctgctgggcttcagccagggcgccgccctggccgccctggtgtgtgccctgggccaggccggggacccccgcttccccctgccccgcttcatcctgctggtgtctggcttctgcccccggggcatcggcttcaaggagagcatcctgcagaggcccctgagcctgcccagcctgcacgtgtttggagacacagacaaggtgatccccagccaggagagcgtgcagctggccagccagtttcctggggccatcaccctgacccacagcggcggccacttcatcccagctgctgccccccagaggcaggcctacctgaagttcctggaccagtttgctgagtag

SEQ ID NO: 18477 - DNA, 1656 bp, Artificial Sequence
  Description of Artificial Sequence: Synthetic coding sequence
atggaggaggccgagctggtgaagggccgcctgcaggccatcacagacaagaggaagatccaggaggagatcagccagaagaggctgaagattgaggaggacaagctgaagcaccagcacctgaagaagaaggccctgcgggagaagtggctgctggatggcatcagcagcggcaaggagcaggaggagatgaagaagcagaaccagcaggaccagcaccagatccaggtgctggagcagagcatcctgcggctggagaaggagatccaggacctggagaaggccgagctgcagatcagcaccaaggaggaggccatcctgaagaagctgaagagcattgaaagaaccacagaggacatcatccgctctgtgaaggtggagcgggaggagcgggcagaggagagcattgaggacatctatgccaacatcccagacctgcccaagagctacatccccagccggctgaggaaggagatcaatgaggagaaggaggatgatgagcagaacaggaaggccctgtatgccatggagatcaaggtggagaaggacctgaagacaggagagagcacagtgctgagcagcatccccctgcccagtgatgacttcaagggcaccggcatcaaggtgtatgatgatggccagaagtctgtgtatgctgtgagcagcaaccacagcgctgcctacaatggaacagatggcctggcccctgtggaggtggaggagctgctgcggcaggccagcgagaggaacagcaagagccccacagagtaccacgagcctgtgtatgccaaccccttctaccggcccaccaccccccagcgggagaccgtgaccccaggccccaacttccaggagcgcatcaagatcaagaccaacggcctgggcatcggcgtgaatgaaagcatccacaacatgggaaatggcctgtctgaggagcggggcaacaacttcaaccacatcagccccatcccccctgtgccccaccccaggagcgtcatccagcaggccgaggagaagctgcacaccccccagaagaggctgatgaccccctgggaggagagcaatgtgatgcaggacaaggatgcccccagccccaagccccggctgagcccccgggagaccatctttgggaagtctgagcaccagaacagcagccccacctgccaggaggatgaagaagatgtgcgctacaacatcgtgcacagcctgcccccagacatcaatgacacagagcctgtgaccatgatcttcatgggctaccagcaggccgaggacagcgaggaggacaagaagttcctgaccggctatgatggcatcatccacgccgagctggtggtgattgatgatgaggaggaggaggatgaaggagaggccgagaagcccagctaccaccccatcgccccccacagccaggtgtaccagcctgccaagcccacccccctgcccaggaagaggtctgaggccagcccccatgagaacaccaaccacaagagcccccacaagaacagcatcagcctgaaggagcaggaggagagcctgggcagccctgtgcaccacagcccctttgatgcccagaccactggagatggaacagaggaccccagcctgacagccctgaggatgaggatggccaagctgggcaagaaggtgatctag

SEQ ID NO: 18478 - DNA, 1701 bp, Artificial Sequence
  Description of Artificial Sequence: Synthetic coding sequence
atgtttgtgtctgacttcaggaaggagttctatgaggtggtgcagagccagagggtgctgctgtttgtggccagtgatgtggatgccctgtgtgcctgcaagatcctgcaggccctcttccagtgtgaccacgtgcagtacaccctggtgcctgtgtctggctggcaggagctggagacagccttcctggagcacaaggagcagttccactacttcatcctgatcaactgtggggccaacgtggacctgctggacatcctgcagccagatgaggacaccatcttctttgtgtgtgacacccacaggcctgtgaatgtggtgaatgtgtacaatgacacccagatcaagctgctgatcaagcaggatgatgacctggaggtgcctgcctatgaggacatcttcagagatgaggaggaggatgaggagcacagcggaaatgacagtgatggcagcgagcccagcgagaagaggacccggctggaggaggagatcgtggagcagaccatgagaagacggcagaggcgggagtgggaggccaggagaagagacatcctgtttgattatgagcagtatgagtaccacggcaccagcagcgccatggtgatgtttgagctggcctggatgctgagcaaggacctgaatgacatgctgtggtgggccatcgtgggcctgacagaccagtgggtgcaggacaagatcacccagatgaagtatgtgacagatgtgggcgtgctgcagagacatgtgagccgccacaaccacagaaatgaagatgaggagaacaccctgtctgtggactgcacccgcatcagctttgaatatgacctgcggctggtgctgtaccagcactggagcctgcatgacagcctgtgcaacaccagctacacagctgcccgcttcaagctgtggagcgtgcacggccagaagaggctgcaggagttcctggccgacatgggcctgcccctgaagcaggtgaagcagaagttccaggccatggacatcagcctgaaggagaacctgcgggagatgattgaggagagcgccaacaagtttggcatgaaggacatgagggtgcagaccttcagcatccacttcggcttcaagcacaagttcctggccagtgatgtggtgtttgccaccatgagcctgatggagagccctgagaaggatggcagcggcacagaccacttcatccaggccctggacagcctgagccgcagcaacctggacaagctgtaccacggcctggagctggccaagaagcagctgcgggccacccagcagaccatcgccagctgcctgtgcaccaacctggtgatcagccagggccccttcctgtactgcagcctgatggagggcaccccagatgtgatgctgttcagcaggcctgccagcctgagcctgctgagcaagcacctgctgaagagctttgtgtgcagcaccaagaacagacgctgcaagctgctgcccctggtgatggccgcccccctgtccatggagcacggcaccgtgacagtggtgggcatccccccagagacagacagcagtgacaggaagaacttcttcggccgggcctttgagaaggctgctgagagcaccagcagcaggatgctgcacaaccactttgacctgtctgtgattgagctgaaggccgaggacaggagcaagttcctggatgccctgatcagcctgctgtcctag

SEQ ID NO: 18479 - DNA, 1461 bp, Artificial Sequence
  Description of Artificial Sequence: Synthetic coding sequence
atgtctgtgacctatgatgacagcgtgggcgtggaggtgtccagtgacagcttctgggaggtgggcaactacaagaggacagtgaagagaattgatgatggccaccggctgtgcagcgacctgatgaactgcctgcacgagcgggccagaattgagaaggcctatgcccagcagctgacagagtgggcccggcgctggaggcagctggtggagaagggcccccagtatggcaccgtggagaaggcctggatggccttcatgtctgaggccgagcgggtgtctgagctgcacctggaggtgaaggccagcctgatgaatgatgactttgagaagatcaagaactggcagaaggaggccttccacaagcagatgatgggcggcttcaaggagaccaaggaggctgaagatggcttcaggaaggcccagaagccctgggccaagaagctgaaggaggtggaggccgccaagaaggcccaccacgccgcctgcaaggaggagaagctggccatcagccgggaggccaacagcaaggctgaccccagcctgaaccctgagcagctgaagaagctgcaggacaagattgagaagtgcaagcaggatgtgctgaagaccaaggagaagtatgagaagagcctgaaggagctggaccagggcaccccccagtacatggagaacatggagcaggtgtttgagcagtgccagcagtttgaggagaagaggctgcgcttcttccgggaggtgctgctggaggtgcagaagcacctggacctgagcaatgtggccggctacaaggccatctaccatgacctggagcagagcatccgggctgctgatgctgtggaggacctgcgctggttccgggccaaccacggccctggcatggccatgaactggccccagtttgaggagtggagcgctgacctgaacagaaccctgagccggcgggagaagaagaaggccacagatggagtgaccctgaccggcatcaaccagacaggagaccagagcctgcccagcaagcccagcagcaccctgaatgtgcccagcaacccagcccagagcgcccagagccagagcagctacaacccctttgaagatgaagatgacaccggcagcacagtgtctgagaaggatgacaccaaggccaagaatgtgtcctcctatgagaagacccagagctaccccacagactggagcgatgatgagagcaacaaccccttcagcagcacagatgccaatggagacagcaacccctttgatgatgatgccaccagcggcacagaggtgcgggtgcgggccctgtatgactatgagggccaggagcatgatgagctgtccttcaaggctggagatgagctgaccaagatggaggatgaagatgagcagggctggtgcaagggccgcctggacaatggccaggtgggcctgtacccagccaactacgtggaggccatccagtag

SEQ ID NO: 18480 - DNA, 2262 bp, Artificial Sequence
  Description of Artificial Sequence: Synthetic coding sequence
atgatggaggagagagctgctgctgctgtggccgctgctgccagcagctgccggcccctgggcagcggggccggccctggccccactggagctgcccctgtgtctgccccagcccctggccctggccctgctgggaagggcggcggcggcggcggcagccctggccccacagctggccctgagcccctgagcctgcccggcatcctgcacttcatccagcacgagtgggccaggtttgaagctgagaaggcccgctgggaggccgagagagctgagctgcaggcccaggtggccttcctgcagggcgagaggaagggccaggagaacctgaagacagacctggtgcggcgcatcaagatgctggagtatgccctgaagcaggagcgggccaagtaccacaagctgaagtttggaacagacctgaaccagggcgagaagaaggcagatgtgtctgagcaggtgtccaatggacctgtggagagcgtgaccctggagaacagccccctggtgtggaaggagggccggcagctgctgcggcagtacctggaggaggtgggctacacagacaccatcctggacatgaggagcaagagggtgcgcagcctgctgggccgcagcctggagctgaatggagctgtggagcccagcgagggcgccccccgggcccctcctggccctgctggcctgagcggcggggagagcctgctggtgaagcagatcgaggagcagatcaagagaaatgctgctgggaaggatggcaaggagcggctgggcggctctgtgctgggccagatccccttcctgcagaactgtgaagatgaggacagtgatgaagatgatgagctggacagcgtgcagcacaagaagcagagggtgaagctgcccagcaaggccctggtgcctgagatggaggatgaagatgaagaagatgacagtgaagatgccatcaatgaatttgacttcctgggcagcggggaggatggagagggcgccccagacccccggcgctgcaccgtggatggcagcccccatgagctggagagcagaagagtgaagctgcagggcatcctggccgacctgagagatgtggatggcctgccccccaaggtgactggacctcctcctggcaccccccagccccggccccatgaagatgtgttcatcatggacaccatcggcggcggggaggtgtccctgggggacctggccgacctgactgtgaccaatgacaatgacctgagctgtgacctgagtgacagcaaggatgccttcaagaagacctggaaccccaagttcaccctgcggagccactatgatggcatccgcagcctggccttccaccacagccagagcgccctgctgacagcctctgaagatggcaccctgaagctgtggaacctgcagaaggctgtgacagccaagaagaatgctgccctggatgtggagcccatccacgccttccgggcccaccggggccctgtgctggccgtggccatgggcagcaacagcgagtactgctacagcggcggcgcagatgcctgcatccacagctggaagatcccagacctgtccatggacccctatgatggctatgaccccagcgtgctgagccacgtgctggagggccatggagatgctgtgtggggcctggccttcagccccaccagccagaggctggccagctgcagcgcagatggcaccgtgcgcatctgggaccccagcagcagcagccctgcctgcctgtgcaccttccccacagccagcgagcacggcgtgcccacctctgtggccttcaccagcacagagcccgcccacatcgtggccagcttccgcagcggggacacagtgctgtatgacatggaggtgggcagcgccctgctgaccctggagagccggggcagcagcggccccacccagatcaaccaggtggtgagccaccccaaccagcccctgaccatcacagcccatgatgaccggggcatccgcttcctggacaacagaacaggcaagcctgtgcacagcatggtggcccacctggatgctgtgacctgcctggccgtggaccccaacggggccttcctgatgagcggcagccatgactgcagcctgcggctgtggagcctggacaacaagacctgtgtgcaggagatcacagcccacaggaagaagcatgaggaggccatccatgctgtggcctgccaccccagcaaggccctgattgccagcgctggagcagatgccctggccaaggtgtttgtgtag

SEQ ID NO: 18481 - DNA, 1596 bp, Artificial Sequence
  Description of Artificial Sequence: Synthetic coding sequence
atgaggatgcacacccggctgagcctgcccggccccccccaccacgtgggcgccgcctacccacctgctgggggcaacagaagtgaaaatgccggctcctggggcggggccggggccagctctgtggagcccctggccaggagagtggccagcggggaggccaccctggccatggaccagcctgctggcctgcaggtggactatgtgttccggggcgtggagcacgctgtgcgggtgatggtgtctggccaggtgctggagctggaggtggaggacaggatgacagctgaccagtggagaggagaatttgatgctggcttcatcgaggacctgacccacaagacaggcaacttcaagcagttcaacatcttctgccacatgctggagagcgccctgacccagagcagcgagagcgtgaccctggacctgctgacctacacagacctggagagcctgaggaacaggaagatgggcggccggcccggcagcctggcccccaggtctgcccagctgaacagcaagcgctacctgatcctgatctacagcgtggagtttgaccgcatccactaccccctgcccctgccctaccagggcaagccagaccctgtggtgctgcagggcatcatccgcagcctgaaggaggagctgggccgcctgcagggcctggatggccagaacacccgggacacccgggagaatgagatctggcacctgcgggagcaggtgtcccggctggccagcgagaagcgggagctggaggcccagctgggccgcagccgggaggaggccctggccggccgggccgcccggcaggaggccgaggccctgcggggcctggtgcggggcctggagctggagctgcggcaggagcggggcctgggccaccgggtggccggccggcggggccaggactgccggcggctggccaaggagctggaggaggccaaggccagcgagaggagcctgcgggcccggctgaagaccctgaccagcgagctggccctgtacaagagaggaggccggggcagccggggccggggccgcccagcccggcccagccccagccccactggaggccgggccctgcgctttgaccccacagcctttgtgaaggccaaggagaggaagcagcgggagatccagatgaagcagcagcagaggaaccggctgggcagcggcggcagcggagatggccccagcgtgtcctggagccggcagacccagcccccagctgccctgaccggcagaggagatgcccccaacagaagcaggaacagaagcagctctgtggacagcttccgcagccgctgcagcagcgccagcagctgcagcgacctggaggacttcagcgagagcctgagccggggcggccacagaagaagaggcaagccacccagccccaccccctggagcggcagcaacatgaagagcccccctgtggagaggagccaccaccagaagagcctggccaacagcggcggctgggtgcccatcaaggagtacagcagcgagcaccaggccgctgacatggccgagattgatgcccggctgaaggccctgcaggagtacatgaaccggctggacatgaggagctag

SEQ ID NO: 18482 - DNA, 1452 bp, Artificial Sequence
  Description of Artificial Sequence: Synthetic coding sequence
atggccagcctgctgtggggcggagatgctggagctgctgagagcgagcggctgaacagccacttcagcaacctgagccagcccaggaagaacctgtggggcatcaagagcacagctgtgagaaatattgatggcagcatcaacaacatcaatgaagatgatgaggaggatgtggtggacctggccgccaacagcctgctgaacaagctgatccaccagagcctggtggagagcagccaccgggtggaggtgctgcagaaggaccccagcagccccctgtacagcgtgaagacctttgaggagctgcggctgaaggaggagctgctgaagggcatctatgccatgggcttcaaccggcccagcaagatccaggagatggccctgcccatgatgctggcccaccccccccagaacctgattgcccagagccagagcggcaccgggaagacagctgcctttgtgctggccatgctgagccgggtgaatgccctggagctgttcccccagtgcctgtgcctggcccccacctatgagctggccctgcagacaggccgggtggtggagcagatgggcaagttctgtgtggatgtgcaggtgatgtatgccatccggggcaaccgcatcccccggggcacagacatcaccaagcagatcatcatcggcaccccaggcaccgtgctggactggtgcttcaagctgaagctgattgacctgaccaagatccgggtgtttgtgctggatgaagcagatgtgatgattgacacccagggcttcagtgaccacagcatccgcatccagagggccctgcccagcgagtgccagatgctgctcttcagcgccacctttgaagattctgtgtggcactttgctgagcgcatcatcccagaccccaacgtcatcaagctgaggaaggaggagctgaccctgaacaacatccggcagtactacgtgctgtgtgagcacaggaaggacaagtaccaggccctgtgcaacatctacggcagcatcaccatcggccaggccatcatcttctgccagaccaggagaaatgccaagtggctgactgtggagatgatccaggacggccaccaggtgtccctgctgtctggagagctgactgtggagcagagggccagcatcatccagcgcttcagagatggcaaggagaaggtgctgatcaccaccaacgtgtgtgcccggggcattgatgtgaagcaggtgaccatcgtggtgaactttgacctgcctgtgaagcagggcgaggagccagactatgagacctacctgcaccgcatcggccgcacaggccgctttgggaagaagggcctggccttcaacatgattgaggtggatgagctgcccagcctgatgaagatccaggaccacttcaacagcagcatcaagcagctgaatgctgaggacatggatgaaattgagaagattgactactag

SEQ ID NO: 18483 - DNA, 1014 bp, Artificial Sequence
  Description of Artificial Sequence: Synthetic coding sequence
atggctgatgctgccccccagctgggcaagaggaagcgggagctggatgtggaggaggcccacgccgccagcacagaggagaaggaggccggcgtgggcaatggcacctgtgcccctgtgcggctgcccttcagcggcttccggctgcagaaggtgctgcgggagagcgcccgggacaagatcatcttcctgcacggcaaggtgaatgaggccagcggagatggagatggagaagatgctgtggtgatcctggagaagacccccttccaggtggagcaggtggcccagctgctgaccggcagccctgagctgcagctgcagttcagcaatgacatctacagcacctaccacctgttccccccccggcagctgaatgatgtgaagaccaccgtggtgtacccagccacagagaagcacctgcagaagtacctgcggcaggacctgcggctcatccgggagactggagatgactacagaaacatcaccctgccccacctggagagccagagcctgagcatccagtgggtgtacaacatcctggacaagaaggccgaggccgacagaattgtgtttgagaacccagaccccagtgatggctttgtgctgatcccagacctgaagtggaaccagcagcagctggatgacctgtacctgattgccatctgccaccggcggggcatccgcagcctgcgggacctgaccccagagcacctgcccctgctgaggaacatcctgcaccagggccaggaggccatcctgcagcgctacaggatgaagggggaccacctgcgggtgtacctgcactacctgcccagctactaccacctgcacgtgcacttcaccgccctgggctttgaggcccctggcagcggcgtggagcgggcccacctgctggccgaggtgattgagaacctggagtgtgaccccaggcactaccagcagaggaccctgacctttgccctgcgggcagatgaccccctgctgaagctgctgcaggaggcccagcagagctag

SEQ ID NO: 18484 - DNA, 1782 bp, Artificial Sequence
  Description of Artificial Sequence: Synthetic coding sequence
atgaagctgcaggccgtgatggagaccctgctgcagaggcagcagagggcccggcaggagctggaggcccggcagcagctgcccccagaccccccagctgcccctcctggccgggcccgggccgccccagatgaagatcgggagcctgagagcgccaggatgcagagggcccagatggccgccctggccgccatgagagctgctgctgctggcctgggccacccagccagccctgggggctctgaagatggccccccaggcagcgaggaggaggatgctgcccgggagggcaccccaggcagccctggccggggccgggagggccctggagaggagcactttgaggacatggccagtgatgaggacatgaagcccaagtgggaggaggaggagatggaggaggacctgggggaggatgaggaggaggaggaggaggactatgaagatgaggaggaggaggaggatgaggagggcctgggccccccaggccctgccagcctgggcaccacagccctcttccccaggaaggcccagcccccccaggccttcagaggagatggagtgccccgggtgctgggcggccaggagcggcccggccctggccctgcccaccctggaggagctgcccacgtggccccccagctgcagcccccagaccacggggactggacctatgaggagcagttcaagcagctgtatgagctggatggagaccccaagaggaaggagttcctggatgacctcttctccttcatgcagaagaggggcacccctgtgaaccgcatccccatcatggccaagcaggtgctggacctcttcatgctgtatgtgctggtgacagagaagggcggcctggtggaggtgatcaacaagaagctgtggagggagatcaccaagggcctgaacctgcccaccagcatcaccagcgctgccttcaccctgcggacccagtacatgaagtacctgtacccctatgaatgtgagaagaggggcctgagcaaccccaatgagctgcaggccgccatcgacagcaacagaagagagggccggcggcagagctttggaggcagcctgtttgcctacagccctggaggagcccacggcatgctgagcagccccaagctgcctgtgagcagcctgggcctggccgccagcaccaacggcagcagcatcaccccagcccccaagatcaagaaggaggaggacagcgccatccccatcaccgtgcccggccgcctgcctgtgtccctggccggccaccctgtggtggccgcccaggccgctgctgtgcaggccgccgccgcccaggccgctgtggccgcccaggccgccgccctggagcagctgcgggagaagctggagagcgctgagcccccagagaagaagatggccctggtggctgatgagcagcagaggctgatgcagagggccctgcagcagaacttcctggccatggccgcccagctgcccatgagcatccgcatcaacagccaggccagcgagagccggcaggacagcgctgtgaacctgaccggcaccaacggcagcaacagcatctccatgtctgtggagatcaatggcatcatgtacacaggagtgctgtttgcccagcccccagcccccacccccaccagcgcccccaacaagggcggcggcggcggcggcggcagcagcagcaatgccggcggccggggcggcaacacaggcaccagcggcggccaggccggccctgctggcctgagcacccccagcaccagcaccagcaacaacagcctgccctag

SEQ ID NO: 18485 - DNA, 6192 bp, Artificial Sequence
  Description of Artificial Sequence: Synthetic coding sequence
atggctgatggagccccccggccccagctgtacagatctgtgtccttcaagctgctggagcgctggagcggcggccctggcctgcgggaggaggacacagacaccccaggcctgcggcggcgggccagctgccggcccaccacagctgcccggggccagcccagccggcgggtgtccaagctggccagcggccccctggccgccccagcccagccccggcccctgcggagcctgagccccagcgtgcggcagctgagcagaagatttgatgccccccggctggatgatggcagcgctggcaccagagatggaggagtgctgcctgctgctgctgaggaggccgctgagggccctgcccggggggcctggcccagcgtgacagagatgaggaagctgtttggaggccctggcagcagaagacccagcgctgacagcgagagccctggcacccccagcccagatggagctgcctgggagcccccagcccgggagagccggcagccccccaccccaccacccaggacctgcttccccctggccggcctgcggagcgcccggcccctgactggacctgagacagagggccgcctgcggcggccccagcagcagcaggagcgggcccagaggcctgcagatggcctgcacagctggcacatcttcagccagccccaggccggggcccgggccagctgcagcagcagcagcattgctgccagctaccctgtgagccgcagcagagctgccagcagcagcgaggaggaggaggagggccccccccagctgcccggggcccagagccctgcctaccacggcggccacagcagcggcagtgatgatgacagagatggagagggcggccaccgctggggcggccggcccggcctgcggcccggcagcagcctgctggaccaggactgcaggccagacagtgatggcctgaacctgagctccatgaacagcgctggggtgtctggcagccctgagccccccaccagcccccgggccccccgggaggagggcctgcgggagtggggcagcggcagccccccctgtgtgcccggcccccaggagggcctgcggcccatgtctgattctgtgggcggggccttccgggtggccaaggtgtccttccccagctacctggccagccctgctggcagccggggcagcagccgctacagcagcacagagaccctgaaggatgatgacctgtggagcagccggggcagcggcggctggggcgtgtaccgcagccccagctttggagctggggagggcctgctgcggagccaggcccggacccgggccaagggccctgggggcaccagccgggccctgagagatggcggctttgagcctgagaagagccggcagaggaagagcctgagcaacccagacatcgccagcgagaccctgaccctgctgtccttcctgcggagtgacctgtctgagctgcgggtgaggaagccaggcggcagcagcggggaccggggcagcaaccccctggatggccgggacagccccagcgctgggggccctgtgggccagctggagcccatccccatcccagccccagccagccctggcacccggcccaccctgaaggacctgacagccaccctgcggcgggccaagagcttcacctgcagcgagaagcccatggcccggcggctgcccaggaccagcgccctgaagagcagcagcagcgagctgctgctgaccggccctggagctgaggaggaccccctgcccctcatcgtgcaggaccagtatgtgcaggaggcccggcaggtgtttgagaagatccagaggatgggcgcccagcaggatgatggcagtgatgcccctcctggcagcccagactgggccggagatgtgacccggggccagaggagccaggaggagctgagcggccctgagagcagcctgacagatgagggcatcggggctgaccctgagccccctgtggccgccttctgtggcctgggcaccaccggcatgtggaggcccctgagcagcagcagcgcccagaccaaccaccacggccctggaacagaggacagcctgggcggctgggccctggtgtccccagagaccccacccacccctggggccctgcggcggcggaggaaggtgcccccatctggcagcggcggcagcgagctgagcaatggagaggccggggaggcctaccgcagcctgagtgaccccatcccccagaggcaccgggccgccaccagcgaggagcccaccggcttctctgtggacagcaacctgctgggcagcctgagccccaagacaggcctgcctgccaccagcgccatggatgagggcctgaccagcggccacagcgactggagcgtgggcagcgaggagagcaagggctaccaggaggtgatccagagcatcgtgcagggccctggcaccctgggccgggtggtggatgacagaattgctgggaaggcccccaagaagaagagcctgagtgaccccagcagaagaggagagctggccggccctggctttgagggccctggaggagagcccatccgggaggtggagcccatgctgccccccagcagcagcgagcccatcctggtggagcagagagctgagcctgaggagcccggggccaccaggagccgggcccagagcgagcgggccctgcctgaggccctgcccccaccagccacagcccacaggaacttccacctggaccccaagctggccgacatcctgagccccaggctcatcagaagaggcagcaagaagaggcctgcccggagcagccaccaggagctgcggagagatgagggcagccaggaccagacaggcagcctgagccgggcccggcccagcagccgccacgtgagacatgcctctgtgcctgccaccttcatgcccatcgtggtgcctgagccccccacctctgtgggcccccctgtggccgtgcctgagcccatcggcttccccacccgggcccaccccaccctgcaggcccccagcctggaggatgtgaccaagcagtacatgctgaacctgcacagcggggaggtgcctgcccctgtgcctgtggacatgccctgcctgcccctggccgcccctccttctgctgaggccaagcccccagaggccgcccggccagcagatgagcccaccccagccagcaagtgctgcagcaagccccaggtggacatgaggaagcacgtggccatgaccctgctggacacagagcagagctatgtggagagcctgcggaccctgatgcagggctacatgcagcccctgaagcagcctgagaacagcgtgctgtgtgaccccagcctggtggatgagatctttgaccagatccctgagctgctggagcaccacgagcagttcctggagcaggtgcgccactgcatgcagacctggcacgcccagcagaaggtgggcgccctgctggtgcagagcttcagcaaggatgtgctggtgaacatctacagcgcctacatcgacaacttcctgaatgccaaggatgctgtgcgggtggccaaggaggcccggcctgccttcctgaagttcctggagcagagcatgagggagaacaaggagaagcaggccctgagtgacctgatgatcaagcctgtgcagaggatccccaggtatgagctgctggtgaaggacctgctgaagcacaccccagaggaccacccagaccaccccctgctgctggaggcccagaggaacatcaagcaggtggccgagcgcatcaacaagggcgtgcgctctgctgaggaggccgagagacatgcccgggtgctgcaggagattgaggcccacatcgagggcatggaggacctgcaggcccccctgcggcgcttcctgcggcaggagatggtgattgaggtgaaggccatcggcggcaagaaggacaggagcctcttcctgttcacagacctgattgtgtgcaccaccctgaagaggaagagcggcagcctgcggcgcagctccatgagcctgtacacagctgcctctgtgattgacacagccagcaagtacaagatgctgtggaagctgcccctggaggatgctgacatcatcaagggggccagccaggccaccaaccgggagaacatccagaaggccatcagccggctggatgaggacctgaccaccctgggccagatgagcaagctgtctgagagcctgggcttcccccaccagagcctggatgatgccctgcgggacctgtctgctgccatgcaccgggacctgtctgagaagcaggccctgtgctacgccctgtccttcccccccaccaagctggagctgtgtgccaccaggcctgagggcacagacagctacatctttgagttcccccacccagatgcccggctgggctttgagcaggcctttgatgaggccaagaggaagctggccagcagcaagagctgcctggaccctgagttcctgaaggccatccccatcatgaagaccaggagcggcatgcagttcagctgtgccgcccccaccctgaacagctgcccagagcccagccctgaggtgtgggtgtgcaacagtgatggctacgtgggccaggtgtgcctgctgagcctgcgggcagagccagatgtggaggcctgcatcgctgtgtgcagcgcccgcatcctgtgcattggagctgtgcccggcctgcagccccgctgccaccgggagcccccacccagcctgcggagccccccagagacagcccctgagcccgccggccctgagctggatgtggaggccgctgctgatgaggaggccgccaccctggccgagcccggcccccagccctgcctgcacatcagcattgctggcagcggcctggagatgaccccaggcctgggggagggggaccccaggcctgagctggtgccctttgacagcgacagtgatgatgagagcagccccagccccagcggcaccctgcagagccaggccagccgcagcaccatcagcagcagctttggaaatgaggagacccccagcagcaaggaggccacagctgagaccaccagcagcgaggaggagcaggagcccggcttcctgcccctgagcggcagctttggacctgggggcccctgtggcaccagccccatggatggccgggccctgcggcgcagcagccacggcagcttcacccggggcagcctggaggacctgctgtctgtggaccctgaggcctaccagagctctgtgtggctgggcacagaagatggctgtgtgcacgtgtaccagagcagtgacagcatccgggacagaagaaattccatgaagctgcagcacgccgcctctgtgacctgcatcctgtacctgaacaaccaggtgtttgtgtccctggccaacggggagctggtggtgtaccagcgggaggccggccacttctgggacccccagaacttcaagtctgtgaccctgggcacccagggcagccccatcaccaagatggtgtctgtgggcggccgcctgtggtgtggctgccagaacagagtgctggtgctgagcccagacaccctgcagctggagcacatgttctacgtgggccaggacagcagccgctgtgtggcctgcatggtggacagcagcctgggcgtgtgggtgaccctgaagggcagcgcccacgtgtgcctgtaccacccagacacctttgagcagctggccgaggtggatgtgaccccacctgtgcacaggatgctggccggcagtgatgccatcatccggcagcacaaggccgcctgcctgcgcatcacagccctgctggtgtgtgaggagctgctgtgggtgggcaccagcgctggggtggtgctgaccatgcccaccagccctggcaccgtgtcctgcccccgggcccccctgagccccaccggcctgggccagggccacacaggccacgtgcgcttcctggccgctgtgcagctgcctgatggcttcaacctgctgtgccccaccccacctcctcctccagacaccggccctgagaagctgcccagcctggagcaccgggacagcccctggcaccggggccctgccccagcccggcccaagatgctggtgatctctggaggagatggctatgaggacttccggctgagcagcggcggcggcagcagcagcgagaccgtgggcagagatgacagcaccaaccacctgctgctgtggagggtgtag

SEQ ID NO: 18486 - DNA, 2499 bp, Artificial Sequence
  Description of Artificial Sequence: Synthetic coding sequence
atgtctgaggccggcggggccggccctgggggctgtggggccggggccggggccggggccggccctggggccctgcccccccagcctgctgccctgcccccagccccaccccagggcagcccctgtgccgctgctgctgggggcagcggggcctgtggccctgccacagctgtggccgctgctggaacagctgagggccctgggggcggcggcagcgccagaattgctgtgaagaaggcccagctgcggagcgccccccgggccaagaagctggagaagctgggcgtgtacagcgcctgcaaggccgaggagagctgcaagtgcaatggctggaagaaccccaaccccagccccaccccacccagggctgacctgcagcagatcatcgtgtccctgacagagagctgccgcagctgcagccacgccctggccgcccacgtgagccacctggagaatgtgtctgaggaggagatgaaccggctgctgggcatcgtgctggatgtggagtacctgttcacctgtgtgcacaaggaggaggatgctgacaccaagcaggtgtacttctacctgttcaagctgctgaggaagagcatcctgcagaggggcaagcctgtggtggagggcagcctggagaagaagcccccatttgagaagcccagcattgagcagggcgtgaacaactttgtgcagtacaagttcagccacctgcctgccaaggagcggcagaccatcgtggagctggccaagatgttcctgaaccgcatcaactactggcacctggaggcccccagccagaggcggctgcggagccccaatgatgacatcagcggctacaaggagaactacacccgctggctgtgctactgcaatgtgccccagttctgtgacagcctgcccaggtatgagaccacccaggtgtttggaagaaccctgctgcggagcgtcttcaccgtgatgaggcggcagctgctggagcaggcccggcaggagaaggacaagctgcccctggagaagaggaccctcatcctgacccacttccccaagttcctgtccatgctggaggaggaggtgtacagccagaacagccccatctgggaccaggacttcctgagcgccagcagcaggaccagccagctgggcatccagaccgtcatcaaccccccacctgtggccggcaccatctcctacaacagcaccagcagcagcctggagcagcccaatgccggcagcagcagccctgcctgcaaggccagcagcggcctggaggccaaccctggagagaagaggaagatgacagacagccacgtgctggaggaggccaagaagccccgggtgatgggagacatccccatggagctgatcaatgaggtgatgagcaccatcacagatcctgctgccatgctgggccctgagaccaacttcctgagcgcccacagcgccagagatgaggccgcccggctggaggagcggcggggcgtcatcgagttccacgtggtgggcaacagcctgaaccagaagcccaacaagaagatcctgatgtggctggtgggcctgcagaatgtgttcagccaccagctgcccaggatgcccaaggagtacatcacccggctggtgtttgaccccaagcacaagaccctggccctgatcaaggatggccgggtgattggaggcatctgcttcaggatgttccccagccagggcttcacagaaattgtgttctgtgctgtgaccagcaatgagcaggtgaagggctacggcacccacctgatgaaccacctgaaggagtaccacatcaagcatgacatcctgaacttcctgacctatgcagatgaatatgccatcggctacttcaagaagcagggcttcagcaaggagatcaagatccccaagaccaagtatgtgggctacatcaaggactatgagggcgccaccctgatgggctgtgagctgaacccccgcatcccctacacagagttcagcgtcatcatcaagaagcagaaggagatcatcaagaagctgattgaaaggaagcaggcccagatcaggaaggtgtacccaggcctgagctgcttcaaggatggagtgcggcagatccccatcgagagcatccctggcatccgggagaccggctggaagcccagcggcaaggagaagagcaaggagccccgggaccctgaccagctgtacagcaccctgaagagcatcctgcagcaggtgaagagccaccagagcgcctggcccttcatggagcctgtgaagaggacagaggcccctggctactatgaagtcatccgcttccccatggacctgaagaccatgtctgagcggctgaagaaccgctactacgtgtccaagaagctgttcatggctgacctgcagagggtcttcaccaactgcaaggagtacaaccccccagagagcgagtactacaagtgtgccaacatcctggagaagttcttcttcagcaagatcaaggaggccggcctgattgacaagtag

SEQ ID NO: 18487 - DNA, 4950 bp, Artificial Sequence
  Description of Artificial Sequence: Synthetic coding sequence
atggccggcggccgcggggcccctggccggggcagagatgagcccccagagagctacccccagaggcaggaccacgagctgcaggccctggaggccatctacggggctgacttccaggacctgcggccagatgcctgtggccctgtgaaggagcccccagagatcaacctggtgctgtacccccagggcctgactggagaggaggtgtatgtgaaggtggacctgcgggtgaagtgcccccccacctacccagatgtggtgcctgagattgagctgaagaatgccaagggcctgagcaatgaatctgtgaacctgctgaagagccggctggaggagctggccaagaagcactgtggggaggtgatgatctttgagctggcctaccacgtgcagagcttcctgtctgagcacaacaagcccccacccaagagcttccacgaggagatgctggagcggcgggcccaggaggagcagcagaggctgctggaggccaagaggaaggaggagcaggagcagcgggagatcctgcacgagatccagaggaggaaggaggagatcaaggaggagaagaagaggaaggagatggccaagcaggagcggctggagatcgccagcctgagcaaccaggaccacaccagcaagaaggaccccggcggccacaggacagctgccatcctgcatggaggcagcccagactttgtgggcaatggcaagcaccgggccaacagcagcggccgcagccggcgggagcggcagtacagcgtgtgcaacagcgaggacagccctggcagctgtgagatcctgtacttcaacatgggcagcccagaccagctgatggtgcacaagggcaagtgcatcggcagtgatgagcagctgggcaagctggtgtacaatgccctggagacagccaccggcggctttgtgctgctgtatgagtgggtgctgcagtggcagaagaagatgggccccttcctgaccagccaggagaaggagaagattgacaagtgcaagaagcagatccagggcacagaaacagagttcaacagcctggtgaagctgagccaccccaacgtggtgcgctacctggccatgaacctgaaggagcaggatgacagcatcgtggtggacatcctggtggagcacatctctggagtgtccctggccgcccacctgagccacagcggccccatccctgtgcaccagctgcggcgctacacagcccagctgctgagcggcctggactacctgcacagcaacagcgtggtgcacaaggtgctgagcgccagcaatgtgctggtggatgctgagggcaccgtgaagatcacagactacagcatcagcaagaggctggccgacatctgcaaggaggatgtgtttgagcagaccagggtgcgcttcagtgacaatgccctgccctacaagacaggcaagaagggagatgtgtggaggctgggcctgctgctgctgagcctgagccagggccaggagtgtggggagtaccctgtgaccatccccagcgacctgcctgctgacttccaggacttcctgaagaagtgtgtgtgcctggatgacaaggagcgctggagcccccagcagctgctgaagcacagcttcatcaacccccagcccaagatgcccctggtggagcagagcccagaagattctgagggccaggactatgtggagaccgtcatccccagcaaccggctgcccagcgctgccttcttcagcgagacccagaggcagttcagccgctacttcatcgagtttgaggagctgcagctgctgggcaagggggcctttggagctgtgatcaaggtgcagaacaagctggatggctgctgctatgctgtgaagaggatccccatcaacccagccagccggcagttccgccgcatcaagggggaggtgaccctgctgagccggctgcaccacgagaacatcgtgcgctactacaatgcctggattgaaagacatgagaggcctgctggccctggcaccccacctccagacagcggccccctggccaaggatgacagagctgcccggggccagcctgccagtgacacagatggcctggacagcgtggaggccgccgcccccccacccatcctgagcagctctgtggagtggagcaccagcggggagaggtctgccagcgcccgcttccctgccaccggccctggcagcagtgatgatgaagatgatgatgaagatgaacatggaggagtcttcagccagagcttcctgcctgccagtgacagcgagagtgacatcatctttgacaatgaagatgagaacagcaagagccagaaccaggatgaggactgcaatgagaagaatggctgccacgagagcgagcccagcgtgaccacagaggccgtgcactacctgtacatccagatggagtactgtgagaagagcaccctgcgggacaccatcgaccagggcctgtacagagacacagtgcggctgtggaggctcttccgggagatcctggatggcctggcctacatccacgagaagggcatgatccaccgggacctgaagcctgtgaacatcttcctggacagtgatgaccacgtgaagatcggggactttggcctggccacagaccacctggccttctctgctgacagcaagcaggatgaccagacaggagacctgatcaagagtgaccccagcggccacctgaccggcatggtgggcacagccctgtatgtgtccccagaggtgcagggcagcaccaagagcgcctacaaccagaaggtggacctcttcagcctgggcatcatcttctttgagatgagctaccaccccatggtgacagccagcgagcgcatctttgtgctgaaccagctgcgggaccccaccagccccaagtttcctgaggactttgatgatggagaacatgccaagcagaagagcgtcatctcctggctgctgaaccacgaccctgccaagaggcccacagccacagagctgctgaagtctgagctgctgcccccaccccagatggaggagagcgagctgcacgaggtgctgcaccacaccctgaccaacgtggatggcaaggcctaccgcaccatgatggcccagatcttcagccagaggatcagccctgccatcgactacacctatgacagcgacatcctgaagggcaacttcagcatcagaacagccaagatgcagcagcacgtgtgtgagaccatcatccgcatcttcaagagacatggagctgtgcagctgtgcacccccctgctgctgcccaggaaccggcagatctatgagcacaatgaagctgccctcttcatggaccacagcggcatgctggtgatgctgccctttgacctgcgcatcccctttgcccgctacgtggccaggaacaacatcctgaacctgaagcgctactgcatcgagagggtcttccggcccaggaagctggaccgcttccaccccaaggagctgctggagtgtgcctttgatattgtgaccagcaccaccaacagcttcctgcccacagctgagatcatctacaccatctatgagatcatccaggagttccctgccctgcaggagaggaactacagcatctacctgaaccacaccatgctgctgaaggccatcctgctgcactgcggcatccctgaggacaagctgagccaggtgtacatcatcctgtatgatgctgtgacagagaagctgacccggcgggaggtggaggccaagttctgcaacctgagcctgagcagcaacagcctgtgccgcctgtacaagttcatcgagcagaagggggacctgcaggacctgatgcccaccatcaacagcctcatcaagcagaagacaggcatcgcccagctggtgaagtatggcctgaaggacctggaggaggtggtgggcctgctgaagaagctgggcatcaagctgcaggtgctgatcaacctgggcctggtgtacaaggtgcagcagcacaacggcatcatcttccagtttgtggccttcatcaagaggcggcagagagctgtgcctgagatcctggccgccggcggccgctatgacctgctgatcccccagttccggggcccccaggccctgggccctgtgcccacagccatcggcgtgtccatcgccatcgacaagatctctgctgctgtgctgaacatggaggagagcgtgaccatcagcagctgtgacctgctggtggtgtctgtgggccagatgtccatgagccgggccatcaacctgacccagaagctgtggacagctggcatcacagctgagatcatgtatgactggagccagagccaggaggagctgcaggagtactgccgccaccacgagatcacctacgtggccctggtgtctgacaaggagggcagccacgtgaaggtgaagagctttgagaaggagcggcagacagagaagagggtgctggagacagagctggtggaccacgtgctgcagaagctgcggaccaaggtgacagatgaaagaaatggccgggaggccagtgacaacctggccgtgcagaacctgaagggcagcttcagcaatgccagcggcctgtttgagatccacggggccaccgtggtgcccatcgtgtctgtgctggcccctgagaagctgagcgccagcacccggcggcgctatgagacccaggtgcagacccggctgcagaccagcctggccaacctgcaccagaagagcagcgagattgagatcctggccgtggacctgcccaaggagaccatcctgcagttcctgagcctggagtgggatgctgatgagcaggccttcaacaccaccgtgaagcagctgctgagccggctgcccaagcagcgctacctgaagctggtgtgtgatgagatctacaacatcaaggtggagaagaaggtgtctgtgctcttcctgtacagctacagagatgactactaccgcatcctcttctag

SEQ ID NO: 18488 - DNA, 5652 bp, Artificial Sequence
  Description of Artificial Sequence: Synthetic coding sequence
atgcctgtgggcagaattgaatgtcccagcagccccagcttcccccgggacatcagccatgaatgtcgggtgtgtggggtgacagaggtgggcctgagcgcctatgccaagcacatcagcggccagctgcacaaggacaacgtggatgcccaggagcgggaggatgatggcaagggggaggaggaggaggaggactactttgacaaggagctgatccagctgatcaagcagaggaaggagcagagccggcaggatgagcccagcaacagcaaccaggagatcaacagtgatgacagaagaccccagtggaggcgggaggaccgcatcccctaccaggaccgggagagctacagccagcctgcctggcaccaccggggccccccccagagggactggaagtgggagaaggatggcttcaacaacaccaggaagaacagcttcccccacagcctgagaaatggaggcggcccccggggccgcagcggctggcacaagggcgtggccggcggcagcagcacctggttccacaaccacagcaacagcggcggcggctggctgagcaacagcggggctgtggactggaaccacaatggaactggaagaaacagctcctggctgtctgagggcaccggcggcttcagctcctggcacatgaacaacagcaatggaaactggaagagctctgtgcgcagcaccaacaactggaactacagcggccctggggacaagttccagcccggcaggaacagaaacagcaactgccagatggaggacatgaccatgctgtggaacaagaagagcaacaagagcaacaagtacagccatgaccgctacaactggcagaggcaggagaatgacaagctgggcaccgtggccacctaccggggccccagcgagggcttcaccagtgacaagttccccagcgagggcctgctggacttcaactttgagcagctggagagccagaccaccaagcaggccgacacagccaccagcaaggtgtctgggaagaatggcagcgctgcccgggagaagccccggcgctggaccccctaccccagccagaagaccctggacctgcagagcggcctgaaggacatcaccggcaacaagtctgagatgattgagaagcccctgtttgacttcagcctcatcaccaccggcatccaggagccccagacagatgagaccaggaacagccccacccagaagacccagaaggagatccacacaggcagcctgaaccacaaggccagcagtgacagcgctgccagctttgaggtggtgcggcagtgccccacagctgagaagccagagcaggagcacacccccaacaagatgcccagcctgaagagccccctgctgccctgcccagccaccaagagcctgagccagaagcaggaccccaagaacatcagcaagaacaccaagaccaacttcttcagccctggagagcacagcaaccccagcaacaagcccaccgtggaggacaaccacggcccctacatcagcaagctgcggagcagctgcccccacgtgctgaagggcaacaagagcaccttcggcagccagaagcagagcggggacaacctgaatgacaccctgaggaaggccaaggaggtgctgcagtgccacgagagcctgcagaaccccctgctgagcaccagcaagagcaccaggaactatgccaaggccagcagaaatgtggaggagagcgagaagggcagcctgaagattgagttccaggtgcacgccctggaggatgaaagtgatggagagaccagtgacacagagaagcacggcaccaagattggcaccctgggcagcgccaccacagagctgctgagcggcagcaccaggacagcagatgagaaggaggaggatgaccgcatcctgaagaccagccgggagctgagcaccagcccctgcaaccccatcgtgcggcagaaggagagcgagctgcagatgaccagcgctgccagcccccaccctggcctgctgctggacctgaagaccagcctggaggatgcccaggtggatgacagcatcaagagccacgtgtcctatgaaacagagggctttgagagcgccagcctggatgctgagctgcagaagagtgacatcagccagcccagcggccccctgctgcctgagctgagcaagctgggcttccctgccagcctgcagagggacctgaccaggcacatcagcctgaagagcaagacaggagtgcacctgcctgagcccaacctgaacagcgcccggcgcatccggaacatcagcggccacaggaagtcagaaacagagaaggagagcggcctgaagcccaccctgcggcagatcctgaatgccagcagaagaaatgtgaactgggagcaggtgatccagcaggtgaccaagaagaagcaggagctgggcaagggcctgccccgcttcggcatcgagatggtgcccctggtgcagaatgagcaggaggccctggacctggatggagagccagacctgagcagcctggagggcttccagtgggagggcgtgtccatcagcagcagccctggcctggccaggaagaggagcctgtctgagagcagcgtcatcatggaccgggcccccagcgtgtacagcttcttcagcgaggagggcaccgggaaggaaaatgagccccagcagatggtgagccccagcaacagcctgcgggccggccagagccagaaggccaccatgcacctgaagcaggaggtgaccccccgggccgccagcctgaggactggagagcgggcagaaaatgtggccacccagaggaggcacagcgcccagctgagcagtgaccacatcatccccctgatgcacctggccaaggacctgaacagccaggagaggagcatccccccatctgagaaccagaacagccaggagagcaatggagagggcaactgcctgagcagcagcgccagcagcgccctggccatcagcagcctggctgatgctgccacagacagcagctgcaccagcggggctgagcagaatgatggccagagcatcaggaagaagaggcgggccactggagatggcagcagccctgagctgcccagcctggagaggaagaacaagaggaggaagatcaagggcaagaaggagaggagccaggtggaccagctgctgaacatcagcctgcgggaggaggagctgagcaagagcctgcagtgcatggacaacaacctgctgcaggcccgggccgccctgcagacagcctacgtggaggtgcagaggctgctgatgctgaagcagcagatcaccatggagatgtctgccctgcggacccaccgcatccagatcctgcagggcctgcaggagacctatgagcccagcgagcacccagaccaggtgccctgcagcctgacccgggagaggaggaacagccgcagccagaccagcattgatgctgccctgctgcccacccccttcttccccctcttcctggagccccccagcagccacgtgagccccagccccaccggggccagcctgcagatcaccaccagccccaccttccagacccacggctctgtgcctgccccagacagctctgtgcagatcaagcaggagcccatgagccctgagcaggatgaaaatgtgaatgctgtgccccccagcagcgcctgcaatgtgtccaaggagctgctggaggccaaccgggagatcagtgacagctgccctgtgtaccctgtgatcacagcccggctgagcctgcctgagagcacagagagcttccacgagcccagccaggagctgaagttctctgtggagcagaggaacaccaggaaccgggagaacagccccagcagccagagcgctggcctgagcagcatcaacaaggagggggaggagcccaccaagggcaacagcggcagcgaggcctgcaccagcagcttcctgcggctgagctttgccagcgagacccccctggagaaggagccccacagccctgctgaccagcctgagcagcaggccgagagcaccctgaccagcgctgagacccggggcagcaagaagaagaagaagctgaggaagaagaagagcctgcgggccgcccacgtgcctgagaacagcgacacagagcaggatgtgctgactgtgaagcctgtgaggaaggtgaaggccggcaagctgatcaagggcggcaaggtgaccaccagcacctgggaggacagcaggacaggccgggagcaggagagcgtgagagatgagccagacagcgacagcagcctggaggtgctggagatccccaacccccagctggaggtggtggccatcgacagcagcgagagcggggaggagaagccagacagccccagcaagaaggacatctggaacagcacagagcagaaccccctggagaccagccgcagcggctgtgatgaggtgagcagcaccagcgagatcggcacccgctacaaggatggcatccctgtgtctgtggccgagacccagaccgtcatcagcagcatcaagggcagcaagaacagcagcgagatcagcagcgagcctggagatgatgatgagcccacagagggcagctttgagggccaccaggccgctgtgaatgccatccagatcttcggcaacctgctgtacacctgcagcgctgacaagacagtgcgggtgtacaacctggtgtccaggaagtgcatcggcgtgtttgagggccacaccagcaaggtgaactgcctgctggtgacccagaccagcggcaagaatgctgccctgtacacaggcagcagtgaccacaccatccgctgctacaacgtgaagagcagagaatgtgtggagcagctgcagctggaggacagagtgctgtgcctgcacagccgctggaggatcctgtatgccggcctggccaacggcaccgtggtgaccttcaacatcaagaacaacaagaggctggagatctttgagtgccacggccccagggctgtgtcctgcctggccacagcccaggagggcgccaggaagctgctggtggtgggcagctatgactgcaccatctctgtgagagatgccagaaatggcctgctgctgcggaccctggagggccacagcaagaccatcctgtgcatgaaggtggtgaatgacctggtgttttctggcagcagtgaccagagcgtgcacgcccacaacatccacactggagagctggtgcgcatctacaagggccacaaccacgctgtgacagtggtgaacatcctgggcaaggtgatggtgacagcctgcctggacaagtttgtgcgggtgtatgagctgcagagccatgaccggctgcaggtgtatggaggccacaaggacatgatcatgtgcatgaccatccacaagtccatgatctacacaggctgctatgatggcagcatccaggccgtgcggctgaacctgatgcagaactaccgctgctggtggcacggctgcagcctcatcttcggcgtggtggaccacctgaagcagcacctgctgacagaccacaccaaccccaacttccagaccctgaagtgccgctggaagaactgtgatgccttcttcaccgccaggaagggcagcaagcaggatgctgctggccacatcgagagacatgctgaagatgacagcaagattgacagctag

SEQ ID NO: 18489 - DNA, 588 bp, Artificial Sequence
  Description of Artificial Sequence: Synthetic coding sequence
atggccgagcctgtgcaggaggagctgtctgtgctggccgccatcttctgccggccccatgagtgggaggtgctgagccgctcagaaacagatggcaccgtcttccgcatccacaccaaggccgagggcttcatggatgtggacatccccctggagctggtgttccacctgcctgtgaactaccccagctgcctgcccggcatcagcatcaacagcgagcagctgacccgggcccagtgtgtgacagtgaaggagaacctgctggagcaggccgagagcctgctgtctgagcccatggtgcatgagctggtgctgtggatccagcagaacctgcggcacatcctgagccagcctgagaccggcagcggcagcgagaagtgcaccttcagcaccagcaccaccatggatgatggcctgtggatcaccctgctgcacctggaccacatgagggccaagaccaagtatgtgaagatcgtggagaagtgggccagtgacctgcggctgaccggccgcctgatgttcatgggcaagatcatcctgatcctgctgcagggcgacaggaacaacctgaaggtgcccaagagctag

SEQ ID NO: 18490 - DNA, 1119 bp, Artificial Sequence
  Description of Artificial Sequence: Synthetic coding sequence
atgagcagaagaagatttgactgccgcagcatcagcggcctgctgaccaccaccccccagatccccatcaagatggagaacttcaacaacttctacatcctgaccagcaaggagctgggccggggcaagtttgctgtggtgcggcagtgcatcagcaagagcacaggccaggagtatgctgccaagttcctgaagaagagaagaagaggccaggactgcagagctgagatcctgcatgaaattgctgtgctggagctggccaagagctgccccagggtcatcaacctgcacgaggtgtatgagaacaccagcgagatcatcctgatcctggagtatgctgctggaggagagatcttcagcctgtgcctgcctgagctggccgagatggtgtctgaaaatgatgtgatccgcctcatcaagcagatcctggagggcgtgtactacctgcaccagaacaacatcgtgcacctggacctgaagccccagaacatcctgctgagcagcatctaccccctgggggacatcaagatcgtggactttggcatgagcaggaagattggccacgcctgtgagctgcgggagatcatgggcaccccagagtacctggcccctgagatcctgaactatgaccccatcaccacagccacagacatgtggaacatcggcatcatcgcctacatgctgctgacccacaccagcccctttgtgggggaggacaaccaggagacctacctgaacatcagccaggtgaatgtggactacagcgaggagaccttcagctctgtgtcccagctggccacagacttcatccagagcctgctggtgaagaaccctgagaagaggcccacagctgagatctgcctgagccacagctggctgcagcagtgggactttgaaaatctcttccaccctgaggagaccagcagcagcagccagacccaggaccacagcgtgcgcagcagcgaggacaagaccagcaagagcagctgcaatggcacctgtggggaccgggaggacaaggagaacatccctgaggacagctccatggtgtccaagcgcttccgctttgatgacagcctgcccaacccccatgagctggtgtctgacctgctgtgctag

SEQ ID NO: 18491 - DNA, 930 bp, Artificial Sequence
  Description of Artificial Sequence: Synthetic coding sequence
atggaggccgccaggacagctgtgctgcgggtgaagaggaagaggtctgctgagcctgctgaggccctggtgctggcctgcaagaggctgcggagtgatgctgtggagagcgctgcccagaagaccagcgagggcctggagagagctgctgaaaataatgtgttccacctggtggccaccgtgtgcagccaggaggagcctgtgcagcccctgctgcgggaggtgctgcggcccagccgggacagccagcagagggtgagaagaaacctgcgggccagcgcccgggaggtgcggcaggagggccgctacagagtgctgagcagcagaagaagcctgggcaccaccagcagcggccaggagagcgagtacaccccaggcaaccctgaggccgccggcaacagcggcttccagctgctggacctggtgcatgaggagggggagcctgaggccgccagcgctggcagctgcaagaccagtgaccctgatgtgatcctgtgcaacagcgtggagctgatccgggagcggctgactgtgtctgaagatggccctggggtgcggcggcaggaggagcagaagcatgatgattatgtgtatgacatctactacctggagacagccaccccaggctggattgagaacatcctgtctgtgcagccctacagccaggagtgggagctggtgaatgatgaccaggagcctgaggacatctatgatgatgaagatgatgaaaattctgagaacaactggagaaatgagtacccagaggaggagagcagtgatggagatgaggacagccggggcagcgctgactacaacagcctgtctgaggaggagcggggcagcagccggcagaggatgtggagcaagtaccccctggatgtgcagaaggagtttggctatgacagcccccatgacctggacagcgactag

SEQ ID NO: 18492 - DNA, 1068 bp, Artificial Sequence
  Description of Artificial Sequence: Synthetic coding sequence
atggctgacaacagcagtgatgaatgtgaggaggagaacaacaaggtgctgcgggagggcatgccccaggcccctggccaccggggcaaggacatggaccctgtgcccccagccccagccagcctgaagtgccaccagacccccagccacgtgctggagcgggtgggctggtaccgggagagccagaagcacaggaaggagaagaagaagaccagccagctgaccccccagaggggcttctctgaaaatgaagatgatgatgatgatgatgatgacagcagcgagacagacagcgacagtgatgatgatgatgaggagcacggggcccccctggagggcgcctatgaccctgctgactatgagcacctgcctgtgtctgctgagatcaaggagctgttccagtacatcagccgctacaccccccagctgattgacctggaccacaagctgaagcccttcatcccagacttcatcccagctgtgggggacattgatgccttcctgaaggtgcccaggccagatggcaagccagacaacctgggcctgctggtgctggatgagcccagcaccaagcagagcgaccccaccgtgctgagcctgtggctgacagagaacagcaagcagcacaacatcacccagcacatgaaggtgaagagcctggaggatgctgagaagaaccccaaggccatcgacacctggattgagagcatcagcgagctgcacaggagcaagcccccagccaccgtgcactacacccggcccatgccagacatcgacaccctgatgcaggagtggagccctgagtttgaggagctgctgggcaaggtgtccctgcccacagctgagattgactgcagcctggccgagtacatcgacatgatctgtgccatcctggacatccctgtgtacaagagccgcatccagagcctgcacctgctcttcagcctgtacagcgagttcaagaacagccagcacttcaaggccctggccgagggcaagaaggccttcacccccagcagcaacagcaccagccaggccggggacatggagaccctgaccttctcctag

SEQ ID NO: 18493 - DNA, 915 bp, Artificial Sequence
  Description of Artificial Sequence: Synthetic coding sequence
atggctgacaacagcagtgatgaatgtgaggaggagaacaacaaggagaagaagaagaccagccagctgaccccccagaggggcttctctgaaaatgaagatgatgatgatgatgatgatgacagcagcgagacagacagcgacagtgatgatgatgatgaggagcacggggcccccctggagggcgcctatgaccctgctgactatgagcacctgcctgtgtctgctgagatcaaggagctgttccagtacatcagccgctacaccccccagctgattgacctggaccacaagctgaagcccttcatcccagacttcatcccagctgtgggggacattgatgccttcctgaaggtgcccaggccagatggcaagccagacaacctgggcctgctggtgctggatgagcccagcaccaagcagagcgaccccaccgtgctgagcctgtggctgacagagaacagcaagcagcacaacatcacccagcacatgaaggtgaagagcctggaggatgctgagaagaaccccaaggccatcgacacctggattgagagcatcagcgagctgcacaggagcaagcccccagccaccgtgcactacacccggcccatgccagacatcgacaccctgatgcaggagtggagccctgagtttgaggagctgctgggcaaggtgtccctgcccacagctgagattgactgcagcctggccgagtacatcgacatgatctgtgccatcctggacatccctgtgtacaagagccgcatccagagcctgcacctgctcttcagcctgtacagcgagttcaagaacagccagcacttcaaggccctggccgagggcaagaaggccttcacccccagcagcaacagcaccagccaggccggggacatggagaccctgaccttctcctag

SEQ ID NO: 18494 - DNA, 1335 bp, Artificial Sequence
  Description of Artificial Sequence: Synthetic coding sequence
atgagggagatcgtgcacctgcaggccggccagtgtggcaaccagatcggggccaagttctgggaggtgatcagtgatgagcacggcatcgaccccaccggcacctaccatggagacagcgacctgcagctggagcgcatcaacgtgtactacaatgaggccactggaggcaactacgtgcccagggctgtgctggtggacctggagcccggcaccatggattctgtgcgcagcggccccttcggccagatcttccggccagacaactttgtgtttggccagagcggggccggcaacaactgggccaagggccactacacagaaggagctgagctggtggatgctgtgctggatgtggtgaggaaggaggccgagagctgtgactgcctgcagggcttccagctgacccacagcctgggcggcggcactggaagtggcatgggcaccctgctgatcagcaagatccgggaggagttcccagaccgcatcatgaacaccttctctgtggtgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcagatgtttgatgccaagaacatgatggccgcctgtgaccccaggcatggccgctacctgactgtggccgctgtgttccggggccgcatgtccatgaaggaggtggatgagcagatgctgtctgtgcagagcaagaacagcagctactttgtggagtggatccccaacaacgtgaagacagctgtgtgtgacatccccccccggggcctgaagatggccgccaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggagggggagtttgaggaggaggccgaggaggaggtggcctag

SEQ ID NO: 18495 - DNA, 1398 bp, Artificial Sequence
  Description of Artificial Sequence: Synthetic coding sequence
atggagcccagcagcctggagctgcctgctgacacagtgcagagaattgctgctgagctgaagtgccaccccacagatgagcgggtggccctgcacctggatgaggaggacaagctgcggcacttccgggagtgcttctacatccccaagatccaggacctgccccctgtggacctgagcctggtgaacaaggatgaaaatgccatctacttcctgggcaacagcctgggcctgcagcccaagatggtgaagacctacctggaggaggagctggacaagtgggccaagattgctgcctacggccacgaggtgggcaagaggccctggatcactggagatgagagcatcgtgggcctgatgaaggacatcgtgggcgccaatgagaaggagatcgccctgatgaatgccctgactgtgaacctgcacctgctgatgctgtccttcttcaagcccacccccaagcgctacaagatcctgctggaggccaaggccttccccagcgaccactacgccatcgagagccagctgcagctgcacggcctgaacatcgaggagagcatgaggatgatcaagccccgggagggggaggagaccctgagaattgaggacatcctggaggtgattgagaaggagggggacagcattgctgtgatcctcttctctggagtgcacttctacacaggccagcacttcaacatcccagccatcaccaaggccggccaggccaagggctgctacgtgggctttgacctggcccatgctgtgggcaatgtggagctgtacctgcatgactggggcgtggactttgcctgctggtgcagctacaagtacctgaatgctggggccggcggcattgctggggccttcatccacgagaagcacgcccacaccatcaagccagccctggtgggctggtttggccacgagctgagcacccgcttcaagatggacaacaagctgcagctgatccctggggtgtgtggcttccgcatcagcaacccccccatcctgctggtgtgcagcctgcacgccagcctggagatcttcaagcaggccaccatgaaggccctgaggaagaagtctgtgctgctgaccggctacctggagtacctgatcaagcacaactacggcaaggacaaggccgccaccaagaagcctgtggtgaacatcatcacccccagccacgtggaggagcggggctgccagctgaccatcaccttctctgtgcccaacaaggatgtgttccaggagctggagaagaggggcgtggtgtgtgacaagaggaaccccaacggcatccgggtggcccctgtgcccctgtacaacagcttccatgatgtgtacaagttcaccaacctgctgaccagcatcctggacagcgctgagaccaagaactag

SEQ ID NO: 18496 - DNA, 4758 bp, Artificial Sequence
  Description of Artificial Sequence: Synthetic coding sequence
atgaacagccagccccagaccaggagccccttcttccagaggccccagatccagcccccccgggccaccatccccaacagcagccccagcatccggcctggggcccagacccccacagctgtgtaccaggccaaccagcacatcatgatggtgaaccacctgcccatgccctaccctgtgccccagggcccccagtactgcatcccccagtaccgccacagcggccccccctacgtgggccccccccagcagtaccctgtgcagcccccaggccctggccccttctacccaggccctggccctggggacttccccaatgcctacggcacccccttctaccccagccagcctgtgtaccagagcgcccccatcatcgtgcccacccagcagcagcccccaccagccaagcgggagaagaagaccatccgcatccgggaccccaaccagggcggcaaggacatcacagaggagatcatgtctgggggcggcagcaggaaccccaccccacccatcggccggcccaccagcacccccaccccaccccagcagctgcccagccaggtgcctgagcacagccctgtggtgtatggcaccgtggagagcgcccacctggccgccagcacccctgtgacagctgccagtgaccagaagcaggaggagaagcccaagccagaccctgtgctgaagagccccagccctgtgctgcggctggtgctgagcggggagaagaaggagcaggagggccagaccagcgagaccacagccatcgtgtccattgctgagctgcccctgccccccagccccaccaccgtgtcctctgtggcccggagcaccatcgccgcccccaccagcagcgccctgagcagccagcccatcttcaccacagccattgatgacagatgtgagctgagcagcccccgggaggacaccatccccatccccagcctgaccagctgcacagagaccagtgaccccctgcccaccaatgaaaatgatgatgacatctgcaagaagccctgcagcgtggccccaaatgacatccccctggtgagcagcaccaacctgatcaatgagatcaacggggtgtctgagaagctgagcgccacagagagcatcgtggagatcgtgaagcaggaggtgctgcccctgaccctggagctggagatcctggagaaccccccagaggagatgaagctggagtgcatcccagcccccatcacccccagcacagtgcccagcttcccccccaccccacccaccccaccagccagccccccccacacccctgtgattgtgcctgctgctgccaccaccgtgagcagccccagcgctgccatcaccgtgcagagggtgctggaggaggatgagagcatccgcacctgcctgtctgaagatgccaaggagatccagaacaagattgaggtggaggctgatggccagacagaggagatcctggacagccagaacctgaacagcagaagaagccctgtgcctgcccagatcgccatcaccgtgcccaagacctggaagaagcccaaggacaggaccaggaccacagaggagatgctggaggccgagctggagctgaaggccgaggaggagctgagcattgacaaggtgctggagagcgagcaggacaagatgagccagggcttccaccctgagcgggaccccagcgacctgaagaaggtgaaggctgtggaggagaatggagaggaggccgagcctgtgagaaatggagctgagagcgtgtctgagggggagggcattgatgccaacagcggcagcacagacagcagtggagatggagtgaccttccccttcaagccagagagctggaagcccacagacacagagggcaagaagcagtatgaccgggagttcctgctggacttccagttcatgcctgcctgcatccagaagccagagggcctgccccccatcagtgatgtggtgctggacaagatcaaccagcccaagctgcccatgaggaccctggacccccgcatcctgccccggggccctgacttcaccccagcctttgctgactttggccggcagaccccaggcggccggggcgtgcccctgctgaatgtgggcagccgccgcagccagcccggccagaggcgggagcccaggaagatcatcaccgtgtctgtgaaggaggatgtgcacctgaagaaggccgagaatgcctggaagcccagccagaagagggacagccaggctgatgatcctgagaacatcaagacccaggagctgttcaggaaggtgcgcagcatcctgaacaagctgaccccccagatgttcaaccagctgatgaagcaggtgtctggcctgactgtggacacagaggagcggctgaagggcgtcatcgacctggtgtttgagaaggccattgatgagcccagcttctctgtggcctatgccaacatgtgccgctgcctggtgaccctgaaggtgcccatggctgacaagccaggcaacacagtgaacttcaggaagctgctgctgaaccgctgccagaaggagtttgagaaggacaaggcagatgatgatgtgtttgagaagaagcagaaggagctggaggccgccagcgcccctgaggagaggacccggctgcatgatgagctggaggaggccaaggacaaggccaggagaagaagcatcggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcgtgaaggagaggaagaccagcagccgcatccgcttcatgctgcaggatgtgattgacctgcggctgtgcaactgggtgtccagaagagctgaccagggccccaagaccatcgagcagatccacaaggaggccaagattgaggagcaggaggagcagaggaaggtgcagcagctgatgaccaaggagaagagaagacctggggtgcagagggtggatgaaggaggctggaacacagtgcagggcgccaagaacagccgggtgctggaccccagcaagttcctgaagatcaccaagcccaccattgatgagaagatccagctggtgcccaaggcccagctgggctcctggggcaagggcagcagcggcggggccaaggccagcgagacagatgccctgcggagcagcgccagcagcctgaaccgcttcagcgccctgcagcccccagcccccagcggcagcacccccagcacccctgtggagtttgacagcaggaggaccctgaccagccggggctccatgggccgggagaagaatgacaagcccctgcccagcgccacagcccggcccaacaccttcatgaggggcggcagcagcaaggacctgctggacaaccagagccaggaggagcagaggcgggagatgctggagaccgtgaagcagctgactggaggagtggatgtggagaggaacagcacagaagctgagaggaacaagacccgggagagcgccaagccagagatcagcgccatgtctgcccatgacaaggccgccctgtctgaggaggagctggagaggaagagcaagagcatcattgatgagttcctgcacatcaatgacttcaaggaggccatgcagtgtgtggaggagctgaatgcccagggcctgctgcacgtgtttgtgcgggtgggcgtggagagcaccctggagaggagccagatcacccgggaccacatgggccagctgctgtaccagctggtgcagagcgagaagctgagcaagcaggacttcttcaagggcttcagcgagaccctggagctggctgatgacatggccatcgacatcccccacatctggctgtacctggccgagctggtgacccccatgctgaaggagggcggcatctccatgagggagctgaccatcgagttcagcaagcccctgctgcctgtgggccgggccggcgtgctgctgtctgagatcctgcacctgctgtgcaagcagatgagccacaagaaggtgggcgccctgtggagggaggccgacctgtcctggaaggacttcctgcctgaaggagaagatgtgcacaacttcctgctggagcagaagctggacttcattgaaagtgacagcccctgcagcagcgaggccctgagcaagaaggagctgtctgctgaggagctgtacaagaggctggagaagctgatcatcgaggacaaggccaatgatgagcagatctttgactgggtggaggccaacctggatgagatccagatgagcagccccaccttcctgcgggccctgatgacagctgtgtgcaaggccgccatcatcgctgacagcagcaccttccgggtggacacagctgtgatcaagcagagggtgcccatcctgctgaagtacctggacagcgacacagagaaggagctgcaggccctgtatgccctgcaggccagcatcgtgaagctggaccagcctgccaacctgctgaggatgttctttgactgcctgtatgatgaggaggtgatcagtgaagatgccttctacaagtgggagagcagcaaggaccctgctgagcagaatggaaaaggagtggccctgaagtctgtgacagccttcttcacctggctgcgggaggccgaggaggagagcgaggacaactag

SEQ ID NO: 18497 - DNA, 378 bp, Artificial Sequence
  Description of Artificial Sequence: Synthetic coding sequence
atggccccagccaagaagggcggggagaagaagaagggccgcagcgccatcaatgaggtggtgacccgggagtacaccatcaacatccacaagaggatccacggcgtgggcttcaagaagagggccccccgggccctgaaggagatcaggaagtttgccatgaaggagatgggcaccccagatgtgagaattgacacccggctgaacaaggctgtgtgggccaagggcatcagaaatgtgccctaccgcatccgggtgcggctgagcaggaagagaaatgaagatgaggacagccccaacaagctgtacaccctggtgacctacgtgcctgtgaccaccttcaagaacctgcagacagtgaatgtggatgagaactag

SEQ ID NO: 18498 - DNA, 1590 bp, Artificial Sequence
  Description of Artificial Sequence: Synthetic coding sequence
atgctggtgctgtttgagacctctgtgggctacgccatcttcaaggtgctgaatgagaagaagctgcaggaggtggacagcctgtggaaggagtttgagaccccagagaaggccaacaagatcgtgaagctgaagcactttgagaagttccaggacacagctgaggccctggccgccttcaccgccctgatggagggcaagatcaacaagcagctgaagaaggtgctgaagaagatcgtgaaggaggcccacgagcccctggccgtggctgatgccaagctgggcggcgtcatcaaggagaagctgaacctgagctgcatccacagccctgtggtgaatgagctgatgaggggcatccgcagccagatggatggcctcatccctggggtggagccccgggagatggccgccatgtgcctgggcctggcccacagcctgagccgctaccgcctgaagttctctgctgacaaggtggacaccatgattgtgcaggccatcagcctgctggatgacctggacaaggagctgaacaactacatcatgcgctgccgggagtggtacggctggcacttccctgagctgggcaagatcatcagtgacaacctgacctactgcaagtgcctgcagaaggtgggggacaggaagaactatgccagcgccaagctgtctgagctgctgcctgaggaggtggaggccgaggtgaaggctgctgctgagatctccatgggcacagaggtgtctgaggaggacatctgcaacatcctgcacctgtgcacccaggtgattgagatcagcgagtaccgcacccagctgtatgagtacctgcagaacaggatgatggccatcgccccaaatgtgacagtgatggtgggggagctggtgggcgcccggctgattgcccacgccggcagcctgctgaacctggccaagcacgccgccagcacagtgcagatcctgggcgctgagaaggccctcttccgggccctgaagagccggcgggacacccccaagtatggcctcatctaccacgccagcctggtgggccagaccagccccaagcacaagggcaagatcagcaggatgctggccgccaagacagtgctggccatccgctatgatgcctttggagaggacagcagcagcgccatgggcgtggagaacagagccaagctggaggcccggctgcggaccctggaggaccggggcatcaggaagatctctggaacaggcaaggccctggccaagacagagaagtatgagcacaagtctgaggtgaagacctatgaccccagcggggacagcaccctgcccacctgcagcaagaagaggaagattgagcaggtggacaaggaggatgagatcacagagaagaaggccaagaaggccaagatcaaggtgaaggtggaggaggaggaggaggagaaggtggccgaggaggaggagacctctgtgaagaagaagaagaagaggggcaagaagaagcacatcaaggaggagcccctgtctgaggaggagccctgcaccagcacagccatcgccagccctgagaagaagaagaagaagaagaagaagcgggagaatgaagattag

SEQ ID NO: 18499 - DNA, 738 bp, Artificial Sequence
  Description of Artificial Sequence: Synthetic coding sequence
atgaatggccgggctgacttccgggagcccaatgctgaggtgccccggcccatcccccacatcggccctgactacatccccacagaggaggagcggcgggtgtttgctgaatgtaatgatgagagcttctggttccgctctgtgcccctggccgccacctccatgctgatcacccagggcctcatcagcaagggcatcctgagcagccaccccaagtatggcagcatccccaagctgatcctggcctgcatcatgggctactttgctgggaagctgtcctatgtgaagacctgccaggagaagttcaagaagctggagaacagccccctgggggaggccctgcggagcggccaggcccggcgcagcagccccccaggccactactaccagaagagcaaatatgacagctctgtgtctggccagagcagctttgtgaccagccctgctgctgacaacatcgagatgctgccccactatgagcccatccccttcagcagctccatgaatgaaagtgcccccaccggcatcacagaccacatcgtgcagggccctgaccccaacctggaggagagccccaagaggaagaacatcacctatgaggagctgaggaacaagaaccgggagagctatgaggtgtccctgacccagaagacagaccccagcgtgcggcccatgcatgagcgggtgcccaagaaggaggtgaaggtgaacaagtatggagacacctgggatgaatag

SEQ ID NO: 18500 - DNA, 1746 bp, Artificial Sequence
  Description of Artificial Sequence: Synthetic coding sequence
atggaggatgtgaacagcaatgtgaatgctgaccaggaggtgaggaagctgcaggagctggtgaagaagctggagaagcagaatgagcagctgcggagccgctctggagctgtgcagggcgccggcagcctgggccctggcagccctgtgcgggccggggccagcatccccagcagtggagctgccagcccccggggcttccccctgggcctgagcgccaagagcggcggcggccctggcagcggccccaggaggaccagcagcgaggagctgagagatgccaccagcctgctggccgccggggagggcggcctgctggatgaggtggagcccctgcggccagatgagctggagcggctgagcggctgggaggaggaggaggagagctggctgtacagcagccccaagaagaagctgacccccatgcagaagtctgtgagccccctggtgtggtgccggcaggtgctggactaccccagcccagatgtggagtgtgccaagaagagcctcatccacaagctggaccagaccatgtctgccctgaagaggcagaacctgtacaacaaccccttcaacagcatgagctacaccagcccctacagccccaatgccagcagcccctacagcagcggcttcaacagccccagcagcacccctgtgcggccccccatcgtgaagcagctgatcctgcccggcaacagcggcaacctgaagagcagtgacaggaacccccccctgagcccccagagcagcattgacagcgagctgagcgccagcgagctggatgaagattccatcggcagcaactacaagctgaatgatgtgacagatgtgcagatcctggccaggatgcaggaggagagcctgcggcaggagtatgctgccaccaccagcagaagaagcagcggcagcagctgcaacagcacccggcggggcaccttcagtgaccaggagctggatgcccagagcctggatgatgaagatgacaacatgcaccacgctgtgtacccagctgtgaaccgcttcagccccagccccaggaacagcccccggcccagccccaagcagagccccaggaacagccccaggagccgcagccctgcccggggcatcgagtacagccgggtgagcccccagcccatgatcagccggctgcagcagccccggctgagcctgcagggccaccccacagacctgcagaccagcaatgtgaagaatgaggagaagctgcggcgcagcctgcccaacctgagcaggaccagcaacacccaggtggacagcgtgaagagcagcagaagtgacagcaacttccaggtgcccaatggaggcatccccaggatgcagccccaggccagcgccatccccagccctgggaagttccgcagccctgctgcccccagccccctggccctgcggcagcctgtgaaggccttcagcaaccacggcagcggcagccctggcagccaggagatcacccagctgacccagaccaccagcagccctggcccccccatggtgcagagcacagtgtctgccaacccccccagcaacatcaacagcgccaccctgaccaggcctgctggcaccacagccatgaggagcggcctgccccggcccagcgcccccagcgctgggggcatccctgtgcccaggagcaagctggcccagcctgtgagaagaagcctgcctgcccccaagacctacggctccatgaaggatgacagctggaaggatggctgctactag

SEQ ID NO: 18501 - DNA, 3153 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgtggcttcatcagtgacagatctgtgaaggaggtggcctgtggcggcaaccacagcgtcttcctgctggaggatggagaggtgtacacctgtggcctgaacaccaagggccagctgggccacgagcgggagggcaacaagccagagcagatcggggccctggccgaccagcacatcatccacgtggcctgtggggagagccacagcctggccctgagtgaccggggccagctgttctcctggggcgccggcagtgatggccagctgggcctgatgaccacagaggacagcgtggccgtgcccaggctcatccagaagctgaaccagcagaccatcctgcaggtgtcctgtggcaactggcactgcctggccctggccgcagatggccagttcttcacctggggcaagaacagccacggccagctgggcctgggcaaggagttccccagccaggccagcccccagagggtgcgcagcctggagggcatccccctggcccaggtggccgccggcggggcccacagctttgccctgagcctgagcggggctgtgtttggctggggcatgaacaatgccggccagctgggcctgagtgatgagaaggaccgggagagcccctgccacgtgaagctgctgcggacccagaaggtggtgtacatcagctgtggggaggagcacacagctgtgctgaccaagagcggcggcgtcttcaccttcggggccggcagctgtggccagctgggccatgacagcatgaatgatgaggtgaacccccggcgggtgctggagctgatgggcagcgaggtgacccagatcgcctgtggccggcagcacaccctggcctttgtgcccagcagcggcctcatctatgccttcggctgtggggcccggggccagctgggcaccggccacacctgcaatgtgaagtgccccagccctgtgaagggctactgggccgcccacagcggccagctgagcgcccgggctgaccgcttcaagtaccacatcgtgaagcagatcttctctggaggagaccagacctttgtgctgtgcagcaaatatgagaactacagccctgctgtggacttccgcaccatgaaccaggcccactacaccagcctcatcaatgatgagaccatcgctgtgtggaggcagaagctgtctgagcacaacaatgccaacaccatcaacggggtggtgcagatcctgagcagcgctgcctgctggaatggcagcttcctggagaagaagattgatgagcacttcaagaccagccccaagatccctggcatcgacctgaacagcaccagggtgctgtttgagaagctgatgaacagccagcacagcatgatcctggagcagatcctgaacagctttgagagctgcctgatcccccagctgagcagcagccccccagatgtggaggccatgaggatctacctgatcctgcctgagttccccctgctgcaggacagcaagtactacatcaccctgaccatccccctggccatggccatcctgcggctggacaccaaccccagcaaggtgctggacaactggtggagccaggtgtgccccaagtacttcatgaagctggtgaacctgtacaagggagctgtgctgtacctgctgcggggcaggaagaccttcctgatccctgtgctcttcaacaactacatcacagctgccctgaagctgctggagaagctgtacaaggtgaacctgaaggtgaagcacgtggagtatgacaccttctacatccctgagatcagcaacctggtggacatccaggaggactacctgatgtggttcctgcaccaggccggcatgaaggcccggcccagcatcatccaggacacagtgaccctgtgcagctaccccttcatctttgatgcccaggccaagaccaagatgctgcagacagatgctgagctgcagatgcaggtggccgtgaatggagccaacctgcagaatgtgttcatgctgctgaccctggagcccctgctggcccggagccccttcctggtgctgcacgtgagaagaaacaacctggtgggagatgccctgcgggagctgagcatccacagcgacatcgacctgaagaagcccctgaaggtgatctttgatggagaggaggccgtggatgctggaggagtgaccaaggagttcttcctgctgctgctgaaggagctgctgaaccccatctacggcatgttcacctactaccaggacagcaacctgctgtggttcagtgacacctgctttgtggagcacaactggttccacctgattggcatcacctgtggcctggccatctacaacagcacagtggtggacctgcacttccccctggccctgtacaagaagctgctgaatgtgaagccaggcctggaggacctgaaggagctgagccccacagagggccgcagcctgcaggagctgctggactacccaggagaagatgtggaggagaccttctgcctgaacttcaccatctgccgggagagctatggagtgattgagcagaagaagctgatccctggaggagacaacgtgacagtgtgcaaggacaaccggcaggagtttgtggatgcctacgtgaactacgtgttccagatctctgtgcatgagtggtacacagccttcagcagcggcttcctgaaggtgtgtggcggcaaggtgctggagctgttccagcccagcgagctgcgggccatgatggtgggcaacagcaactacaactgggaggagctggaggagacagccatctacaagggggactacagcgccacccaccccaccgtgaagctgttctgggagaccttccacgagttccccctggagaagaagaagaagttcctgctcttcctgactggaagtgaccgcatccccatctacggcatggccagcctgcagatcgtcatccagagcacagccagcggggaggagtacctgcctgtggcccacacctgctacaacctgctggacctgcccaagtacagcagcaaggagatcctgagcgcccggctgacccaggccctggacaactatgagggcttcagcctggcctag

SEQ ID NO: 18502 - DNA, 3069 bp, Artificial Sequence
  Description of Artificial Sequence: Synthetic coding sequence
atgtacttctgctggggcgctgacagccgggagctgcagaggagaagaacagctggcagccctggagctgagctgctgcaggccgccagcggggagcggcacagcctgctgctgctgaccaaccaccgggtgctgagctgtggggacaacagccggggccagctgggcagaagaggagcccagagaggagagctgcctgagcccatccaggccctggagaccctcatcgtggacctggtgtcctgtgggaaggagcacagcctggccgtgtgccacaagggccgggtgtttgcctggggcgccggcagcgagggccagctgggcattggagagttcaaggagatctccttcacccccaagaagatcatgaccctgaatgacatcaagatcatccaggtgtcctgtggccactaccacagcctggccctgagcaaggacagccaggtgttctcctggggcaagaacagccacggccagctgggcctgggcaaggagttccccagccaggccagcccccagagggtgcgcagcctggagggcatccccctggcccaggtggccgccggcggggcccacagctttgccctgagcctgtgtggcaccagctttggctggggcagcaacagcgctggccagctggccctgagcggcagaaatgtgcctgtgcagagcaacaagcccctgtctgtgggcgccctgaagaacctgggcgtggtgtacatcagctgtggagatgcccacacagctgtgctgacccaggacggcaaggtgttcaccttcggggacaacagaagtggccagctgggctacagccccaccccagagaagaggggcccccagctggtggagagaattgatggcctggtgtcccagattgactgtggcagctaccacaccctggcctacgtgcacaccaccggccaggtggtgtcctttggccacggccccagcgacaccagcaagcccacccaccctgaggccctgacagagaactttgacatcagctgcctgatctctgcagaagattttgtggatgtgcaggtgaagcacatctttgctggcacctacgccaactttgtgaccacccaccaggacaccagcagcacccgggcccctgggaagaccctgcctgagatcagccgcatcagccagagcatggccgagaagtggattgctgtgaagagaagaagcacagagcacgagatggccaagtctgagatccgcatgatcttcagcagccctgcctgcctgacagccagcttcctgaagaagaggggcactggagagaccaccagcattgatgtggacctggagatggcccgggacaccttcaagaagctgaccaagaaggagtggatcagctccatgatcaccacctgcctggaggatgacctgctgcgggccctgccctgccacagcccccaccaggaggccctgagcgtcttcctgctgctgcctgaatgtcctgtgatgcatgacagcaagaactggaagaacctggtggtgccctttgccaaggctgtgtgtgagatgagcaagcagagcctgcaggtgctgaagaagtgctgggccttcctgcaggagagcagcctgaaccccctcatccagatgctgaaggccgccatcatcagccagctgctgcaccagaccaagacagagcaggaccactgcaatgtgaaggccctgctgggcatgatgaaggagctgcacaaggtgaacaaggccaactgccgcctgcctgagaacaccttcaacatcaatgagctgagcaacctgctgaacttctacatcgaccggggccggcagctgttccgggacaaccacctgatcccagctgagacccccagccctgtgatcttcagtgacttccccttcatcttcaacagcctgagcaagatcaagctgctgcaggccgacagccacatcaagatgcagatgtctgagaagaaggcctacatgctgatgcatgagaccatcctgcagaagaaggatgagttcccccccagcccccgcttcatcctgcgggtgagaagaagccggctggtgaaggatgccctgcggcagctgagccaggccgaggccacagacttctgcaaggtgctggtggtggagttcatcaatgagatctgcccagagagcggaggagtgagcagcgagttcttccactgcatgtttgaggagatgaccaagccagaatatggcatgttcatgtacccagagatgggcagctgcatgtggttccctgccaagcccaagccagagaagaagcgctacttcctgtttggcatgctgtgtggcctgagcctcttcaacctgaatgtggccaacctgcccttccccctggccctgtacaagaagctgctggaccagaagcccagcctggaggacctgaaggagctgagcccccggctgggcaagagcctgcaggaggtgctggatgatgctgctgatgacattggagatgccctgtgcatccgcttcagcatccactgggaccagaatgatgtggacctgatccccaacggcatcagcatccctgtggaccagaccaacaagagggactatgtgtccaagtacatcgactacatcttcaacgtgtctgtgaaggctgtgtatgaggagttccagaggggcttctacagagtgtgtgagaaggagatcctgcggcacttctacccagaggagctgatgacagccatcatcggcaacacagattatgactggaagcagtttgagcagaacagcaaatatgagcagggctaccagaagagccaccccaccatccagctgttctggaaggccttccacaagctgaccctggatgagaagaagaagttcctgttcttcctgaccggccgggaccggctgcacgcccggggcatccagaagatggagatcgtgttccgctgcccagagaccttcagcgagcgggaccaccccaccagcatcacctgccacaacatcctgagcctgcccaagtacagcaccatggagaggatggaggaggccctgcaggtggccatcaacaacaacagaggatttgtgagccccatgctgacccagagctag

SEQ ID NO: 18503 - DNA, 1221 bp, Artificial Sequence
  Description of Artificial Sequence: Synthetic coding sequence
atggctgctgctgtgcggcaggacctggcccagctgatgaacagcagcggcagccacaaggacctggccggcaagtaccggcagatcctggagaaggccatccagctgtctggagctgagcagctggaggccctgaaggcctttgtggaggccatggtgaatgaaaatgtgtccctggtgatcagccggcagctgctgacagacttctgcacccacctgcccaacctgcctgacagcacagccaaggagatctaccacttcaccctggagaagatccagcccagggtcatcagctttgaggagcaggtggccagcatccggcagcacctggccagcatctatgagaaggaggaggactggagaaatgctgcccaggtgctggtgggcatccccctggagaccggccagaagcagtacaacgtggactacaagctggagacctacctgaagatcgcccggctgtacctggaggatgatgatcctgtgcaggccgaggcctacatcaacagagccagcctgctgcagaatgaaagcaccaatgagcagctgcagatccactacaaggtgtgctacgcccgggtgctggactacagaaggaagttcatcgaggccgcccagcgctacaatgagctgagctacaagaccatcgtgcatgagagcgagcggctggaggccctgaagcacgccctgcactgcaccatcctggccagcgctggccagcagaggagcaggatgctggccaccctcttcaaggatgagcgctgccagcagctggccgcctacggcatcctggagaagatgtacctggaccgcatcatccggggcaaccagctgcaggagtttgctgccatgctgatgccccaccagaaggccaccacagcagatggcagcagcatcctggacagagctgtgattgagcacaacctgctgagcgccagcaagctgtacaacaacatcacctttgaggagctgggcgccctgctggagatcccagctgccaaggccgagaagatcgccagccagatgatcacagagggccgcatgaatggcttcatcgaccagattgatggcatcgtgcactttgagacccgggaggccctgcccacctgggacaagcagatccagagcctgtgcttccaggtgaacaacctgctggagaagatcagccagacagcccctgagtggacagcccaggccatggaggcccagatggcccagtag

SEQ ID NO: 18504 - DNA, 1578 bp, Artificial Sequence
  Description of Artificial Sequence: Synthetic coding sequence
atggctgctggcctgctgggctctgaagatcctccctggagctggaacctgacctgccgggccctgcggacctgccaggtgaggaacatccgggtgctgcagctgctgctgaagccctggtgcatcagcagagctgtgtaccagatgacagagggccgccgctgccaggtgcacctgctggatgacaggaagctggagctgctggtgcagcccaagctgctggccaaggagctgctggacctggtggccagccacttcaacctgaaggagaaggagtacttcggcatcgccttcacagatgagaccggccacctgaactggctgcagctggaccggcgggtgctggagcatgacttccccaagaagagcggccctgtggtgctgtacttctgtgtgcgcttctacatcgagagcatctcctacctgaaggacaatgccaccatcgagctgttcttcctgaatgccaagagctgcatctacaaggagctgattgatgtggacagcgaggtggtgtttgagctggccagctacatcctgcaggaggccaagggggacttcagcagcaatgaggtggtgcggagtgacctgaagaagctgcctgccctgcccacccaggccctgaaggagcaccccagcctggcctactgtgaagatagagtgattgagcactacaagaagctgaatggccagacccggggccaggccatcgtgaactacatgagcatcgtggagagcctgcccacctatggagtgcactactatgctgtgaaggacaagcagggcatcccctggtggctgggcctgagctacaagggcatcttccagtatgactaccatgacaaggtgaagcccaggaagatcttccagtggaggcagctggagaacctgtacttccgggagaagaagttctctgtggaggtgcatgacccccggcgggcctctgtgaccaggaggaccttcggccacagcggcattgctgtgcacacctggtacgcctgcccagccctgatcaagagcatctgggccatggccatcagccagcaccagttctacctggacaggaagcagagcaagagcaagatccatgctgcccggagcctgtctgagatcgccatcgacctgacagaaacaggcaccctgaagaccagcaagctggccaacatgggcagcaagggcaagatcatcagcggcagcagcggcagcctgctgagcagcggcagccaggagagtgacagcagccagagcgccaagaaggacatgctggccgccctgaagagccggcaggaggccctggaggagaccctgcggcagaggctggaggagctgaagaagctgtgcctgcgggaggccgagctgaccgggaagctgcctgtggagtaccccctggaccccggggaggagccccccatcgtgagaagaagaattggaacagccttcaagctggatgagcagaagatcctgcccaagggggaggaggccgagctggagcggctggagcgggagtttgccatccagagccagatcacagaagctgcccggcggctggccagtgaccccaacgtgtccaagaagctgtag

SEQ ID NO: 18505 - DNA, 1605 bp, Artificial Sequence
  Description of Artificial Sequence: Synthetic coding sequence
atgaagcaggagggcagcgccaggagaagaggagctgacaaggccaagcccccacctgggggcggggagcaggagcccccacctcctccagccccccaggatgtggagatgaaggaggaggccgccactggaggcggcagcactggagaggctgatggcaagacagctgctgctgctgctgagcacagccagcgggagctggacacagtgaccctggaggacatcaaggagcacgtgaagcagctggagaaggctgtgtctgggaaggagcccaggtttgtgctgcgggccctgaggatgctgcccagcaccagccggcggctgaaccactacgtgctgtacaaggctgtgcagggcttcttcaccagcaacaatgccacccgggacttcctgctgcccttcctggaggagcccatggacacagaagctgacctgcagttccggcccaggacaggcaaggccgccagcacccccctgctgcctgaggtggaggcctacctgcagctgctggtggtgatcttcatgatgaacagcaagcgctacaaggaggcccagaagatcagtgatgacctgatgcagaagatcagcacccagaacagaagagccctggacctggtggccgccaagtgctactactaccacgcccgggtgtatgagttcctggacaagctggatgtggtgcgctccttcctgcacgcccggctgaggacagccaccctgcggcatgatgctgatggccaggccaccctgctgaacctgctgctgaggaactacctgcactacagcctgtatgaccaggccgagaagctggtgtccaagagcgtcttccctgagcaggccaacaacaatgagtgggcccgctacctgtactacacaggccgcatcaaggccatccagctggagtacagcgaggcccggaggaccatgaccaatgccctgaggaaggccccccagcacacagctgtgggcttcaagcagacagtgcacaagctgctgattgtggtggagctgctgctgggggagatcccagaccggctgcagttccggcagcccagcctgaagaggagcctgatgccctacttcctgctgacccaggccgtgaggactggaaacctggccaagttcaaccaggtgctggaccagtttggagagaagttccaggctgatggcacctacaccctcatcatccggctgcggcacaacgtcatcaagacaggagtgaggatgatcagcctgagctacagccgcatcagcctggccgacatcgcccagaagctgcagctggacagcccagaagatgctgagttcatcgtggccaaggccatcagagatggagtgattgaggccagcatcaaccacgagaagggctacgtgcagagcaaggagatgattgacatctacagcacccgggagccccagctggccttccaccagaggatctccttctgcctggacatccacaacatgtctgtgaaggccatgagatttcctcccaagagctacaacaaggacctggagagcgctgaggagcggcgggagcgggagcagcaggacctggagtttgccaaggagatggctgaagatgatgatgacagcttcccctag

SEQ ID NO: 18506 - DNA, 1311 bp, Artificial Sequence
  Description of Artificial Sequence: Synthetic coding sequence
atgagaagagatgtgaatggagtgaccaagagcagatttgagatgttcagcaacagtgatgaggccgtcatcaacaagaagctgcccaaggagctgctgctgcgcatcttctccttcctggatgtggtgaccctgtgccgctgtgcccaggtgtcccgggcctggaatgtgctggccctggatggcagcaactggcagagaattgacctgtttgacttccagagggacatcgagggccgggtggtggagaacatcagcaagagatgtggcggcttcctgaggaagctgagcctgcggggctgcctgggcgtgggggacaatgccctgcggacctttgcccagaactgcagaaatattgaggtgctgaacctgaatggctgcaccaagaccacagatgccacctgcaccagcctgagcaagttctgcagcaagctgcggcacctggacctggccagctgcaccagcatcaccaacatgagcctgaaggccctgtctgagggctgccccctgctggagcagctgaacatctcctggtgtgaccaggtgaccaaggatggcatccaggccctggtgcggggctgcggcggcctgaaggccctcttcctgaagggctgcacccagctggaggatgaggccctgaagtacatcggggcccactgcccagagctggtgaccctgaacctgcagacctgcctgcagatcacagatgagggcctcatcaccatctgccggggctgccacaagctgcagagcctgtgtgccagcggctgcagcaacatcacagatgccatcctgaatgccctgggccagaactgcccccggctgcgcatcctggaggtggcccgctgcagccagctgacagatgtgggcttcaccaccctggccaggaactgccacgagctggagaagatggacctggaggagtgtgtgcagatcacagacagcaccctcatccagctgagcatccactgcccccggctgcaggtgctgagcctgagccactgtgagctgatcacagatgatggcatccgccacctgggcaatggagcctgtgcccatgaccagctggaggtgattgagctggacaactgccccctcatcacagatgccagcctggagcacctgaagagctgccacagcctggagcgcatcgagctgtatgactgccagcagatcaccagggctggcatcaagaggctgcggacccacctgcccaacatcaaggtgcacgcctactttgcccctgtgaccccacctccttctgtgggcggcagccggcagcgcttctgccgctgctgcatcatcctgtag

SEQ ID NO: 18507 - DNA, 1167 bp, Artificial Sequence
  Description of Artificial Sequence: Synthetic coding sequence
atgcgctgcctgtatggccgggtgggcggggcccggaggaagatggccgccagcgctgctgctgctgagctgcaggccagcggcggccccaggcaccctgtgtgcctgctggtgctgggcatggccggcagcggcaagaccacctttgtgcagaggctgaccggccacctgcacgcccagggcaccccaccctacgtgatcaacctggaccctgctgtgcatgaggtgcccttccctgccaacatcgacatccgggacacagtgaagtacaaggaggtgatgaagcagtatggcctgggccccaacggcggcatcgtgaccagcctgaacctgtttgccaccaggtttgaccaggtgatgaagttcatcgagaaggcccagaacatgagcaaatatgtgctgattgacaccccaggccagatcgaggtgttcacctggagcgccagcggcaccatcatcacagaggccctggccagcagcttccccaccgtggtgatctacgtgatggacaccagccgcagcaccaaccctgtgaccttcatgagcaacatgctgtatgcctgcagcatcctgtacaagaccaagctgcccttcatcgtggtgatgaacaagacagacatcatcgaccacagctttgctgtggagtggatgcaggactttgaggccttccaggatgccctgaaccaggagaccacctacgtgagcaacctgaccaggtccatgagcctggtgctggatgagttctacagcagcctgcgggtggtgggcgtgtctgctgtgctgggcaccggcctggatgagctgtttgtgcaggtgaccagcgctgctgaggagtatgagcgggagtacagaccagaatatgagcggctgaagaagagcctggccaatgctgagagccagcagcagcgggagcagctggagcggctgaggaaggacatgggctctgtggccctggatgctggaacagccaaggacagcctgagccctgtgctgcaccccagcgacctgatcctgacccggggcaccctggatgaggaggatgaggaggccgacagcgacacagatgacatcgaccaccgggtgacagaggagagccatgaggagcccgccttccagaacttcatgcaggagagcatggcccagtactggaagaggaacaacaagtag

SEQ ID NO: 18508 - DNA, 1668 bp, Artificial Sequence
  Description of Artificial Sequence: Synthetic coding sequence
atgaggctcatcggcatgcccaaggagaagtatgaccccccagacccccggcgcatctacaccatcatgtctgctgaggaggtggccaacgggaagaagagccactgggccgagctggagatcagcggccgggtgcgcagcctgagcaccagcctgtggagcctgacccacctgacagccctgcacctgaatgacaactacctgagccgcatccccccagacatcgccaagctgcacaacctggtgtacctggacctgagcagcaacaagctgcggagcctgcctgctgagctgggcaacatggtgtccctgcgggagctgctgctgaacaacaacctgctgcgggtgctgccctatgagctgggccgcctcttccagctgcagaccctgggcctgaagggcaaccccctgagccaggacatcctgaacctgtaccaggaccctgatggcaccaggaagctgctgaacttcatgctggacaacctggccgtgcaccctgagcagctgcccccccggccctggatcaccctgaaggagcgggaccagatcctgcccagcgccagcttcaccgtgatgtgctacaacgtgctgtgtgacaagtatgccacccggcagctgtatggctactgccccagctgggccctgaactgggagtacaggaagaagggcatcatggaggagatcgtgaactgtgatgctgacatcatcagcctgcaggaggtggagacagagcagtacttcaccctcttcctgcctgccctgaaggagcggggctatgatggcttcttcagccccaagagccgggccaagatcatgtctgagcaggagaggaagcacgtggatggctgtgccatcttcttcaagacagagaagttcaccctggtgcagaagcacacagtggagttcaaccaggtggccatggccaacagtgatggcagcgaggccatgctgaacagagtgatgaccaaggacaacatcggcgtggccgtggtgctggaggtgcacaaggagctgtttggagctggcatgaagcccatccacgccgctgacaagcagctgctgattgtggccaatgcccacatgcactgggaccctgagtacagtgatgtgaagctgatccagaccatgatgtttgtgtctgaggtgaagaacatcctggagaaggccagcagcaggcctggcagccccacagctgaccccaacagcatccccctggtgctgtgtgccgacctgaacagcctgcctgattctggagtggtggagtacctgagcaatggaggagtggccgacaaccacaaggacttcaaggagctgcgctacaatgaatgtctgatgaacttcagctgcaatggcaagaatggcagcagcgagggccgcatcacccacggcttccagctgaagagcgcctatgagaacaacctgatgccctacaccaactacacctttgacttcaagggcgtcatcgactacatcttctacagcaagacccacatgaatgtgctgggcgtgctgggccccctggacccccagtggctggtggagaacaacatcaccggctgcccccacccccacatccccagcgaccacttcagcctgctgacccagctggagctgcacccccccctgctgcccctggtgaatggagtgcacctgcccaacagaagatag

SEQ ID NO: 18509 - DNA, 2673 bp, Artificial Sequence
  Description of Artificial Sequence: Synthetic coding sequence
agcagtgacagcgagatcatcggctacgccctggacaccctgtacaacatcatcagcaatgaggaggaggaggaggtggaggagaacagcacccggcagagcgaggacctgggcagccagttcacagagatcttcatcaagcagcaggagaatgtgaccctgctgctgagcctgctggaggagtttgacttccacgtgcgctggccaggagtgaagctgctgaccagcctgctgaagcagctgggcccccaggtgcagcagatcatcctggtgagccccatgggcgtgtcccggctgatggacctgctggccgacagccgggaggtgatcagaaatgatggagtgctgctgctgcaggccctgaccaggagcaatggagccatccagaagatcgtggcctttgaaaatgcctttgagcggctgctggacatcatcagcgaggagggcaacagtgatggcggcatcgtggtggaggactgcctgatcctgctgcagaacctgctgaagaacaacaacagcaaccagaacttcttcaaggagggcagctacatccagaggatgaagccctggtttgaggtgggagatgagaacagcggctggagcgcccagaaggtgaccaacctgcacctgatgctgcagctggtgcgggtgctggtgagccccaccaaccccccaggggccaccagcagctgccagaaggccatgttccagtgtggcctgctgcagcagctgtgcaccatcctgatggccactggagtgcctgctgacatcctgacagagaccatcaacacagtgtctgaggtgatccggggctgccaggtgaaccaggactactttgcctctgtgaatgcccccagcaacccccccaggcctgccatcgtggtgctgctgatgtccatggtgaatgaaaggcagccctttgtgctgcgctgtgctgtgctgtactgcttccagtgcttcctgtacaagaaccagaagggccagggcgagatcgtgtccaccctgctgcccagcaccattgatgccactggaaacagcgtgtctgctggccagctgctgtgtggcggcctcttcagcacagacagcctgagcaactggtgtgccgctgtggccctggcccacgccctgcaggagaatgccacccagaaggagcagctgctgcgggtgcagctggccaccagcatcggcaacccccctgtgtccctgctgcagcagtgcaccaacatcctgagccagggcagcaagatccagaccagggtgggcctgctgatgctgctgtgcacctggctgagcaactgccccatcgctgtgacccacttcctgcacaacagcgccaacgtgcccttcctgaccggccagattgctgagaacctgggggaggaggagcagctggtgcagggcctgtgtgccctgctgctgggcatcagcatctacttcaatgacaacagcctggagagctacatgaaggagaagctgaagcagctgattgagaagagaattggcaaggagaacttcatcgagaagctgggcttcatcagcaagcatgagctgtacagccgggccagccagaagccccagcccaacttccccagccctgagtacatgatctttgaccacgagttcaccaagctggtgaaggagctggagggcgtcatcaccaaggccatctacaagagcagcgaggaggacaagaaggaggaggaggtgaagaagaccctggagcagcacgacaacatcgtgacccactacaagaacatgatccgggagcaggacctgcagctggaggagctgcggcagcaggtgtccaccctgaagtgccagaatgagcagctgcagacagctgtgacccagcaggtgtcccagatccagcagcacaaggaccagtacaacctgctgaagatccagctgggcaaggacaaccagcaccagggcagctacagcgagggcgcccagatgaatggcatccagcctgaggagatcggccgcctgcgggaggagattgaggagctgaagaggaaccaggagctgctgcagagccagctgacagagaaggacagcatgattgagaacatgaagagcagccagaccagcggcaccaatgagcagagcagcgccatcgtgtctgcccgggacagcgagcaggtggccgagctgaagcaggagctggccaccctgaagagccagctgaacagccagagcgtggagatcaccaagctgcagacagagaagcaggagctgctgcagaagacagaggcctttgccaagtctgtggaggtgcagggcgagacagagaccatcatcgccaccaagaccacagatgtggagggccgcctgagcgccctgctgcaggagaccaaggagctgaagaatgagatcaaggccctgtctgaggagaggacagccatcaaggagcagctggacagcagcaacagcaccatcgccatcctgcagacagagaaggacaagctggagctggagatcacagacagcaagaaggagcaggatgacctgctggtgctgctggccgaccaggaccagaagatcctgagcctgaagaacaagctgaaggacctgggccaccctgtggaggaggaggatgagctggagagcggggaccaggaggatgaagatgatgaaagtgaagatcctgggaaggacctggaccacatctag

SEQ ID NO: 18510 - DNA, 1944 bp, Artificial Sequence
  Description of Artificial Sequence: Synthetic coding sequence
atggcccgggccggcccccggctggtgctgtctgaggaggccgtgcgggccaagagcggcctgggcccccaccgggacctggccgagctgcagagcctgagcatccctggcacctaccaggagaagatcacccacctgggccacagcctgatgagcctgaccggcctgaagagcctggacctgagcaggaacagcctggtgtccctggagggcatccagtacctgacagccctggagagcctgaacctgtactacaactgcatcagcagcctggccgaggtgttccggctgcacgccctgacagagctggtggatgtggacttccggctgaaccctgtggtgaaggtggagccagactaccgcctgtttgtggtgcacctgctgcccaagctgcagcagctggatgacaggcctgtgcgggccagcgagaggaaggccagccggctgcactttgccagcgaggacagcctggacagcaaggagagcgtgcctgccagcctgaaggagggccggccccaccacccccgggccaagtgcacagaggccctggccaagcagagcctggtgatggatgctgatgatgaggccgtgctgaacctgattgctgaatgtgagtgggacctgggccggcccccaggcagcaccagcttcagccagaagggccgggaggccgacagccggggcagccaggagagccgccacctgctgagcccccagctggtgcagtaccagtgtggggacagcggcaagcagggccgggagacccggcgcagcagctgccggggctgctgcctggagaagatgccctggagccagctgtgtggggagctgccccccctgtatggagctgagcctgaggccagccgggccccccggccccacacctacttcaccccccacccagacagcatggacacagaagattctgccagcagccagaagctggacctgagcggggagatggtgcccggccccctgcctgcccctggaaaatgtaggaagaggaggatgcctgtgggccgcttccagaccttcagtgaccaggagggcctgggctgcccagagaggacccacggcagctctgtgcccaaggagagcctgagccggcaggacagcagcgagagcagaaatggaagaaccctgagccagcctgaggccagcgagacagaggagcagaggagccggggcgtgacagacacccgggagcccagccctggcagccacagcgccctgcccgggaagaagacagccctgcaggccgccctgctggagaccctgctggacctggtggaccgctcctggggcggctgccgcagcctgcacagcaatgaggccttcctggcccaggcccggcacatcctgagctctgtggaggagttcaccgctgcccaggacagcagcgccatggtgggggaggatgtgggcagcctggccctggagagcaagagcctgcagagccggctggccgagcagcagcagcagcacgcccgggagatgtctgaggtgacagctgagctgcaccacacccacaaggagctggatgacctgcggcagcacctggacaagagcctggaggagaacagccggctgaagagcctgctgctgtccatgaagaaggaggtgaagtctgctgacacagctgccaccctgaacctgcagattgctggcctgcagacctctgtgaagaggctgtgtggggagatcgtggagctgaagcagcacctggagcactatgacaagatccaggagctgacccagatgctgcaggagagccacagcagcctggtgtccaccaatgagcacctgctgcaggagctgagccaggtgcgggcccagcacagagctgaggtggagcagatgcactggagctaccaggagctgaagaagaccatggccctcttcccccacagcagcgccagccatggaggctgccaggcctgctag

SEQ ID NO: 18511 - DNA, 777 bp, Artificial Sequence
  Description of Artificial Sequence: Synthetic coding sequence
atggccgagacagaggagaggagcctggacaacttctttgccaagagggacaagaagaagaagaaggagaggagcaacagagctgccagcgctgctggagctgctggcagcgctgggggcagcagcggggctgctggagctgctgggggcggggccggggccggcaccaggcctggagatggcggcacagccagcgctggagctgctggccctggagctgccaccaaggctgtgaccaaggatgaagatgagtggaaggagctggagcagaaggaggtggactacagcggcctgcgggtgcaggccatgcagatcagcagcgagaaggaggaggatgacaatgagaagaggcaggaccccggggacaactgggaggagggcggcggcggcggcggcggcatggagaagagcagcggcccctggaacaagacagcccctgtgcaggcccccccagcccctgtgattgtgacagagaccccagagcccgccatgaccagcggcgtgtacagacctcctggggcccggctgaccaccaccaggaagaccccccagggccccccagagatctacagcgacacccagttccccagcctgcagagcacagccaagcacgtggagagcaggaaggacaaggagatggagaagagctttgaggtggtgcgccacaagaacagaggaagagatgaggtgtccaagaaccaggccctgaagctgcagctggacaaccagtatgctgtgctggagaaccagaagagcagccacagccagtacaactag

SEQ ID NO: 18512 - DNA, 1077 bp, Artificial Sequence
  Description of Artificial Sequence: Synthetic coding sequence
atggccccccagaacctgagcaccttctgcctgctgctgctgtacctgattggagctgtgattgctggccgggacttctacaagatcctgggcgtgcccaggtctgccagcatcaaggacatcaagaaggcctacaggaagctggccctgcagctgcacccagacaggaacccagatgacccccaggcccaggagaagttccaggacctgggcgccgcctatgaggtgctgagtgacagcgagaagaggaagcagtatgacacctatggagaggagggcctgaaggatggccaccagagcagccacggggacatcttcagccacttcttcggggactttggcttcatgtttggaggcaccccccggcagcaggacaggaacatcccccggggcagtgacatcatcgtggacctggaggtgaccctggaggaggtgtatgccggcaactttgtggaggtggtgaggaacaagcctgtggcccggcaggcccctgggaagaggaagtgcaactgccggcaggagatgaggaccacccagctgggccctggccgcttccagatgacccaggaggtggtgtgtgatgaatgtcccaacgtgaagctggtgaatgaggagaggaccctggaggtggagattgagcccggggtgagagatggcatggagtaccccttcatcggggagggggagccccacgtggatggagagcccggggacctgcgcttccgcatcaaggtggtgaagcaccccatctttgaaagaagaggagatgacctgtacaccaacgtgaccatcagcctggtggagagcctggtgggctttgagatggacatcacccacctggatggccacaaggtgcacatcagccgggacaagatcaccaggcctggggccaagctgtggaagaagggggagggcctgcccaactttgacaacaacaacatcaagggcagcctcatcatcacctttgatgtggacttccccaaggagcagctgacagaggaggcccgggagggcatcaagcagctgctgaagcagggctctgtgcagaaggtgtacaacggcctgcagggctactag

SEQ ID NO: 18513 - DNA, 624 bp, Artificial Sequence
  Description of Artificial Sequence: Synthetic coding sequence
atgaccagcaggaagaaggtgctgctgaaggtgatcatcctgggggacagcggcgtgggcaagaccagcctgatgaaccagtatgtgaacaagaagttcagcaaccagtacaaggccaccatcggggctgacttcctgaccaaggaggtgatggtggatgaccggctggtgaccatgcagatctgggacacagctggccaggagcgcttccagagcctgggcgtggccttctacagaggagctgactgctgcgtgctggtgtttgatgtgacagcccccaacaccttcaagaccctggacagctggagagatgagttcctgatccaggccagcccccgggaccctgagaacttcccctttgtggtgctgggcaacaagattgacctggagaaccggcaggtggccaccaagagggcccaggcctggtgctacagcaagaacaacatcccctactttgagaccagcgccaaggaggccatcaacgtggagcaggccttccagaccatcgccagaaatgccctgaagcaggagacagaggtggagctgtacaatgagttccctgagcccatcaagctggacaagaatgaccgggccaaggccagcgctgagagctgcagctgctag

SEQ ID NO: 18514 - DNA, 3225 bp, Artificial Sequence
  Description of Artificial Sequence: Synthetic coding sequence
atgatccccatctgccctgtggtgtccttcacctacgtgcccagccggctgggagaagatgccaagatggccactggaaactacttcggcttcacccacagcggggctgctgctgctgctgctgctgcccagtacagccagcagcctgccagcggcgtggcctacagccaccccaccaccgtggccagctacacagtgcaccaggcccctgtggccgcccacacagtgacagctgcctatgccccagctgctgccaccgtggccgtggcccggcctgcccctgtggccgtggccgccgccgccacagctgctgcctacggcggctaccccacagcccacacagccacagattatggctacacccagaggcagcaggaggcccctcctcctcctcctccagccaccacccagaactaccaggacagctacagctatgtgcgcagcacagccccagctgtggcctatgacagcaagcagtactaccagcagcccacagccacagctgctgctgtggccgccgccgcccagccccagcccagcgtggccgagacctactaccagacagcccccaaggccggctacagccagggcgccacccagtacacccaggcccagcagacccggcaggtgacagccatcaagccagccacccccagccctgccaccaccaccttcagcatctaccctgtgagcagcacagtgcagcctgtggccgccgccgccaccgtggtgcccagctacacccagagcgccacctacagcaccacagctgtgacctacagcggcaccagctacagcggctatgaggccgctgtgtacagcgctgccagcagctactaccagcagcagcagcagcagcagaagcaggccgctgctgctgctgctgctgctgctgccacagctgcctggacaggcaccaccttcaccaagaaggcccccttccagaacaagcagctgaagcccaagcagccccccaagccaccccagatccactactgtgatgtgtgcaagatcagctgtgccggcccccagacctacaaggagcacctggagggccagaagcacaagaagaaggaggccgccctgaaggccagccagaacaccagcagcagcaacagcagcacccggggcacccagaaccagctgcgctgtgagctgtgtgatgtgtcctgcaccggggctgatgcctatgctgcccacatccggggggccaagcaccagaaggtggtgaagctgcacaccaagctgggcaagcccatccccagcacagagcccaacgtggtgtcccaggccaccagcagcacagctgtgtctgccagcaagcccacagccagccccagcagcattgctgccaacaactgcaccgtgaacaccagctctgtggccaccagctccatgaagggcctgaccaccaccggcaacagcagcctgaacagcaccagcaacaccaaggtgtctgctgtgcccaccaacatggccgccaagaagaccagcacccccaagatcaactttgtgggcggcaacaagctgcagagcactggaaacaaggccgaggacatcaagggcacagaatgtgtgaagagcacccctgtgaccagcgctgtgcagatccctgaggtgaagcaggacacagtgtctgagcctgtgaccccagccagcctggccgccctgcagagtgatgtgcagcctgtgggccatgactatgtggaggaggtgagaaatgatgagggcaaggtgatccgcttccactgcaagctgtgtgagtgcagcttcaatgaccccaatgccaaggagatgcacctgaagggccgccgccaccggctgcagtacaagaagaaggtgaacccagacctgcaggtggaggtgaagcccagcatccgggccaggaagatccaggaggagaagatgaggaagcagatgcagaaggaggagtactggaggcggcgggaggaggaggagcgctggaggatggagatgagaagatatgaggaggacatgtactggaggaggatggaggaggagcagcaccactgggatgacagaagaaggatgccagatggcggctacccccacggccccccaggccccctgggcctgctgggcgtgcggcccggcatgccaccccagccccagggccctgcccccctgcggcggccagacagcagtgatgaccgctacgtgatgaccaagcacgccaccatctaccccacagaggaggagctgcaggccgtgcagaagatcgtgtccatcacagagcgggccctgaagctggtgtctgacagcctgtctgaacatgagaagaacaagaacaaggagggagatgacaagaaggagggcggcaaggaccgggccctgaagggcgtgctgcgggtgggcgtgctggccaagggcctgctgctgcggggggacagaaatgtgaacctggtgctgctgtgcagcgagaagcccagcaagaccctgctgagcagaattgctgagaacctgcccaagcagctggccgtcatcagccctgagaagtatgacatcaagtgtgctgtgtctgaggccgccatcatcctgaacagctgtgtggagcccaagatgcaggtgaccatcaccctgaccagccccatcatccgggaggagaacatgagagaaggagatgtgaccagcggcatggtgaaggaccccccagatgtgctggaccggcagaagtgcctggatgccctggccgccctgcggcatgccaagtggttccaggcccgggccaacggcctgcagagctgtgtgatcatcatccgcatcctgcgggacctgtgccagagggtgcccacctggagcgacttccccagctgggccatggagctgctggtggagaaggccatcagcagcgccagcagcccccagagccctggagatgccctgcggcgggtgtttgagtgcatcagcagcggcatcatcctgaagggcagccctggcctgctggacccctgtgagaaggacccctttgacaccctggccaccatgacagaccagcagcgggaggacatcaccagcagcgcccagtttgccctgcggctgctggccttccggcagatccacaaggtgctgggcatggaccccctgccccagatgagccagcgcttcaacatccacaacaacaggaagagaagaagagacagtgatggagtggatggctttgaggccgagggcaagaaggacaagaaggactatgacaacttctag

SEQ ID NO: 18515 - DNA, 438 bp, Artificial Sequence
  Description of Artificial Sequence: Synthetic coding sequence
atgaagttcaacccctttgtgaccagtgacaggagcaagaacaggaagaggcacttcaatgcccccagccacgtgcggaggaagatcatgagcagccccctgagcaaggagctgcggcagaagtacaacgtgcgctccatgcccatcaggaaggatgatgaggtgcaggtggtgcggggccactacaagggccagcagatcggcaaggtggtgcaggtgtacaggaagaagtatgtgatctacatcgagcgggtgcagcgggagaaggccaacggcaccaccgtgcacgtgggcatccaccccagcaaggtggtgatcacccggctgaagctggacaaggacaggaagaagatcctggagaggaaggccaagagccggcaggtgggcaaggagaagggcaagtacaaggaggagctgattgagaagatgcaggagtag

SEQ ID NO: 18516 - DNA, 3177 bp, Artificial Sequence
  Description of Artificial Sequence: Synthetic coding sequence
atggaggatggcacccccaagcacatcatccagatgacaggcttcaagatggaggagaaggaggccctggtgaagctgctgctgaagctggactgcaccttcatcaagtctgagaagtacaagaactgcacccacctgattgctgagcggctgtgcaagtctgagaagttcctggccgcctgtgccgccggcaagtggatcctgaccaaggactacatcatccacagcgccaagagcggccgctggctggatgagaccacctatgagtggggctacaagattgagaaggacagccgctacagcccccagatgcagagcgcccccaagcgctggagggaggagctgaagaggactggagcccctggggccttccaccgctggaaggtggtgctgctggtgaggacagacaagagaagtgacagcctcatccgggtgctggaggccggcaaggccaacgtcatcctgcccaagagcagccccagcggcatcacccacgtgattgccagcaatgcccgcatcaaggccgagaaggagaaggacaacttcaaggcccccttctaccccatccagtacctgggggacttcctgctggagaaggagatccagaatgatgaggacagccagaccaacagcgtgtggacagagcacagcaatgaggagaccaacaaggacttcaggaaggatgctggcttcctggagatgaagggggccctgcgggagaccatgtaccgcacccagaaggagatgcagaaccatgaagatgtgaatgtgggcagcatcctgatccagcaccacaagaaggagaagttcagcggcagcagcaaggacctgaagtttgtgaagatgaggaacaccttcggcagccacacctatgagaaccagaaggagatcaagaagaaggatgaggacatccagaggagctacaccctgcggaggaagaggaagaagggcaaggagagcaactgcaagaagggcgtggagcacgagaagatcaagagcaccctgcggcggcacatctacaacagagaccagaaggagatgaagaacagcatctttgctgaatatgccaaggagagcaaggccatggccatcaagacagatgtggatgtggtggagatcaagaacaccctgaggaagcacatctaccgggcccaggccgtgcgctacaactgcatcagaattgacaagcagcctgtgtacaacgtggaggtgaagaatgctgagttcccccggggcgtgctgaacctgattgagagcctgattgagggccacttcttcaaggaggccatcgaggagctgagcaccctgcaggcccactacatcccccctgtgtgtgtgctgcacgccctgctggagaatgtgctgcaggacaacatcgacaccttcagcggccgctacttccacatcctgagcgccctgctgcacctgcaccccccctggaagagccctgccatgagccgctactacctggagctgttccagtgccccacctgcatgaagggggcctggagcctggtggaggtgctgatccgcagctgcctcttcaatgaaagcttctgccaccagatcagtgaaaatattggcagcaaggtgctgcacctgaccctgctgaagttcttcttcaacctgattgagagcgaggtgcagcacctgagccagaagctgtatgactggagcgacagccagaacctgaagatcaccgggaaggccatgctgctggagatcttctggagcggcagcgagaccagcggcctgctgaccaagcctgtgaacatgctgctggagtggaccatctacagccacaaggagaagttcaagagcaatgatgtgttcaagcatgagctggcctacctgctggccggcatcctgggcgccgccatcgactactggatcttcctgggcctgaagatgggcagaaatgtgatgaggcacatgtctgatgacctgggcagctatgtgtccctgagctgtgatgacttcagcagccaggagctggagatcttcatctgcagcttcagcagctcctggctgcagatgtttgtggccgaggccgtgttcaagaagctgtgcctgcagagcagcggctctgtgtcctctgagcccctgagcctgcagaagatggtgtacagctacctgcctgccctgggcaagacaggagtgctgggcagcggcaagatccaggtgtccaagaagattggccagaggccctgctttgacagccagaggaccctgctgatgctgaatggcaccaagcagaagcaggtggagggcctgcctgagctgctggacctgaacctggccaagtgcagcagcagcctgaagaagctgaagaagaagtctgagggggagctgagctgcagcaaagaaaactgccccagcgtggtgaagaagatgaacttccacaagaccaacctgaagggggagacagccctgcaccgggcctgcatcaacaaccaggtggagaagctgatcctgctgctgagcctgcccggcatcgacatcaacgtgaaggacaatgccggctggacccccctgcacgaggcctgcaactacggcaacacagtgtgtgtgcaggagatcctgcagcgctgcccagaggtggacctgctgacccaggtggatggagtgacccccctgcatgatgccctgagcaatggacatgtggagatcggcaagctgctgctgcagcacggcggccctgtgctgctgcagcagagaaatgccaagggggagctgcccctggactatgtggtgagcccccagatcaaggaggagctgtttgccatcaccaagattgaagatactgtggagaacttccacgcccaggccgagaagcacttccactaccagcagctggagtttggcagcttcctgctgagcaggatgctgctgaacttctgcagcatctttgacctgagcagcgagttcatcctggccagcaagggcctgacccacctgaatgagctgctgatggcctgcaagagccacaaggagaccacctctgtgcacacagactggctgctggacctgtatgccggcaacatcaagaccctgcagaagctgccccacatcctgaaggagctgcctgagaacctgaaggtgtgccctggggtgcacacagaggccctgatgatcaccctggagatgatgtgccgctctgtgatggagttctcctag

SEQ ID NO: 18517 - DNA, 660 bp, Artificial Sequence
  Description of Artificial Sequence: Synthetic coding sequence
atggagcccaaggaggccaccgggaaggagaacatggtgaccaagaagaagaacctggccttcctgcggagccggctgtacatgctggagaggaggaagacagacacagtggtggagagctctgtgtctggggaccacagcggcaccctgcggcgcagccagagcgacagaacagagtacaaccagaagctgcaggagaagatgaccccccagggagaatgttctgtggccgagaccctgaccccagaggaggagcaccacatgaagaggatgatggccaagcgggagaagatcatcaaggagctgatccagacagagaaggactacctgaatgacctggagctgtgtgtgcgggaggtggtgcagcccctgaggaacaagaagacagaccggctggatgtggacagcctcttcagcaacattgaatctgtgcaccagatcagcgccaagctgctgagcctgctggaggaggccaccacagatgtggagcccgccatgcaggtgattggagaggtgttcctgcagatcaagggccccctggaggacatctacaagatctactgctaccaccatgatgaggcccacagcatcctggagagctatgagaaggaggaggagctgaaggagcacctgagccactgcatccagagcctgaagtag

SEQ ID NO: 18518 - DNA, 3183 bp, Artificial Sequence
  Description of Artificial Sequence: Synthetic coding sequence
atgctgattgaagatgtggatgccctgaagtcctggctggccaagctgctggagcccatctgtgatgctgaccccagcgccctggccaactacgtggtggccctggtgaagaaggacaagccagagaaggagctgaaggccttctgtgccgaccagctggatgtgttcctgcagaaggagaccagcggctttgtggacaagctgtttgagagcctgtacaccaagaactacctgcccctgctggagcctgtgaagccagagcccaagcccctggtgcaggagaaggaggagatcaaggaggaggtgttccaggagcctgctgaggaggagagagatggcaggaagaagaagtaccccagcccccagaagaccaggtctgagagcagcgagaggaggacccgggagaagaagagagaagatggcaagtggagggactatgaccgctactatgaaagaaatgagctgtaccgggagaagtatgactggaggcggggccgcagcaagagccgcagcaagagccggggcctgagccgcagccgcagccgcagccggggccgcagcaaggaccgggaccccaacagaaatgtggagcaccgggagaggagcaagttcaagtcagaaagaaatgacctggagagcagctatgtgcctgtgtctgcccccccacccaacagcagcgagcagtacagcagcggggcccagagcatccccagcacagtgacagtgattgccccagcccaccacagcgagaacaccacagagagctggagcaactactacaacaaccacagcagcagcaacagctttggaagaaacctgccccccaagaggcgctgccgggactatgatgagcggggcttctgtgtgctgggggacctgtgccagtttgaccacggcaatgaccccctggtggtggatgaggtggccctgcccagcatgatccccttccccccacctcctcctggcctgcccccacctcctcctcctggcatgctgatgccacccatgcctggccctggccctggccctggccctggccctggccctggccctggccctggccctggccctggccacagcatgaggctgcctgtgccccagggccacggccagcccccaccttctgtggtgctgcccatccccaggcctcccatcacccagagcagcctcatcaacagccgggaccagcccggcaccagcgctgtgcccaacctggcctctgtgggcacccggctgcccccacccctgccccagaacctgctgtacacagtgtctgagcggcagcccatgtacagccgggagcacggggccgccgccagcgagcggctgcagctgggcaccccaccacccctgctggccgcccggctggtgccccccaggaacctgatgggcagcagcatcggctaccacacctctgtgagcagccccacccccctggtgcctgacacctatgagccagatggctacaaccctgaggcccccagcatcaccagcagcggccgcagccagtaccggcagttcttcagcaggacccagacccagaggcccaacctgattggcctgaccagcggggacatggatgtgaacccccgggccgccaacatcgtcatccagacagagccccctgtgcctgtgtccatcaacagcaacatcaccagggtggtgctggagccagacagcaggaagagggccatgagcggcctggagggccccctgaccaagaagccctggctgggcaagcagggcaacaacaaccagaacaagccaggcttcctgaggaagaaccagtacaccaacaccaagctggaggtgaagaagatcccccaggagctgaacaacatcaccaagctgaatgagcacttcagcaagtttggcaccatcgtgaacatccaggtggccttcaagggggaccctgaggccgccctgatccagtacctgaccaatgaggaggccaggaaggccatcagcagcacagaggccgtgctgaacaaccgcttcatccgggtgctgtggcaccgggagaacaatgagcagcccaccctgcagagcagcgcccagctgctgctgcagcagcagcagaccctgagccacctgagccagcagcaccaccacctgccccagcacctgcaccagcagcaggtgctggtggcccagagcgcccccagcacagtgcatggaggcatccagaagatgatgagcaagccccagaccagcggggcctacgtgctgaacaaggtgcctgtgaagcaccggctgggccatgctgggggcaaccagagtgatgccagccacctgctgaaccagagcggcggggccggggaggactgccagatcttcagcaccccaggccaccccaagatgatctacagcagcagcaacctgaagacccccagcaagctgtgcagcggcagcaagagccatgatgtgcaggaggtgctgaagaagaagcaggaggccatgaagctgcagcaggacatgaggaagaagaggcaggaggtgctggagaagcagatcgagtgccagaagatgctgatcagcaagctggagaagaacaagaacatgaagccagaggagcgggccaacatcatgaagaccctgaaggagctgggggagaagatcagccagctgaaggatgagctgaagaccagcagcgctgtgtccacccccagcaaggtgaagaccaagacagaggcccagaaggagctgctggacacagagctggacctgcacaagaggctgagcagtggagaggacaccacagagctgaggaagaagctgagccagctgcaggtggaggccgcccggctgggcatcctgcctgtgggccggggcaagaccatgagcagccagggccggggccggggccggggccggggcggccggggccggggcagcctgaaccacatggtggtggaccaccggcccaaggccctgactgtgggcggcttcatcgaggaggagaaggaggacctgctgcagcacttcagcacagccaaccagggccccaagttcaaggaccggcggctgcagatctcctggcacaagcccaaggtgcccagcatcagcacagaaacagaggaggaggaggtgaaggaggaggagacagagaccagtgacctcttcctgcctgatgatgatgatgaagatgaagatgaatatgagagccgctcctggaggaggtag

SEQ ID NO: 18519 - DNA, 1818 bp, Artificial Sequence
  Description of Artificial Sequence: Synthetic coding sequence
atggaggccgacatcatcaccaacctgcgctgccgcctgaaggaggccgaggaggagcggctgaaggccgcccagtatggcctgcagctggtggagagccagaatgagctgcagaaccagctggacaagtgcagaaatgagatgatgaccatgacagagagctatgagcaggagaagtacaccctgcagcgggaggtggagctgaagagcaggatgctggagagcctgagctgtgaatgtgaggccatcaagcagcagcagaagatgcacctggagaagctggaggagcagctgagccgcagccacggccaggaggtgaatgagctgaagaccaagattgagaagctgaaggtggagctggatgaggcccggctgtctgagaagcagctgaagcaccaggtggaccaccagaaggagctgctgagctgcaagtctgaggagctgcgggtgatgtctgagcgggtgcaggagagcatgagcagcgagatgctggccctgcagatcgagctgacagagatggagagcatgaagaccaccctgaaggaggaggtgaatgagctgcagtaccggcaggagcagctggagctgctgatcaccaacctgatgaggcaggtggaccggctgaaggaggagaaggaggagcgggagaaggaggccgtgtcctactacaatgccctggagaaggcccgggtggccaaccaggacctgcaggtgcagctggaccaggccctgcagcaggccctggaccccaacagcaaaggaaacagcctgtttgctgaggtggaggaccggcgggccgccatggagcggcagctgatctccatgaaggtgaagtaccagagcctgaagaagcagaatgtgttcaaccgggagcagatgcagaggatgaagctgcagatcgccaccctgctgcagatgaagggcagccagacagaatttgagcagcaggagcggctgctggccatgctggagcagaagaatggagagatcaagcacctgctgggggagatccggaacctggagaagttcaagaacctgtatgacagcatggagagcaagcccagcgtggacagcggcaccctggaggacaacacctactacacagacctgctgcagatgaagctggacaacctgaacaaggagattgagagcaccaagggggagctgagcatccagaggatgaaggccctgtttgagagccagagggccctggacatcgagaggaagctgtttgccaatgaacgctgcctgcagctgtctgagagcgagaacatgaagctgcgggccaagctggatgagctgaagctgaagtatgagcctgaggagaccgtggaggtgcctgtgctgaagaagaggcgggaggtgctgcctgtggacatcaccacagccaaggatgcctgtgtgaacaacagcgccctgggcggggaggtgtaccgcctgcccccccagaaggaggagacccagagctgccccaacagcctggaggacaacaacctgcagctggagaagtctgtgtccatctacacccctgtggtgtccctgagcccccacaagaacctgcctgtggacatgcagctgaagaaggagaagaagtgtgtgaagctgattggagtgcctgcagatgctgaggccctgtctgagaggagcggcaacacccccaacagcccccggctggccgctgagagcaagctgcagacagaggtgaaggagggcaaggagaccagcagcaagctggagaaggagacctgcaagaagctgcaccccatcctgtatgtgagcagcaagagcaccccagagacccagtgcccccagcagtag

SEQ ID NO: 18520 - DNA, 888 bp, Artificial Sequence
  Description of Artificial Sequence: Synthetic coding sequence
atgatggccaagaagccacccaagccagccccccggcgcatcttccaggagcggctgaagatcacagccctgcccctgtactttgagggcttcctgctgatcaagaggagcggctaccgggagtatgagcactactggacagagctgcggggcaccaccctcttcttctacacagacaagaagagcatcatctacgtggacaagctggacatcgtggacctgacctgcctgacagagcagaacagcacagagaagaactgtgccaagttcaccctggtgctgcccaaggaggaggtgcagctgaagacagagaacacagagagcggggaggagtggaggggcttcatcctgactgtgacagagctgtctgtgccccagaatgtgtccctgctgcccggccaggtgatcaagctgcacgaggtgctggagcgggagaagaagaggcgcatcgagacagagcagagcacctctgtggagaaggagaaggagcccacagaggactatgtggatgtgctgaaccccatgcctgcctgcttctacacagtgtccaggaaggaggccacagagatgctgcagaagaaccccagcctgggcaacatgatcctgcggcccggcagtgacagcaggaactacagcatcaccatccggcaggagattgacatcccccgcatcaagcactacaaggtgatgtctgtgggccagaactacaccatcgagctggagaagcctgtgaccctgcccaacctcttctctgtgattgactactttgtgaaggagacccggggcaacctgcggcccttcatctgcagcacagatgaaaatacaggccaggagcccagcatggagggccgctctgagaagctgaagaagaacccccacatcgcctag

SEQ ID NO: 18521 - DNA, 4821 bp, Artificial Sequence
  Description of Artificial Sequence: Synthetic coding sequence
atgttccacatctgcccagctgagaacctgtaccagaaccgcttcctgggcctggccgccatggccagccccagcaggaacagccagagcagaagacgctgcaaggagcccctgcgctacagctacaacccagaccagttccacaacatggacctgcggggcggcccccatgatggagtgaccatccccaggagcaccagtgacacagacctggtgaccagtgacagccgcagcaccctgatggtgagcagcagctactacagcatcggccacagccaggacctggtgatccactgggacatcaaggaggaggtggatgctggggactggattggcatgtacctgattgatgaggtgctgtctgagaacttcctggactacaagaacagaggagtgaatggcagccaccggggccagatcatctggaagattgatgccagcagctactttgtggagcctgagaccaagatctgcttcaagtactaccatggagtgtctggggccctgcgggccaccaccccatctgtgacagtgaagaacagcgctgcccccatcttcaagagcattggagcagatgagaccgtgcagggccagggcagcagaagactcatctccttcagcctgagtgacttccaggccatgggcctgaagaagggcatgttcttcaacccagacccctacctgaagatcagcatccagcccgggaagcacagcatcttccctgccctgccccaccacggccaggagcggcgcagcaagatcatcggcaacacagtgaaccccatctggcaggccgagcagttctcctttgtgtccctgcccacagatgtgctggagattgaggtgaaggacaagtttgccaagagccggcccatcatcaagcgcttcctgggcaagctgtccatgcctgtgcagaggctgctggagagacatgccatcggggacagagtggtgtcctacaccctgggccggcggctgcccacagaccacgtgtctggccagctgcagttccgctttgagatcaccagcagcatccacccagcagatgatgaggagatcagcctgagcacagagcctgagagcgcccagatccaggacagccccatgaacaacctgatggagagcggcagcggggagcccaggtctgaggcccctgagagcagcgagagctggaagccagagcagctgggggagggctctgtgcctgatggccctggcaaccagagcattgagctgagcaggcctgctgaggaggccgccgtcatcacagaagctggggaccagggcatggtgtctgtgggccctgagggcgctggggagctgctggcccaggtgcagaaggacatccagcctgcccccagcgctgaggagctggccgagcagctggacctgggggaggaggccagcgccctgctgctggaggatggagaggccccagccagcaccaaggaggagcccctggaggaggaggccaccacccagagcagagctggccgggaggaggaggagaaggagcaggaggaggagggagatgtgtccaccctggagcagggcgagggccgcctgcagctgcgggcctctgtgaagaggaagagccggccctgcagcctgcctgtgtctgagctggagaccgtcatcgccagcgcctgtggggaccctgagacccccaggacccactacatccgcatccacaccctgctgcacagcatgcccagcgcccagggcggcagcgctgctgaggaggaggatggagctgaggaggagagcaccctgaaggacagcagcgagaaggatggcctgtctgaggtggacacagtggccgctgaccccagcgccctggaggaggaccgggaggagcctgagggcgccaccccaggcacagcccaccctggccacagcggcggccacttccccagcctggccaacggggccgcccaggatggagacacccaccccagcacaggcagcgagagtgacagcagcccccggcagggcggggaccacagctgtgagggctgtgatgccagctgctgcagccccagctgctacagcagcagctgctacagcaccagctgctacagcagcagctgctacagcgccagctgctacagccccagctgctacaatggaaacagatttgccagccacacccgcttcagctctgtggacagcgccaagatcagcgagagcacagtgttcagcagccaggatgatgaggaggaggagaacagcgcctttgagagcgtgcctgacagcatgcagagccctgagctggaccctgagagcaccaacggggccggcccctggcaggatgagctggccgcccccagcggccacgtggagaggagccctgagggcctggagagccctgtggccggccccagcaacagaagagaaggagaatgtcccatcctgcacaacagccagcctgtgtcccagctgcccagcctgcggcctgagcaccaccactaccccaccattgatgagcccctgccccccaactgggaggccagaattgacagccacggccgggtcttctacgtggaccacgtgaacagaaccaccacctggcagaggcccacagctgctgccaccccagatggcatgaggaggagcggcagcatccagcagatggagcagctgaacagacgctaccagaacatccagaggaccatcgccacagagaggagtgaagaagattctggcagccagagctgtgagcaggccccagctgggggcggcggcggcggcggcagtgacagcgaggccgagagcagccagagcagcctggacctgcggcgggagggcagcctgagccctgtgaacagccagaagatcaccctgctgctgcagagccctgctgtgaagttcatcaccaaccctgagttcttcaccgtgctgcacgccaactacagcgcctacagagtcttcaccagcagcacctgcctgaagcacatgatcctgaaggtgagaagagatgccaggaactttgagcgctaccagcacaacagagacctggtgaacttcatcaacatgtttgctgacacccggctggagctgccccggggctgggagatcaagacagaccagcagggcaagagcttctttgtggaccacaacagccgggccaccaccttcatcgacccccgcatccccctgcagaatggccgcctgcccaaccacctgacccaccggcagcacctgcagaggctgcggagctacagcgctggggaggccagcgaggtgtccaggaacagaggagccagcctgctggcccggcccggccacagcctggtggccgccatccgcagccagcaccagcacgagagcctgcccctggcctacaatgacaagatcgtggccttcctgcggcagcccaacatctttgagatgctgcaggagcggcagcccagcctggccaggaaccacaccctgcgggagaagatccactacatcagaacagagggcaaccacggcctggagaagctgagctgtgatgctgacctggtgatcctgctgagcctgtttgaggaggagatcatgtcctatgtgcccctgcaggccgccttccaccctggctacagcttcagcccccgctgcagcccctgcagcagcccccagaacagccctggcctgcagagggccagcgcccgggcccccagcccctaccgccgggactttgaggccaagctgaggaacttctacaggaagctggaggccaagggcttcggccagggccctgggaagatcaagctgatcatcagaagagaccacctgctggagggcaccttcaaccaggtgatggcctacagcaggaaggagctgcagaggaacaagctgtatgtgacctttgtgggggaggagggcctggactacagcggccccagccgggagttcttcttcctgctgagccaggagctgttcaacccctactacggcctgtttgagtacagcgccaatgacacctacacagtgcagatcagccccatgtctgcctttgtggagaaccacctggagtggttccgcttcagcggccgcatcctgggcctggccctgatccaccagtacctgctggatgccttcttcacccggcccttctacaaggccctgctgcggctgccctgtgacctgagtgacctggagtacctggatgaggagttccaccagagcctgcagtggatgaaggacaacaacatcacagacatcctggacctgaccttcaccgtgaatgaggaggtgtttggccaggtgacagagcgggagctgaagagcggcggggccaacacccaggtgacagagaagaacaagaaggagtacatcgagaggatggtgaagtggagggtggagcggggcgtggtgcagcagacagaggccctggtgcggggcttctatgaggtggtggacagccggctggtgtctgtgtttgatgcccgggagctggagctggtgattgctggaacagctgagattgacctgaatgactggaggaacaacacagagtacagaggaggctaccatgatggccacctggtgatccgctggttctgggccgctgtggagcgcttcaacaatgagcagaggctgcggctgctgcagtttgtgacaggcaccagctctgtgccctatgagggctttgctgccctgcggggcagcaatggcctgcggcgcttctgcatcgagaagtggggcaagatcaccagcctgccccgggcccacacctgcttcaaccggctggacctgcccccctaccccagctacagcatgctgtatgagaagctgctgacagctgtggaggagaccagcaccttcggcctggagtag

SEQ ID NO: 18522 - DNA, 2373 bp, Artificial Sequence
  Description of Artificial Sequence: Synthetic coding sequence
atgggcaccaggaagaaggtgcacgcctttgtgcgggtgaagcccacagatgactttgcccacgagatgatccgctatggagatgacaagaggagcattgacatccacctgaagaaggacatccggcggggcgtggtgaacaaccagcagacagactggagcttcaagctggatggagtgctgcatgatgccagccaggacctggtgtatgagaccgtggccaaggatgtggtgtcccaggccctggatggctacaacggcaccatcatgtgctacggccagacaggagctgggaagacctacaccatgatgggcgccacagagaactacaagcaccggggcatcctgccccgggccctgcagcaggtgttcaggatgattgaggagcggcccacccacgccatcaccgtgcgggtgtcctacctggagatctacaatgaaagcctgtttgacctgctgagcaccctgccctacgtgggccccagcgtgacccccatgaccatcgtggagaacccccagggcgtcttcatcaagggcctgtctgtgcacctgaccagccaggaggaggatgccttcagcctgctgtttgaaggagagaccaaccgcatcatcgccagccacaccatgaacaagaacagcagccgcagccactgcatcttcaccatctacctggaggcccacagcaggaccctgtctgaggagaagtacatcaccagcaagatcaacctggtggacctggccggcagcgagcggctgggcaagagcggcagcgagggccaggtgctgaaggaggccacctacatcaacaagagcctgtccttcctggagcaggccatcatcgccctgggggaccagaagagggaccacatccccttccggcagtgcaagctgacccacgccctgaaggacagcctgggcggcaactgcaacatggtgctggtgaccaacatctacggggaggccgcccagctggaggagaccctgagcagcctgcgctttgccagcaggatgaagctggtgaccacagagcccgccatcaatgagaagtatgatgctgagaggatggtgaagaacctggagaaggagctggccctgctgaagcaggagctggccatccatgacagcctgaccaacagaacatttgtgacctatgaccccatggatgagatccagattgctgagatcaacagccaggtgcggcgctacctggagggcaccctggatgaaattgacatcatcagcctgcggcagatcaaggaggtgttcaaccagttccgggtggtgctgagccagcaggagcaggaggtggagagcaccctgcggaggaagtacaccctgattgacagaaatgactttgctgccatcagcgccatccagaaggccggcctggtggatgtggatggccacctggtgggggagcctgagggccagaactttggcctgggcgtggcccccttcagcaccaagccaggcaagaaggccaagagcaagaagaccttcaaggagcccctgagcagcctggccaggaaggagggcgccagcagccctgtgaatggcaaggacctggactatgtgtccaccagcaagacccagctggtgcccagcagcaaggatggagatgtgaaggacatgctgagccgggaccgggagaccagcagcattgagcccctgcccagcgacagccccaaggaggagctgcggcccatccggccagacaccccacccagcaagcctgtggcctttgaggagttcaagaatgagcagggcagcgagatcaaccgcatcttcaaggagaacaagagcatcctgaatgaaagaaggaagagggccagcgagaccacccagcacatcaatgccatcaagcgggagattgatgtgaccaaggaggccctgaacttccagaagagcctgcgggagaagcagggcaagtatgaaaataaaggcctgatgatcattgatgaggaggagttcctgctgatcctgaagctgaaggacctgaagaagcagtacagaagtgagtaccaggacctgcgggacctgcgggcagagatccagtactgccagcacctggtggaccagtgccgccaccggctgctgatggagtttgacatctggtacaatgaaagctttgtgattcctgaggacatgcagatggccctgaagccaggcggcagcatccggcccggcatggtgcctgtgaaccgcatcgtgtccctgggagaagatgaccaggacaagttcagccagctgcagcagagggtgctgcctgagggccctgacagcatctccttctacaatgccaaggtgaagattgagcagaagcacaactacctgaagaccatgatgggcctgcagcaggcccacaggaagtag

SEQ ID NO: 18523 - DNA, 876 bp, Artificial Sequence
  Description of Artificial Sequence: Synthetic coding sequence
atggcctctgtgaccctgtctgaggccgagaaggtgtacatcgtgcacggcgtgcaggaggacctgcgggtggatggccggggctgtgaggactaccgctgtgtggaggtggagacagatgtggtgagcaacaccagcggcagcgcccgggtgaagctgggccacacagacatcctggtgggcgtgaaggccgagatgggcacccccaagctggagaagcccaatgaaggctacctggagttctttgtggactgcagcgccagcgccaccccagagtttgagggcagaggaggagatgacctgggcacagaaattgccaacaccctgtaccgcatcttcaacaacaagagctctgtggacctgaagaccctgtgcatcagcccccgggagcactgctgggtgctgtatgtggatgtgctgctgctggagtgtggcggcaacctgtttgatgccatcagcattgctgtgaaggccgccctcttcaacacccgcatcccccgggtgcgggtgctggaggatgaggagggcagcaaggacatcgagctgagtgatgacccctatgactgcatccggctgtctgtggagaatgtgccctgcatcgtgaccctgtgcaagattggctaccgccacgtggtggatgccaccctgcaggaggaggcctgcagcctggccagcctgctggtgtctgtgaccagcaaaggagtggtgacctgcatgaggaaggtgggcaagggcagcctggaccctgagagcatctttgagatgatggagaccgggaagagggtgggcaaggtgctgcacgccagcctgcagagcgtggtgcacaaggaggagagcctgggccccaagaggcagaaggtgggcttcctgggctag

SEQ ID NO: 18524 - DNA, 2382 bp, Artificial Sequence
  Description of Artificial Sequence: Synthetic coding sequence
atgttctggaagtttgacctgcacagcagcagccacatcgacaccctgctggagcgggaggatgtgaccctgaaggagctgatggatgaagaagatgtgctgcaggagtgcaaggcccagaacaggaagctgattgagttcctgctgaaggccgagtgcctggaggacctggtgtccttcatcatcgaggagcccccccaggacatggatgagaagatccgctacaagtaccccaacatcagctgtgagctgctgaccagtgatgtgtcccagatgaatgaccggctgggggaggatgagagcctgctgatgaagctgtacagcttcctgctgaatgacagccccctgaaccccctgctggccagcttcttcagcaaggtgctgagcatcctgatcagcaggaagccagagcagatcgtggacttcctgaagaagaagcatgactttgtggacctgatcatcaagcacatcggcaccagcgccatcatggacctgctgctgcggctgctgacctgcatcgagcccccccagccccggcaggatgtgctgaactggctgaatgaggagaagatcatccagaggctggtggagatcgtgcaccccagccaggaggaggacagacacagcaatgccagccagagcctgtgtgagatcgtgcggctgagccgggaccagatgctgcagatccagaacagcacagagccagaccccctgctggccaccctggagaagcaggagatcatcgagcagctgctgagcaacatcttccacaaggagaagaatgaaagtgccatcgtgtctgccatccagatcctgctgaccctgctggagacccggcggcccacctttgagggccacatcgagatctgccccccaggcatgagccacagcgcctgcagcgtgaacaagtctgtgctggaggccatccggggccgcctgggcagcttccacgagctgctgctggagccccccaagaacatgttcttcaagtacacctggaacaacttcctgcacacccaggtggagatctgcatcgccctgatcctggccagcccctttgagaacacagaaaatgccaccatcacagaccaggacagcactggagacaacctgctgctgaagcacctgttccagaagtgccagctgattgagcgcatcctggaggcctgggagatgaatgagaagaagcaggccgagggcggccgccgccacggctacatgggccacctgaccagaattgccaactgcatcgtgcacagcacagacaagggccccaacagcgccctggtgcagcagctgatcaaggacctgcctgatgaggtgcgggagcgctgggagaccttctgcaccagcagcctgggggagaccaacaagaggaacacagtggacctggccttcagtgactaccagatgcagcagatgaccagcaacttcatcgaccagtttggcttcaatgatgagaagtttgctgaccaggatgacattggaaatgtgtcctttgacagagtgtctgacatcaacttcaccctgaacaccaatgaaagtggcaacatcgccctgtttgaggcctgctgcaaggagcgcatccagcagtttgatgatggcggcagtgatgaggaggacatctgggaggagaagcacatcgccttcaccccagagagccagaggaggagcagcagcggcagcacagattctgaggagagcacagattctgaggaggaggatggagccaagcaggacctgtttgagcccagcagcgccaacacagaggacaagatggaggtggacctgtctgagccccccaactggagcgccaactttgatgtgcccatggagaccacccatggagcccccctggacagcgtgggcagtgatgtgtggagcacagaggagcccatgcccaccaaggagaccggctgggccagcttcagcgagttcaccagcagcctgagcaccaaggacagcctgcggagcaacagccctgtggagatggagaccagcacagagcccatggaccccctgaccccatctgctgctgccctggccgtgcagcctgaggccgccggctctgtggccatggaggccagcagtgatggagaagaagatgctgagagcacagacaaggtgacagagaccgtgatgaatggaggcatgaaggagaccctgagcctgactgtggatgccaagacagaaacagctgtgttcaagtctgaggagggcaagctgagcaccagccaggatgctgcctgcaaggatgctgaagaatgtcctgagacagctgaggccaagtgtgccgcccccaggcctcccagcagcagccctgagcagaggacaggccagcccagcgcccctggggacacctctgtgaatggacctgtgtag

SEQ ID NO: 18525 - DNA, 3375 bp, Artificial Sequence
  Description of Artificial Sequence: Synthetic coding sequence
atggaccccttcacagagaagctgctggagaggacccgggcccggcgggagaacctgcagaggaagatggccgagcggcccacagctgcccccaggtccatgacccacgccaagagggcccggcagcccctgtctgaggccagcaaccagcagcccctgagcggcggggaggagaagagctgcaccaagcccagccccagcaagaagcgctgcagcgacaacacagaggtggaggtgagcaacctggagaacaagcagcctgtggagagcaccagcgccaagagctgcagccccagccctgtgagcccccaggtgcagccccaggccgctgacaccatcagtgacagcgtggccgtgcctgccagcctgctgggcatgagaagaggcctgaacagccggctggaggccacagctgccagctctgtgaagaccaggatgcagaagctggccgagcagaggcggcgctgggacaatgatgacatgacagatgacatccctgagagcagcctcttcagccccatgcccagcgaggagaaggccgccagccccccccggcccctgctgagcaatgccagcgccacccctgtgggccggcggggccgcctggccaacctggccgccaccatctgctcctgggaggatgatgtgaaccacagctttgccaagcagaacagcgtgcaggagcagcccggcacagcctgcctgagcaagttcagcagcgccagcggggccagcgcccgcatcaacagcagctctgtgaagcaggaggccaccttctgcagccagagagatggagatgccagcctgaacaaggccctgagcagcagcgcagatgatgccagcctggtgaatgccagcatcagcagctctgtgaaggccaccagccctgtgaagagcaccaccagcatcacagatgccaagagctgtgagggccagaaccctgagctgctgcccaagacccccatcagccccctgaagacaggagtgtccaagcccatcgtgaagagcaccctgagccagacagtgcccagcaaaggagagctgagccgggagatctgcctgcagagccagagcaaggacaagagcaccaccccaggcggcaccggcatcaagcccttcctggagagatttggagagcgctgccaggagcacagcaaggagagccctgcccggagcaccccccacaggacccccatcatcacccccaacaccaaggccatccaggagcggctcttcaagcaggacaccagcagcagcaccacccacctggcccagcagctgaagcaggagcggcagaaggagctggcctgcctgcggggccgctttgacaagggcaacatctggagcgctgagaagggcggcaacagcaagagcaagcagctggagaccaagcaggagacccactgccagagcacccccctgaagaagcaccagggcgtgtccaagacccagagcctgcctgtgacagagaaggtgacagagaaccagatcccagccaagaacagcagcacagagcccaagggcttcacagaatgtgagatgaccaagagcagccccctgaagatcaccctcttcctggaggaggacaagagcctgaaggtgaccagtgaccccaaggtggagcagaagattgaggtgatccgggagattgagatgtctgtggatgatgatgacatcaacagcagcaaggtgatcaatgacctcttcagtgatgtgctggaggagggggagctggacatggagaagagccaggaggagatggaccaggccctggccgagagcagcgaggagcaggaggatgccctgaacatcagctccatgagcctgctggcccccctggcccagacagtgggcgtggtgtccccagagagcctggtgtccaccccccggctggagctgaaggacaccagcagaagtgatgagagccccaagccaggcaagttccagaggaccagggtgcccagggctgagagcggggacagcctgggctctgaagatcgggacctgctgtacagcattgatgcctaccgcagccagcgcttcaaggagacagagcggcccagcatcaagcaggtgattgtgaggaaagaagatgtgaccagcaagctggatgagaagaacaatgccttcccctgccaggtgaacatcaagcagaagatgcaggagctgaacaatgagatcaacatgcagcagaccgtcatctaccaggccagccaggccctgaactgctgcgtggatgaggagcacggcaagggcagcctggaggaggccgaggccgagcggctgctgctgattgccaccgggaagaggaccctgctgattgatgagctgaacaagctgaagaatgaaggcccccagaggaagaacaaggccagcccccagagcgagttcatgcccagcaaaggatctgtgaccctgtctgagatccggctgcccctgaaggctgactttgtgtgcagcacagtgcagaagccagatgctgccaactactactacctgatcatcctgaaggccggggctgagaacatggtggccacccccctggccagcaccagcaacagcctgaatggagatgccctgaccttcaccaccaccttcaccctgcaggatgtgtccaatgactttgagatcaacatcgaggtgtacagcctggtgcagaagaaggaccccagcggcctggacaagaagaagaagaccagcaagagcaaggccatcacccccaagaggctgctgaccagcatcaccaccaagagcaacatccacagctctgtgatggccagccctgggggcctgtctgctgtgaggaccagcaactttgccctggtgggcagctacaccctgagcctgagctctgtgggcaacaccaagtttgtgctggacaaggtgcccttcctgagcagcctggagggccacatctacctgaagatcaagtgccaggtgaacagctctgtggaggagcggggcttcctgaccatctttgaagatgtgtctggctttggagcctggcaccggcgctggtgtgtgctgagcggcaactgcatctcctactggacctacccagatgatgagaagaggaagaaccccatcggccgcatcaacctggccaactgcaccagccggcagatcgagcccgccaaccgggagttctgtgcccggaggaacacctttgagctgatcaccgtgcggccccagcgggaggatgaccgggagaccctggtgtcccagtgccgggacaccctgtgtgtgaccaagaactggctgtctgctgacaccaaggaggagcgggacctgtggatgcagaagctgaaccaggtgctggtggacatccggctgtggcagccagatgcctgctacaagcccatcggcaagccctag

SEQ ID NO: 18526 - DNA, 1365 bp, Artificial Sequence
  Description of Artificial Sequence: Synthetic coding sequence
atgctgaagcagatcctgtctgagatgtacattgatcctgacctgctggccgagctgtctgaggagcagaagcagatcctcttcttcaagatgagggaggagcagatccgccgctggaaggagcgggaggccgccatggagaggaaggagagcctgcctgtgaagccccggcccaagaaggaaaatggcaagtctgtgcactggaagctgggcgctgacaaggaggtgtgggtgtgggtgatgggagagcaccacctggacaagccctatgatgtgctgtgcaatgagatcatcgccgagcgggcccggctgaaggccgagcaggaggccgaggagcccaggaagacccacagcgaggagttcaccaacagcctgaagaccaagagccagtaccatgacctgcaggccccagacaaccagcagaccaaggacatctggaagaaggtggccgagaaggaggagctggagcagggcagcaggcctgcccccaccctggaggaggagaagatccgcagcctgagcagcagcagcaggaacatccagcagatgctggccgacagcatcaacaggatgaaggcctatgccttccaccagaagaaggagagcatgaagaagaagcaggatgaggagatcaaccagatcgaggaggagaggaccaagcagatctgcaagtcctggaaggaggacagcgagtggcaggccagcctgaggaagagcaaggccgcagatgagaagaggaggagcctggccaagcaggcccgggaggactacaagaggctgagcctgggcgcccagaagggccggggcggggagcggctgcagagccccctgcgggtgccccagaagccagagcggccccccctgccccccaagccccagttcctgaacagcggggcctacccccagaagcccctgaggaaccagggcgtggtgaggaccctgagcagcagcgcccaggaggacatcatccgctggttcaaggaggagcagctgcccctgcgggccggctaccagaagaccagtgacaccatcgccccctggttccacggcatcctgaccctgaagaaggccaatgagctgctgctgagcacaggcatgcctggcagcttcctgatccgggtgtctgagcgcatcaagggctacgccctgagctacctgtctgaagatggctgcaagcacttcctgattgatgccagcgcagatgcctacagcttcctgggcgtggaccagctgcagcacgccaccctggccgacctggtggagtaccacaaggaggagcccatcaccagcctgggcaaggagctgctgctgtacccctgtggccagcaggaccagctgcctgactacctggagctgtttgaatag

SEQ ID NO: 18527 - DNA, 1497 bp, Artificial Sequence
  Description of Artificial Sequence: Synthetic coding sequence
atggatgaaacagagtggatccaccgccaccccaaggccgaggacctgcgggtgggcctcatctcctgggccggcacctacctgacctttgaggcctgcaagaacacagtgacagccacagccaagagcctgggccggcggcagacctgggagatcctggtgtccaatgagcacgagacccaggccgtggtgcggctgaagtctgtgcagggcctgtacctgctgtgtgaatgtgatggcaccgtgtgctacggccggcccaggaccagccaccacggctgcttcctgctgcgcttccacaggaacagcaagtggaccctgcagtgcctgatcagcggccgctacctggagagcaatggcaaggatgtgttctgcaccagccacgtgctgagcgcctaccacatgtggacccccaggcctgccctgcacgtgcacgtgatcctgtacagccccatccaccgctgctacgcccgggctgaccccaccatgggccgcatctgggtggatgctgctgtgccctgcctggaggagtgtggcttcctgctgcacttcagagatggctgctaccacctggagaccagcacccaccacttcctgagccacgtggacaggctcttcagccagcccagcagccagacagccttccacatgcaggtgcggcctgggggcctggtggccctgtgtgatggagagggcggcatgctgtacccccagggcacccacctgctgctgggcatgggctgcaaccccatgagaggagaggagtggttcatcctgcagcactgccccacctgggtgtccctgcggagcaagacaggccgcttcatcagcgtcatctatgatggagaggtgcgggccgccagcgagcggctgaacaggatgagcctcttccagtttgaatgtgacagcgagagccccaccgtgcagctgcggagcgccaacggctactacctgagccagaggaggcacagagctgtgatggctgatggccaccccctggagagtgacaccttcttcaggatgcactggaactgtggccgcatcatcctgcagagctgccggggccgcttcctgggcatcgcccccaacagcctgctgatggccaacgtcatcctgcccggccccaatgaggagtttggcatcctgtttgccaacagaagcttcctggtgctgcggggccgctatggctacgtgggcagcagcagcggccatgacctgatccagtgcaaccaggaccagcctgaccgcatccacctgctgccctgccggcccggcatctaccacttccaggcccagggcggcagcttctggagcatcaccagctttggcaccttccggccctggggcaagtttgccctgaacttctgcatcgagctgcagggcagcaacctgctgactgtgctggccccaaatggcttctacatgagagctgaccagagcggcaccctgctggccgacagcgaggacatcacccgggagtgcatctgggagttctag

SEQ ID NO: 18528 - DNA, 1377 bp, Artificial Sequence
  Description of Artificial Sequence: Synthetic coding sequence
atggagcgggagcccagcgccagcgaggccgccccagctgctgctgccctgtttgcctggggcgccaacagctatggccagctgggcctgggccacaaggaggatgtgctgctgccccagcagctgaatgacttctgcaagcccaggtctgtgcggcgcatcactggaggcggcggccacagcgctgtggtgacagatggaggagacctgtttgtgtgtggcctgaacaaggatggccagctgggcctgggccacacagaggacatcccctacttcaccccctgcaagagcctgtttggctgccccatccagcaggtggcctgtggctgggacttcaccatcatgctgacagaaaatggccaggtgctgagctgtggcagcaacagctttggccagctgggcgtgccccacggcccccggcgctgtgtggtgccccaggccatcgagctgcacaaggagaaggtggtgtgcatcgccgccggcctgcggcatgctgtggccgccacagccagcggcatcgtgttccagtggggcaccggcctggccagctgtggccggcggctgtgccccggccagaccctgcccctcttcttcaccgccaaggagcccagccgggtgacaggcctggagaacagcaaggccatgtgtgtgctggccggcagtgaccacagcgccagcctgacagatgctggggaggtgtatgtgtggggcagcaacaagcacggccagctggccaatgaggccgccttcctgcctgtgccccagaagattgaggcccactgcttccagaatgagaaggtgacagccatctggagcggctggacccacctggtggcccagacagaaacaggcaagatgttcacctggggccgggctgactatggccagctgggcaggaagctggagacctatgagggctggaagctggagaagcaggacagcttcctgccctgcagcaggcctcccaacagcatgcccagcagcccccactgcctgactggagccacagaggtgtcctgtggcagcgagcacaacctggccatcattggaggagtgtgctacagctggggctggaatgaacatggcatgtgtggagatggaacagaggccaacgtgtgggcccccaagcctgtgcaggccctgctgagcagcagcggcctgctggtgggctgtggggccggccacagcctggccctgtgccagctgcctgcccacccagccctggtgcaggaccccaaggtgacctacctgagcccagatgccatcgaggacacagagagccagaaggccatggacaaggagaggaactggaaggagcggcagagcgagaccagcacccagagccagagcgactggagcagaaatggaggcctgtag

SEQ ID NO: 18529 - DNA, 2961 bp, Artificial Sequence
  Description of Artificial Sequence: Synthetic coding sequence
atggagaggatgaactggctgagccggctggccagccggggccctggccaccgcatcccccagggcgccaacctgcagacccctgtgatggctgaccctgagacctgcctgatggtgttcaagaaccactggagccaggtggtgcgcatcctggagcggcagggcccccgggccgcccctgggggcgcagatgacctgtctgctgtgaggaaccacacctaccagatgctgaccctgctggccgaggacagagctgtgcccagcgcccccactggacctggccccctgctggagtttgccctgcacgaggacctgctgaccagggtgctgacctggcagctgcagtgggatgagctgggagatggagtggaggagcggcgggcagagcagctgaagctgtttgagatgctggtgtctgaggcccggcagcccctgctgcggcacggccctgtgcgggaggccctgctgaccctgctggatgcctgtggccggcctgtgcccagcagccctgccctggatgagggcctggtgctgctgctgagccagctgtgtgtgtgtgtggcccaggagcccagcctgctggagttcttcctgcagcccccacctgagcccggggccgccccccggctgctgctcttcagccggctggtgccctttgtgcaccgggagggcaccctgggccagcaggccagagatgccctgctgctgctgatggccctgtctgctggcagccccaccgtgggccgctacatcgctgaccacagctacttctgccctgtgctggccaccggcctgagcgccctgtacagcagcctgcccaggaagattgaggtgcctggagatgactggcactgcctgcggcgggaggactggctgggcgtgcctgccctggccctcttcatgagcagcctggagttctgcaatgctgtgatccaggtggcccaccccctggtgcagaagcagctggtggactacatccacaacggcttcctggtgcctgtgatgggccctgccctgcacaagacctctgtggaggagatgattgccagcacagcctacctggagctgttcctgcggagcatcagcgagcccgccctgctgcggaccttcctgcgcttcctgctgctgcacagacatgacacccacaccatcctggacaccctggtggcccgcatcggcagcaacagccggctgtgcatggtgtccctgagcctcttccgcaccctgctgaacctgagctgtgaagatgtgctgctgcagctggtgctgcgctacctggtgccctgcaaccacgtgatgctgagccagaagccagctgtgagagatgtggacctgtatggccgggctgctgacaagttcctgagcctcatcccccgctgctgccgccaccacgcccccagcccccccaggcctgagcacgcctcctgggcccggggcggccccagccgggagactggaagaagagaggacatcaccggccctggcagccccagcgtggacagcagctctgtgaccaccgtgccccggcccagcacccccagccggctggccctcttcctgcggcagcagagcctgggcggcagcgagagccctggccctgccccctgcagccctggcctgagcgccagccctgccagcagccctggccggcggcccaccccagctgaggagcccggggagctggaggacaactacctggagtacctgcgggaggccaggagaggagtggacagatgtgtgcgggcctgcaggacctggagcgccccctatgatggagagcggcccagccctgagcccagccccttcggcagcaggaccaagaagaggagcctgctgcctgaagaagatagaaataatgtgggggagggggaggaggaggagctgggccggcggggccgggccggcggggccggggagggccctggccacctgcccccaccccagctgaatggagtgcccggctcctggccagagggcgccaagaaggtgcggctggtgcccaaggagggcgctggggagctgctggagggcatcagcgagggcatggccggcctggagggcttcggccaggagctgcgggagctggaggtggccctgagcaatggaggcaccggcagcgagagccccctggagccccccctgcccctggaggaggaggaggcctatgagagcttcacctgccccccagagcccccaggccccttcctgagcagccccctgcggaccctgaaccagctgcccagccagcccttcaccggccccttcatggctgtgctgtttgccaagctggagaacatgctgcagaacagcgtgtatgtgaacttcctgctgaccggcctggtggcccagctggcctgccacccccagcccctgctgcggagcttcctgctgaacaccaacatggtgttccagcccagcgtgaagagcctgctgcaggtgctgggctctgtgaagaacaagattgagaactttgctgccagccaggaggacttccctgccctgctgagcaaggccaagaagtacctgattgcccggggcaagctggactgggccgagggccctgctgctggccctgcccccaggagaagtgaccccctggtgaagagccggcggcccagcctgggggagctgctgctgcggcatgcccacagccccacccgggcccggcaggccgcccagctggtgctgcagcccggcagagatggagctggcctgggcctgagcggcggcagccctggggccagcacccctgtgctgctgacccggggcggggcccctgagcggcagggcgaggccctgcgggtgaagaatgctgtgtactgtgccgtcatcttccctgagttcctgaaggagctggccgccatcagccaggcccatgctgtgaccagccccttcctgctggagaccagcgaggagggcagcggccccctcatcagcggctgcggccccctgaacccctag

SEQ ID NO: 18530 - DNA, 6723 bp, Artificial Sequence
  Description of Artificial Sequence: Synthetic coding sequence
atggatgacaagggggaccccagcaatgaggaggcccccaaggccatcaagcccaccagcaaggagttcaggaagacctggggcttccggaggaccaccatcgccaagcgggagggcgctggagatgctgaggccgaccccctggagcccccaccaccccagcagcagctgggcctgagcctgcggcgcagcggccggcagcccaagaggacagagcgggtggagcagttcctgaccatcgccaggagaagaggccgccgctccatgcctgtgtccctggaggacagcggggagcccaccagctgcccagccacagatgctgagacagccagcgagggctctgtggagagcgccagcgagaccaggagcggcccccagagcgccagcacagctgtgaaggagaggcctgccagcagcgagaaggtgaagggaggagatgaccatgatgacaccagtgacagcgacagtgatggcctgaccctgaaggagctgcagaaccggctgcggaggaagcgggagcaggagcccacagagcggcccctgaagggcatccagagccggctgaggaagaagaggcgggaggagggccctgctgagaccgtgggcagcgaggccagtgacacagtggagggcgtgctgcccagcaagcaggagccagaaaatgaccagggcgtggtgtcccaggccggcaaggatgaccgggagagcaagctggagggcaaggccgcccaggacatcaaggatgaggagcccggggacctgggccggcccaagccagaatgtgagggctatgaccccaatgccctgtactgcatctgccggcagccccacaacaaccgcttcatgatctgctgtgacagatgtgaggagtggttccatggagactgtgtgggcatcagcgaggcccggggccgcctgctggagagaaatggagaggactacatctgccccaactgcaccatcctgcaggtgcaggatgagacccacagcgagacagctgaccagcaggaggccaagtggaggcctggagatgctgatggaacagactgcaccagcatcggcaccatcgagcagaagagcagcgaggaccagggcatcaagggccgcatcgagaaggccgccaaccccagcggcaagaagaagctgaagatcttccagcctgtgattgaggcccctggggccagcaagtgcatcggccctggctgctgccacgtggcccagcctgacagcgtgtactgcagcaatgactgcatcctgaagcacgccgccgccaccatgaagttcctgagcagcggcaaggagcagaagcccaagcccaaggagaagatgaagatgaagccagagaagcccagcctgcccaagtgtggggcccaggccggcatcaagatcagctctgtgcacaagaggcctgcccctgagaagaaggagaccaccgtgaagaaggctgtggtggtgcctgcccggtctgaggccctgggcaaggaggccgcctgtgagagcagcacccccagctgggccagtgaccacaactacaatgctgtgaagccagagaagacagctgcccccagccccagcctgctgtacaagagcaccaaggaggacagaagaagtgaggagaaggccgccgccatggccgccagcaagaagacagcccctcctggcagcgctgtgggcaagcagcctgcccccaggaacctggtgcccaagaagagcagctttgccaacgtggccgccgccaccccagccatcaagaagccacccagcggcttcaagggcaccatccccaagaggccctggctgagcgccacccccagcagcggggccagcgctgcccggcaggccggccctgccccagctgctgccacagctgccagcaagaagtttcctggcagcgctgccctggtgggcgctgtgaggaagcctgtggtgcccagcgtgcccatggccagccctgcccctggccgcctgggcgccatgtctgctgcccccagccagcccaacagccagatccggcagaacatcagaagaagcctgaaggagatcctgtggaagagggtgaatgacagtgatgacctgatcatgacagaaaatgaggtgggcaagatcgccctgcacatcgagaaggagatgttcaacctcttccaggtgacagacaaccgctacaagagcaagtaccgcagcatcatgttcaacctgaaggaccccaagaaccagggcctcttccaccgggtgctgcgggaggagatcagcctggccaagctggtgcggctgaagccagaggagctggtgtccaaggagctgagcacctggaaggagaggcctgcccggtctgtgatggagagcaggaccaagctgcacaatgaaagcaagaagacagccccccggcaggaggccatcccagacctggaggacagcccccctgtgtctgattctgaggagcagcaggagagcgcccgggctgtgcctgagaagagcacagcccccctgctggatgtgttcagctccatgctgaaggacaccaccagccagcaccgggcccacctgtttgacctgaactgcaagatctgcaccggccaggtgcccagcgcagaagatgagcccgcccccaagaagcagaagctgagcgcctctgtgaagaaggaggacctgaagagcaagcatgacagcagcgccccagaccctgccccagacagcgcagatgaggtgatgcctgaggccgtgcctgaggtggccagcgagcccggcctggagagcgccagccaccccaacgtggacaggacctacttccctggccccccaggagatggccaccctgagcccagccccctggaggacctgagcccctgcccagccagctgtggcagcggcgtggtgaccaccgtgacagtgtctggccgggaccccaggacagcccccagcagcagctgcacagctgtggccagcgctgccagcaggccagacagcacccacatggtggaggcccggcaggatgtgcccaagcctgtgctgacctctgtgatggtgcccaagagcatcctggccaagcccagcagcagcccagacccccgctacctgtctgtgccccccagccccaacatcagcaccagcgagagccgcagccccccagagggggacaccaccctcttcctgagccggctgagcaccatctggaagggcttcatcaacatgcagagcgtggccaagtttgtgaccaaggcctaccctgtgtctggctgctttgactacctgtctgaggacctgcctgacaccatccacatcggcggcagaattgcccccaagacagtgtgggactatgtgggcaagctgaagagctctgtgtccaaggagctgtgcctgatccgcttccacccagccacagaggaggaggaggtggcctacatcagcctgtacagctacttcagcagccggggccgcttcggcgtggtggccaacaacaacagacatgtgaaggacctgtacctgatccccctgagcgcccaggaccctgtgcccagcaagctgctgccctttgagggccctggcctggagagcccccggcccaacatcatcctgggcctggtgatctgccagaagatcaagaggcctgccaacagcggggagctggacaagatggatgagaagaggacccggctgcagcctgaggaggctgatgtgcctgcctaccccaaggtggccaccgtgccccagagcgagaagaagcccagcaagtaccccctgtgcagcgcagatgctgctgtgtccaccaccccacctggcagccccccacctcctccacccctgcctgagccccctgtgctgaaggtgctgagcagcctgaagccagctgcccccagccctgccacagctgccaccacagctgctgctgccagcacagctgccagcagcacagccagcagcgccagcaagacagccagccccctggagcacatcctgcagaccctgtttgggaagaagaagagctttgaccccagcgcccgggagcccccaggcagcacagctggcctgccccaggagcccaagaccacagcagaagatggagtgcctgccccacccctgctggaccccatcgtgcagcagtttggccagttcagcaaggacaaggccctggaggaggaggaggatgaccggccctatgaccctgaggaggagtatgaccctgagcgggcctttgacacccagctggtggagcggggcagaagacatgaggtggagcgggcccctgaggccgctgctgctgagcgggaggaggtggcctatgaccctgaagatgagaccatcctggaggaggccaaggtgacagtggatgacctgcccaacaggatgtgtgctgatgtgagaagaaacagcgtggagaggcctgctgagcctgtggccggggccgccacccccagcctggtggagcagcagaagatgctggaggagctgaacaagcagatcgaggagcagaagaggcagctggaggagcaggaggaggccctgcggcagcagagagctgctgtgggcgtgtccatggcccacttctctgtgtctgatgccctgatgagccccccacccaagagcagcctgcccaaggccgagctgttccagcaggagcagcagagcgctgacaagccagccagcctgcccccagccagccaggccagcaaccaccgggacccccggcaggcccggcggctggccacagagaccggggagggggagggggagcccctgagccggctgagcgcccggggggcccagggcgccctgcctgagagagatgccagccggggcggcctggtgggccaggcccccatgcctgtgcctgaggagaaggagcccgccagcagcccctgggccagcggggagaagcccccagctggcagcgagcaggacggctggaaggccgagcccggggagggcaccaggcctgccaccgtgggggacagcagcgcccggcctgcccggcgggtgctgctgcccaccccaccctgtggggccctgcagcccggcttccccctgcagcatgatggagagcgggaccccttcacctgccccggctttgccagccaggacaaggccctgggcagcgcccagtatgaggaccccaggaacctgcacagcgctggccgcagcagcagccctgctggggagacagaaggagaccgggagccccaggcccggcctggagagggcacagcccccctgcccccacctggccagaaggtgggcggcagccagccccccttccagggccagcgggagcccggcccccacgccctgggcatgagcggcctgcacggccccaacttccctggcccccggggccctgccccacccttccctgaggagaacatcgccagcaatgatggcccccggggccccccaccagccaggtttggagcccagaagggccccatccccagcctcttcagcggccagcacggccccccaccctacggggacagccggggccccagccccagctacctgggcggcccccggggcgtggcccccagccagtttgaggagaggaaggacccccatggagagaagcgggagttccaggatgccccctacaatgaggtgactggagccccagcccagtttgagggcacagagcaggcccccttcctgggcagcagaggaggagcccccttccagtttggaggccagaggcggcccctgctgagccagctgaagggcccccggggcggccccccacccagccagtttggaggccagaggggccccccacctggccactttgtgggcccccggggcccccaccccagccagtttgaaacagcccggggcccccaccccaaccagtttgagggcccccggggccaggcccccaacttcatgcctggcccccggggcatccagccccagcagtttgaggaccagagggtgcacagccccccacgcttcaccaaccagagggccccagcccccctgcagtttggaggcctgcggggcagcgcccccttcagcgagaagaatgagcagacccccagccgcttccacttccagggccaggccccccaggtgatgaagccaggcccccggcccctgctggagctgcccagccaccccccccagcacaggaaggaccgctgggaggaggccggcccccccagcgccctgagcagcagcgcccctggccagggccctgaggctgatggccagtgggccagcgctgacttccgggagggcaagggccacgagtacagaaaccagacctttgagggccggcagcgggagagatttgatgtgggccccaaggagaagcccctggaggagccagatgcccagggccgggcctctgaagatagaagaagagagcgggagcggggcaggaactggagccgggagcgggactgggaccggccccgggagtgggacagacaccgggacaaggacagcagccgggactgggacaggaaccgggagaggtctgccaacagagaccgggagcgggaggccgaccggggcaaggagtgggacaggagccgggagaggagcaggaaccgggagcgggagcgggacagaagaagagaccgggacaggagccgcagccgggagcgggaccgggacaaggcccgggaccgggagcggggccgggacaggaaggacaggagcaagagcaaggagagcgcccgggaccccaagccagaggccagccgggccagtgatgctggaacagccagccaggcctag

SEQ ID NO: 18531 - DNA, 1635 bp, Artificial Sequence
  Description of Artificial Sequence: Synthetic coding sequence
atggatgacaagggggaccccagcaatgaggaggcccccaaggccatcaagcccaccagcaaggagttcaggaagacctggggcttccggaggaccaccatcgccaagcgggagggcgctggagatgctgaggccgaccccctggagcccccaccaccccagcagcagctgggcctgagcctgcggcgcagcggccggcagcccaagaggacagagcgggtggagcagttcctgaccatcgccaggagaagaggccgccgctccatgcctgtgtccctggaggacagcggggagcccaccagctgcccagccacagatgctgagacagccagcgagggctctgtggagagcgccagcgagaccaggagcggcccccagagcgccagcacagctgtgaaggagaggcctgccagcagcgagaaggtgaagggaggagatgaccatgatgacaccagtgacagcgacagtgatggcctgaccctgaaggagctgcagaaccggctgcggaggaagcgggagcaggagcccacagagcggcccctgaagggcatccagagccggctgaggaagaagaggcgggaggagggccctgctgagaccgtgggcagcgaggccagtgacacagtggagggcgtgctgcccagcaagcaggagccagaaaatgaccagggcgtggtgtcccaggccggcaaggatgaccgggagagcaagctggagggcaaggccgcccaggacatcaaggatgaggagcccggggacctgggccggcccaagccagaatgtgagggctatgaccccaatgccctgtactgcatctgccggcagccccacaacaaccgcttcatgatctgctgtgacagatgtgaggagtggttccatggagactgtgtgggcatcagcgaggcccggggccgcctgctggagagaaatggagaggactacatctgccccaactgcaccatcctgcaggtgcaggatgagacccacagcgagacagctgaccagcaggaggccaagtggaggcctggagatgctgatggaacagactgcaccagcatcggcaccatcgagcagaagagcagcgaggaccagggcatcaagggccgcatcgagaaggccgccaaccccagcggcaagaagaagctgaagatcttccagcctgtgattgaggcccctggggccagcaagtgcatcggccctggctgctgccacgtggcccagcctgacagcgtgtactgcagcaatgactgcatcctgaagcacgccgccgccaccatgaagttcctgagcagcggcaaggagcagaagcccaagcccaaggagaagatgaagatgaagccagagaagcccagcctgcccaagtgtggggcccaggccggcatcaagatcagctctgtgcacaagaggcctgcccctgagaagaaggagaccaccgtgaagaaggctgtggtggtgcctgcccggtctgaggccctgggcaaggaggccgcctgtgagagcagcacccccagctgggccagtgaccacaactacaatgctgtgaagccagagaagacagctgcccccagccccagcctgctgtacaagtgcagcggcaagtacagctacagcctgcaccccagcctgattgcctag

SEQ ID NO: 18532 - DNA, 1164 bp, Artificial Sequence
  Description of Artificial Sequence: Synthetic coding sequence
atggagcggcccccacccagggctgctggccgggaccccagcgccctgcgggcagaggccccctggctgcgggcagagggccctggcccccgggccgcccctgtgacagtgcccaccccaccccagggcagctctgtgggcggcggctttgctggcctggagtttgcccggccccaggagagcgagccccgggccagtgacctgggcgcccccaggacctggacaggagctgctgctggccccaggaccccatctgcccacatccctgtgcctgcccagagggccaccccaggcaaggcccggctggatgaggtgatggctgctgctgccctgaccagcctgagcaccagccccctgctgctgggcgcccctgtggccgccttcagccctgagcccggcctggagccctggaaggaggccctggtgcggcccccaggcagctacagcagcagcagcaacagcggggactggggctgggacctggccagtgaccagagcagccccagcacccccagcccccccctgcccccagaggccgcccacttcctgtttggagagcccaccctgaggaagaggaagagccctgcccaggtgatgttccagtgcctgtggaagagctgtgggaaggtgctgagcacagccagcgccatgcagaggcacatccggctggtgcacctgggccggcaggccgagcctgagcagagtgatggagaggaggacttctactacacagagctggatgtgggcgtggacaccctgacagatggcctgagcagcctgacccctgtgagccccacagcctccatgcccccagccttcccccggctggagctgcctgagctgctggagcccccagccctgcccagccccctgcggcccccagccccacccctgcccccacctcctgtgctgagcacagtggccaacccccagagctgccacagcgacagagtgtaccagggctgcctgaccccagcccggctggagccccagcccacagaggtgggcgcctgccccccagccctgagcagccgcatcggcgtgaccctgaggaagcccagaggagatgccaagaagtgcaggaaggtgtatggcatggagcggcgggacctgtggtgcacagcctgccgctggaagaaggcctgccagcgcttcctggactag

SEQ ID NO: 18533 - DNA, 414 bp, Artificial Sequence
  Description of Artificial Sequence: Synthetic coding sequence
atgctgcgcttctgtgccggcctgagtgactttgcccctgtggccgtgcgcagcctgcaggacctggccagaattgccatccggggcaccatcaagaagatcatccaccaggagaccgtgtccaagaatggaaatggcctgaagaacaccccccgcttcaagagaagaagagtgagaagaagaaggatggagaccatcgtgttcctggacaaggaggtgtttgccagccgcatcagcaaccccagtgatgacaacagctgtgaggacctggaggaggagcggcgggaggaggaggagaagaccccacctgagaccaagccagacccccctgtgaacttcctgcggcagaaggtgctgagcctgcccctgcctgaccccctgaagtactacctgctgtactaccgggagaagtag

SEQ ID NO: 18534 - DNA, 2505 bp, Artificial Sequence
  Description of Artificial Sequence: Synthetic coding sequence
atgaggctgctggatggcaagcagaccagccgctacagtgaaaatgcctgtgagaagaagatcttcagcatctacggccactaccctgtggtgcgggccgccctgcggaggaagggctgggtggagaagaagttccacttcctgcccaaggtgatcccagatgtggaggatgaaggagcccgggtgaatgatgacacctgtgccaaggtgaaggagaaccaggagatggccctggagaagacagacaacatccatgatgtgatgagccggctggtgaagaatgagatgccctacctgctgtggaccatcaagagggacatcatcgactaccacagcctgacctatgaccagatgctgaaccactacgccaagacagccagcttcaccaccaagattggcctgtgtgtgaacatgaggagcctgccctggtacgtgcctgccaacccagacagcttcttcccccgctgctacagcctgtgcacagaaagtgagcagcaggagttcctggaggacttccggaggaccatggccagcagcatcctgaagtgggtggtgagccaccagagctgcagccgcagcagccgcagcaagccccgggaccagcgggaggaggccggcagcagtgacctgagcagccggcaggatgctgaaaatgctgaggccaagctgcggggcctgcccggccagctggtggacatcgcctgcaaggtgtgccaggcctacctgggccagctggagcacgaggacatcgacaccagcgcagatgctgtggaggacctgacagaagctgagtgggaggacctgacccagcagtactacagcctggtgcaggtgcccctgggcagcagcatcgtgctgtgcatcttcaagatccagaaggtgatgatgagctttgagcccccaacagcccgggaccggcagtgccaggccctgctgaaccgcatcacctctgtgaacccccagacagacattgatggcctgaggaacatctggatcatcaagccagctgccaagagccggggccgcggggagagcccagacatcgtgtgcatggacagagtggaggagatcctggagctggccgctgctgaccaccccctgagccgggacaacaagtgggtggtgcagaagtacatcgagacccccctgctgatctgtgacaccaagtttgacatccggcagtggttcctggtgacagactggaaccccctgaccatctggttctacaaggagagctacctgcgcttcagcacccagcgcttcagcctggacaagctggacagcgccatccacctgtgcaacaatgctgtgcagaagtacctgaagaatgatgtgggccgcagccccctgctgcctgcccacaacatgtggaccagcacccgcttccaggagtacctgcagaggcagggcagaggagctgtgtggggcagcgtcatctaccccagcatgaagaaggccatcgcccacgccatgaaggtggcccaggaccacgtggagcccaggaagaacagctttgagctgtatggagctgactttgtgctgggccgggacttccggccctggctgattgagatcaacagcagccccaccatgcaccccagcacccctgtgacagcccagctgtgtgcccaggtgcaggaggacaccatcaaggtggccgtggacaggagctgtgacatcggcaactttgagctgctgtggaggcagcctgtggtggagcccccacccttcagcggcagtgacctgtgtgtggccggcgtgtctgtgcggcgggcccggcggcaggtgctgcctgtgtgcaacctgaaggccagcgccagcctgctggatgcccagcccctgaaggcccggggccccagcgccatgccagaccctgcccagggcccccccagccctgccctgcagagggacctgggcctgaaggaggagaagggcctgcccctggccctgctggcccccctgcggggagctgctgagagcggcggggccgcccagcccaccaggaccaaggccgccggcaaggtggagctgcctgcctgcccctgccgccacgtggacagccaggcccccaacacaggagtgcctgtggcccagcctgccaagtcctgggaccccaaccagctgaatgcccaccccctggagcctgtgctgcggggcctgaagacagctgagggcgccctgcggcccccacctgggggcaagggggagggcaccgtgtgcagccggctgccccaccacggccaccacgtggccgcctgccagaccaccggcaccacctgggatggcggccctggggtgtgcttcctgcggcagctgctggccagcgagctgcccatgggccctggcctgccccgggacccccgggccccaccctgcctggtgtgccggggcctgctgcccccagctggcccctgcaagcgctgccgctccttctgtgccgctgtgctgcagggcgccagctttgtgcggctgggcggccgcagctgcagccccaggaccccctag

SEQ ID NO: 18535 - DNA, 759 bp, Artificial Sequence
  Description of Artificial Sequence: Synthetic coding sequence
atgtgcagcaccagcggctgtgacctggaggagatccccctggatgatgatgacctgaacaccatcgagttcaagatcctggcctactacaccaggcaccacgtgttcaagagcaccccagccctcttcagccccaagctgctgcggaccaggagcctgagccagaggggcctgggcaactgcagcgccaatgaatcctggacagaggtgtcctggccctgcaggaacagccagagcagcgagaaggccatcaacctgggcaagaagaagagctcctggaaggccttctttggagtggtggagaaggaggacagccagagcaccccagccaaggtgtctgcccagggccagaggaccctggagtaccaggacagccacagccagcagtggagccgctgcctgagcaatgtggagcagtgcctggagcatgaagctgtggaccccaaggtgatcagcatcgccaacagagtggccgagatcgtgtacagctggcccccaccccaggccacccaggccggcggcttcaagagcaaggagatctttgtgacagagggcctgtccttccagctgcagggccacgtgcctgtggccagcagcagcaagaaggatgaggaggagcagatcctggccaagatcgtggagctgctgaagtacagcggggaccagctggagaggaaggacacagccttcatccccatccccctggtggacaccagcatccagggcttcccccaggacggcctgatggcctgcatctag

SEQ ID NO: 18536 - DNA, 261 bp, Artificial Sequence
  Description of Artificial Sequence: Synthetic coding sequence
atgagcctgcccctgaaccccaagcccttcctgaatggcctgaccgggaagcctgtgatggtgaagctgaagtggggcatggagtacaagggctacctggtgtctgtggatggctacatgaacatgcagctggccaacacagaggagtacattgatggagccctgagcggccacctgggggaggtgctgatccgctgcaacaacgtgctgtacatccggggcgtggaggaggaggaggaggatggagagatgagggagtag

SEQ ID NO: 18537 - DNA, 1281 bp, Artificial Sequence
  Description of Artificial Sequence: Synthetic coding sequence
atggccagcggccacagcctgctgctggagaatgcccagcaggtggtgctggtgtgtgcccggggggagcgcttcctggccagagatgccctgcggagcctggccgtgctggagggcgccagcctggtggtgggcaaggatggcttcatcaaggccatcggccctgcagatgtgatccagaggcagttcagcggggagacctttgaggagatcatcgactgcagcggcaagtgcatcctgcccggcctggtggatgcccacacccaccctgtgtgggccggggagcgggtgcatgaatttgccatgaagctggccggggccacctacatggagatccaccaggccggcggcggcatccacttcaccgtggagaggacccggcaggccacagaggaggagctgttccgcagcctgcagcagaggctgcagtgcatgatgagagctggcaccaccctggtggagtgcaagagcggctacggcctggacctggagacagagctgaagatgctgcgggtgattgagcgggcccggcgggagctggacatcggcatcagcgccacctactgtggggcccacagcgtgcccaagggcaagacagccacagaagctgctgatgacatcatcaacaaccacctgcccaagctgaaggagctgggcagaaatggagagatccacgtggacaacattgatgtgttctgtgagaagggcgtgtttgacctggacagcacccggcgcatcctgcagaggggcaaggacatcggcctgcagatcaacttccatggagatgagctgcaccccatgaaggctgctgagctgggcgctgagctgggcgcccaggccatcagccacctggaggaggtgtctgatgagggcatcgtggccatggccacagcccgctgcagcgccatcctgctgcccaccacagcctacatgctgcggctgaagcagccccgggccaggaagatgctggatgagggcgtcatcgtggccctgggcagtgacttcaaccccaatgcctactgcttctccatgcccatggtgatgcacctggcctgtgtgaacatgaggatgtccatgcctgaggccctggccgccgccaccatcaatgctgcctatgccctgggcaagagccacacccacggcagcctggaggtgggcaagcagggcgacctgatcatcatcaacagcagccgctgggagcacctgatctaccagtttggaggccaccacgagctgattgaatatgtgattgccaagggcaagctgatctacaagacctag

SEQ ID NO: 18538 - DNA, 1263 bp, Artificial Sequence
  Description of Artificial Sequence: Synthetic coding sequence
atgttcagccctggccaggaggagcactgtgcccccaacaaggagcctgtgaagtatggagagctggtggtgctgggctacaacggggccctgcccaatggagaccggggccgcaggaagagcagatttgccctgtacaagaggcccaaggccaacggggtgaagcccagcacagtgcacgtgatcagcaccccccaggccagcaaggccatcagctgcaagggccagcacagcatctcctacaccctgagcaggaaccagacagtggtggtggagtacacccatgacaaggacacagacatgttccaggtgggccgcagcacagagagccccatcgactttgtggtgacagacaccatcagcggcagccagaacacagatgaggcccagatcacccagagcaccatcagcagatttgcctgcagaattgtgtgtgacagaaatgagccctacacagcccgcatctttgctgctggctttgacagcagcaagaacatcttcctgggggagaaggccgccaagtggaagaacccagatggccacatggatggcctgaccaccaacggggtgctggtgatgcacccccggggcggcttcacagaggagagccagcccggggtgtggagggagatctctgtgtgtggagatgtgtacaccctgcgggagaccaggtctgcccagcagaggggcaagctggtggagagcgagaccaacgtgctgcaggacggcagcctgattgacctgtgtggggccaccctgctgtggaggacagcagatggcctcttccacacccccacccagaagcacatcgaggccctgcggcaggagatcaatgctgcccggccccagtgccctgtgggcctgaacaccctggccttccccagcatcaacaggaaggaggtggtggaggagaagcagccctgggcctacctgagctgtggccacgtgcacggctaccacaactggggccacagaagtgacacagaggccaatgaaagagagtgccccatgtgcaggacagtgggcccctacgtgcccctgtggctgggctgtgaggccggcttctacgtggatgctggcccccccacccacgccttcaccccctgtggccacgtgtgcagcgagaagagcgccaagtactggagccagatccccctgccccacggcacccacgccttccacgccgcctgccccttctgtgccacccagctggtgggggagcagaactgcatcaagctgatcttccagggccccattgattag

SEQ ID NO: 18539 - DNA, 1056 bp, Artificial Sequence
  Description of Artificial Sequence: Synthetic coding sequence
atgattgtgcagagggtggtgctgaacagcaggcctgggaagaatggaaatcctgtggccgagaacttcaggatggaggaggtgtacctgcctgacaacatcaatgaaggccaggtgcaggtgaggaccctgtacctgtctgtggacccctacatgcgctgcaggatgaatgaagacaccggcacagactacatcaccccctggcagctgagccaggtggtggatggcggcggcatcggcatcatcgaggagagcaagcacaccaacctgaccaagggggactttgtgaccagcttctactggccctggcagaccaaggtgatcctggatggcaacagcctggagaaggtggacccccagctggtggatggccacctgagctacttcctgggcgccatcggcatgcctggcctgaccagcctcatcggcatccaggagaagggccacatcacagctggcagcaacaagaccatggtggtgtctggagctgctggggcctgtggctctgtggccggccagatcggccacttcctgggctgcagccgggtggtgggcatctgtggcacccatgagaagtgcatcctgctgaccagcgagctgggctttgatgctgccatcaactacaagaaggacaacgtggccgagcagctgcgggagagctgcccagctggggtggatgtgtactttgacaacgtgggcggcaacatcagtgacaccgtcatcagccagatgaatgaaaacagccacatcatcctgtgtggccagatcagccagtacaacaaggatgtgccctaccccccacccctgagccctgccatcgaggccatccagaaggagaggaacatcacccgggagcgcttcctggtgctgaactacaaggacaagtttgagcccggcatcctgcagctgagccagtggttcaaggagggcaagctgaagatcaaggagaccgtcatcaatggcctggagaacatgggcgccgccttccagagcatgatgactggaggcaacatcggcaagcagatcgtgtgcatcagcgaggagatcagcctgtag

SEQ ID NO: 18540 - DNA, 2172 bp, Artificial Sequence
  Description of Artificial Sequence: Synthetic coding sequence
atggccgaggaggaggagacagctgccctgacagagaaggtgatccgcacccagagggtcttcatcaacctgctggacagctacagcagcggcaacatcggcaagttcctgagcaactgtgtggtgggcgccagcctggaggagatcacagaggaggaggaggaggaggatgagaacaagagcgccatgctggaggccagcagcaccaaggtgaaggagggcaccttccagatcgtgggcaccctgagcaagccagacagccccaggccagactttgctgtggagacctacagcgccatcagccgggaggacctgctgatgaggctgctggagtgtgatgtgatcatctacaacatcacagagagcagccagcagatggaggaggccatctgggccgtgtctgccctgtctgaggaggtgagccactttgagaagaggaagctgttcatcctgctgagcacagtgatgacctgggcccggagcaaggccctggaccctgaagattctgaggtgcccttcacagaggaggactacagaagaaggaagagccaccccaacttcctggaccacatcaatgctgagaagatggtgctgaagtttgggaagaaggccaggaagtttgctgcctacgtggtggccgccggcctgcagtacggggctgagggcggcatgctgcacaccttcttcaagatggcctggctgggggagatcccagccctgcctgtgtttggagatggcaccaacgtcatccccaccatccacgtgctggacctggccggggtcatccagaatgtcatcgaccacgtgcccaagccccactacctggtggccgtggatgaatctgtgcacaccctggaggacatcgtgaagtgcatcagcaagaacacaggccctgggaagatccagaagatccccagagaaaatgcctacctgaccaaggacctgacccaggactgcctggaccacctgctggtgaacctgaggatggaggccctgtttgtgaaggagaacttcaacatccgctgggccgcccagacaggctttgtggagaacatcaacaccatcctgaaggagtacaagcagagccggggcctgatgcccatcaagatctgcatcctgggccccccagctgtgggcaagagcagcatcgccaaggagctggccaactactacaagctgcaccacatccagctgaaggatgtgatcagcgaggccatcgccaagctggaggccatcgtggccccaaatgatgtgggggagggggaggaggaggtggaggaggaggaggaggaggagaatgtggaggatgcccaggagctgctggatggcatcaaggagagcatggagcagaatgccggccagctggatgaccagtacatcatccgcttcatgaaggagaagctgaagtccatgccctgcaggaaccagggctacatcctggatggcttccccaagacctatgaccaggccaaggacctcttcaaccaggaggatgaggaggaggaggatgatgtgcggggccgcatgttcccctttgacaagctgatcatccctgagtttgtgtgtgccctggatgccagtgatgagttcctgaaggagagggtcatcaacctgcctgagagcatcgtggccggcacccactacagccaggaccgcttcctgcgggccctgagcaactacagagacatcaacattgatgatgaaacagtgttcaactactttgatgagctggagatccaccccatccacattgatgtgggcaagctggaggatgcccagaaccggctggccatcaagcagctgatcaaggagattggagagcccagaaattatggcctgacagatgaggagaaggccgaggaggagaggaaggctgctgaggagcggctggcccgggaggccgctgaggaggccgagcgggagcaccaggaggccgtggagatggccgagaagatcgcccgctgggaggagtggaacaagaggctggaggaggtgaagcgggaggagcgggagctgctggaggcccagagcatccccctgaggaactacctgatgacctacgtgatgcccaccctcatccagggcctgaatgaatgctgcaatgtgcggccagaagatcctgtggacttcctggccgagtacctgttcaagaacaaccctgaggcccagtag

SEQ ID NO: 18541 - DNA, 1245 bp, Artificial Sequence
  Description of Artificial Sequence: Synthetic coding sequence
atgcagaccttcctgaagggcaagagggtgggctactggctgtctgagaagaagatcaagaagctgaacttccaggcctttgctgagctgtgcaggaagaggggcatggaggtggtgcagctgaacctgagccggcccatcgaggagcagggccccctggatgtgatcatccacaagctgacagatgtgatcctggaggccgaccagaatgacagccagagcctggagctggtgcaccgcttccaggagtacattgatgcccaccctgagaccatcgtgctggaccccctgcctgccatccgcaccctgctggacaggagcaagagctatgagctgatcaggaagattgaggcctacatggaggatgaccgcatctgcagcccccccttcatggagctgaccagcctgtgtggagatgacaccatgaggctgctggagaagaatggcctgaccttccccttcatctgcaagaccagggtggcccacggcaccaacagccatgagatggccatcgtgttcaaccaggagggcctgaatgccatccagcccccctgtgtggtgcagaacttcatcaaccacaatgctgtgctgtacaaggtgtttgtggtgggggagagctacacagtggtgcagaggcccagcctgaagaacttctctgctggcaccagtgaccgggagagcatcttcttcaacagccacaacgtgtccaagccagagagcagctctgtgctgacagagctggacaagattgagggcgtgtttgagcggcccagtgatgaagtcatccgggagctgagccgggccctgcggcaggccctgggcgtgtccctgtttggcatcgacatcatcatcaacaaccagacaggccagcacgccgtcatcgacatcaatgccttccctggctatgagggcgtgtctgagttcttcacagacctgctgaaccacatcgccaccgtgctgcagggccagagcacagccatggccgccactggagatgtggccctgctgcggcacagcaagctgctggccgagcctgctgggggcctggtgggggagaggacctgcagcgccagccctggctgctgcggctccatgatgggccaggatgccccctggaaggccgaggctgatgctgggggcacagccaagctgccccaccagaggctgggctgcaatgccggcgtgagccccagcttccagcagcactgtgtggccagcctggccaccaaggccagcagccagtag

SEQ ID NO: 18542 - DNA, 600 bp, Artificial Sequence
  Description of Artificial Sequence: Synthetic coding sequence
atgaggttccgcttctgtggggacctggactgcccagactgggtgctggccgagatcagcaccctggccaagatgagctctgtgaagctgcggctgctgtgcagccaggtgctgaaggagctgctgggccagggcatcgactatgagaagatcctgaagctgacagcagatgccaagtttgagagcggagatgtgaaggccaccgtggccgtgctgtccttcatcctgagcagcgctgccaagcacagcgtggatggagagagcctgagcagcgagctgcagcagctgggcctgcccaaggagcacgccgccagcctgtgccgctgctatgaggagaagcagagccccctgcagaagcacctgcgggtgtgcagcctgaggatgaaccggctggccggcgtgggctggagggtggactacaccctgagcagcagcctgctgcagagcgtggaggagcccatggtgcacctgcggctggaggtggccgccgcccctggcaccccagcccagcctgtggccatgagcctgtctgctgacaagttccaggtgctgctggccgagctgaagcaggcccagaccctgatgagcagcctgggctag

SEQ ID NO: 18543 - DNA, 1224 bp, Artificial Sequence
  Description of Artificial Sequence: Synthetic coding sequence
atgagccacaggaagttcagcgcccccaggcatggccacctgggcttcctgccccacaagaggagccaccgccaccggggcaaggtgaagacctggcccagagatgaccccagccagcctgtgcacctgacagccttcctgggctacaaggccggcatgacccacaccctgcgggaggtgcacaggcctggcctgaagatcagcaagcgggaggaggtggaggccgtgaccatcgtggagaccccacccctggtggtggtgggcgtggtgggctacgtggccaccccccggggcctgcgctccttcaagaccatctttgctgagcacctgagtgatgaatgtagaagacgcttctacaaggactggcacaagagcaagaagaaggccttcaccaaggcctgcaagcgctggagggacacagatggcaagaagcagctgcagaaggactttgctgccatgaagaagtactgcaaggtgatccgggtgattgtgcacacccagatgaagctgctgcccttccggcagaagaaggcccacatcatggagatccagctgaatggaggcaccgtggccgagaaggtggcctgggcccaggcccggctggagaagcaggtgcctgtgcacagcgtcttcagccagagcgaggtgattgatgtgattgctgtgaccaagggccggggcgtgaagggcgtgaccagccgctggcacaccaagaagctgcccaggaagacccacaagggcctgaggaaggtggcctgcatcggggcctggcacccagcccgggtgggctgcagcatcgcccgggccggccagaagggctaccaccacaggacagagctgaacaagaagatcttcagaattggccggggcccccacatggaggatggcaagctggtgaagaacaatgccagcaccagctatgatgtgacagccaagagcatcacccccctgggcggcttcccccactatggagaggtgaacaatgactttgtgatgctgaagggctgcatcgccggcaccaagaagagggtcatcaccctgaggaagagcctgctggtgcaccacagccggcaggccgtggagaacatcgagctgaagttcatcgacaccaccagcaagtttggccacggccgcttccagacagcccaggagaagagggccttcatgggcccccagaagaagcacctggagaaggagaccccagagaccagcggggacctgtag

SEQ ID NO: 18544 - DNA, 7323 bp, Artificial Sequence
  Description of Artificial Sequence: Synthetic coding sequence
atgagcagcagcggctacccacccaaccagggcgccttcagcacagagcagagccgctacccaccccacagcgtgcagtacaccttccccaacaccaggcaccagcaggagtttgctgtgcctgactaccgcagcagccacctggaggtgtcccaggccagccagctgctgcagcagcagcagcagcagcagctgcggcggcggcccagcctgctgtctgagttccaccctggcagtgaccggccccaggagaggaggaccagctatgagcccttccaccctggccccagccctgtggaccatgacagcctggagagcaagaggccccggctggagcaggtgtctgacagccacttccagagggtgtctgctgctgtgctgcccctggtgcaccccctgcctgagggcctgcgggccagcgcagatgccaagaaggaccctgcctttggaggcaagcatgaggcccccagcagccccatcagcggccagccctgtggagatgaccagaatgccagccccagcaagctgagcaaggaggagctgatccagagcatggacagagtggaccgggagatcgccaaggtggagcagcagatcctgaagctgaagaagaagcagcagcagctggaggaggaggccgccaagcccccagagcctgagaagcctgtgtccccacctcctgtggagcagaagcacaggagcatcgtgcagatcatctatgatgagaacaggaagaaggccgaggaggcccacaagatctttgagggcctgggccccaaggtggagctgcccctgtacaaccagcccagcgacaccaaggtgtaccacgagaacatcaagaccaaccaggtgatgaggaagaagctgatcctcttcttcaagagaagaaaccacgccaggaagcagcgggagcagaagatctgccagagatatgaccagctgatggaggcctgggagaagaaggtggacagaattgagaacaaccccaggaggaaggccaaggagagcaagacccgggagtactatgagaagcagtttcctgagatcaggaagcagcgggagcagcaggagcgcttccagagggtgggccagagaggagctggcctgagcgccaccatcgcccggtctgagcacgagatcagcgagatcattgatggcctgtctgagcaggagaacaatgagaagcagatgaggcagctgagcgtcatcccccccatgatgtttgatgctgagcagaggagagtgaagttcatcaacatgaatggcctgatggaggaccccatgaaggtgtacaaggaccggcagttcatgaatgtgtggacagaccacgagaaggagatcttcaaggacaagttcatccagcaccccaagaactttggcctcatcgccagctacctggagaggaagtctgtgcctgactgtgtgctgtactactacctgaccaagaagaatgaaaactacaaggccctggtgagaagaaattatggcaagaggcggggcaggaaccagcagatcgcccggcccagccaggaggagaaggtggaggagaaggaggaggacaaggccgagaagacagagaagaaggaggaggagaagaaggatgaggaggagaaggatgagaaggaggacagcaaggagaacaccaaggagaaggacaagattgatggaacagctgaggagacagaggagcgggagcaggccaccccccggggcaggaagacagccaacagccagggccgcaggaagggccgcatcaccaggtccatgaccaatgaagctgctgctgccagcgctgctgctgctgctgccacagaggagcccccaccacccctgcccccacctcctgagcccatcagcacagagcctgtggagaccagccgctggacagaggaggagatggaggtggccaagaagggcctggtggagcacggcaggaactgggccgccatcgccaagatggtgggcaccaagtctgaggcccagtgcaagaacttctacttcaactacaagagaagacacaacctggacaacctgctgcagcagcacaagcagaagaccagcaggaagccccgggaggagagagatgtgtcccagtgtgagagcgtggccagcacagtgtctgcccaggaggatgaggacatcgaggccagcaatgaggaggagaaccctgaggacagcgaggtggaggccgtgaagcccagcgaggacagcccagaaaatgccaccagccggggcaacacagagcctgctgtggagctggagcccaccacagaaacagcccccagcaccagccccagcctggccgtgcccagcaccaagccagcagaagatgaatctgtggagacccaggtgaatgacagcatctctgctgagacagctgagcagatggatgtggaccagcaggagcacagcgctgaggagggctctgtgtgtgaccccccaccagccaccaaggctgacagcgtggatgtggaggtgcgggtgcctgagaaccacgccagcaaggtggagggggacaacaccaaggagcgggacctggaccgggccagcgagaaggtggagcccagagatgaggacctggtggtggcccagcagatcaatgcccagaggcctgagccccagagcgacaatgacagcagcgccacctgcagcgcagatgaagatgtggatggagagcctgagcggcagaggatgttccccatggacagcaagcccagcctgctgaaccccaccggcagcatcctggtgagcagccccctgaagcccaaccccctggacctgccccagctgcagcacagagctgctgtgatcccccccatggtgtcctgcaccccctgcaacatccccatcggcacccctgtgtctggctacgccctgtaccagaggcacatcaaggccatgcatgagagcgccctgctggaggagcagaggcagaggcaggagcagattgacctggagtgccgcagcagcaccagcccctgtggcaccagcaagagccccaaccgggagtgggaggtgctgcagcctgccccccaccaggtgatcaccaacctgcctgagggcgtgcggctgcccaccacccggcccacccggcccccaccacccctcatccccagcagcaagaccaccgtggccagcgagaagcccagcttcatcatgggcggcagcatcagccagggcaccccaggcacctacctgaccagccacaaccaggccagctacacccaggagacccccaagcccagcgtgggcagcatcagcctgggcctgccccggcagcaggagagcgccaagagcgccaccctgccctacatcaagcaggaggagttcagccccaggagccagaacagccagcctgagggcctgctggtgcgggcccagcacgagggcgtggtgcggggcacagctggggccatccaggagggcagcatcacccggggcacccccaccagcaagatctctgtggagagcatccccagcctgcggggcagcatcacccagggcaccccagccctgccccagacaggcatccccacagaggccctggtgaagggcagcatcagcaggatgcccatcgaggacagcagccctgagaagggccgggaggaggccgccagcaaaggacatgtgatctatgagggcaagagcggccacatcctgtcctatgacaacatcaagaatgcccgggagggcaccaggagccccaggacagcccacgagatcagcctgaagaggagctatgaatctgtggagggcaacatcaagcagggcatgtccatgagggagagccctgtgtctgcccccctggagggcctcatctgccgggccctgccccggggcagcccccacagcgacctgaaggagaggacagtgctgagcggcagcatcatgcagggcaccccccgggccaccacagagagctttgaagatggcctgaagtaccccaagcagatcaagcgggagagcccccccatccgggcctttgagggcgccatcaccaagggcaagccctatgatggcatcaccaccatcaaggagatgggccgcagcatccacgagatcccccggcaggacatcctgacccaggagagcaggaagaccccagaggtggtgcagagcacccggcccatcatcgagggcagcatcagccagggcacccccatcaagtttgacaacaacagcggccagagcgccatcaagcacaacgtgaagagcctcatcaccggccccagcaagctgagccggggcatgccacccctggagatcgtgcctgagaacatcaaggtggtggagcggggcaagtatgaagatgtgaaggccggggagaccgtgcgcagccgccacacctctgtggtgagcagcggccccagcgtgctgcggagcaccctgcacgaggcccccaaggcccagctgagccctggcatctatgatgacaccagcgcccggaggacccctgtgtcctaccagaacaccatgagccggggcagccccatgatgaacagaacatctgatgtgaccatcagcagcaacaagagcaccaaccacgagaggaagagcaccctgacccccacccagcgggagagcatcccagccaagagccctgtgcctggggtggaccctgtggtgagccacagcccctttgacccccaccaccggggcagcacagctggggaggtgtaccgcagccacctgcccacccacctggaccctgccatgcccttccaccgggccctggaccctgctgctgctgcctacctgttccagaggcagctgagccccaccccaggctaccccagccagtaccagctgtatgccatggagaacacccggcagaccatcctgaatgactacatcaccagccagcagatgcaggtgaacctgcggccagatgtggcccggggcctgagcccccgggagcagcccctgggcctgccctacccagccacccggggcatcatcgacctgaccaacatgccacccaccatcctggtgccccaccctgggggcaccagcaccccacccatggaccgcatcacctacatccctggcacccagatcaccttccccccccggccctacaacagcgcctccatgagccctggccaccccacccacctggccgctgctgccagcgctgagcgggagcgggagcgggagcgggagaaggagcgggagcgggagagaattgctgctgccagcagtgacctgtacctgcggcccggcagcgagcagcccggccggcccggcagccacggctacgtgcgcagccccagccccagcgtgaggacccaggagaccatgctgcagcagaggccttctgtgttccagggcaccaacggcaccagcgtcatcacccccctggaccccacagcccagctgcgcatcatgcccctgcctgctgggggccccagcatcagccagggcctgcctgccagccgctacaacacagctgctgatgccctggccgccctggtggatgctgctgccagcgccccccagatggatgtgtccaagaccaaggagagcaagcatgaggccgcccggctggaggagaacctgcggagccgctctgctgctgtgtctgagcagcagcagctggagcagaagaccctggaggtggagaagaggtctgtgcagtgcctgtacaccagcagcgccttccccagcggcaagccccagccccacagctctgtggtgtacagcgaggccggcaaggacaagggccccccacccaagagccgctatgaggaggagctgcggacccggggcaagaccaccatcacagctgccaacttcattgatgtgatcatcacccggcagatcgccagtgacaaggatgcccgggagcggggcagccagagcagtgacagcagcagcagcctgagcagccacagatatgagacccccagtgatgccattgaagtcatcagccctgccagcagccctgccccaccccaggagaagctgcagacctaccagcctgaggtggtgaaggccaaccaggctgaaaatgaccccacccggcagtatgagggccccctgcaccactaccggccccagcaggagagccccagcccccagcagcagctgccccccagcagccaggccgagggcatgggccaggtgcccaggacccacaggctcatcaccctggccgaccacatctgccagatcatcacccaggactttgccaggaaccaggtgagcagccagaccccccagcagccccccaccagcaccttccagaacagccccagcgccctggtgtccacccctgtgaggaccaagaccagcaaccgctacagccctgagagccaggcccagagcgtgcaccaccagaggcctggcagccgggtgtccccagagaacctggtggacaagagccggggcagcaggcctgggaagagccctgagaggagccacgtgagcagcgagccctatgagcccatcagccccccccaggtgcctgtggtgcatgagaagcaggacagcctgctgctgctgagccagagaggagctgagcctgctgagcagagaaatgatgcccggagccctggcagcatctcctacctgcccagcttcttcaccaagctggagaacaccagccccatggtgaagagcaagaagcaggagatcttcaggaagctgaacagcagcggcggcggggacagcgacatggccgccgcccagcctggaacagagatcttcaacctgcctgctgtgaccaccagcggctctgtgagcagccggggccacagctttgctgaccctgccagcaacctgggcctggaggacatcatcaggaaggccctgatgggcagctttgatgacaaggtggaggaccacggcgtggtgatgagccagcccatgggcgtggtgcccggcacagccaacacctctgtggtgaccagcggggagacccggcgggaggagggggaccccagcccccacagcggcggcgtgtgcaagcccaagctgatcagcaagagcaacagcaggaagagcaagagccccatccctggccagggctacctgggcacagagcggcccagctctgtgtcctctgtgcacagcgagggggactaccaccggcagaccccaggctgggcctgggaggaccggcccagcagcacaggcagcacccagttcccctacaaccccctgaccatgaggatgctgagcagcaccccacccacccccatcgcctgtgcccccagcgctgtgaaccaggccgccccccaccagcagaaccgcatctgggagcgggagcccgcccccctgctgagcgcccagtatgagaccctgagtgacagtgatgactag

SEQ ID NO: 18545 - DNA, 2313 bp, Artificial Sequence
  Description of Artificial Sequence: Synthetic coding sequence
atgctgcagcaggtgaatggccacaaccctggcagtgatggccaggcccgggagtacctgcgggaggacctgcaggagttcctgggcggggaggtgctgctgtacaagctggatgacctgaccagggtgaaccctgtgaccctggagaccgtgctgcgctgcctgcaggcccgctacatggctgacaccttctacaccaatgccggctgcaccctggtggccctgaaccccttcaagcctgtgccccagctgtacagccctgagctgatgagggagtaccacgccgccccccagccccagaagctgaagccccacgtgttcaccgtgggggagcagacctacagaaatgtgaagagcctgattgagcctgtgaaccagagcatcgtggtgtctggagagagcggggccggcaagacctggaccagccgctgcctgatgaagttctatgctgtggtggccaccagccctgcctcctgggagagccacaagattgctgagcgcatcgagcagaggatcctgaacagcaaccctgtgatggaggcctttggaaatgcctgcaccctgaggaacaacaacagcagcagatttgggaagttcatccagctgcagctgaacagagcccagcagatgactggagctgctgtgcagacctacctgctggagaagaccagggtggcctgccaggccagcagcgagaggaacttccacatcttctaccagatctgcaagggggcctctgaagatgagcggctgcagtggcacctgcctgagggcgccgccttctcctggctgcccaaccctgagaggagcctggaggaggactgctttgaggtgacccgggaggccatgctgcacctgggcatcgacacccccacccagaacaacatcttcaaggtgctggccggcctgctgcacctgggcaacatccagtttgctgcctctgaagatgaggcccagccctgccagcccatggatgatgccaagtacagcgtgaggacagctgccagcctgctgggcctgcctgaagatgtgctgctggagatggtgcagatccgcaccatccgggccggccggcagcagcaggtgttcaggaagccctgtgcccgggcagaatgtgacacccggcgggactgcctggccaagctgatctatgcccggctgtttgactggctggtgtctgtcatcaacagcagcatctgtgccgacacagacagctggaccaccttcatcggcctgctggatgtgtatggctttgagagcttcccagacaacagcctggagcagctgtgcatcaactatgccaatgagaagctgcagctggaggcctgtggcctggtggagaccatccacatctctgctgctggcttccccatccgggtgagccacaggaactttgtggagcgctacaagctgctgcggcggctgcacccctgcaccagcagcggccctgacagcccctacccagccaagggcctgcctgagtggtgcccccacagcgaggaggccaccctggagcccctcatccaggacatcctgcacaccctgcctgtgctgacccaggccgccgccatcactggagacagcgctgaggccatgcctgcccccatgcactgcggccgcaccaaggtgttcatgacagacagcatgctggagctgctggagtgtggccgggcccgggtgctggagcagtgtgcccgctgcatccagggcggctggaggaggcaccgccaccgggagcaggagcggcagtggagggctgtgatgctgatccaggccgccatccgctcctggctgaccaggaagcacatccagaggctgcacgccgccgccaccgtcatcaagagggcctggcagaagtggaggatccgcatggcctgcctggccgccaaggagctggatggagtggaggagaagcacttcagccaggccccctgcagcctgagcaccagccccctgcagacccggctgctggaggccatcatccggctgtggcccctgggcctggtgctggccaacacagccatgggcgtgggcagcttccagaggaagctggtggtgtgggcctgcctgcagctgccccggggcagccccagcagctacacagtgcagacagcccaggaccaggccggcgtgaccagcatccgggccctgccccagggcagcatcaagttccactgcaggaagagccccctgcgctatgctgacatctgcccagagcccagcccctacagcatcaccggcttcaaccagatcctgctggagcggcacaggctcatccacgtgaccagcagcgccttcaccggcctgggctag

SEQ ID NO: 18546 - DNA, 2796 bp, Artificial Sequence
  Description of Artificial Sequence: Synthetic coding sequence
atggccgaggtggaggccgtgcagctgaaggaggagggcaacagacacttccagctgcaggactacaaggccgccaccaacagctacagccaggccctgaagctgaccaaggacaaggccctgctggccaccctgtacagaaacagagctgcctgtggcctgaagacagagagctatgtgcaggccgccagtgatgccagccgggccatcgacatcaacagcagtgacatcaaggccctgtaccgccgctgccaggccctggagcacctgggcaagctggaccaggccttcaaggatgtgcagagatgtgccaccctggagcccaggaaccagaacttccaggagatgctgcggcggctgaacaccagcatccaggagaagctgcgggtgcagttcagcacagacagccgggtgcagaagatgtttgagatcctgctggatgagaacagcgaggccgacaagcgggagaaggccgccaacaacctgattgtgctgggccgggaggaggccggggctgagaagatcttccagaacaatggagtggccctgctgctgcagctgctggacaccaagaagccagagctggtgctggccgctgtgaggaccctgagcggcatgtgcagcggccaccaggcccgggccaccgtcatcctgcatgctgtgagaattgaccgcatctgcagcctgatggctgtggagaatgaggagatgagcctggccgtgtgcaacctgctgcaggccatcatcgacagcctgtctggagaggacaagcgggagcaccggggcaaggaggaggccctggtgctggacaccaagaaggacctgaagcagatcaccagccacctgctggacatgctggtgtccaagaaggtgtctggccagggccgggaccaggccctgaacctgctgaacaagaatgtgcccaggaaggacctggccatccatgacaacagcaggaccatctacgtggtggacaatggcctgaggaagatcctgaaggtggtgggccaggtgcctgacctgcccagctgcctgcccctgacagacaacaccaggatgctggccagcatcctgatcaacaagctgtatgatgacctgcgctgtgaccctgagcgggaccacttcaggaagatctgtgaggagtacatcaccgggaagtttgacccccaggacatggacaagaacctgaatgccatccagacagtgtctggcatcctgcagggcccctttgacctgggcaaccagctgctgggcctgaagggcgtgatggagatgatggtggccctgtgtggcagcgagcgggagacagaccagctggtggccgtggaggccctgattcatgccagcaccaagctgagccgggccaccttcatcatcaccaatggagtgtccctgctgaagcagatctacaagaccaccaagaatgagaagatcaagatccgcaccctggtgggcctgtgcaagctgggcagcgctgggggcacagattatggcctgcggcagtttgctgagggcagcacagagaagctggccaagcagtgcaggaagtggctgtgcaacatgagcattgacaccaggacccggcgctgggccgtggagggcctggcctacctgaccctggatgctgatgtgaaggatgactttgtgcaggatgtgcctgccctgcaggccatgtttgagctggccaaggccggcaccagtgacaagaccatcctgtacagcgtggccaccaccctggtgaactgcaccaacagctatgatgtgaaggaggtgattcctgagctggtgcagctggccaagttcagcaagcagcacgtgcctgaggagcaccccaaggacaagaaggacttcatcgacatgagggtgaagaggctgctgaaggccggggtcatcagcgccctggcctgcatggtgaaggctgacagcgccatcctgacagaccagaccaaggagctgctggcccgggtcttcctggccctgtgtgacaaccccaaggaccggggcaccatcgtggcccagggcggcggcaaggccctgatccccctggccctggagggcacagatgtgggcaaggtgaaggccgcccacgccctggccaagattgctgctgtgagcaacccagacatcgccttccctggagagcgggtgtatgaggtggtgcggcccctggtgcggctgctggacacccagagagatggcctgcagaactatgaggccctgctgggcctgaccaacctgagcggccgcagtgacaagctgcggcagaagatcttcaaggagcgggccctgcctgacatcgagaactacatgtttgagaaccacgaccagctgcggcaggccgccacagagtgcatgtgcaacatggtgctgcacaaggaggtgcaggagcgcttcctggctgatggaaatgaccggctgaagctggtggtgctgctgtgtggagaagatgatgacaaggtgcagaatgctgctgctggggccctggccatgctgacagctgcccacaagaagctgtgcctgaagatgacccaggtgaccacccagtggctggagatcctgcagaggctgtgcctgcatgaccagctgtctgtgcagcaccggggcctggtgattgcctacaacctgctggccgcagatgctgagctggccaagaagctggtggagagcgagctgctggagatcctgactgtggtgggcaagcaggagccagatgagaagaaggccgaggtggtgcagacagcccgggagtgcctgatcaagtgcatggactatggcttcatcaagcctgtgtcctag

SEQ ID NO: 18547 - DNA, 2022 bp, Artificial Sequence
  Description of Artificial Sequence: Synthetic coding sequence
atggccagccagttctgcctgcctgagagcccctgcctgagccccctgaagcccctgaagccccactttggagacatccaggagggcatctacgtggccatccagaggagtgacaagaggatccacctggccgtggtgacagagatcaaccgggagaactactgggtgacagtggagtgggtggagaaggctgtgaagaagggcaagaagattgacctggagaccatcctgctgctgaacccagccctggacagcgctgagcaccccatgcctcctccacccctgagccccctggccctggcccccagcagcgccatccgggaccagaggacagccaccaagtgggtggccatgatcccccagaagaaccagacagccagcggggacagcctggatgtgcgggtgcccagcaagccctgcctgatgaagcagaagaagagcccctgcctgtgggagatccagaagctgcaggagcagcgggagaagagaagaaggctgcagcaggagatccgggcccggcgggccctggatgtgaacaccaggaaccccaactatgagatcatgcacatgattgaggagtacagaagacacctggacagcagcaagatctctgtgctggagcccccccaggagcaccgcatctgtgtgtgtgtgaggaagaggcccctgaaccagcgggagaccaccctgaaggacctggacatcatcaccgtgcccagcgacaacgtggtgatggtgcatgagagcaagcagaaggtggacctgacccgctacctgcagaaccagaccttctgctttgaccacgcctttgatgacaaggccagcaatgagctggtgtaccagttcaccgcccagcccctggtggagagcatcttcaggaagggcatggccacctgctttgcctacggccagacaggcagcggcaagacctacaccatgggcggggacttcagcggcacagcccaggactgcagcaagggcatctatgccctggtggcccaggatgtgttcctgctgctgaggaacagcacctatgagaagctggacctgaaggtgtatggcaccttctttgagatctacggcggcaaggtgtatgacctgctgaactggaagaagaagctgcaggtgctggaggatggcaaccagcagatccaggtggtgggcctgcaggagaaggaggtgtgctgcgtggaggaggtgctgaacctggtggagatcggcaacagctgcaggaccagccggcagacccctgtgaatgcccacagcagccgcagccatgctgtgttccagatcatcctgaagagcggccgcatcatgcacggcaagttcagcctggtggacctggccggaaatgaaagaggagctgacaccaccaaggccagcaggaagaggcagctggagggcgctgagatcaacaagagcctgctggccctgaaggagtgcatcctggccctgggccagaacaagccccacacccccttccgggccagcaagctgaccctggtgctgcgggacagcttcatcggccagaacagcagcacctgcatgattgccaccatcagccctggcatgaccagctgtgagaacaccctgaacaccctgcgctatgccaacagagtgaagaagctgaatgtggatgtgcggccctaccaccggggccactaccccatcggccacgaggcccccaggatgctgaagagccacatcggcaacagcgagatgagcctgcagagagatgagttcatcaagatcccctacgtgcagagcgaggagcagaaggagattgaggaggtggagaccctgcccaccctgctgggcaaggacaccaccatcagcggcaagggcagcagccagtggctggagaacatccaggagagagctggaggagtgcaccacgacatcgacttctgcatcgcccggagcctgagcatcctggagcagaagattgatgccctgacagagatccagaagaagctgaagctgctgctggccgacctgcacgtgaagagcaaggtggagtag

SEQ ID NO: 18548 - DNA, 1236 bp, Artificial Sequence
  Description of Artificial Sequence: Synthetic coding sequence
atggccaccacagccaccatggccaccagcggcagcgccaggaagaggctgctgaaggaggaggacatgaccaaggtggagtttgagaccagcgaggaggtggatgtgacccccacctttgacaccatgggcctgcgggaggacctgctgcggggcatctatgcctacggctttgagaagcccagcgccatccagcagagggccatcaagcagatcatcaagggcagagatgtgattgcccagagccagagcggcaccgggaagacagccaccttcagcatctctgtgctgcagtgcctggacatccaggtgcgggagacccaggccctgatcctggcccccacccgggagctggccgtgcagatccagaagggcctgctggccctgggggactacatgaatgtgcagtgccacgcctgcattggaggcaccaacgtgggggaggacatcaggaagctggactatggccagcacgtggtggccggcaccccaggccgggtgtttgacatgatcagaagaagaagcctgcggacccgggccatcaagatgctggtgctggatgaagcagatgagatgctgaacaagggcttcaaggagcagatctatgatgtgtaccgctacctgcccccagccacccaggtggtgctgatcagcgccaccctgccccatgagatcctggagatgaccaacaagttcatgacagaccccatccgcatcctggtgaagagagatgagctgaccctggagggcatcaagcagttctttgtggccgtggagcgggaggagtggaagtttgacaccctgtgtgacctgtatgacaccctgaccatcacccaggccgtcatcttctgcaacaccaagaggaaggtggactggctgacagagaagatgagggaggccaacttcaccgtgtcctccatgcacggggacatgccccagaaggagcgggagagcatcatgaaggagttccgcagcggggccagccgggtgctgatcagcacagatgtgtgggcccggggcctggatgtgccccaggtgtccctcatcatcaactatgacctgcccaacaaccgggagctgtacatccacagaattggccgcagcggccgctatggcaggaagggcgtggccatcaactttgtgaagaatgatgacatccgcatcctgcgggacatcgagcagtactacagcacccagattgatgagatgcccatgaatgtggccgacctgatctag

SEQ ID NO: 18549 - DNA, 1683 bp, Artificial Sequence
  Description of Artificial Sequence: Synthetic coding sequence
atggagctgcctgctgtgggggagcacgtgtttgctgtggagagcattgagaagaagaggatcaggaagggccgggtggagtacctggtgaagtggaggggctggagccccaagtacaacacctgggagcctgaggagaacatcctggacccccggctgctgattgccttccagaaccgggagcggcaggagcagctgatgggctacaggaagaggggccccaagcccaagcccctggtggtgcaggtgcccacctttgcccggcgcagcaatgtgctgaccggcctgcaggacagcagcacagacaacagagccaagctggacctgggcgcccagggcaagggccagggccaccagtatgagctgaacagcaagaagcaccaccagtaccagccccacagcaaggagcgggccggcaagcccccacctcctgggaagagcggcaagtactactaccagctgaacagcaagaagcaccacccctaccagcctgaccccaagatgtatgacctgcagtaccagggcggccacaaggaggcccccagccccacctgcccagacctgggcgccaagagccaccccccagacaagtgggcccagggcgctggggccaagggctacctgggcgctgtgaagcccctggccggggccgccggggcccctggaaaaggaagtgagaagggccccccaaatggcatgatgcctgcccccaaggaggccgtgactggaaatggcatcggcggcaagatgaagatcgtgaagaacaagaacaagaatggccgcatcgtcatcgtgatgagcaagtacatggagaatggcatgcaggccgtgaagatcaagtctggagaggtggccgagggggaggcccggagccccagccacaagaagagagctgctgatgagcggcaccccccagctgacaggaccttcaagaaggccgccggggctgaggagaagaaggtggaggccccacccaagagaagagaggaggaggtgtctggagtgtctgacccccagccccaggatgctggcagcaggaagctgagccccaccaaggaggcctttggagagcagcccctgcagctgaccaccaagccagacctgctggcctgggaccctgccaggaacacccacccccccagccaccacccccacccccacccccaccaccaccaccaccaccaccaccaccaccaccacgctgtgggcctgaacctgagccacgtgaggaagcgctgcctgtctgagacccacggggagcgggagccctgcaagaagaggctgacagcccggagcatcagcacccccacctgcctgggcggcagccctgctgctgagaggcctgctgacctgcccccagctgctgccctgccccagcctgaggtgatcctgctggacagcgacctggatgagcccatcgacctgcgctgtgtgaagaccaggtctgaggccggggagccccccagcagcctgcaggtgaagccagagaccccagccagcgctgctgtggccgtggccgctgctgctgcccccaccaccacagctgagaagcccccagctgaggcccaggatgagcctgctgagagcctgtctgagttcaagcccttctttggaaacatcatcatcacagatgtgacagccaactgcctgactgtgaccttcaaggagtatgtgacagtgtag

SEQ ID NO: 18550 - DNA, 1218 bp, Artificial Sequence
  Description of Artificial Sequence: Synthetic coding sequence
atggacagcctggtgacagccaacaccaagttctgctttgacctcttccaggagatcggcaaggatgacagacacaagaacatcttcttcagccccctgagcctgtctgctgccctgggcatggtgcggctgggcgcccggagtgacagcgcccaccagattgatgaggtgctgcacttcaatgagttcagccagaatgaaagcaaggagccagacccctgcctgaagagcaacaagcagaaggccggcagcctgaacaatgaaagtggcctggtgtcctgctacttcggccagctgctgagcaagctggaccgcatcaagacagactacaccctgagcatcgccaaccggctgtatggagagcaggagttccccatctgccaggagtacctggatggagtcatccagttctaccacaccaccatcgagagcgtggacttccagaagaaccctgagaagagccggcaggagatcaacttctgggtggagtgccagagccagggcaagatcaaggagctgttcagcaaggatgccatcaatgctgagaccgtgctggtgctggtgaatgctgtgtacttcaaggccaagtgggagacctactttgaccacgagaacacagtggatgcccccttctgcctgaatgccaatgaaaacaagtctgtgaagatgatgacccagaagggcctgtaccgcatcggcttcatcgaggaggtgaaggcccagatcctggagatgagatacaccaagggcaagctgtccatgtttgtgctgctgcccagccacagcaaggacaacctgaagggcctggaggagctggagaggaagatcacctatgagaagatggtggcctggagcagcagcgagaacatgtctgaggagagcgtggtgctgtccttcccccgcttcaccctggaggacagctatgacctgaacagcatcctgcaggacatgggcatcacagacatctttgatgagaccagggctgacctgaccggcatcagccccagccccaacctgtacctgagcaagatcatccacaagacctttgtggaggtggatgaaaatggcacccaggccgctgctgccactggagctgtggtgtctgagaggagcctgcgctcctgggtggagttcaatgccaaccaccccttcctgttcttcatccgccacaacaagacccagaccatcctcttctacggccgggtgtgcagcccctag

SEQ ID NO: 18551 - DNA, 3537 bp, Artificial Sequence
  Description of Artificial Sequence: Synthetic coding sequence
atgctgaggatgaagctgcccctgaagcccacccaccctgctgagcccccacctgaggccgaggagcctgaggctgatgcccggcctggggccaaggcccccagcagaagaagaagagactgcaggcctcctcctcctcctcctcctcctgctggccccagccggggccccctgcccccacctcctccaccccggggcctgggcccccctgtggccggcggcgctgctgctggagctggcatgcctgggggcggcggcggccccagcgctgccctgcgggagcaggagcgggtgtatgagtggtttggcctggtgctgggcagcgcccagaggctggagttcatgtgtggcctgctggacctgtgcaaccccctggagctgcgcttcctgggcagctgcctggaggacctggccaggaaggactaccactacctgcgggacagcgaggccaaggccaacggcctgagtgaccccggccccctggccgacttccgggagcctgctgtgcgcagccgcctcatcgtgtacctggccctgctgggctctgaaaatcgggaggccgccggccgcctgcaccggctgctgccccaggtggacagcgtgctgaagagcctgcgggccgcccggggggagggcagcagaggaggagcagaagatgaaagaggagaagatggagatggagagcaggatgctgagaaggatggcagcggccctgagggcggcatcgtggagccccgggtgggcggcggcctgggcagccgggcccaggaggagctgctgctgctcttcaccatggccagcctgcacccagccttctccttccaccagagggtgaccctgcgggagcacctggagcggctgcgggccgccctgcggggcggcccagaagatgctgaggtggaggtggagccctgcaagtttgctggcccccgggcccagaacaacagcgcccacggggactacatgcagaacaatgaaagcagcctcatcgagcaggcccccatcccccaggacggcctgactgtggccccccaccgggcccagcgggaggccgtgcacatcgagaagatcatgctgaagggcgtgcagaggaagagagctgacaagtactgggagtacaccttcaaggtgaactggagcgacctgtctgtgaccaccgtgaccaagacccaccaggagctgcaggagttcctgctgaagctgcccaaggagctgagcagcgagacctttgacaagaccatcctgcgggccctgaaccagggcagcctgaagcgggaggagcggcggcacccagacctggagcccatcctgcggcagctgttcagcagcagcagccaggccttcctgcagagccagaaggtgcacagcttcttccagagcatcagcagtgacagcctgcacagcatcaacaacctgcagagcagcctgaagaccagcaagatcctggagcacctgaaggaggacagcagcgaggccagcagccaggaggaggatgtgctgcagcacgccatcatccacaagaagcacacaggcaagagccccatcgtgaacaacatcggcaccagctgcagccccctggatggcctgaccatgcagtacagcgagcagaatggaattgtggactggaggaagcagagctgcaccaccatccagcaccctgagcactgtgtgaccagcgctgaccagcacagcgctgagaagaggagcctgagcagcatcaacaagaagaagggcaagccccagacagagaaggagaagatcaagaagacagacaaccggctgaacagccgcatcaatggcatccggctgagcaccccccagcacgcccacggcggcaccgtgaaggatgtgaacctggacatcggcagcggccatgacacctgtggggagaccagcagcgagagctacagcagccccagcagccccaggcatgatggccgggagagctttgagagcgaggaggagaaggaccgggacacagacagcaacagtgaagattctggcaaccccagcaccacccgcttcaccggctacggctctgtgaaccagacagtgacagtgaagccccctgtgcagatcgccagcctgggcaatgaaaatggaaacctgctggaggaccccctgaacagccccaagtaccagcacatctccttcatgcccaccctgcactgtgtgatgcacaacggggcccagaagtctgaggtggtggtgcctgcccccaagccagcagatggcaagaccatcggcatgctggtgcccagccctgtggccatcagcgccatccgggagagcgccaacagcacccctgtgggcatcctgggccccacagcctgcacaggagagagcgagaagcacctggagctgctggccagccccctgcccatccccagcaccttcctgccccacagcagcaccccagccctgcacctgactgtgcagaggctgaagctgcccccaccccagggcagcagcgagagctgcaccgtgaacatcccccagcagcccccaggcagcctgagcatcgccagccccaacacagccttcatccccatccacaaccctggcagcttccctggcagccctgtggccaccacagaccccatcaccaagagcgccagccaggtggtgggcctgaaccagatggtgccccagatcgagggcaacacaggaacagtgccccagcccaccaacgtgaaggtggtgctgcctgctgctggcctgtctgctgcccagcccccagccagctaccccctgcccggcagccccctggccgccggcgtgctgcccagccagaacagctctgtgctgagcacagctgccaccagcccccagcctgccagcgctggcatcagccaggcccaggccaccgtgcccccagctgtgcccacccacaccccaggccctgcccccagccccagccctgccctgacccacagcacagcccagagcgacagcaccagctacatctctgctgtgggcaacaccaatgccaacggcaccgtggtgcccccccagcagatgggcagcggcccctgtggcagctgtggccgccgctgcagctgtggcaccaacggcaacctgcagctgaacagctactactaccccaaccccatgcctggccccatgtacagagtgcccagcttcttcaccctgcccagcatctgcaatggcagctacctgaaccaggcccaccagagcaatggaaaccagctgcccttcttcctgccccagaccccctatgccaacggcctggtgcatgaccctgtgatgggcagccaggccaactacggcatgcagcagatggccggcttcggccgcttctaccctgtgtacccagccccaaatgtggtggccaacaccagcggcagcggccccaagaagaatggaaatgtgtcctgctacaactgtggggtgtctggccactacgcccaggactgcaagcagagctccatggaggccaaccagcagggcacctaccgcctgcgctatgccccacccctgccccccagcaatgacaccctggacagcgctgactag

SEQ ID NO: 18552 - DNA, 411 bp, Artificial Sequence
  Description of Artificial Sequence: Synthetic coding sequence
atgcctgggaagaaggccaggaagaatgcccagcccagccctgcccgggccccagctggccctgctggaacagctggaacagcccgggaccaggccggctttgccatcggcatgcagctgcgcttcacccggggcaagaagctgctgagcagcagcctgagcagcagccccctggccctgccccggggccacgaggagcaggtgcaggtggccggcagccgggtgtgctacagcacccaggagatctggaggcagacagagctgcctgctgagaccagcgagagtgacatccagaccctgctgctgaggaacctgacagccagcaagacctgcatgaggggcctgctgcagaagagcttcctgcggcgctgcaccttccaccagtttgaggagcggctgcactgcaactag

SEQ ID NO: 18553 - DNA, 879 bp, Artificial Sequence
  Description of Artificial Sequence: Synthetic coding sequence
atgaaggccaccgtgctgatgaggcagcccggccgggtgcaggagatcgtgggcgccctgaggaagggcggcggggaccggctgcaggtgatcagtgactttgacatgaccctgagcagatttgcctacaacgggaagcgctgccccagcagctacaacatcctggacaacagcaagatcatcagcgaggagtgcaggaaggagctgacagccctgctgcaccactactaccccattgaaattgacccccacaggacagtgaaggagaagctgccccacatggtggagtggtggaccaaggcccacaacctgctgtgccagcagaagatccagaagttccagatcgcccaggtggtgcgggagagcaatgccatgctgcgggagggctacaagaccttcttcaacaccctgtaccacaacaacatccccctcttcatcttctctgctggcattggagacatcctggaggagatcatccggcagatgaaggtgttccaccccaacatccacatcgtgagcaactacatggacttcaatgaagatggcttcctgcagggcttcaagggccagctgatccacacctacaacaagaacagcagcgcctgtgaaaattctggctacttccagcagctggagggcaagaccaacgtcatcctgctgggggacagcatcggggacctgaccatggctgatggagtgcctggggtgcagaacatcctgaagattggcttcctgaatgacaaggtggaggagcggcgggagcgctacatggacagctatgacatcgtgctggagaaggatgagaccctggatgtggtgaatggcctgctgcagcacatcctgtgccagggcgtgcagctggagatgcagggcccctag

SEQ ID NO: 18554 - DNA, 2010 bp, Artificial Sequence
  Description of Artificial Sequence: Synthetic coding sequence
atggacctgaggacagctgtgtacaatgctgccagagatggcaagctgcagctgctgcagaagctgctgagcggccgcagccgggaggagctggatgagctgactggagaggtggccggcggcggcacccccctgctgattgctgcccgctatggccacctggatgtggtggagtacctggtggacagatgtggggcctctgtggaggccggcggctctgtgcactttgatggagagaccattgaaggagccccacccctgtgggccgccagcgctgctggccacctggatgtggtgcgcagcctgctgcggcggggggcctctgtgaacagaaccaccaggaccaacagcacccccctgcgggccgcctgctttgatggccacctggaggtggtgcgctacctggtgggggagcaccaggccgacctggaggtggccaacagacatggccacacctgcctgatgatcagctgctacaagggccaccgggagatcgcccgctacctgctggagcagggcgcccaggtgaacagaagaagtgccaagggcaacacagccctgcatgactgtgccgagagcggcagcctggagatcctgcagctgctgctgggctgcaaggccaggatggagagagatggctacggcatgacccccctgctggccgcctctgtgacaggccacaccaacatcgtggagtacctgatccaggagcagcccggccaggagcaggtggccggcggggaggcccagcccggcctgccccaggaggaccccagcaccagccagggctgtgcccagccccagggcgccccctgctgcagcagcagccctgaggagcccctgaatggagagagctatgagagctgctgccccaccagccgggaggccgctgtggaggccctggagctgctgggcgccacctacgtggacaagaagagggacctgctgggcgccctgaagcactggaggcgggccatggagctgcggcaccagggcggggagtacctgcccaagccagagcccccccagctggtgctggcctatgactacagccgggaggtgaacaccacagaggagctggaggccctgatcacagatcctgatgagatgaggatgcaggccctgctgatccgggagcgcatcctgggccccagccacccagacaccagctactacatccgctacagaggagctgtgtatgctgacagcggcaactttgagcgctgcatccggctgtggaagtatgccctggacatgcagcagagcaacctggagcccctgagccccatgacagccagcagcttcctgagctttgctgagctgttctcctatgtgctgcaggaccgggccgccaagggcagcctgggcacccagattggatttgctgacctgatgggcgtgctgaccaagggcgtgcgggaggtggagcgggccctgcagctgccccgggagcccggggacagcgcccagttcaccaaggccctggccatcatcctgcacctgctgtacctgctggagaaggtggagtgcacccccagccaggagcacctgaagcaccagacagtgtaccgcctgctgaagtgtgccccccggggcaagaatggcttcacccccctgcacatggctgtggacaaggacaccaccaacgtgggccgctaccctgtgggccgcttccccagcctgcacgtggtgaaggtgctgctggactgtggggctgaccctgacagccgggactttgacaacaacacccccctgcacatcgccgcccagaacaactgcccagccatcatgaatgccctgattgaagctggggcccacatggatgccaccaatgccttcaagaagacagcctatgagctgctggatgagaagctgctggcccggggcaccatgcagcccttcaactacgtgaccctgcagtgcctggccgcccgggccctggacaagaacaagatcccctacaagggcttcatccctgaggacctggaggccttcatcgagctgcactag

SEQ ID NO: 18555 - DNA, 720 bp, Artificial Sequence
  Description of Artificial Sequence: Synthetic coding sequence
atggccgccaccctgctggccgcccggggagctggccctgccccagcctggggccctgaggccttcaccccagactgggagagccgggaggtgtccacaggcaccaccatcatggctgtgcagtttgatggaggagtggtgctgggcgctgacagcaggaccaccaccggcagctacatcgccaacagagtgacagacaagctgacccccatccatgaccgcatcttctgctgccgcagcggcagcgctgctgacacccaggccgtggctgatgctgtgacctaccagctgggcttccacagcattgagctgaatgaaccacccctggtgcacacagctgccagcctcttcaaggagatgtgctaccgctaccgggaggacctgatggccggcatcatcatcgccggctgggacccccaggagggcggccaggtgtacagcgtgcccatgggcggcatgatggtgcggcagagctttgccatcggcggcagcggcagcagctacatctacggctacgtggatgccacctaccgggagggcatgaccaaggaggagtgcctgcagttcaccgccaatgccctggccctggccatggagagagatggcagcagcggcggcgtcatccggctggccgccatcgccgagagcggcgtggagcggcaggtgctgctgggggaccagatccccaagtttgctgtggccaccctgcccccagcctag

SEQ ID NO: 18556 - DNA, 1383 bp, Artificial Sequence
  Description of Artificial Sequence: Synthetic coding sequence
atgaacttcagcgaggtgttcaagctgagcagcctgctgtgcaagttctccccagatggcaagtacctggccagctgtgtgcagtaccgcctggtggtgagagatgtgaacaccctgcagatcctgcagctgtacacctgcctggaccagatccagcacatcgagtggagcgctgacagcctcttcatcctgtgtgccatgtacaagaggggcctggtgcaggtgtggagcctggagcagcctgagtggcactgcaagattgatgagggcagcgctggcctggtggccagctgctggagcccagatggccgccacatcctgaacaccacagagttccacctgcgcatcaccgtgtggagcctgtgcaccaagtctgtgtcctacatcaagtaccccaaggcctgcctgcagggcatcaccttcaccagagatggccgctacatggccctggccgagcggcgggactgcaaggactatgtgtccatctttgtgtgcagcgactggcagctgctgcggcactttgacacagacacccaggacctgaccggcatcgagtgggccccaaatggctgtgtgctggccgtgtgggacacctgcctggagtacaagatcctgctgtacagcctggatggccgcctgctgagcacctacagcgcctatgagtggagcctgggcatcaagtctgtggcctggagccccagcagccagttcctggccgtgggcagctatgatggcaaggtgcgcatcctgaaccacgtgacctggaagatgatcacagaatttggccaccctgctgccatcaatgaccccaagatcgtggtgtacaaggaggccgagaagagcccccagctgggcctgggctgcctgtccttccccccaccccgggccggggccggccccctgcccagcagcgagagcaaatatgagatcgcctctgtgcctgtgtccctgcagaccctgaagcctgtgacagaccgggccaaccccaagattggaattggcatgctggccttctccccagacagctacttcctggccaccagaaatgacaacatccccaatgctgtgtgggtgtgggacatccagaagctgcggctgtttgctgtgctggagcagctgagccctgtgcgggccttccagtgggacccccagcagccccggctggccatctgcaccggcggcagccggctgtacctgtggagccctgctggctgcatgtctgtgcaggtgcctggagagggggactttgctgtgctgagcctgtgctggcacctgagcggggacagcatggccctgctgagcaaggaccacttctgcctgtgcttcctggagacagaagctgtggtgggcacagcctgccggcagctgggcggccacacctag

SEQ ID NO: 18557 - DNA, 282 bp, Artificial Sequence
  Description of Artificial Sequence: Synthetic coding sequence
atgagcggcctgcgggtgtacagcacctctgtgacaggcagccgggagatcaagagccagcagagcgaggtgacccgcatcctggatggcaagaggatccagtaccagctggtggacatcagccaggacaatgccctgagagatgagatgagggccctggccggcaaccccaaggccaccccaccccagatcgtgaatggagaccagtactgtggggactatgagctgtttgtggaggccgtggagcagaacaccctgcaggagttcctgaagctggcctag

SEQ ID NO: 18558 - DNA, 1920 bp, Artificial Sequence
  Description of Artificial Sequence: Synthetic coding sequence
atgaacctggagaagctgagcaagccagagctgctgaccctcttcagcatcctggagggggagctggaggcccgggacctggtgattgaggccctgaaggcccagcaccgggacaccttcatcgaggagagatatggcaagtacaacatcagtgaccccctgatggccctgcagagggactttgagaccctgaaggagaagaatgatggagagaagcagcctgtgtgcaccaaccccctgagcatcctgaaggtggtgatgaagcagtgcaagaacatgcaggagaggatgctgagccagctggccgctgctgagagccgccacaggaaggtgatcctggacctggaggaggagcggcagagacatgcccaggacacagcagaaggagatgatgtgacctacatgctggagaaggagcgggagcggctgacccagcagctggagtttgagaagagccaggtgaagaagtttgagaaggagcagaagaagctgagcagccagctggaggaggagaggagccgccacaagcagctgagctccatgctggtgctggagtgcaagaaggccaccaacaaggctgctgaggagggccagaaggccggggagctgagcctgaagctggagaaggagaagagccgggtgtccaagctggaggaggagctggccgctgagaggaagaggggcctgcagacagaggcccaggtggagaagcagctgtctgaatttgacatcgagcgggagcagctgcgggccaagctgaaccgggaggagaacagaaccaagaccctgaaggaggagatggagagcctgaagaagatcgtgaaggacctggaggccagccaccagcacagcagccccaatgagcagctgaagaagcctgtgacagtgtccaagggcacagccacagagcccctgatgctgatgtctgtgttctgccagacagagagcttccctgctgagaggacccacggcagcaacatcgccaagatgaccaacacaggcctgcccggccctgccaccccagcctacagctatgccaagaccaacggccactgtgaccctgagatccagaccacccgggagctgacagctggcaacaacgtggagaaccaggtgcccccccgggagaagtctgtggccctggcccaggagaagcctgtggagaatggaggctgccctgtgggcatcgagacccctgtgcccatgcccagccccctgagcagcagcggcagcagcctgagccccagcagcacagccagcagcagcctgaccagcagcccctgcagcagccctgtgctgaccaagaggctgctgggcagcagcgccagcagccctggctaccagagcagctaccaggtgggcatcaaccagcgcttccacgccgcccggcacaagttccagagccaggccgaccaggaccagcaggccagcggcctgcagagcccccccagccgggacctgagccccaccctgattgacaacagcgctgccaagcagctggccaggaacacagtgacccaggtgctgagccgcttcaccagccagcagggccccatcaagcctgtgagccccaacagcagcccctttggaacagactacagaaacctggccaacacagccaaccccaggggggacaccagccacagccccacccctgggaaggtgagcagccccctgagccccctgagccctggcatcaagagccccaccatccccagggctgagcggggcaaccccccacccatcccccccaagaagccaggcctgacccccagccccagcgccaccacccccctgaccaagacccacagccaggccgccagcctgaccacagctgaggacctggccagcagctgcagcagcaacacagtggtggccaacgggaaggatgtggagctgctgctgcccaccagcagctag

SEQ ID NO: 18559 - DNA, 2487 bp, Artificial Sequence
  Description of Artificial Sequence: Synthetic coding sequence
atgaggttcctggaggcccggagcctggccgtggccatgggagacacagtggtggagcccgcccccctgaagcccaccagcgagcccaccagcggccccccaggcaacaatggaggcagcctgctgagcgtcatcacagagggcgtgggggagctgtctgtgattgatcctgaggtggcccagaaggcctgccaggaggtgctggagaaggtgaagctgctgcatggaggagtggccgtgagcagccggggcacccccctggagctggtgaatggagatggagtggacagcgagatccgctgcctggatgatcctccagcccagatccgggaggaggaggatgagatgggcgctgctgtggccagcggcacagccaagggggccaggagaagacggcagaacaacagcgccaagcagagctggctgctgcggctgtttgagagcaagctgtttgacatctccatggccatctcctacctgtacaacagcaaggagcccggggtgcaggcctacatcggcaacagactcttctgcttcagaaatgaagatgtggacttctacctgccccagctgctgaacatgtacatccacatggatgaagatgtgggagatgccatcaagccctacatcgtgcaccgctgccggcagagcatcaacttcagcctgcagtgtgccctgctgctgggcgcctacagcagtgacatgcacatcagcacccagaggcacagccggggcaccaagctgaggaagctgatcctgagtgatgagctgaagccagcccacaggaagcgggagctgcccagcctgagccctgccccagacaccggcctgagccccagcaagaggacccaccagaggagcaagagtgatgccacagccagcatcagcctgagcagcaacctgaagaggacagccagcaaccccaaggtggagaatgaagatgaggagctgagcagcagcacagagagcattgacaacagcttcagcagccctgtgcggctggcccctgagcgggagttcatcaagagcctgatggccatcggcaagaggctggccaccctgcccaccaaggagcagaagacccagaggctcatcagcgagctgagcctgctgaaccacaagctgcctgcccgggtgtggctgcccacagctggctttgaccaccacgtggtgcgggtgccccacacccaggccgtggtgctgaacagcaaggacaaggccccctacctgatctacgtggaggtgctggagtgtgaaaattttgacaccacctctgtgcctgcccgcatccctgagaaccgcatccgcagcaccaggtctgtggagaacctgcctgaatgtggcatcacccatgagcagagagctggcagcttcagcacagtgcccaactatgacaatgatgatgaggcctggagcgtggatgacatcggggagctgcaggtggagctgcctgaggtgcacaccaacagctgtgacaacatcagccagttctctgtggacagcatcaccagccaggagagcaaggagcccgtcttcatcgctgctggggacatcagaagaaggctgtctgagcagctggcccacacccccacagccttcaagagggaccctgaggaccccagcgctgtggccctgaaggagccctggcaggagaaggtgcggcgcatccgggagggcagcccctacggccacctgcccaactggaggctgctgagcgtcatcgtgaagtgtggagatgacctgcggcaggagctgctggccttccaggtgctgaagcagctgcagagcatctgggagcaggagcgggtgcccctgtggatcaagccctacaagatcctggtgatctctgctgacagcggcatgattgagcctgtggtgaatgctgtgtccatccaccaggtgaagaagcagagccagctgagcctgctggactacttcctgcaggagcacggcagctacaccacagaggccttcctgagcgcccagaggaactttgtgcagagctgtgccggctactgcctggtgtgctacctgctgcaggtgaaggacagacacaacggcaacatcctgctggatgctgagggccacatcatccacatcgactttggcttcatcctgagcagcagccccaggaacctgggctttgagaccagcgccttcaagctgaccacagaatttgtggatgtgatgggcggcctggatggagacatgttcaactactacaagatgctgatgctgcagggcctgattgctgccaggaagcacatggacaaggtggtgcagatcgtggagatcatgcagcagggcagccagctgccctgcttccacggcagcagcaccatccggaacctgaaggagcgcttccacatgtccatgacagaggagcagctgcagctgctggtggagcagatggtggatggctccatgaggagcatcaccaccaagctgtatgatggcttccagtacctgaccaacggcatcatgtag

SEQ ID NO: 18560 - DNA, 4233 bp, Artificial Sequence
  Description of Artificial Sequence: Synthetic coding sequence
atggctgacacagacctcttcatggagtgtgaggaggaggagctggagccctggcagaagatcagtgatgtgattgaggacagcgtggtggaggactacaacagcgtggacaagaccaccaccgtgtctgtgtcccagcagcctgtgtctgcccctgtgcccatcgccgcccacgcctctgtggccggccacctgagcaccagcaccaccgtgagcagcagcggggcccagaacagcgacagcaccaagaagaccctggtgaccctcatcgccaacaacaatgccggcaaccccctggtgcagcagggcggccagcccctcatcctgacccagaacccagcccctggcctgggcaccatggtgacccagcctgtgctgcggcctgtgcaggtgatgcagaatgccaaccacgtgaccagcagccctgtggccagccagcccatcttcatcaccacccagggcttccctgtgagaaatgtgcggcctgtgcagaatgccatgaaccaggtgggcatcgtgctgaatgtgcagcagggccagacagtgcggcccatcaccctggtgcctgcccctggcacccagtttgtgaagcccaccgtgggcgtgccccaggtgttcagccagatgacccctgtgcggcccggcagcaccatgcctgtgcggcccaccaccaacaccttcaccaccgtcatcccagccaccctgaccatccgcagcacagtgccccagagccagagccagcagaccaagagcacccccagcaccagcaccacccccacagccacccagcccaccagcctgggccagctggccgtgcagagccctggccagagcaaccagaccaccaaccccaagctggcccccagcttccccagccccccagctgtgtccatcgccagctttgtgacagtgaagaggcctggggtgactggagagaacagcaatgaggtggccaagctggtgaacaccctgaacaccatccccagcctgggccagagccctggccctgtggtggtgagcaacaacagcagcgcccacggcagccagaggaccagcggccctgagagctccatgaaggtgaccagcagcatccctgtgtttgacctgcaggacggcggcaggaagatctgcccccgctgcaatgcccagttccgggtgacagaggccctgcggggccacatgtgctactgctgcccagagatggtggagtaccagaagaagggcaagagcctggacagcgagcccagcgtgcccagcgctgccaagccacccagccctgagaagacagcccctgtggccagcacccccagcagcacccccatcccagccctgagcccccccaccaaggtgcctgagcccaatgaaaatgtgggagatgctgtgcagaccaagctgatcatgctggtggatgacttctactacggcagagatggcggcaaggtggcccagctgaccaacttccccaaggtggccaccagcttccgctgcccccactgcaccaagaggctgaagaacaacatccgcttcatgaaccacatgaagcaccacgtggagctggaccagcagaatggagaggtggatggccacaccatctgccagcactgctaccggcagttcagcacccccttccagctgcagtgccacctggagaatgtgcacagcccctatgagagcaccaccaagtgcaagatctgtgagtgggcctttgaaagtgagcccctcttcctgcagcacatgaaggacacccacaagccaggagagatgccctacgtgtgccaggtgtgccagtaccgcagcagcctgtacagcgaggtggatgtgcacttcaggatgattcatgaggacaccaggcacctgctgtgcccctactgcctgaaggtgttcaagaatggaaatgccttccagcagcactacatgaggcaccagaagagaaatgtgtaccactgcaacaagtgccgcctgcagttcctgtttgccaaggacaagattgagcacaagctgcagcaccacaagaccttcaggaagcccaagcagctggagggcctgaagccaggcaccaaggtgaccatccgggccagccggggccagcccaggacagtgcctgtgagcagcaatgacaccccacccagcgccctgcaggaggccgcccccctgaccagctccatggaccccctgcccgtcttcctgtacccacctgtgcagaggagcatccagaagagagctgtgaggaagatgtctgtgatgggccggcagacctgcctggagtgcagctttgagatcccagacttccccaaccacttccccacctacgtgcactgcagcctgtgccgctacagcacctgctgcagccgggcctatgccaaccacatgatcaacaaccacgtgcccaggaagagccccaagtacctggccctcttcaagaacagcgtgtctggcatcaagctggcctgcaccagctgcacctttgtgacctctgtgggagatgccatggccaagcacctggtgttcaaccccagccacaggagcagcagcatcctgccccggggcctgacctggatcgcccacagccgccacggccagacccgggacagagtgcatgacagaaatgtgaagaacatgtaccccccacccagcttccccaccaacaaggccgccaccgtgaagtctgctggggccaccccagctgagcctgaggagctgctgacccccctggccccagccctgcccagccctgccagcacagccaccccaccacccacccccacccacccccaggccctggccctgccccccctggccacagagggcgctgagtgcctgaatgtggatgaccaggatgagggcagccctgtgacccaggagcctgagctggccagcggcggcggcggcagcggcggcgtgggcaagaaggagcagctgtctgtgaagaagctgcgggtggtgctgtttgccctgtgctgcaacacagagcaggccgctgagcacttcaggaacccccagaggcgcatccgccgctggctgcggcgcttccaggccagccagggcgagaacctggagggcaagtacctgagctttgaagctgaggagaagctggccgagtgggtgctgacccagcgggagcagcagctgcctgtgaatgaggagaccctcttccagaaggccaccaagattggccgcagcctggagggcggcttcaagatctcctatgagtgggccgtgcgcttcatgctgcggcaccacctgaccccccacgcccggcgggctgtggcccacaccctgcccaaggatgtggctgaaaatgccggcctcttcatcgactttgtgcagaggcagatccacaaccaggacctgcccctgtccatgattgtggccattgatgagatcagcctcttcctggacacagaggtgctgagcagtgatgacagaaaagaaaatgccctgcagacagtgggcaccggggagccctggtgtgatgtggtgctggccatcctggctgatggcaccgtgctgcccaccctggtgttctaccggggccagatggaccagcctgccaacatgccagacagcatcctgctggaggccaaggagagcggctacagtgatgatgagatcatggagctgtggagcaccagggtgtggcagaagcacacagcctgccagaggagcaagggcatgctggtgatggactgccacaggacccacctgtctgaggaggtgctggccatgctgagcgccagcagcaccctgcctgctgtggtgcctgctggctgcagcagcaagatccagcccctggatgtgtgcatcaagaggacagtgaagaacttcctgcacaagaagtggaaggagcaggcccgggagatggctgacacagcctgtgacagtgatgtgctgctgcagctggtgctggtgtggctgggggaggtgctgggcgtcatcggggactgcccagagctggtgcagaggagcttcctggtggcctctgtgctgcccggcccagatggcaacatcaacagccccaccagaaatgctgacatgcaggaggagctgattgccagcctggaggagcagctgaagctgagcggggagcacagcgagagcagcaccccccggcccaggagcagccctgaggagaccatcgagcctgagagcctgcaccagctgtttgaaggagagagcgagacagagagcttctacggctttgaggaggccgacctggacctgatggagatctag

SEQ ID NO: 18561 - DNA, 1488 bp, Artificial Sequence
  Description of Artificial Sequence: Synthetic coding sequence
atgccccagctgctgcagaacatcaatggcatcatcgaggccttccgccgctatgccaggacagagggcaactgcacagccctgaccagaggagagctgaagaggctgctggagcaggagtttgctgatgtgattgtgaagccccatgaccctgccaccgtggatgaggtgctgcggctgctggatgaggaccacacaggcaccgtggagttcaaggagttcctggtgctggtgttcaaggtggcccaggcctgcttcaagaccctgtctgagagcgctgagggcgcctgtggcagccaggagagcggcagcctgcacagcggggccagccaggagctgggggagggccagaggtctggaacagaggtgggccgggccggcaagggccagcactatgagggcagcagccaccggcagagccagcagggcagccggggccagaacagacctggggtgcagacccagggccaggccactggaagtgcctgggtgagcagctatgaccggcaggccgagagccagagccaggagcgcatcagcccccagatccagctgagcggccagacagagcagacccagaaggccggggagggcaagaggaaccagaccacagagatgaggcctgagcggcagccccagacccgggagcaggaccgggcccaccagacaggagagaccgtgacaggcagcggcacccagacccaggccggggccacccagacagtggagcaggacagcagccaccagacaggccgcaccagcaagcagacccaggaggccaccaatgaccagaacagaggaacagagacccacggccagggccgcagccagaccagccaggccgtgactggaggccacgcccagatccaggccggcacccacacccagacccccacccagacagtggagcaggacagcagccaccagacaggcagcaccagcacccagacccaggagagcaccaacggccagaacagaggaacagagatccacggccagggccgcagccagaccagccaggccgtgactggaggccacacccagatccaggccggcagccacacagaaacagtggagcaggacaggagccagacagtgagccacggcggggcccgggagcagggccagacccagacccagcccggcagcggccagcgctggatgcaggtgagcaaccctgaggccggggagaccgtgcctgggggccaggcccagacaggagccagcacagagagcggccggcaggagtggagcagcacccacccccggcgctgtgtgacagagggccagggcgaccggcagcccaccgtggtgggggaggagtgggtggatgaccacagccgggagaccgtcatcctgcggctggaccagggcaacctgcacacctctgtgagcagcgcccagggccaggatgctgcccagagcgaggagaagaggggcatcacagcccgggagctgtacagctacctgcggagcaccaagccctag

SEQ ID NO: 18562 - DNA, 1233 bp, Artificial Sequence
  Description of Artificial Sequence: Synthetic coding sequence
atgaacatgcccagcacccccctggcccccaccaccggcacagccacctgctcctggagcgccagcacctgcaccaccaccaggcctgctgtgcggcccccatccttcccccaccggcccccaggaaatgctgccctgcccagcctgatgcccagccggcccacccaggtggccggccagtgtggggccggcaacaactgggccaagggccactacacagaaggagctgagctgatggagagcgtgatggatgtggtgaggaaggaggccgagagctgtgactgcctgcagggcttccagctgacccacagcctgggcggcggcactggaagtggcatgggcaccctgctgctgagcaagatccgggaggagtacccagaccgcatcatcaacaccttcagcatcctgcccagccccaaggtgtctgacacagtggtggagccctacaatgccaccctgtctgtgcaccagctgattgaaaatgctgatgagaccttctgcatcgacaatgaggccctgtatgacatctgcagcaagaccctgaagctgcccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtggccgagctgacccagcagatgtttgatgccaagaacatgatggccgcctgtgaccccaggcatggccgctacctgacagctgctgccatcttccggggccgcatgcccatgagggaggtggatgagcagatgttcaacatccaggacaagaacagcagctactttgctgactggctgcccaacaacgtgaagacagctgtgtgtgacatccccccccggggcctgaagatgtctgccaccttcatcggcaacaacacagccatccaggagctgttcaagagggtgtctgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggaggaggatgaggagtatgcagaggaggaggtggcctag

SEQ ID NO: 18563 - DNA, 2106 bp, Artificial Sequence
  Description of Artificial Sequence: Synthetic coding sequence
atgggcagcgctgctgatgtgcgcttcagcctgggcaccaccacccacgcccctcctggggtgcaccggcgctacagcgccctgcgggaggagagcgccaaggactgggagaccagccccctgcccggcatgctggccccagctgctggccctgcctttgacagcgaccctgagatcagtgatgtggatgaagatgagcccggcggcctggtgggcagcgcagatgtggtgagccccagcggccacagtgatgcccagaccctggccatgatgctgcaggagcagctggatgccatcaatgaggagatccgcatgatccaggaggagaaggagagcacagagctgcgggcagaggagattgagaccagggtgaccagcggctccatggaggccctgaacctgaagcagctgaggaagaggggcagcatccccaccagcctgacagccctgagcctggccagcgccagcccccccctgagcggccgcagcacccccaagctgaccagccgctctgctgcccaggacctggacaggatgggcgtgatgaccctgcccagcgacctgaggaagcacaggaggaagctgctgagccctgtgtcccgggaggagaaccgggaggacaaggccaccatcaagtgtgagaccagcccccccagcagccccaggaccctgcggctggagaagctgggccacccagccctgagccaggaggagggcaagagcgccctggaggaccagggcagcaaccccagcagcagcaacagcagccaggacagcctgcacaagggggccaagaggaagggcatcaagagcagcatcggccgcctgtttgggaagaaggagaagggccgcctcatccagctgagcagagatggagccaccggccacgtgctgctgacagacagcgagttctccatgcaggagcccatggtgcctgccaagctgggcacccaggccgagaaggaccggcggctgaagaagaagcaccagctgctggaggatgcccggaggaagggcatgccctttgcccagtgggatggccccaccgtggtgtcctggctggagctgtgggtgggcatgcctgcctggtacgtggccgcctgccgggccaacgtgaagagcggggccatcatgtctgccctgagtgacacagagatccagcgggagatcggcatcagcaatgccctgcaccggctgaagctgcggctggccatccaggagatggtgtccctgaccagccccagcgccccacccaccagcaggaccagcagtggaaatgtgtgggtgacccatgaggagatggagaccctggagaccagcaccaagacagattctgaggagggctcctgggcccagaccctggcctacggggacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagaagaggcgggaggagagccagcacgagatcaaggatgtgctggtgtggaccaatgaccaggtggtgcactgggtgcagagcatcggcctgcgggactatgccggcaacctgcacgagagcggcgtgcatggagccctgctggccctggatgaaaattttgaccacaacaccctggccctgatcctgcagatccccacccagaacacccaggcccggcaggtgatggagcgggagttcaacaacctgctggccctgggcacagacaggaagctggatgatggagatgacaaggtgttccggcgggcccccagctggaggaagcgcttccggccccgggagcaccacggccggggcggcatgctgagcgccagcgctgagaccctgcctgctggcttccgggtgtccaccctgggcaccctgcagcccccaccagccccacccaagaagatcatgcctgaggcccacagccactacctgtatggccacatgctgagcgccttccgggactag

SEQ ID NO: 18564 - DNA, 1029 bp, Artificial Sequence
  Description of Artificial Sequence: Synthetic coding sequence
atggcctctgtgaccagggctgtgtttggagagctgcccagcggcggcggcaccgtggagaagttccagctgcagagcgacctgctgcgggtggacatcatctcctggggctgcaccatcacagccctggaggtgaaggaccggcagggccgggccagtgatgtggtgctgggctttgctgagctggagggctacctgcagaagcagccctactttggagctgtgattggccgggtggccaacagaattgccaagggcaccttcaaggtggatggcaaggagtaccacctggccatcaacaaggagcccaacagcctgcatggaggagtgcggggctttgacaaggtgctgtggaccccccgggtgctgagcaatggagtgcagttcagccgcatcagcccagatggagaggagggctacccaggagagctgaaggtgtgggtgacctacaccctggatggaggagagctgattgtgaactaccgggcccaggccagccaggccacccctgtgaacctgaccaaccacagctacttcaacctggccggccaggccagccccaacatcaatgaccacgaggtgaccatcgaggccgacacctacctgcctgtggatgagaccctcatccccactggagaggtggcccctgtgcagggcacagcctttgacctgaggaagcctgtggagctgggcaagcacctgcaggacttccacctgaatggatttgaccacaacttctgcctgaagggcagcaaggagaagcacttctgtgcccgggtgcaccacgccgccagcggccgggtgctggaggtgtacaccacccagcccggggtgcagttctacacaggcaacttcctggatggcaccctgaagggcaagaatggagctgtgtaccccaagcacagcggcttctgcctggagacccagaactggccagatgctgtgaaccagccccgcttcccccctgtgctgctgcggcctggagaggagtatgaccacaccacctggttcaagttctctgtggcctag

SEQ ID NO: 18565 - DNA, 2295 bp, Artificial Sequence
  Description of Artificial Sequence: Synthetic coding sequence
atgtctgacacccggcggcgggtgaaggtgtacaccctgaatgaagatcggcagtgggatgaccggggcaccggccacgtgagcagcacctacgtggaggagctgaagggcatgagcctgctggtgcgggcagagagtgatggcagcctgctgctggagagcaagatcaaccccaacacagcctaccagaagcagcaggacaccctcatcgtgtggagcgaggccgagaactatgacctggccctgtccttccaggagaaggccggctgtgatgagatctgggagaagatctgccaggtgcagggcaaggaccccagcgtggaggtgacccaggacctgattgatgaaagtgaggaggagagatttgaggagatgcctgagaccagccacctgattgacctgcccacctgtgagctgaacaagctggaggagattgctgacctggtgacctctgtgctgagcagccccatccggcgggagaagctggccctggccctggagaatgaaggctacatcaagaagctgctgcagctgttccaggcctgtgagaacctggagaacacagagggcctgcaccacctgtatgagatcatccggggcatcctcttcctgaacaaggccaccctgtttgaggtgatgttcagtgatgagtgcatcatggatgtggtgggctgcctggagtatgaccctgccctggcccagcccaagaggcaccgggagttcctgaccaagacagccaagttcaaggaggtgatccccatcacagattctgagctgcggcagaagatccaccagacctacagagtgcagtacatccaggacatcatcctgcccaccccatctgtgtttgaggagaacttcctgagcaccctgaccagcttcatcttcttcaacaaggtggagatcgtgtccatgctgcaggaggatgagaagttcctgtctgaggtgtttgcccagctgacagatgaggccacagatgatgacaagaggcgggagctggtgaacttcttcaaggagttctgtgccttcagccagaccctgcagccccagaacagagatgccttcttcaagaccctggccaagctgggcatcctgcctgccctggagatcgtgatgggcatggatgacctgcaggtgcgctctgctgccacagacatcttctcctacctggtggagttcagccccagcatggtgcgggagtttgtgatgcaggaggcccagcagagtgatgatgacatcctgctgatcaacgtggtgattgagcagatgatctgtgacacagatcctgagctgggcggcgctgtgcagctgatgggcctgctgcggaccctgattgatcctgagaacatgctggccaccaccaacaagacagagaagtctgagttcctgaacttcttctacaaccactgcatgcacgtgctgacagcccccctgctgaccaacaccagcgaggacaagtgtgagaaggacaacatcgtgggcagcaacaagaacaacaccatctgccctggggccctgcgcttcatgaggcgcatcatcggcctgaaggatgagttctacaaccgctacatcaccaagggcaacctgtttgagcccgtcatcaatgccctgctggacaatggcacccgctacaacctgctgaacagcgctgtgattgagctgtttgagttcatccgggtggaggacatcaagagcctgacagcccacatcgtggagaacttctacaaggccctggagagcattgaatatgtgcagaccttcaagggcctgaagaccaagtatgagcaggagaaggaccggcagaaccagaagctgaacagcgtgcccagcatcctgcggagcaaccgcttcagaagagatgccaaggccctggaggaggatgaggagatgtggttcaatgaagatgaggaggaggagggcaaggctgtggtggcccctgtggagaagcccaagccagaagatgacttcccagacaactatgagaagttcatggagaccaagaaggccaaggagagcgaggacaaggagaacctgcccaagaggaccagccctgggggcttcaagttcaccttcagccacagcgccagcgctgccaacggcaccaacagcaagtctgtggtggcccagatccccccagccaccagcaatggcagcagcagcaagaccaccaacctgcccacctctgtgacagccaccaagggcagcctggtgggcctggtggactacccagatgatgaggaggaggatgaggaggaggagagcagccccaggaagaggccccggctgggcagctag

SEQ ID NO: 18566 - DNA, 231 bp, Artificial Sequence
  Description of Artificial Sequence: Synthetic coding sequence
atgagcaaggcccaccccccagagctgaagaagttcatggacaagaagctgagcctgaagctgaatggaggccgccacgtgcagggcatcctgcggggctttgaccccttcatgaacctggtgattgatgaatgtgtggagatggccaccagcggccagcagaacaacatcggcatggtggtgatccggggcaacagcatcatcatgctggaggccctggagcgggtgtag

SEQ ID NO: 18567 - DNA, 528 bp, Artificial Sequence
  Description of Artificial Sequence: Synthetic coding sequence
atgcagctgacccaccagctggacctcttccctgagtgccgggtgaccctgctgctcttcaaggatgtgaagaatgctggggacctgcggaggaaggccatggagggcaccattgatggcagcctcatcaaccccaccgtcatcgtggaccccttccagatcctggtggccgccaacaaggctgtgcacctgtacaagctgggcaagatgaagaccaggaccctgagcacagagatcatcttcaacctgagccccaacaacaacatcagcgaggccctgaagaagtttggcatcagcgccaatgacaccagcatcctgattgtgtacatcgaggagggggagaagcagatcaaccaggagtacctgatcagccaggtggagggccaccaggtgtccctgaagaacctgcctgagatcatgaacatcacagaggtgaagaagatctacaagctgagcagccaggaggagagcatcggcaccctgctggatgccatcatctgcaggatgagcaccaaggatgtgctgtag

SEQ ID NO: 18568 - DNA, 909 bp, Artificial Sequence
  Description of Artificial Sequence: Synthetic coding sequence
atggccctgcatgacatggaggacttcacctttgatggcaccaagaggctgtctgtgaactacgtgaagggcatcctgcagcccacagacacctgtgacatctgggacaagatctggaacttccaggccaagccagatgacctgctgatcagcacctaccccaaggccggcaccacctggacccaggagatcgtggagctgatccagaatgaaggagatgtggagaagagcaagagggcccccacccaccagcgcttccccttcctggagatgaagatccccagcctgggcagcggcctggagcaggcccacgccatgcccagcccccgcatcctgaagacccacctgcccttccacctgctgccccccagcctgctggagaagaactgcaagatcatctacgtggccaggaaccccaaggacaacatggtgtcctactaccacttccagaggatgaacaaggccctgcctgcccctggcacctgggaggagtactttgagaccttcctggccggcaaggtgtgctggggctcctggcatgagcacgtgaagggctggtgggaggccaaggacaagcaccgcatcctgtacctgttctatgaggacatgaagaagaaccccaagcatgagatccagaagctggccgagttcatcggcaagaagctggatgacaaggtgctggacaagatcgtgcactacaccagctttgatgtgatgaagcagaaccccatggccaactacagcagcatcccagctgagatcatggaccacagcatcagccccttcatgaggaaaggagctgtgggggactggaagaagcacttcaccgtggcccagaatgaaagatttgatgaggactacaagaagaagatgacagacacccggctgaccttccacttccagttctag

SEQ ID NO: 18569 - DNA, 2892 bp, Artificial Sequence
  Description of Artificial Sequence: Synthetic coding sequence
atgtggtgcctgcactgcaacagcgagaggacccagagcctgctggagctggagctggacagcggcgtggagggggaggcccccagcagcgagaccggcaccagcctggacagccccagcgcctacccccagggccccctggtgcccggcagcagcctgagcccagaccactatgagcacacctctgtgggcgcctacggcctgtacagcggccccccaggccagcagcagaggacccggcggcccaagctgcagcacagcaccagcatcctgaggaagcaggccgaggaggaggccatcaagaggagccgcagcctgtctgagagctatgagctgagcagtgacctgcaggacaagcaggtggagatgctggagaggaaatatggaggccgcctggtgaccaggcatgctgcccggaccatccagacagccttccggcagtaccagatgaacaagaactttgagcggctgcggagctccatgtctgaaaataggatgagccgccgcatcgtgctgagcaacatgaggatgcagttctcctttgagggccctgagaaggtgcacagcagctactttgagggcaagcaggtgtctgtgaccaatgatggcagccagctgggcgccctggtgtccccagaatgtggggacctgtctgagcccaccaccctgaagagccctgcccccagcagtgactttgctgatgccatcacagagctggaggatgccttcagccggcaggtgaagagcctggccgagagcattgatgatgccctgaactgccgcagcctgcacacagaggaggccccagccctggatgctgcccgggcccgggacacagagccccagacagccctgcacggcatggaccacaggaagctggatgagatgacagccagctacagtgatgtgaccctgtacattgatgaggaggagctgagcccccccctgcccctgagccaggccggggaccggcccagcagcacagaaagtgacctgcggctgcgggccggcggggccgccccagactactgggccctggcccacaaggaggacaaggctgacacagacaccagctgccgcagcacccccagcctggagcggcaggagcagaggctgcgggtggagcacctgcccctgctgaccatcgagccccccagcgacagctctgtggacctgagtgacagaagtgagcggggcagcctgaagaggcagagcgcctatgaaagaagcctgggcggccagcagggcagccccaagcacggcccccacagcggggcccccaagagcctgccccgggaggagcctgagctgcggcccaggcctccccggcccctggacagccacctggccatcaatggcagcgccaaccggcagagcaagtctgagagtgactacagtgatggagacaatgacagcatcaacagcaccagcaacagcaatgacaccatcaactgcagcagcgagagcagcagccgggacagcctgcgggagcagaccctgagcaagcagacctaccacaaggaggccaggaacagctgggacagccctgccttcagcaatgatgtgatcaggaagaggcactaccgcatcggcctgaacctcttcaacaagaagccagagaagggcgtgcagtacctgattgagcggggctttgtgcctgacacccctgtgggcgtggcccacttcctgctgcagaggaagggcctgagccggcagatgattggagagttcctgggcaaccggcagaagcagttcaacagagatgtgctggactgtgtggtggatgagatggacttcagcaccatggagctggatgaggccctgaggaagttccaggcccacatccgggtgcagggcgaggcccagaaggtggagcggctcatcgaggccttcagccagcgctactgcatctgcaaccctggggtggtgcggcagttcagaaatccagacaccatcttcatcctggcctttgccatcatcctgctgaacacagacatgtacagccccaacgtgaagccagagaggaagatgaagctggaggacttcatcaagaacctgcggggcgtggatgatggagaggacatcccccgggagatgctgatgggcatctatgaaagaatcaggaagcgggagctgaagaccaatgaagaccacgtgtcccaggtgcagaaggtggagaagctgattgtgggcaagaagcccatcggcagcctgcaccctggcctgggctgtgtgctgagcctgccccaccggcggctggtgtgctactgccgcctgtttgaggtgcctgaccccaacaagccccagaagctgggcctgcaccagcgggagatcttcctgttcaatgacctgctggtggtgaccaagatcttccagaagaagaagaacagcgtgacctacagcttccggcagagcttcagcctgtatggcatgcaggtgctgctgtttgagaaccagtactacccaaatggcatccggctgaccagctctgtgcctggagctgacatcaaggtgctgatcaacttcaatgcccccaacccccaggacaggaagaagttcacagatgacctgcgggagagcattgctgaggtgcaggagatggagaagcaccgcatcgagagcgagctggagaagcagaagggcgtggtgcggcccagcatgagccagtgcagcagcctgaagaaggagagcggaaatggcaccctgagccgggcctgcctggatgacagctatgccagcggggagggcctgaagaggtctgccctgagcagcagcctgcgggacctgtctgaggccggcaagagaggaagaagaagcagcgctggcagcctggagagcaatgtggagttccagccctttgagcccctgcagcccagcgtgctgtgcagctag

SEQ ID NO: 18570 - DNA, 711 bp, Artificial Sequence
  Description of Artificial Sequence: Synthetic coding sequence
atggccagcctggacagagtgaaggtgctggtgctgggggacagcggcgtgggcaagagcagcctggtgcacctgctgtgccagaaccaggtgctgggcaaccccagctggacagtgggctgcagcgtggatgtgcgggtgcatgactacaaggagggcaccccagaggagaagacctactacatcgagctgtgggatgtgggcggctctgtgggcagcgccagctctgtgaagagcaccagggctgtgttctacaacagcgtgaatggcatcatctttgtgcatgacctgaccaacaagaagagcagccagaacctgcggcgctggagcctggaggccctgaacagagacctggtgcccactggagtgctggtgaccaatggagactatgaccaggagcagtttgctgacaaccagatccccctgctggtgattggcaccaagctggaccagatccacgagaccaagagacatgaggtgctgaccaggacagccttcctggccgaggacttcaaccctgaggagatcaacctggactgcaccaacccccgctacctggccgccggcagcagcaatgctgtgaagctgagccgcttctttgacaaggtgattgagaagcgctacttcctgcgggagggcaaccagatccctggcttcccagacaggaagagatttggagctggcaccctgaagagcctgcactatgactag

SEQ ID NO: 18571 - DNA, 2784 bp, Artificial Sequence
  Description of Artificial Sequence: Synthetic coding sequence
atgcagagcatcctgtaccacggcctcatccgggaccaggcctgccggcggcagacagactactggcagtttgtgaaggacatccgctggctgagcccccacagcgccctgcacgtggagaagttcatctctgtgcatgaaaatgaccagagcagcgcagatggagccagcgagagagctgtggccgagctgtggctgcagcacagcctgcagtaccactgcctgagcgcccagctgcggcccctgctgggggaccggcagtacatcaggaagttctacacagatgctgccttcctgctgagtgatgcccacgtgacagccatgctgcagtgcctggaggccgtggagcagaacaacccccggctgctggcccagattgatgcctccatgtttgccaggaagcatgagagccccctgctggtgaccaagagccagagcctgacagccctgcccagcagcacctacaccccacccaacagctatgcccagcacagctacttcggcagcttcagcagcctgcaccagagcgtgcccaacaacggcagcgagcggcgcagcaccagcttccccctgagcggcccccccaggaagccccaggagagccggggccacgtgtccccagctgaggaccagaccatccaggcccctcctgtgtctgtgtctgccctggcccgggacagccccctgaccccaaatgagatgagcagcagcaccctgaccagccccatcgaggcctcctgggtgagcagccagaatgacagccctggagatgccagcgagggccctgagtacctggccatcggcaacctggacccccggggccgcacagccagctgccagagccacagcagcaatgctgagagcagcagcagcaacctcttcagcagcagcagcagccagaagccagacagcgctgccagcagcctgggggaccaggagggcggcggggagagccagctgagctctgtgctgcggcgcagcagcttcagcgagggccagaccctgactgtgaccagcggggccaagaagagccacatccgcagccacagcgacaccagcatcgccagcagaggagcccctgggggccccaggaacatcaccatcatcgtggaggaccccatcgccgagagctgcaatgacaaggccaagctgcggggccccctgccctacagcggccagagcagcgaggtgtccacccccagcagcctgtacatggagtatgaaggaggccgctacctgtgcagcggggagggcatgttcagaagacccagcgagggccagagcctcatctcctacctgtctgagcaggactttggcagctgtgccgacctggagaaggaaaatgcccacttcagcatcagcgagagcctgattgctgccatcgagctgatgaagtgcaacatgatgagccagtgcctggaggaggaggaggtggaggaggaggacagcgaccgggagatccaggagctgaagcagaagatccggctgcggcggcagcagatccgcaccaagaacctgctgcccatgtaccaggaggccgagcacggcagcttccgggtgaccagcagcagcagccagttcagcagccgggacagcgcccagctgagtgacagcggcagcgcagatgaggtggatgaatttgagatccaggatgctgacatcagaagaaacacagccagcagcagcaagagctttgtgagcagccagagcttcagccactgcttcctgcacagcaccagcgctgaggccgtggccatgggcctgctgaagcagtttgagggcatgcagctgcctgctgccagcgagctggagtggctggtgcctgagcatgatgccccccagaagctgctgcccatcccagacagcctgcccatcagcccagatgatggccagcacgccgacatctacaagctgcgcatccgggtgcggggcaacctggagtgggccccaccccggccccagatcatcttcaacgtgcacccagcccccaccaggaagattgctgtggccaagcagaactaccgctgtgccggctgcggcatcagaacagatcctgactacatcaagaggctgcgctactgtgagtacctgggcaagtacttctgccagtgctgccatgaaaatgcccagatggccatccccagccgggtgctgaggaagtgggacttcagcaagtactacgtgagcaacttcagcaaggacctgctgatcaagatctggaatgaccccctcttcaacgtgcaggacatcaacagcgccctgtacaggaaggtgaagctgctgaaccaggtgcggctgctgcgggtgcagctgtgccacatgaagaacatgttcaagacctgccgcctggccaaggagctgctggacagctttgacacagtgcccggccacctgacagaggacctgcacctgtacagcctgaatgacctgacagccaccaggaaaggagagctgggcccccggctggccgagctgacccgggccggggccacccacgtggagcgctgcatgctgtgccaggccaagggcttcatctgtgagttctgccagaatgaagatgacatcatcttcccctttgagctgcacaagtgcaggacctgtgaggagtgcaaggcctgctaccacaaggcctgcttcaagagcggcagctgcccccgctgtgagcggctgcaggcccggcgggaggccctggcccggcagagcctggagagctacctgagtgactatgaggaggagcctgctgaggccctggccctggaggccgctgtgctggaggccacctag

SEQ ID NO: 18572 - DNA, 300 bp, Artificial Sequence
  Description of Artificial Sequence: Synthetic coding sequence
atggccagcgccagcgcccggggcaaccaggacaaggatgcccacttccccccacccagcaagcagagcctgctcttctgccccaagagcaagctgcacatccacagagctgagatcagcaagatcatgagggagtgccaggaggagagcttctggaagagggccctgcccttcagcctggtgtccatgctggtgacccagggcctggtgtaccagggctacctggccgccaacagcagatttggcagcctgcccaaggtggccaggacagccagcctgcctgtgagaaatgccaagtag

SEQ ID NO: 18573 - DNA, 786 bp, Artificial Sequence
  Description of Artificial Sequence: Synthetic coding sequence
atggtggtgctgtctgtgcctgctgaggtgaccgtcatcctgctggacatcgagggcaccaccacccccatcgcctttgtgaaggacatcctcttcccctacattgaagaaaatgtgaaggagtacctgcagacccactgggaggaggaggagtgccagcaggatgtgtccctgctgaggaagcaggccgaggaggatgcccacctggatggagctgtgcccatcccagctgccagcggaaatggagtggatgacctgcagcagatgatccaggccgtggtggacaacgtgtgctggcagatgagcctggacaggaagaccacagccctgaagcagctgcagggccacatgtggagggctgccttcaccgctggccgcatgaaggccgagttctttgctgatgtggtgcctgctgtgaggaagtggagggaggccggcatgaaggtgtacatctacagcagcggctctgtggaggcccagaagctgctgtttggccacagcacagaaggagacatcctggagctggtggatggccactttgacaccaagattggccacaaggtggagagcgagagctacaggaagattgctgacagcatcggctgcagcaccaacaacatcctcttcctgacagatgtgacccgggaggccagcgctgctgaggaggctgatgtgcacgtggccgtggtggtgcggcctggaaatgccggcctgacagatgatgagaagacctactacagcctcatcaccagcttcagcgagctgtacctgcccagcagcacctag

SEQ ID NO: 18574 - DNA, 1188 bp, Artificial Sequence
  Description of Artificial Sequence: Synthetic coding sequence
atggctgaagatggcctgcccaagatctacagccaccccccaacagagagcagcaagacccccacagctgccaccatcttcttcggggctgacaatgccatccccaagtctgagaccaccatcaccagcgagggggaccacgtgacctctgtgaatgagtacatgctggagagtgacttcagcaccaccacagacaacaagctgacagccaagaaggagaagctgaagtcagaagatgacatgggcacagacttcatcaagagcaccacccacctgcagaaggagatcaccagcctgaccggcaccaccaacagcatcacccgggacagcatcacagagcacttcatgcctgtgaagattggcaacatcagcagccctgtgaccaccgtgtccctgattgacttcagcacagacatcgccaaggaggacatcctgctggccaccatcgacacaggagatgctgagatcagcatcaccagcgaggtgtctggcaccctgaaggacagcagcgctggggtggctgatgccccagccttccccaggaagaaggatgaggccgacatgagcaactacaacagcagcatcaagagcaatgtgcctgcagatgaggccgtgcaggtgacagacagcaccatccctgaggccgagatccccccagcccctgaggagagcttcaccaccatcccagacatcacagccctggaggaggagaagatcacagaaattgacctgtctgtgctggaggatgacaccagcgctgtggccaccctgacagacagtgatgagaagttcatcaccgtgtttgagctgaccaccagcgctgagaaggacaaggacaagcgggaggacaccctgctgacagatgaggagaccacagagggcgccagcatctggatggagcgggacacagccaatgaagctgagacccacagcgtgctgctgacagctgtggagagccgctatgactttgtggtgcctgccagcatcgccaccaacctggtggaggagagcagcacagaggaggacctgtctgaaacagacaacacagaaacagtgcccaagatcacagagcccttcagcggcaccacctctgtgctggacaccccagactacaaggaggacaccagcaccacagaaacagacatctttgagctgctgaaggaggagccagatgagttcatgatctag

SEQ ID NO: 18575 - DNA, 921 bp, Artificial Sequence
  Description of Artificial Sequence: Synthetic coding sequence
atgtacttctgctggggcgctgacagccgggagctgcagaggagaagaacagctggcagccctggagctgagctgctgcaggccgccagcggggagcggcacagcctgctgctgctgaccaaccaccgggtgctgagctgtggggacaacagccggggccagctgggcagaagaggagcccagagaggagagctgcctgagcccatccaggccctggagaccctcatcgtggacctggtgtcctgtgggaaggagcacagcctggccgtgtgccacaagggccgggtgtttgcctggggcgccggcagcgagggccagctgggcattggagagttcaaggagatctccttcacccccaagaagatcatgaccctgaatgacatcaagatcatccaggtgtcctgtggccactaccacagcctggccctgagcaaggacagccaggtgttctcctggggcaagaacagccacggccagctgggcctgggcaaggagttccccagccaggccagcccccagagggtgcgcagcctggagggcatccccctggcccaggtggccgccggcggggcccacagctttgccctgagcctgtgtggcaccagctttggctggggcagcaacagcgctggccagctggccctgagcggcagaaatgtgcctgtgcagagcaacaagcccctgtctgtgggcgccctgaagaacctgggcgtggtgtacatcagctgtggagatgcccacacagctgtgctgacccaggacggcaaggtgttcaccttcggggacaacagaagtggccagctgggctacagccccaccccagagaagaggggcccccagctggtggagagaattgatggcctggtgtcccagattgactgtggcaggaacagcaagcacggcttcatgaccttcttctag

SEQ ID NO: 18576 - DNA, 909 bp, Artificial Sequence
  Description of Artificial Sequence: Synthetic coding sequence
atgggcaactgctgctggacccagtgcttcggcctgctgaggaaggaggccggccgcctgcagagggtgggcggcggcggcggcagcaagtacttccgcacctgcagcagaggagagcacctgaccattgaatttgagaacctggtggagagtgatgaaggagagagccctggcagcagccaccggcccctgacagaggaggagatcgtggacctgcgggagcggcactatgacagcattgctgagaagcagaaggacctggacaagaagatccagaaggagctggccctgcaggaggagaagctgcggctggaggaggaggccctgtatgctgcccagcgggaggccgcccgggccgccaagcagaggaagctgctggagcaggagcggcagagaattgtgcagcagtaccaccccagcaacaacggggagtaccagagcagcggcccagaagatgactttgagagctgcctgaggaacatgaagagccagtatgaggtgttccgcagcagccggctgagcagtgatgccaccgtgctgacccccaacacagagagcagctgtgacctgatgaccaagaccaagagcaccagcggaaatgatgacagcaccagcctggacctggagtgggaggatgaggagggcatgaacaggatgctgcccatgagggagaggagcaagacagaggaggacatcctgcgggccgccctgaagtacagcaacaagaagacaggcagcaaccccaccagcgccagtgatgacagcaatggcctggagtgggagaatgactttgtgtctgctgagatggatgacaatggaaattctgagtacagcggctttgtgaaccctgtgctggagctgagtgacagcggcatccgccacagcgacacagaccagcagaccaggtag

SEQ ID NO: 18577 - DNA, 1641 bp, Artificial Sequence
  Description of Artificial Sequence: Synthetic coding sequence
atggccaccctggtggtgaacaagctgggcgccggcgtggacagcggccggcagggcagccggggcacagctgtggtgaaggtgctggagtgtggggtgtgtgaagatgtgttcagcctgcagggcgacaaggtgccccggctgctgctgtgtggccacacagtgtgccacgactgcctgacccggctgcccctgcacggccgggccatccgctgcccctttgaccggcaggtgacagacctgggggacagcggcgtgtggggcctgaagaagaactttgccctgctggagctgctggagcggctgcagaatggccccatcggccagtacggggctgctgaggagagcatcggcatcagcggggagagcatcatccgctgtgatgaagatgaggcccacctggcctctgtgtactgcaccgtgtgtgccacccacctgtgcagtgaatgttcccaggtgacccacagcaccaagaccctggccaagcaccggcgggtgcccctggccgacaagccccatgagaagaccatgtgcagccagcaccaggtgcacgccatcgagtttgtgtgcctggaggagggctgccagaccagccccctgatgtgctgcgtgtgcaaggagtatggcaagcaccagggccacaagcacagcgtgctggagcctgaggccaaccagatccgggccagcatcctggacatggcccactgcatccgcaccttcacagaggagatcagtgactacagcaggaagctggtgggcatcgtgcagcacatcgagggcggggagcagatcgtggaggatggcatcggcatggcccacacagagcacgtgcccggcacagcagaaaatgcccggagctgcatccgggcctacttctatgacctgcacgagaccctgtgccggcaggaggagatggccctgtctgtggtggatgcccacgtgcgggagaagctgatctggctgcggcagcagcaggaggacatgaccatcctgctgtctgaggtgtctgctgcctgcctgcactgtgagaagaccctgcagcaggatgactgccgggtggtgctggccaagcaggagatcacccggctgctggagaccctgcagaagcagcagcagcagttcacagaggtggccgaccacatccagctggatgccagcatccctgtgaccttcaccaaggacaacagagtgcacatcggccccaagatggagatccgggtggtgaccctgggcctggatggagctgggaagaccaccatcctcttcaagctgaagcaggatgagttcatgcagcccatccccaccatcggcttcaacgtggagaccgtggagtacaagaacctgaagttcaccatctgggatgtgggcggcaagcacaagctgcggcccctgtggaagcactactacctgaacacccaggccgtggtgtttgtggtggacagcagccaccgggaccgcatcagcgaggcccacagcgagctggccaagctgctgacagagaaggagctgagagatgccctgctgctgatctttgccaacaagcaggatgtggccggggccctgtctgtggaggagatcacagagctgctgagcctgcacaagctgtgctgcggccgcagctgcttcagtgacaacatgtag

SEQ ID NO: 18578 - DNA, 609 bp, Artificial Sequence
  Description of Artificial Sequence: Synthetic coding sequence
atggctgtgcctgctgccctgatcctgcgggagagccccagcatgaagaaggctgtgtccctcatcaatgccatcgacaccggccgcttcccccggctgctgacccgcatcctgcagaagctgcacctgaaggccgagagcagcttcagcgaggaggaggaggagaagctgcaggccgccttcagcctggagaagcaggacctgcacctggtgctggagaccatctccttcatcctggagcaggccgtgtaccacaacgtgaagccagctgccctgcagcagcagctggagaacatccacctgcggcaggacaaggccgaggcctttgtgaacacctggagctccatgggccaggagaccgtggagaagttccggcagaggatcctggccccctgcaagctggagaccgtgggctggcagctgaacctgcagatggcccacagcgcccaggccaagctgaagagcccccaggccgtgctgcagctgggcgtgaacaatgaagacagcaagagcctggagaaggtgctggtggagttcagccacaaggagctgtttgacttctacaacaagctggagaccatccaggcccagctggacagcctgacctag

SEQ ID NO: 18579 - DNA, 1521 bp, Artificial Sequence
  Description of Artificial Sequence: Synthetic coding sequence
atggaggccgacatcatcaccaacctgcgctgccgcctgaaggaggccgaggaggagcggctgaaggccgcccagtatggcctgcagctggtggagagccagaatgagctgcagaaccagctggacaagtgcagaaatgagatgatgaccatgacagagagctatgagcaggagaagtacaccctgcagcgggaggtggagctgaagagcaggatgctggagagcctgagctgtgaatgtgaggccatcaagcagcagcagaagatgcacctggagaagctggaggagcagctgagccgcagccacggccaggaggtgaatgagctgaagaccaagattgagaagctgaaggtggagctggatgaggcccggctgtctgagaagcagctgaagcaccaggtggaccaccagaaggagctgctgagctgcaagtctgaggagctgcgggtgatgtctgagcgggtgcaggagagcatgagcagcgagatgctggccctgcagatcgagctgacagagatggagagcatgaaggtgaagtaccagagcctgaagaagcagaatgtgttcaaccgggagcagatgcagaggatgaagctgcagatcgccaccctgctgcagatgaagggcagccagacagaatttgagcagcaggagcggctgctggccatgctggagcagaagaatggagagatcaagcacctgctgggggagatccggaacctggagaagttcaagaacctgtatgacagcatggagagcaagcccagcgtggacagcggcaccctggaggacaacacctactacacagacctgctgcagatgaagctggacaacctgaacaaggagattgagagcaccaagggggagctgagcatccagaggatgaaggccctgtttgagagccagagggccctggacattgaaaggaagctgtttgccaatgaacgctgcctgcagctgtctgagagcgagaacatgaagctgcgggccaagctggatgagctgaagctgaagtatgagcctgaggagaccgtggaggtgcctgtgctgaagaagagaagagaggtgctgcctgtggacatcaccacagccaaggatgcctgtgtgaacaacagcgccctgggcggggaggtgtaccgcctgcccccccagaaggaggagacccagagctgccccaacagcctggaggacaacaacctgcagctggagaagtctgtgtccatctacacccctgtggtgtccctgagcccccacaagaacctgcctgtggacatgcagctgaagaaggagaagaagtgtgtgaagctgattggagtgcctgcagatgctgaggccctgtctgagaggagcggcaacacccccaacagcccccggctggccgctgagagcaagctgcagacagaggtgaaggagggcaaggagaccagcagcaagctggagaaggagacctgcaagaagctgcaccccatcctgtatgtgagcagcaagagcaccccagagacccagtgcccccagcagtag

SEQ ID NO: 18580 - DNA, 1842 bp, Artificial Sequence
  Description of Artificial Sequence: Synthetic coding sequence
atggccaccatcccagactggaagctgcagctgctggcccggcggcggcaggaggaggcctctgtgcggggccgggagaaggccgagcgggagcggctgagccagatgcctgcctggaagaggggcctgctggagaggagaagagccaagctgggcctgagccctggagagcccagccctgtgctgggcaccgtggaggccggccccccagaccctgatgaatctgctgtgctgctggaggccatcggccctgtgcaccagaaccgcttcatccggcaggagcggcagcagcagcagcagcagcagcagaggtctgaggagctgctggccgagaggaagccaggccccctggaggcccgggagcggcggcccagccctggagagatgagggaccagagccccaagggccgggagagccgggaggagcggctgagcccccgggagacccgggagcggcggctgggcatcggcggggcccaggagctgagcctgcggcccctggaggcccgggactggaggcagagccctggagaggtgggggacaggagcagccggctgtctgaggcctggaagtggaggctgagccctggagagaccccagagaggagcctgcggctggccgagagccgggagcagagccccaggaggaaggaggtggagagccggctgagccctggagagagcgcctaccagaagctgggcctgacagaggcccacaagtggaggccagacagccgggagagccaggagcagagcctggtgcagctggaggccacagagtggaggctgcggtctggagaggagcggcaggactacagtgaagaatgtggcaggaaggaggagtggcctgtgcctggggtggcccccaaggagacagctgagctgtctgagaccctgacccgggaggcccagggcaacagcagcgctggggtggaggccgctgagcagaggcctgtggaggatggagagcggggcatgaagcccacagagggctggaagtggaccctgaacagcggcaaggcccgggagtggaccccccgggacatcgaggcccagacccagaagccagagcccccagagagcgctgagaagctgctggagagccctggggtggaggccggggagggggaggccgagaaggaggaggccggggcccagggccggcccctgcgggccctgcagaactgctgcagcgtgcccagccccctgcccccagaagatgctggcaccggcggcctgcggcagcaggaggaggaggccgtggagctgcagcccccacctccagcccccctgagccccccacctccagcccccacagccccccagcccccaggggaccccctgatgagccgcctcttctacggcgtgaaggccggccctggggtgggcgccccccggcgcagcggccacaccttcaccgtgaaccccaggagatctgtgcccccagccaccccagccacccccaccagccctgccaccgtggatgctgctgtgcctggagctgggaagaagcgctaccccacagctgaggagatcctggtgctgggcggctacctgcggctgagccgcagctgcctggccaagggcagccctgagcggcaccacaagcagctgaagatctccttcagcgagacagccctggagaccacctaccagtaccccagcgagagctctgtgctggaggagctgggccctgagcctgaggtgcccagcgcccccaaccccccagctgcccagccagatgatgaggaggatgaggaggagctgctgctgctgcagcctgagctgcagggcggcctgcggaccaaggccctgattgtggatgagagctgcagaagatag

SEQ ID NO: 18581 - DNA, 654 bp, Artificial Sequence
  Description of Artificial Sequence: Synthetic coding sequence
atgtcctggacctgcccccgctgccagcagcctgtgttctttgctgagaaggtgagcagcctgggcaagaactggcaccgcttctgcctgaagtgtgagcgctgccacagcatcctgagccctgggggccatgctgagcacaacggccggccctactgccacaagccctgctacggggccctgtttggcccccggggcgtgaacattggaggagtgggcagctacctgtacaacccccccacccccagccctggctgcaccacccccctgagccccagcagcttcagccccccccggcccaggacaggcctgccccagggcaagaagagccccccccacatgaagaccttcaccggggagaccagcctgtgccccggctgtggggagcctgtgtactttgctgagaaggtgatgagcctgggcaggaactggcaccggccctgcctgcgctgccagcgctgccacaagaccctgacagctggcagccacgccgagcatgatggagtgccctactgccacgtgccctgctacggctacctgtttggccccaagggcggccagccccaccccaggcactgggatggcatgtacatgcctgaggtgtggcacgtgcacggcctgtgggtgtgtgtggacaacttcccctgtggctag

SEQ ID NO: 18582 - DNA, 1503 bp, Artificial Sequence
  Description of Artificial Sequence: Synthetic coding sequence
atgaaccagaggagaagtgagagccggcccggcaaccaccggctgcaggcctatgcagagcctggaaaaggagacagcggcggggccggccccctgagcggcagcgcccggcggggccggggcggcggcggggccatccgggtgagaagaccctgctggagcggcggggccggccggggcggcggccctgcctgggccgtgcggctgcccaccgtgacagctggctggacctggccagccctgcggaccctgagcagcctgcgggccggccccagcgagccccacagccctggaagaagaccaccccgggccggccggcccctgtgccaggccgacccccagcccgggaaggccgcccggcgcagcctggagccagaccctgcccagacaggccccaggcctgcccgggccgccggcatgtctgaggccaggaaaggaccagatgaggccgaggagagccagtatgattctggaattgagagcctgcggagcctgcggagcctgcctgagagcaccagcgccccagccagcggccccagtgatggcagcccccagccctgcacccaccccccaggccctgtgaaggagccccaggagaaggaggatgctgatggagagagagctgacagcacctacggcagcagcagcctgacctacaccctgagcctgctgggcggccctgaggccgaggaccctgccccccggctgcccctgccccacgtgggcgccctgagcccccagcagctggaggccctgacctacatcagtgaagatggagacaccctggtgcacctggccgtcatccacgaggccccagctgtgctgctgtgctgcctggccctgctgccccaggaggtgctggacatccagaacaacctgtaccagacagccctgcacctggccgtgcacctggaccagcctggagctgtgcgggccctggtgctgaagggggccagccgggccctgcaggacagacatggagacacagccctgcacgtggcctgccagaggcagcacctggcctgtgcccgctgcctgctggagggccggcctgagcccggccggggcaccagccacagcctggacctgcagctgcagaactggcagggcctggcctgcctgcacatcgccaccctgcagaagaaccagcccctgatggagctgctgctgagaaatggagctgacattgatgtgcaggagggcaccagcggcaagacagccctgcacctggccgtggagacccaggagcggggcctggtgcagttcctgctgcaggccggggcccaggtggatgccaggatgctgaatggctgcacccccctgcacctggccgccggccggggcctgatgggcatcagcagcaccctgtgcaaggccggggctgacagcctgctgagaaatgtggaggatgagaccccccaggacctgacagaggagagcctggtgctgctgccctttgatgacctgaagatcagcggcaagctgctgctgtgcacagactag

SEQ ID NO: 18583 - DNA, 1881 bp, Artificial Sequence
  Description of Artificial Sequence: Synthetic coding sequence
atggagggcccccgggagaaccaggaccccccacccaggagcctggcccggcacctgagtgatgctgaccggctgaggaaggtgatccaggagctggtggacacagagaagagctatgtgaaggacctgagctgcctgtttgagctgtacctggagcccctgcagaatgagaccttcctgacccaggatgagatggagagcctgtttggcagcctgcctgagatgctggagttccagaaggtgttcctggagaccctggaggatggcatcagcgccagcagtgacttcaacaccctggagacccccagccagttcaggaagctgctcttcagcctgggcggcagcttcctgtactatgctgaccacttcaagctgtacagcggcttctgtgccaaccacatcaaggtgcagaaggtgctggagcgggccaagacagacaaggccttcaaggccttcctggatgccaggaaccccaccaagcagcacagcagcaccctggagagctacctgatcaagcctgtgcagagggtgctgaagtaccccctgctgctgaaggagctggtgtccctgacagaccaggagagcgaggagcactaccacctgacagaggccctgaaggccatggagaaggtggccagccacatcaatgagatgcagaagatctatgaagattatggaacagtgtttgaccagctggtggccgagcagagcggcacagagaaggaggtgacagagctgtccatgggagagctgctgatgcacagcacagtgtcctggctgaaccccttcctgagcctgggcaaggccaggaaggacctggagctgactgtgtttgtgttcaagagagctgtgatcctggtgtacaaggagaactgcaagctgaagaagaagctgcccagcaacagcaggcctgcccacaacagcacagacctggaccccttcaagttccgctggctgatccccatcagcgccctgcaggtgcggctgggcaacccagctggaacagagaacaacagcatctgggagctgatccacaccaagtcagaaattgagggccggcctgagaccatcttccagctgtgctgcagcgacagcgagagcaagaccaacatcgtgaaggtgatccgcagcatcctgcgggagaacttccgccgccacatcaagtgtgagctgcccctggagaagacctgcaaggaccggctggtgcccctgaagaacagagtgcctgtgtctgccaagctggccagcagccgcagcctgaaggtgctgaagaacagcagcagcaatgagtggacaggagaaacaggcaagggcaccctgctggacagtgatgagggcagcctgagcagcggcacccagagcagcggctgccccacagctgagggccggcaggacagcaagagcaccagccctgggaagtacccccaccctggcctggccgactttgctgacaacctgatcaaggagagtgacatcctgagtgatgaagatgatgaccaccggcagacagtgaagcagggcagccccaccaaggacatcgagatccagttccagaggctgcgcatcagcgaggaccctgatgtgcaccctgaggccgagcagcagcccggccctgagagcggggagggccagaagggcggggagcagcccaagctggtgcggggccacttctgccccatcaagaggaaggccaacagcaccaagagggaccggggcaccctgctgaaggcccagatccgccaccagagcctggacagccagagtgaaaatgccaccatcgacctgaacagcgtgctggagcgggagttctctgtgcagagcctgacctctgtggtgtctgaggagtgcttctatgaaacagagagccacggcaagagctag

SEQ ID NO: 18584 - DNA, 1596 bp, Artificial Sequence
  Description of Artificial Sequence: Synthetic coding sequence
atggctgctgtgaagaccctgaaccccaaggccgaggtggcccgggcccaggccgccctggccgtgaacatctctgctgcccggggcctgcaggatgtgctgcggaccaacctgggccccaagggcaccatgaagatgctggtgtctggagctggggacatcaagctgaccaaggatggaaatgtgctgctgcacgagatgcagatccagcaccccacagccagcctgattgccaaggtggccacagcccaggatgacatcactggagatggcaccaccagcaatgtgctgatcattggagagctgctgaagcaggccgacctgtacatcagcgagggcctgcacccccgcatcatcacagagggctttgaagctgccaaggagaaggccctgcagttcctggaggaggtgaaggtgtcccgggagatggaccgggagaccctgattgatgtggcccggaccagcctgcggaccaaggtgcacgccgagctggctgatgtgctgacagaagctgtggtggacagcatcctggccatcaagaagcaggatgagcccatcgacctcttcatgattgagatcatggagatgaagcacaagtcagaaacagacaccagcctcatccggggcctggtgctggaccacggggcccggcacccagacatgaagaagagggtggaggatgcctacatcctgacctgcaatgtgtccctggagtatgagaagacagaggtgaacagcggcttcttctacaagtctgctgaggagcgggagaagctggtgaaggccgagaggaagttcatcgaggacagagtgaagaagatcatcgagctgaagaggaaggtgtgtggggacagcgacaagggctttgtggtgatcaaccagaagggcatcgaccccttcagcctggatgccctgagcaaggagggcatcgtggccctgcggcgggccaagagaagaaacatggagcggctgaccctggcctgtggcggcgtggccctgaacagctttgatgacctgagcccagactgcctgggccatgctggcctggtgtatgagtacaccctgggggaggagaagttcaccttcatcgagaagtgcaacaaccccaggtctgtgaccctgctgatcaagggccccaacaagcacaccctgacccagatcaaggatgctgtgagagatggcctgcgggctgtgaagaatgccattgatgatggctgtgtggtgcctggagctggagctgtggaggtggccatggccgaggccctgatcaagcacaagcccagcgtgaagggccgggcccagctgggcgtgcaggcctttgctgatgccctgctgatcatccccaaggtgctggcccagaacagcggctttgacctgcaggagaccctggtgaagatccaggccgagcacagcgagagcggccagctggtgggcgtggacctgaacacaggagagcccatggtggccgctgaggtgggcgtgtgggacaactactgtgtgaagaagcagctgctgcacagctgcaccgtgattgccaccaacatcctgctggtggatgagatcatgagagctggcatgagcagcctgaagggctag

SEQ ID NO: 18585 - DNA, 666 bp, Artificial Sequence
  Description of Artificial Sequence: Synthetic coding sequence
atgtctgccttcggccatgatgaggcctggatggaggccggcggcttcggcctggaggccgctgagaggacagagtaccagagcctgtgcaagagcaagctgctcttcctgggggagcagagcggcaagaccagcatcatcagccgcttcatgtacaacagctttggctgtgcctgccaggccaccgtgggcatcgacttcctgagcaagaccatgtacctggaggaccagatcgtgcagctgcagctgtgggacacagctggccaggagcgcttccacagcctcatccccagctacatccgggacagcaccatcgctgtggtggtgtatgacatcaccaacatcaacagcttcaaggagacagacaagtgggtggagcacgtgcgggcagagagaggagatgatgtggtgatcatgctgctgggcaacaagattgacctggacaacaagaggcaggtgacagctgagcagggcgaggagaagagcaggaacctgaatgtgatgttcatcgagaccagcgccaagacaggctacaacgtgaagaagctgttcagaagagtggccagcgccctgctgagcaccaggaccagccccccacccaaggagggcaccgtggagattgagctggagagctttgaggagagcggcaacagaagctactgctag

SEQ ID NO: 18586 - DNA, 6222 bp, Artificial Sequence
  Description of Artificial Sequence: Synthetic coding sequence
atggccgaggtgaggaagttcaccaagaggctgagcaagccaggcacagctgctgagctgcggcagagcgtgtctgaggccgtgcggggctctgtggtgctggagaaggccaaggtggtggagcccctggactatgaaaatgtgattgcccagaggaagacccagatctacagcgaccccctgcgggacctgctgatgttccccatggaggacatcagcatctctgtgattggccggcagaggagaacagtgcagagcacagtgcctgaagatgctgagaagagggcccagagcctgtttgtgaaggagtgcatcaagacctacagcacagactggcacgtggtgaactacaagtatgaggacttcagcggggacttcaggatgctgccctgcaagagcctgcggcctgagaagatccccaaccacgtgtttgaaattgatgaggactgtgagaaggatgaggacagcagcagcctgtgcagccagaagggcggcgtcatcaagcagggctggctgcacaaggccaacgtgaacagcaccatcaccgtgaccatgaaggtgttcaagaggcgctacttctacctgacccagctgcctgatggcagctacatcctgaacagctacaaggatgagaagaacagcaaggagagcaagggctgcatctacctggatgcctgcattgatgtggtgcagtgccccaagatgagaagacatgcctttgagctgaagatgctggacaagtacagccactacctggccgctgagacagagcaggagatggaggagtggctgatcaccctgaagaagatcatccagatcaacacagacagcctggtgcaggagaagaaggagaccgtggagacagcccaggatgatgagaccagcagccagggcaaggccgagaacatcatggccagcctggagaggtccatgcaccctgagctgatgaagtatggccgggagacagagcagctgaacaagctgagcagaggagatggccggcagaacctcttctcctttgacagcgaggtgcagaggctggacttcagcggcatcgagccagacatcaagccctttgaggagaagtgcaacaagcgcttcctggtgaactgccacgacctgaccttcaacatcctgggccagatcggggacaatgccaagggcccccccaccaacgtggagcccttcttcatcaacctggccctgtttgatgtgaagaacaactgcaagatctctgctgacttccacgtggacctgaaccccccatctgtgcgggagatgctgtggggcagcagcacccagctggccagtgatggcagccccaagggcagcagccctgagagctacatccatggaattgctgagagccagctgcgctacatccagcagggcatcttctctgtgaccaacccccaccctgagatcttcctggtggccagaattgagaaggtgctgcagggcaacatcacccactgtgccgagccctacatcaagaacagcgaccctgtgaagacagcccagaaggtgcacaggacagccaagcaggtgtgcagccggctgggccagtacaggatgccctttgcctgggccgcccggcccatcttcaaggacacccagggcagcctggacctggatggccgcttcagccccctgtacaagcaggacagcagcaagctgagcagcgaggacatcctgaagctgctgtctgagtacaagaagccagagaagaccaagctgcagatcatccctggccagctgaacatcaccgtggagtgtgtgcctgtggacctgagcaactgcatcaccagcagctatgtgcccctgaagccctttgagaagaactgccagaacatcaccgtggaggtggaggagtttgtgcctgagatgaccaagtactgctaccccttcaccatctacaagaaccacctgtatgtgtaccccctgcagctgaagtatgacagccagaagacctttgccaaggccaggaacattgctgtgtgtgtggagttccgggacagtgatgaaagtgatgccagcgccctgaagtgcatctacggcaagccagctggctctgtgttcaccaccaatgcctatgctgtggtgagccaccacaaccagaaccctgagttctatgatgagatcaagattgagctgcccatccacctgcaccagaagcaccacctgctcttcaccttctaccacgtgtcctgtgagatcaacaccaagggcaccaccaagaagcaggacacagtggagacccctgtgggctttgcctgggtgcccctgctgaaggatggccgcatcatcacctttgagcagcagctgcctgtgtctgccaacctgcccccaggctacctgaacctgaatgatgctgagagccggcggcagtgcaatgtggacatcaagtgggtggatggagccaagcccctgctgaagatcaagagccacctggagagcaccatctacacccaggacctgcacgtgcacaagttcttccaccactgccagctgatccagagcggcagcaaggaggtgcctggagagctgatcaagtacctgaagtgcctgcacgccatggagatccaggtgatgatccagttcctgcctgtgatcctgatgcagctgttccgggtgctgaccaacatgacccatgaagatgatgtgcccatcaactgcaccatggtgctgctgcacatcgtgtccaagtgccacgaggagggcctggacagctacctgcggagcttcatcaagtacagcttccggcctgagaagcccagcgccccccaggcccagctgatccacgagaccctggccaccaccatgattgccatcctgaagcagagcgctgacttcctgagcatcaacaagctgctgaagtacagctggttcttctttgagatcatcgccaagtccatggccacctacctgctggaggagaacaagatcaagctgccccggggccagcgcttccctgagacctaccaccacgtgctgcacagcctgctgctggccatcatcccccacgtgaccatccgctatgcagagatcccagatgagagcagaaatgtgaactacagcctggccagcttcctgaagcgctgcctgaccctgatggaccggggcttcatcttcaacctgatcaatgactacatcagcggcttcagccccaaggaccccaaggtgctggccgagtacaagtttgagttcctgcagaccatctgcaaccacgagcactacatccccctgaacctgcccatggcctttgccaagcccaagctgcagagggtgcaggacagcaacctggagtacagcctgagtgatgagtactgcaagcaccacttcctggtgggcctgctgctgcgggagaccagcatcgccctgcaggacaactatgagatccgctacacagccatcagcgtcatcaagaacctgctgatcaagcacgcctttgacacccgctaccagcacaagaaccagcaggccaagatcgcccagctgtacctgccctttgtgggcctgctgctggagaacatccagaggctggccggccgggacaccctgtacagctgtgccgccatgcccaacagcgccagcagagatgagttcccctgtggcttcaccagccctgccaacagaggcagcctgagcacagacaaggacacagcctacggcagcttccagaatggccacggcatcaagcgggaggacagccggggcagcctcatccctgagggcgccaccggcttcccagaccagggcaacacaggagagaacacccggcagagcagcaccaggagctctgtgtcccagtacaaccggctggaccagtatgagatccgcagcctgctgatgtgctacctgtacatcgtgaagatgatcagcgaggacaccctgctgacctactggaacaaggtgagcccccaggagctgatcaacatcctgatcctgctggaggtgtgcctcttccacttccgctacatgggcaagaggaacatcgcccgggtgcatgatgcctggctgagcaagcacttcggcatcgacaggaagagccagaccatgcctgccctgaggaacagaagtggagtgatgcaggcccggctgcagcacctgagcagcctggagagcagcttcaccctgaaccacagcagcaccaccacagaggccgacatcttccaccaggccctgctggagggcaacacagccacagaggtgtccctgactgtgctggacaccatctccttcttcacccagtgcttcaagacccagctgctgaacaatgatggccacaaccccctgatgaagaaggtgtttgacatccacctggccttcctgaagaatggccagagcgaggtgtccctgaagcacgtgtttgccagcctgcgggccttcatcagcaagttccccagcgccttcttcaagggccgggtgaacatgtgtgccgccttctgctatgaggtgctgaagtgctgcaccagcaagatcagcagcaccagaaatgaggccagcgccctgctgtacctgctgatgaggaacaactttgagtacaccaagaggaagaccttcctgcggacccacctgcagatcatcatcgctgtgtcccagctgattgctgatgtggccctgagcggcggcagccgcttccaggagagcctcttcatcatcaacaactttgccaacagcgaccggcccatgaaggccacagccttccctgctgaggtgaaggacctgaccaagaggatcagaacagtgctgatggccacagcccagatgaaggagcacgagaaggaccctgagatgctgattgacctgcagtacagcctggccaagagctatgccagcaccccagagctgaggaagacctggctggacagcatggccaagatccacgtgaagaatggagacttcagcgaggccgccatgtgctacgtgcacgtggccgccctggtggccgagttcctgcacaggaagaagctgttccccaacggctgcagcgccttcaagaagatcacccccaacattgatgaggagggcgccatgaaggaggatgctggcatgatggatgtgcactacagcgaggaggtgctgctggagctgctggagcagtgtgtggatggcctgtggaaggccgagagatatgagatcatcagcgagatcagcaagctgattgtgcccatctatgagaagagaagagaatttgagaagctgacccaggtgtaccgcaccctgcatggagcctacaccaagatcctggaggtgatgcacaccaagaagaggctgctgggcaccttcttccgggtggccttctacggccagagcttctttgaggaggaggatggcaaggagtacatctacaaggagcccaagctgaccggcctgtctgagatcagcctgcggctggtgaagctgtatggagagaagtttggaacagaaaatgtgaagatcatccaggacagcgacaaggtgaatgccaaggagctggaccccaagtatgcccacatccaggtgacctacgtgaagccctactttgatgacaaggagctgacagagaggaagacagaatttgagaggaaccacaacatcagcagatttgtgtttgaggccccctacaccctgagcggcaagaagcagggctgcatcgaggagcagtgcaagaggaggaccatcctgaccaccagcaacagcttcccctacgtgaagaagaggatccccatcaactgtgagcagcagatcaacctgaagcccattgatgtggccacagatgagatcaaggacaagacagctgagctgcagaagctgtgcagcagcacagatgtggacatgatccagctgcagctgaagctgcagggctgtgtgtctgtgcaggtgaatgccggccccctggcctatgcccgggccttcctgaatgacagccaggccagcaagtacccacccaagaaggtgtctgagctgaaggacatgttcaggaagttcatccaggcctgcagcatcgccctggagctgaatgaaagactcatcaaggaggaccaggtggagtaccacgagggcctgaagagcaacttccgggacatggtgaaggagctgagtgacatcatccacgagcagatcctgcaggaggacaccatgcacagcccctggatgagcaacaccctgcacgtgttctgtgccatcagcggcaccagcagtgaccggggctacggcagccccaggtatgcagaggtgtag

SEQ ID NO: 18587 - DNA, 1644 bp, Artificial Sequence
  Description of Artificial Sequence: Synthetic coding sequence
atgggcggctgcatccccttcctgaaggccgcccgggccctgtgcccccgcatcatgccacccctgctgctgctgagcgccttcatcttcctggtgtctgtgctgggcggggcccctggccacaacccagacaggaggaccaagatggtgtccatccacagcctgtctgagctggagcggctgaagctgcaggagacagcctaccacgagctggtggcccggcacttcctgtctgagttcaagccagaccgggccctgcccatcgaccggcccaacaccctggacaagtggttcctgatcctgcggggccagcagagagctgtgagccacaagaccttcggcatcagcctggaggaggtgctggtgaatgagttcaccaggaggaagcacctggagctgacagccaccatgcaggtggaggaggccaccggccaggccgccggcagaagaagaggaaatgtggtgcggcgggtgtttggccgcatccgccgcttcttcagcagaagaagaaatgagcccaccctgccccgggagttcacccggcggggcagaagaggagctgtgtctgtggacagcctggccgagctggaggatggagccctgctgctgcagaccctgcagctgagcaagatctccttccccatcggccagaggctgctgggcagcaagaggaagatgagcctgaaccccatcgccaagcagatcccccaggtggtggaggcctgctgccagttcatcgagaagcacggcctgtctgctgtgggcatcttcaccctggagtacagcgtgcagagggtgcggcagctgcgggaggagtttgaccagggcctggatgtggtgctggatgacaaccagaatgtgcatgatgtggccgccctgctgaaggagttcttccgggacatgaaggacagcctgctgcctgatgacctgtacatgtccttcctgctgacagccaccctgaagccccaggaccagctgagcgccctgcagctgctggtgtacctgatgccaccctgccacagcgacaccctggagcggctgctgaaggccctgcacaagatcacagagaactgtgaagattccatcggcattgatggccagctggtgcccggcaacaggatgaccagcaccaacctggccctggtgtttggaagtgccctgctgaagaagggcaagtttgggaagcgggagagcaggaagaccaagctgggcatcgaccactacgtggcctctgtgaatgtggtgcgggccatgattgacaactgggatgtgctcttccaggtgcccccccacatccagaggcaggtggccaagagggtgtggaagagcagccctgaggccctggacttcatcagaagaagaaacctgaggaagatccagagcgcccgcatcaagatggaggaggatgccctgctgagtgaccctgtggagaccagcgctgaggcccgggctgctgtgctggcccagagcaagcccagtgatgagggcagcagcgaggagcctgctgtgcccagcggcacagcccggagccatgatgatgaggagggcgccggcaacccccccatccctgagcaggaccggcccctgctgcgggtgccccgggagaaggaggccaagacaggagtgtcctacttcttcccctag

SEQ ID NO: 18588 - DNA, 5613 bp, Artificial Sequence
  Description of Artificial Sequence: Synthetic coding sequence
atggcccgctggatccccaccaagaggcagaagtatggagtggccatctacaactacaatgccagccaggatgtggagctgagcctgcagattggagacacagtgcacatcctggagatgtatgagggctggtaccggggctacaccctgcagaacaagagcaagaagggcatcttccctgagacctacatccacctgaaggaggccaccgtggaggacctgggccagcatgaaacagtcatccctggagagctgcccctggtgcaggagctgaccagcaccctgcgggagtgggccgtcatctggaggaagctgtatgtgaacaacaagctgaccctcttccggcagctgcagcagatgacctacagcctgattgagtggaggagccagatcctgagcggcaccctgcccaaggatgagctggccgagctgaagaagaaggtgacagccaagattgaccacggcaacaggatgctgggcctggacctggtggtgagagatgacaatggaaacatcctggaccctgatgagaccagcaccatcgccctcttcaaggcccacgaggtggccagcaagagaattgaggagaagatccaggaggagaagagcatcctgcagaacctggacctgcggggccagagcatcttcagcaccatccacacctacggcctgtatgtgaacttcaagaactttgtgtgcaacattggagaagatgctgagctgttcatggccctgtatgaccctgaccagagcaccttcatcagcgagaactacctgatccgctggggcagcaatggcatgcccaaggagattgagaagctgaacaacctgcaggccgtgttcacagacctgagctccatggacctgatccggccccgggtgtccctggtgtgccagatcgtgcgggtgggccacatggagctgaaggagggcaagaagcacacctgtggcctgcggcggcccttcggcgtggccgtgatggacatcacagacatcatccacggcaaggtggatgatgaggagaagcagcacttcatccccttccagcagatcgccatggagacctacatccggcagaggcagctgatcatgagccccctcatcaccagccacgtgattggagaaaatgagcccctgacctctgtgctgaacaaggtgattgctgccaaggaggtgaaccacaagggccagggcctgtgggtgtccctgaagctgctgcccggggacctgacccaggtgcagaagaacttcagccacctggtggacaggagcacagccatcgccaggaagatgggcttccctgagatcatcctgcctggagatgtgagaaatgacatctacgtgaccctcatccacggggagtttgataaaggcaagaagaagacccccaagaatgtggaggtgaccatgtctgtgcatgatgaggagggcaagctgctggagaaggccatccaccctggggccggctatgagggcatcagcgagtacaagtctgtggtgtactaccaggtgaagcagccctgctggtatgagaccgtgaaggtgtccatcgccatcgaggaggtgacccgctgccacatccgcttcaccttccgccacaggagcagccaggagacccgggacaagtctgagcgggcctttggagtggcctttgtgaagctgatgaacccagatggcaccaccctgcaggacggcagacatgacctggtggtgtacaagggggacaacaagaagatggaggatgccaagttctacctgaccctgcccggcaccaagatggagatggaggagaaggagctgcaggccagcaagaacctggtgaccttcacccccagcaaggacagcaccaaggacagcttccagatcgccaccctcatctgcagcaccaagctgacccagaatgtggacctgctgggcctgctgaactggaggagcaacagccagaacatcaagcacaacctgaagaagctgatggaggtggatggaggagaaattgtgaagttcctgcaggacaccctggatgccctcttcaacatcatgatggagatgtctgacagcgagacctatgacttcctggtgtttgatgccctggtgttcatcatcagcctcatcggggacatcaagttccagcacttcaaccctgtgctggagacctacatctacaagcacttcagcgccaccctggcctacgtgaagctgagcaaggtgctgaacttctacgtggccaatgctgatgacagcagcaagacagagctgctgtttgctgccctgaaggccctgaagtacctgttccgcttcatcatccagagccgggtgctgtacctgcgcttctacggccagagcaaggatggagatgagttcaacaacagcatccggcagctgttcctggccttcaacatgctgatggaccggcccctggaggaggccgtgaagatcaagggagctgccctgaagtacctgcccagcatcatcaatgatgtgaagctggtgtttgatcctgtggagctgtctgtgctcttctgcaagttcatccagagcatcccagacaaccagctggtgcggcagaagctgaactgcatgaccaagatcgtggagagcaccctcttccggcagagtgaatgtcgggaggtgctgctgcccctgctgacagaccagctgagcggccagctggatgacaacagcaacaagccagaccacgaggccagcagccagctgctgagcaacatcctggaggtgctggacaggaaggatgtgggcgccacagctgtgcacatccagctgatcatggagcggctgctgcggcgcatcaacagaacagtgattggcatgaaccggcagagcccccacatcggcagctttgtggcctgcatgattgccctgctgcagcagatggatgacagccactacagccactacatcagcaccttcaagacccggcaggacatcatcgacttcctgatggagaccttcatcatgttcaaggacctgattggcaagaatgtgtatgccaaggactggatggtgatgaacatgacccagaacagagtcttcctgcgggccatcaaccagtttgctgaggtgctgacccgcttcttcatggaccaggccagctttgagctgcagctgtggaacaactacttccacctggccgtggccttcctgacccatgagagcctgcagctggagaccttcagccaggccaagaggaacaagatcgtgaagaagtacggggacatgaggaaggagatcggcttccgcatccgggacatgtggtacaacctgggcccccacaagatcaagttcatccccagcatggtgggccccatcctggaggtgaccctgaccccagaggtggagctgaggaaggccaccatccccatcttctttgacatgatgcagtgtgagttcaacttctctggaaatggaaacttccacatgtttgaaaatgaactcatcaccaagctggaccaggaggtggagggcggcagaggagatgagcagtacaaggtgctgctggagaagctgctgctggagcactgcaggaagcacaagtacctgagcagcagtggagaggtgtttgccctgctggtgagcagcctgctggagaacctgctggactaccgcaccatcatcatgcaggatgagagcaaggagaacaggatgagctgcaccgtgaatgtgctgaacttctacaaggagaagaagcgggaggacatctacatccgctacctgtacaagctgcgggacctgcaccgggactgtgagaactacacagaggccgcctacaccctgctgctgcacgccgagctgctgcagtggagcgacaagccctgtgtgccccacctgctgcagaaggacagctactacgtgtacacccagcaggagctgaaggagaagctgtaccaggagatcatctcctactttgacaagggcaagatgtgggagaaggccatcaagctgagcaaggagctggccgagacctatgagagcaaggtgtttgattatgagggcctgggcaacctgctgaagaagagggccagcttctatgagaacatcatcaaggccatgaggccccagcctgagtactttgctgtgggctactacggccagggcttccccagcttcctgaggaacaagatcttcatctaccggggcaaggagtatgaaagaagagaggacttcagcctgcggctgctgacccagttccccaatgctgagaagatgaccagcaccaccccacctggagaggacatcaagagcagccccaagcagtacatgcagtgcttcaccgtgaagcctgtgatgagcctgccccccagctacaaggacaagcctgtgcctgagcagatcctgaactactaccgggccaatgaggtgcagcagttccgctacagccggcccttcaggaagggggagaaggaccctgacaatgaatttgccaccatgtggattgaaagaaccacctacaccacagcctacaccttccctggcatcctgaagtggtttgaggtgaagcagatcagcacagaggagatcagccccctggagaatgccatcgagaccatggagctgaccaatgaaagaatcagcaactgtgtgcagcagcacgcctgggacaggagcctgtctgtgcaccccctgtccatgctgctgagcggcatcgtggaccctgctgtgatgggcggcttcagcaactatgagaaggccttcttcacagagaagtacctgcaggagcaccctgaggaccaggagaaggtggagctgctgaagaggctgattgccctgcagatgcccctgctgacagagggcatccgcatccatggagagaagctgacagagcagctgaagcccctgcacgagcggctgagcagctgcttccgggagctgaaggagaaggtggagaagcactatggagtcatcaccctgccccccaacctgacagagaggaagcagagcaggacaggcagcatcgtgctgccctacatcatgagcagcaccctgcggcggctgagcatcacctctgtgaccagctctgtggtgtccaccagcagcaacagcagtgacaatgcccccagccggcccggcagtgatggcagcatcctggagcccctgctggagcggcgggccagcagcggggcccgggtggaggacctgagcctgcgggaggagaacagcgagaaccgcatcagcaagttcaagaggaaggactggagcctgagcaagagccaggtgattgctgagaaggcccctgagccagacctgatgagccccaccaggaaggcccagaggcccaagagcctgcagctgatggacaaccggctgagccccttccacggcagcagccccccccagagcacccccctgagccccccacccctgacccccaaggccaccaggaccctgagcagccccagcctgcagacagatggcattgctgccacccctgtgcccccacctcctccacccaagagcaagccctatgagggcagccagaggaacagcacagagctggccccacccctgcctgtgcggcgggaggccaaggcccctcctcctcctccacccaaggccaggaagagcggcatccccaccagcgagcccggcagccagtag

SEQ ID NO: 18589 - DNA, 1623 bp, Artificial Sequence
  Description of Artificial Sequence: Synthetic coding sequence
atgtctgccagcctgaactacaagagcttcagcaaggagcagcagaccatggacaacctggagaagcagctgatctgccccatctgcctggagatgttcaccaagcctgtggtgatcctgccctgccagcacaacctgtgcaggaaatgtgccagtgacatcttccaggccagcaacccctacctgcccacccggggcggcaccaccatggccagcggcggccgcttccgctgccccagctgcagacatgaggtggtgctggacagacatggagtgtatggcctgcagaggaacctgctggtggagaacatcatcgacatctacaagcaggagagcaccaggcctgagaagaagagtgaccagcccatgtgtgaggagcacgaggaggagcgcatcaacatctactgcctgaactgtgaggtgcccacctgcagcctgtgcaaggtgtttggagcccacaaggactgccaggtggcccccctgacccacgtgttccagaggcagaagtctgagctgagtgatggcatcgccatcctggtgggcagcaatgacagagtgcagggcgtcatcagccagctggaggacacctgcaagaccatcgaggagtgctgcaggaagcagaagcaggagctgtgtgagaagtttgactacctgtatggcatcctggaggagaggaagaatgagatgacccaggtgatcaccaggacccaggaggagaagctggagcacgtgcgggccctgatcaagaagtacagcgaccacctggagaatgtgtccaagctggtggagagcggcatccagttcatggatgagcctgagatggctgtgttcctgcagaatgccaagaccctgctgaagaagatcagcgaggccagcaaggccttccagatggagaagattgagcacggctatgagaacatgaaccacttcaccgtgaacctgaaccgggaggagaagatcatccgggagattgacttctacagagaagatgaagatgaggaggaggaggagggcggggagggggagaaggagggggagggggaggtgggcggggaggccgtggaggtggaggaggtggagaatgtgcagacagagttccctggagaagatgaaaatcctgagaaggccagcgagctgagccaggtggagctgcaggccgcccctggggccctgcctgtgagcagccctgagcccccaccagccctgcccccagctgctgatgcccctgtgacccagggcgaggtggtgcccaccggcagcgagcagaccacagagagcgagacccctgtgcctgctgctgctgagacagctgaccccctcttctaccccagctggtacaagggccagaccaggaaggccaccaccaaccccccctgcaccccaggcagcgagggcctgggccagatcggccccccaggcagcgaggacagcaatgtgaggaaggccgaggtggccgctgctgctgccagcgagagagctgctgtgtctgggaaggagaccagcgccccagctgccaccagccaggagctggtgatctgcctggccctgctggccttcctgatcctgcactacatctggagccagatccagtgcctgatcttcaccctgatggactggatctag

SEQ ID NO: 18590 - DNA, 3252 bp, Artificial Sequence
  Description of Artificial Sequence: Synthetic coding sequence
atgagccagacccaggactatgagtgccgcagccacaacgtggacctgcctgagagccgcatccctggcagcaacacccggctggagtgggtggagatcatcgagcccaggacccgggagaggatgtatgccaacctggtgactggagaatgtgtgtgggaccccccagctggggtgcgcatcaagaggaccagcgagaaccagtggtgggagctgtttgaccccaacaccagccgcttctactactacaatgccagcacccagaggacagtgtggcaccggccccagggctgtgacatcatccccctggccaagctgcagaccctgaagcagaacacagagagcccccgggccagcgctgagagcagccctggccggggcagctctgtgtcccgggagggcagcaccagcagcagcctggagcctgagccagacacagagaaggcccaggagctgcctgcccgggccggccggcctgctgccttcggcaccgtgaaggaggacagcggcagcagcagccccccaggagtcttcctggagaaggactatgagatctacagagactacagcgcagatggccagctgctgcactaccgcaccagcagcctgcgctggaacagcggggccaaggagaggatgctgatcaaggtggccgaccgggagcccagcttcctggccgcccagggcaatggctacgccccagatggccccccaggagtgcgcagcagaagacccagcggcagccagcacagccccagcctgcagacctttgcccctgaggctgatggcaccatcttcttccctgagcggcggcccagccccttcctgaagagagctgagctgcccggcagcagcagccccctgctggcccagcccaggaagcccagcggggacagccagcccagcagccccaggtatggctatgagccccccctgtatgaggagccccctgtggagtaccaggcccccatctatgatgagccccccatggatgtgcagtttgaggccggcggcggctaccaggccggcagcccccagaggagccctggcaggaagccccggcccttcctgcagcccaacaagcagggcccccccagcccctgccagcagctggtgctgaccaagcagaagtgcccagagcgcttcctgagcctggagtacagccctgctgggaaggagtatgtgcggcagctggtgtatgtggagcaggccggcagcagccccaagctgcgggccggccccaggcacaagtatgcccccaaccctgggggcggcagctacagcctgcagcccagcccctgcctgctgcgggaccagaggctgggcgtgaagagcggggactacagcaccatggagggccctgagctgcggcacagccagccccccacccccctgccccaggcccaggaggatgccatgtcctggagcagccagcaggacaccctgagcagcacaggctacagccctggcaccaggaagaggaagagcaggaagcccagcctgtgccaggccaccagcgccacccccacagagggccctggggacctgctggtggagcagcccctggccgaggagcagcccccctgtggcaccagcctggcccctgtgaagagagctgagggggaggccgagggcgcccggggagctgctgagcccttcctggcccaggcccggctggcctgggaggcccagcaggcccacttccacatgaagcagaggagctcctgggacagccagcaggacggcagcggctatgaaagtgatggagccctgcccctgcccatgcctggccctgtggtgcgggccttctctgaagatgaggccctggcccagcaggagaacagacactggaggcggggcacctttgagaagctgggcttcccccagatcctgctggagaagtctgtgtctgtgcagaccaacctggccagccctgagccctacctgcaccccagccagagcgaggacctggccgcctgtgcccagtttgagagcagccggcagagccgctctggagtgcccagcagcagctgtgtgttccccaccttcaccctgaggaagcccagcagcgagacagacatcgagaactgggccagcaagcacttcaacaagcacacccagggcctcttccggaggaaggtgtccatcgccaacatgctggcctggagcagcgagagcatcaagaagcccatgattgtgaccagtgacagacatgtgaagaaggaggcctgtgagctgttcaagctgatccagatgtacatgggagacagaagagccaaggctgaccccctgcacgtggccctggaggtggccaccaagggctggagcgtgcagggcctgagagatgagctgtacatccagctgtgccggcagaccacagagaacttccggctggagagcctggcccggggctgggagctgatggccatctgcctggccttcttcccccccacccccaagttccacagctacctggagggctacatctaccgccacatggaccctgtgaatgacaccaagggcgtggccatcagcacctacgccaagtactgctaccacaagctgcagaaggccgccctgactggagccaagaagggcctgaagaagcccaacgtggaggagatcagacatgccaagaatgctgtgttcagccccagcatgtttggcagcgccctgcaggaggtgatgggcatgcagcgggagcgctacccagagcggcagctgccctgggtgcagacccggctgtctgaggaggtgctggccctgaatggagaccagacagagggcatcttccgggtgcctggggacattgatgaggtgaatgccctgaagctgcaggtggaccagtggaaggtgcccaccggcctggaggacccccacgtgcctgccagcctgctgaagctgtggtaccgggagctggaggagcccctcatcccccatgagttctatgagcagtgcatcgcccactatgacagccctgaggccgctgtggccgtggtgcacgccctgccccgcatcaacaggatggtgctgtgctacctgatccgcttcctgcaggtgtttgtgcagcctgccaacgtggccgtgaccaagatggatgtgagcaacctggccatggtgatggcccccaactgcctgcgctgccagagtgatgaccccagggtcatctttgagaacaccaggaaggagatgtccttcctgcgggtgctgatccagcacctggacaccagcttcatggagggcgtgctgtag

SEQ ID NO: 18591 - DNA, 426 bp, Artificial Sequence
  Description of Artificial Sequence: Synthetic coding sequence
atgggcaagggcatccccctgaatgaccaggaccgcatcccctggctgtgcaacctgcatgacatcctgctgagagatgtggccagcggccagagggtggtgctggcctgcagcgccctgaagaagacctacagagacatcctgacccagggcaaggatggagtggccctgaagtgtgaggagagcggcaaggaggccaagcaggccgagatgcagctgctggtggtgcacctgagcggcagctttgaggtgatcagcggccgcctgctgaagcgggagggccacttcatgcctcctgagctgctgcagagccagtttgagaccctggagcccccagctgcccctgagaacttcatccagatctctgtggacaagaatgtgtctgagatcatcgccaccatcatggagaccctgaagatgaagtag

SEQ ID NO: 18592 - DNA, 1701 bp, Artificial Sequence
  Description of Artificial Sequence: Synthetic coding sequence
atggacatccagctggaccctgccagagatgacctgcccctgatggccaacaccagccacatcctggtgaagcactacgtgctggacctggatgtggactttgagagccaggtgattgagggcaccatcgtgctcttcctggaggatggcaaccgcttcaagaagcagaacagcagcattgaggaggcctgccagagcgagagcaacaaggcctgcaagtttggcatgcctgagccctgccacatccctgtgaccaatgcccggaccttcagcagcgagatggagtacaatgactttgccatctgcagcaagggggagaaggacaccagtgacaaggatggcaaccacgacaaccaggagcacgccagcggcatcagcagcagcaagtactgctgtgacaccggcaaccacggcagcgaggacttcctgctggtgctggactgctgtgacctgtctgtgctgaaggtggaggaggtggatgtggccgctgtgcccggcctggagaagttcaccaggagccctgagctgactgtggtgtctgaggagttcaggaaccagatcgtgcgggagctggtgaccctgcctgccaaccgctggagggagcagctggactactatgcccgctgcagccaggcccctggctgtggggagctgctgtttgacacagacacctggagcctgcagatcaggaagacaggagcccagacagccacagacttcccccacgccatccgcatctggtacaagaccaagccagagggccgctctgtgacctggaccagtgaccagagcggccggccctgtgtgtacacagtgggcagccccatcaacaacagagccctcttcccctgccaggagccccctgtggccatgagcacctggcaggccaccgtgcgggctgctgccagctttgtggtgctgatgtctggagaaaattctgccaagcccacccagctgtgggaggagtgcagctcctggtactactacgtgaccatgcccatgcctgccagcaccttcaccatcgctgtgggctgctggacagagatgaagatggagacctggagcagcaatgacctggccacagagcggcccttcagccccagcgaggccaacttccgccacgtgggcgtgtgcagccacatggagtacccctgccgcttccagaatgccagcgccaccacccaggagatcatcccccaccgggtgtttgcccctgtgtgcctgactggagcctgccaggagaccctgctgcggctcatccccccctgcctgtctgctgcccacagcgtgctgggcgcccaccccttcagccggctggatgtgctgattgtgcctgccaacttccccagcctgggcatggccagcccccacatcatgttcctgagccagagcatcctgactggaggcaaccacctgtgtggcacccggctgtgccatgaaattgcccacgcctggtttggcctggccatcggggcccgggactggacagaggagtggctgtctgagggctttgccacccacctggaggatgtgttctgggccacagcccagcagctggccccctatgaggcccgggagcagcaggagctgcgggcctgcctgcgctggaggcggctgcaggatgagatgcagtgcagccctgaggagatgcaggtgctgcgcttcccccacgtgggcggctgcagcggcagcttctcctag

SEQ ID NO: 18593 - DNA, 1266 bp, Artificial Sequence
  Description of Artificial Sequence: Synthetic coding sequence
atgcccttcctgcacggcttccgccgcatcatctttgagtaccagcccctggtggatgccatcctgggcagcctgggcatccaggaccctgagcggcaggagagcctggaccggcccagctatgtggccagcgaggagagccgcatcctggtgctgacagagctgctggagaggaaggcccacagccccttctaccaggagggcgtgtccaatgccctgctgaagatggccgagctgggcctgaccagggctgctgatgtgctgctgcggcatggagccaacctgaactttgaggaccctgtgacctactacacagccctgcacatcgctgtgctgaggaaccagcctgacatggtggagctgctggtgcaccacggggctgatgtgaacagaagagaccgcatccacgagagcagccccctggacctggccagcgaggagcctgagcggctgccctgcctgcagaggctgctggacctgggcgcagatgtgaatgctgctgacaagcacggcaagacagccctgctgcacgccctggccagcagtgatggagtgcagatccacaacacagagaacatccggctgctgctggagggcggcgcagatgtgaaggccaccaccaaggatggagacaccgtcttcacctgcatcatcttcctgctgggggagaccgtgggcggggacaaggaggaggcccagatgatcaaccgcttctgcttccaggtgacccggctgctgctggcccatggagctgaccccagtgaatgtcctgcccacgagagcctgacccacatctgcctgaagagcttcaagctgcacttccccctgctgcgcttcctgctggagagcggggccgcctacaactgcagcctgcacggggccagctgctggagcggcttccacatcatctttgagcggctgtgcagccaccctggctgcacagaagatgagagccacgccgacctgctgaggaaggccgagaccgtgctggacctgatggtgaccaacagccagaagctgcagctgcctgagaactttgacatccaccctgtgggcagcctggccgagaagatccaggccctgcacttcagcctgcggcagctggagagctaccccccacccctgaagcacctgtgccgggtggccatccggctgtacctgcagccctggcctgtggatgtgaaggtgaaggccctgcccctgcctgaccggctgaagtggtacctgctgtctgagcacagcggctctgtggaggatgacatctag

SEQ ID NO: 18594 - DNA, 594 bp, Artificial Sequence
  Description of Artificial Sequence: Synthetic coding sequence
atgcccttcctgcacggcttccgccgcatcatctttgagtaccagcccctggtggatgccatcctgggcagcctgggcatccaggaccctgagcggcaggagagcctggaccggcccagctatgtggccagcgaggagagccgcatcctggtgctgacagagctgctggagaggaaggcccacagccccttctaccaggagggcgtgtccaatgccctgctgaagatggccgagctgggcctgaccagggctgctgatgtgctgctgcggcatggagccaacctgaactttgaggaccctgtgacctactacacagccctgcacatcgctgtgctgaggaaccagcctgacatggtggagctgctggtgcaccacggggctgatgtgaacagaagagaccgggagaagctgctgtgcagcatgctgtggccagctgccaccggctgccgcagcaccatcctgcggacctttgtgtcctactggaaggagggccagaccagccggcccccacccaagatgggcacccagtgcagccctgccagcagcagctgcctggtgcggccctgggagggcaccaagaggcggcccaggtag

SEQ ID NO: 18595 - DNA, 684 bp, Artificial Sequence
  Description of Artificial Sequence: Synthetic coding sequence
atgtctgacatcaacctggactgggtggaccggcggcagctgcagaggctggaggagatgctgattgtggtggatgaaaatgacaaggtgattggagctgacaccaagaggaactgccacctgaatgaaaatattgagaagggcctgctgcaccgggccttctctgtggtgctcttcaacaccaagaaccgcatcctgatccagcagaggagtgacaccaaggtgaccttccctggctacttcacagacagctgcagcagccaccccctgtacaacccagctgagctggaggagaaggatgccatcggcgtgagaagagctgcccagaggcggctgcaggccgagctgggcatccctggagagcagatcagccctgaggacatcgtgttcatgaccatctaccaccacaaggccaagagtgaccgcatctggggcgagcacgagatctgctacctgctgctggtgaggaagaatgtgaccctgaacccagaccccagcgagaccaagagcatcctgtacctgagccaggaggagctgtgggagctgctggagcgggaggcccggggggaggtgaaggtgaccccctggctgcggaccatcgccgagcgcttcctgtaccgctggtggccccacctggatgatgtgaccccatttgtggagctgcacaagatccaccgggtgtag

SEQ ID NO: 18596 - DNA, 864 bp, Artificial Sequence
  Description of Artificial Sequence: Synthetic coding sequence
atggaggtgatggagggccccctgaacctggcccaccagcagagccggcgggctgaccggctgctggccgccggcaagtatgaggaggccatcagctgccacaagaaggccgccgcctacctgtctgaggccatgaagctgacccagagcgagcaggcccacctgagcctggagctgcagagggacagccacatgaagcagctgctgctgatccaggagcgctggaagagggcccagcgggaggagcggctgaaggcccagcagaacacagacaaggatgctgctgcccacctgcagaccagccacaagcccagcgcagaagatgctgagggccagagccccctgagccagaagtacagccccagcacagagaagtgcctgcctgagatccagggcatctttgaccgggaccctgacaccctgctgtacctgctgcagcagaagtctgagcctgctgagccctgcatcggcagcaaggcccccaaggatgacaagaccatcatcgaggagcaggccaccaagattgctgacctgaagagacatgtggagttcctggtggccgagaatgaaaggctgaggaaagaaaacaagcagctgaaggccgagaaggcccggctgctgaagggccccatcgagaaggagctggatgtggatgctgactttgtggagaccagcgagctgtggagcctgccccctcatgctgagacagccacagccagcagcacctggcagaagtttgctgccaacacaggcaaggccaaggacatccccatccccaacctgccccccctggacttccccagccctgagctgcccctgatggagctgtctgaggacatcctgaagggcttcatgaacaactag

SEQ ID NO: 18597 - DNA, 2844 bp, Artificial Sequence
  Description of Artificial Sequence: Synthetic coding sequence
atgtgtgtggacagcctggtgcgcatctgcagcggcctgtcctatggccgcatccggaacatcaagagcctgagtgacatccagatcgtgcaggtggcctgtggctactaccacagcctggccctgagcaaggccagcgaggtgttctgctggggccagaacaagtatggccagctgggcctgggcacagactgcaagaagcagaccagcccccagctgctgaagagcctgctgggcatccccttcatgcaggtggccgccggcggggcccacagctttgtgctgaccctgagcggggccatcttcggctggggcaggaacaagtttggccagctgggcctgaatgatgaaaatgacagatatgtgcccaacctgctgaagagcctgcggagccagaagatcgtgtacatctgctgcggggaggaccacacagctgccctgaccaaggagggcggcgtcttcaccttcggggccggcggctacggccagctgggccacaacagcaccagccatgagatcaaccccaggaaggtgtttgagctgatgggcagcatcgtgacagaaattgcctgtggccggcagcacaccagcgcctttgtgcccagcagcggccgcatctacagctttggcctgggcggcaatggccagctgggcaccggcagcaccagcaacaggaagagccccttcaccgtgaagggcaactggtacccctacaacggccagtgcctgcctgacatcgacagcgaggagtacttctgtgtgaagaggatcttctctggaggagaccagagcttcagccactacagcagcccccagaactgtggccccccagatgacttccgctgccccaaccccaccaagcagatctggacagtgaatgaggccctgatccagaagtggctgagctaccccagcggccgcttccctgtggagatcgccaatgaaattgatggcaccttcagcagcagcggctgcctgaatggcagcttcctggccgtgtccaatgatgaccactacagaacaggcacccgcttcagcggcgtggacatgaatgctgcccggctgctcttccacaagctgatccagcctgaccacccccagatcagccagcaggtggccgccagcctggagaagaacctgatccccaagctgaccagcagcctgcctgatgtggaggccctgcgcttctacctgaccctgcctgagtgccccctgatgtctgacagcaacaacttcaccaccatcgccatcccctttggaacagccctggtgaacctggagaaggcccccctgaaggtgctggagaactggtggagcgtgctggagcccccactcttcctgaagatcgtggagctgttcaaggaggtggtggtgcacctgctgaagctgtacaagattggcatccccccatctgaaagacgcatcttcaacagcttcctgcacacagccctgaaggtgctggagatcctgcaccgggtgaatgagaagatgggccagatcatccagtatgacaagttctacatccacgaggtgcaggagctgattgacatcagaaatgactacatcaactgggtgcagcagcaggcctacggcatggatgtgaaccacggcctgacagagctggccgacatccctgtgaccatctgcacctacccctttgtgtttgatgcccaggccaagaccaccctgctgcagacagatgctgtgctgcagatgcagatggccatcgaccaggcccaccggcagaatgtgagcagcctcttcctgcccgtcatcgagagcgtgaacccctgcctgatcctggtggtgcggcgggagaacatcgtgggagatgccatggaggtgctgaggaagaccaagaacatcgactacaagaagcccctgaaggtgatctttgtgggagaagatgctgtggatgctgggggcgtgaggaaggagttcttcctgctgatcatgagggagctgctggaccccaagtatggcatgttccgctactatgaggacagccgcctcatctggttcagtgacaagacctttgaggacagcgacctcttccacctgattggagtcatctgtggcctggccatctacaactgcaccatcgtggacctgcacttccccctggccctgtacaagaagctgctgaagaagaagcccagcctggatgacctgaaggagctgatgccagatgtgggccgctccatgcagcagctgctggactacccagaagatgacatcgaggagaccttctgcctgaacttcaccatcaccgtggagaactttggagccacagaggtgaaggagctggtgctgaatggagctgacacagctgtgaacaagcagaaccggcaggagtttgtggatgcctacgtggactacatcttcaacaagtctgtggccagcctgtttgatgccttccacgccggcttccacaaggtgtgtggcggcaaggtgctgctgctcttccagcccaatgagctgcaggccatggtgattggcaacaccaactatgactggaaggagctggagaagaacacagagtacaagggggagtactgggccgagcaccccaccatcaagatcttctgggaggtgttccacgagctgcccctggagaagaagaagcagttcctgctcttcctgaccggcagtgaccgcatccccatcctgggcatgaagagcctgaagctggtgatccagagcactggaggaggagaggagtacctgcctgtgagccacacctgcttcaacctgctggacctgcccaagtacacagagaaggagaccctgcggagcaagctgatccaggccatcgaccacaatgaaggcttcagcctcatctag

SEQ ID NO: 18598 - DNA, 2541 bp, Artificial Sequence
  Description of Artificial Sequence: Synthetic coding sequence
atgcctgccttcctgggcctgaagtgcctgggcaagctgtgcagcagcgagaagagcaaggtgaccagcagcgagaggaccagcgcccggggcagcaacaggaagaggctcatcgtggaggaccggcgggtgtctggcaccagcttcaccgcccacagaagagccaccatcacccacctgctgtacctgtgccccaaggactactgcccccggggccgggtgtgcaacagcgtggacccctttgtggcccacccccaggacccccaccaccccagcgagaagcctgtgatccactgccacaagtgtggggagccctgcaagggggaggtgctgcgggtgcagaccaagcacttccacatcaagtgcttcacctgcaaggtgtgtggctgtgacctggcccagggcggcttcttcatcaagaatggagagtacctgtgcaccctggactaccagaggatgtatggcacccgctgccacggctgtggggagtttgtggagggggaggtggtgacagccctgggcaagacctaccaccccaactgctttgcctgcaccatctgcaagaggcccttccccccaggggacagagtgaccttcaacggccgggactgcctgtgccagctgtgtgcccagcccatgagcagcagccccaaggagaccaccttcagcagcaactgtgccggctgcggccgggacatcaagaatggccaggccctgctggccctggacaagcagtggcacctgggctgcttcaagtgcaagagctgtgggaaggtgctgactggagagtacatcagcaaggatggagccccctactgtgagaaggactaccagggcctgtttggagtgaagtgtgaggcctgccaccagttcatcaccgggaaggtgctggaggccggggacaagcactaccaccccagctgtgcccgctgcagccgctgcaaccagatgttcacagaaggagaggagatgtacctgcagggcagcacagtgtggcacccagactgcaagcagagcaccaagacagaggagaagctgcggctgcccaacatccgccgcagcagcagtgacttcttctacagcaagagcctcatccggaggacaggccgcagccccagcctgcagcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggcctgagctgctgagccctggggtgcagaggctgagctacctgcggaccagcagcctgagccccacccacagcgacagccggcccaacccccccttccgccaccacttcatcccccacatcaagggaaatgagcccagcagcggcaggaacagccccctgccctacagaccagacagccggcccctgacccccacctacgcccaggcccccaagcacttccacgtgcctgaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggcccccccagctttgctgtggtgggccctgacatgaagaggaggagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctatggaagaaatggcctgcacaggcctgtgtccacagactttgcccagtacaacagctatggagatgtgtctgggggcgtgcgggactaccagaccctgcctgatggccacatgcctgccatgaggatggaccggggcgtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 18599 - DNA, 594 bp, Artificial Sequence
  Description of Artificial Sequence: Synthetic coding sequence
atgtttggctgcctggtggccggccgcctggtgcagacagctgcccagcaggtggccgaggacaagtttgtgtttgacctgcctgactatgagagcatcaaccacgtggtggtgttcatgctgggcaccatccccttccctgagggcatgggcggctctgtgtacttctcctacccagacagcaatggcatgcctgtgtggcagctgctgggctttgtgaccaacgggaagcccagcgccatcttcaagatcagcggcctgaagtctggagagggcagccagcacccctttggagccatgaacatcgtgaggaccccatctgtggcccagatcggcatctctgtggagctgctggacagcatggcccagcagacccctgtgggcaatgctgctgtgtcctctgtggacagcttcacccagttcacccagaagatgctggacaacttctacaactttgccagcagctttgctgtgtcccaggcccagatgacccccagccccagcgagatgttcatcccagccaacgtggtgctgaagtggtatgagaacttccagaggcggctggcccagaaccccctcttctggaagacctag

SEQ ID NO: 18600 - DNA, 930 bp, Artificial Sequence
  Description of Artificial Sequence: Synthetic coding sequence
atggtgtttcctgccaagcgcttctgcctggtgcccagcatggagggcgtgcgctgggccttcagctgtggcacctggctgcccagcagagctgagtggctgctggccgtgcgcagcatccagcctgaggagaaggagcgcatcggccagtttgtgtttgccagagatgccaaggccgccatggccggccgcctgatgatcaggaagctggtggccgagaagctgaacatcccctggaaccacatccggctgcagaggacagccaagggcaagcctgtgctggccaaggacagcagcaacccctaccccaacttcaacttcaacatcagccaccagggcgactatgctgtgctggccgctgagcctgagctgcaggtgggcatcgacatcatgaagaccagcttccctggccggggcagcatccctgagttcttccacatcatgaagaggaagttcaccaacaaggagtgggagaccatccgctccttcaaggatgagtggacccagctggacatgttctacagaaactgggccctgaaggagagcttcatcaaggccatcggcgtgggcctgggctttgagctgcagaggctggagtttgacctgagccccctgaacctggacatcggccaggtgtacaaggagaccaggctcttcctggatggagaggaggagaaggagtgggcctttgaggagagcaagattgatgagcaccactttgtggccgtggccctgaggaagccagatggcagccgccaccaggatgtgcccagccaggatgacagcaagcccacccagaggcagttcaccatcctgaacttcaatgacctgatgagcagcgctgtgcccatgaccccagaggaccccagcttctgggactgcttctgcttcacagaggagatccccatcagaaatggcaccaagagctag

SEQ ID NO: 18601 - DNA, 1599 bp, Artificial Sequence
  Description of Artificial Sequence: Synthetic coding sequence
atgcagagctgtgagagcagcggggacagcgcagatgaccccctgagccggggcctgcggcggcggggccagccccgggtggtggtgattggagctggcctggccggcctggccgccgccaaggccctgctggagcagggcttcacagatgtgacagtgctggaggccagcagccacatcggcggccgggtgcagagcgtgaagctgggccacgccacctttgagctgggcgccacctggatccacggcagccacggcaaccccatctaccacctggccgaggccaacggcctgctggaggagaccacagatggagagaggtctgtgggccgcatcagcctgtacagcaagaatggagtggcctgctacctgaccaaccacggccgccgcatccccaaggatgtggtggaggagttcagtgacctgtacaatgaggtgtacaacctgacccaggagttcttcagacatgacaagcctgtgaatgctgagagccagaacagcgtgggcgtcttcacccgggaggaggtgaggaaccgcatcagaaatgaccctgatgatcctgaggccaccaagaggctgaagctggccatgatccagcagtacctgaaggtggagagctgtgagagcagcagccacagcatggatgaggtgtccctgagcgccttcggggagtggacagagatccctggggcccaccacatcatccccagcggcttcatgagggtggtggagctgctggccgagggcatcccagcccacgtgatccagctgggcaagcctgtgcgctgcatccactgggaccaggccagcgcccggccccggggccctgagattgagccccggggcgtgctgaagaggcagtacaccagcttcttccggcccggcctgcccacagagaaggtggccgccatccaccggctgggcatcggcaccacagacaagatcttcctggagtttgaggagcccttctggggccctgagtgcaacagcctgcagtttgtgtgggaggatgaagctgagagccacaccctgacctacccacctgagctgtggtacaggaagatctgtggctttgatgtgctgtacccacctgagagatatggccacgtgctgagcggctggatctgtggggaggaggccctggtgatggagaagtgtgatgatgaggccgtggccgagatctgcacagagatgctgcggcagttcaccggcaaccccaacatccccaagccccggcgcatcctgcggagcgcctggggcagcaacccctacttccggggcagctacagctacacccaggtgggcagcagtggagcagatgtggagaagctggccaagcccctgccctacacagagagcagcaagacagcccacggcagcagcaccaagcagcagcccggccacctgttcagcagcaaatgtcctgagcagcccctggatgccaacagaggagctgtgaagcccatgcaggtgctcttcagcggggaggccacccacaggaagtactacagcaccacccatggagccctgctgagcggccagcgggaggccgcccggctgattgagatgtacagagacctcttccagcagggcacctag

SEQ ID NO: 18602 - DNA, 2349 bp, Artificial Sequence
  Description of Artificial Sequence: Synthetic coding sequence
atggacagcagcatccacctgagcagcctcatcagcagacatgatgatgaggccaccaggaccagcaccagcgagggcctggaggagggggaggtggagggggagaccctgctgattgtggagagcgaggaccaggcctctgtggacctgagccatgaccagagcggggacagcctgaacagtgatgaaggagatgtgtcctggatggaggagcagctgagctacttctgtgacaagtgccagaagtggatcccagccagccagctgcgggagcagctgagctacctgaagggggacaacttcttccgcttcacctgcagcgactgcagcgcagatggcaaggagcagtatgagcggctgaagctgacctggcagcaggtggtgatgctggccatgtacaacctgagcctggagggcagcggccggcagggctacttccgctggaaggaggacatctgtgccttcatcgagaagcactggaccttcctgctgggcaacaggaagaagaccagcacctggtggagcacagtggccggctgcctgtctgtgggcagccccatgtacttccgcagcggggcccaggagtttggagagcccggctggtggaagctggtgcacaacaagccacccaccatgaagccagagggggagaagctgagcgccagcaccctgaagatcaaggccgccagcaagcccaccctggaccccatcatcaccgtggagggcctgaggaagagggccagcagaaatcctgtggagagcgccatggagctgaaggagaagaggagcaggacccaggaggccaaggacatccggcgggcccagaaggaggccgccggcttcctggacaggagcaccagcagcacccctgtgaagttcatcagccggggccggcggccagatgtgatcctggagaagggggaggtgattgacttcagcagcctgagcagcagtgacaggacccccctgaccagccccagccccagccccagcctggacttcagcgcccctggcaccccagccagccacagcgccacccccagcctgctgtctgaggccgacctgatcccagatgtgatgccaccccaggccctcttccatgatgatgatgagatggagggagatggagtcatcgaccccggcatggagtatgtgcccccacctgctggctctgtggccagcggccctgtggtgggcgtgaggaagaaggtgcggggccctgagcagatcaagcaggaggtggagagcgaggaggagaagccagacaggatggacatcgacagcgaggacacagacagcaacaccagcctgcagacccgggcccgggagaagaggaagccccagctggagaaggacaccaagcccaaggagccccgctacacccctgtgtccatctatgaggagaagctgctgctgaagaggctggaggcctgccctggagctgtggccatgaccccagaggcccggcggctgaagaggaagctgattgtgcggcaggccaagagggaccggggcctgcccctgtttgacctggaccaggtggtgaatgctgccctgctgctggtggatggcatctacggggccaaggagggcggcatcagccggctgcctgctggccaggccacctaccgcaccacctgccaggacttccgcatcctggaccgctaccagaccagcctgcccagcaggaagggcttccgccaccagaccaccaagttcctgtaccgcctggtgggcagcgaggacatggctgtggaccagagcatcgtgagcccctacaccagccgcatcctgaagccctacatcagaagagattatgagaccaagccacccaagctgcagctgctgagccagatccgcagccacctgcacagaagtgacccccactggaccccagagccagatgcccccctggactactgctacgtgcggcccaaccacatccccaccatcaacagcatgtgccaggagttcttctggccaggcatcgacctgtctgaatgtctgcagtacccagacttctctgtggtggtgctgtacaagaaggtgatcatcgccttcggcttcatggtgcctgatgtgaagtacaatgaggcctacatctccttcctgtttgtgcaccctgagtggaggagagctggcatcgccaccttcatgatctaccacctgatccagacctgcatgggcaaggatgtgaccctgcacgtgtctgccagcaacccagccatgctgctgtaccagaagtttggcttcaagacagaggagtatgtgctggacttctatgacaagtactaccccctggagagcacagagtgcaagcacgccttcttcctgcggctgcggaggtag

SEQ ID NO: 18603 - DNA, 2745 bp, Artificial Sequence
  Description of Artificial Sequence: Synthetic coding sequence
atgggcaccacagcccctggccccatccacctgctggagctgtgtgaccagaagctgatggagttcctgtgcaacatggacaacaaggacctggtgtggctggaggagatccaggaggaggccgagaggatgttcacccgggagttcagcaaggagcctgagctgatgcccaagacccccagccagaagaacagaaggaagaagaggcgcatctcctatgtgcaggatgaaaatagagaccccatcagaagaaggctgagcaggaggaagagccgcagcagccagctgagcagccggcggctgcggagcaaggacagcgtggagaagctggccaccgtggtgggggagaatggatctgtgctgcggcgggtgaccagggctgctgctgctgctgctgctgccaccatggccctggccgcccccagcagccccaccccagagagccccaccatgctgaccaagaagccagaggacaaccacacccagtgccagctggtgcctgtggtggagatcggcatcagcgagcggcagaatgctgagcagcacgtgacccagctgatgagcacagagcccctgcccaggaccctgagccccaccccagccagcgccacagcccccaccagccagggcatccccaccagtgatgaggagagcacccccaagaagagcaaggcccgcatcctggagagcatcaccgtgagcagcctgatggccaccccccaggaccccaagggccagggcgtgggcaccggccgcagcgccagcaagctgagaattgcccaggtgtccccaggcccccgggacagccctgccttcccagacagcccctggagggagcgggtgctggcccccatcctgcctgacaacttcagcacccccaccggcagcaggacagacagccagagcgtgcgccacagccccatcgcccccagcagccccagcccccaggtgctggcccagaagtacagcctggtggccaagcaggagagcgtggtgagaagagccagccggcggctggccaagaagacagctgaggagcctgctgccagcggccgcatcatctgccacagctacctggagcggctgctgaatgtggaggtgccccagaaggtgggcagcgagcagaaggagcccccagaggaggccgagcctgtggccgctgctgagcctgaggtgcctgagaacaacggcaacaacagctggccccacaatgacacagagatcgccaacagcacccccaaccccaagccagctgccagcagccctgagacccccagcgctggccagcaggaggccaagacagaccaggctgatggcccccgggagcccccccagagcgcccggaggaagaggagctacaagcaggccgtgtctgagctggatgaggagcagcacctggaggatgaggagctgcagcccccaagaagcaagacccccagcagcccctgcccagccagcaaggtggtgcggcccctgcggaccttcctgcacacagtgcagaggaaccagatgctgatgacccccaccagcgcccccaggtctgtgatgaagagcttcatcaagaggaacacccccctgaggatggaccccaaggagaaggagcggcagaggctggagaacctgcggaggaaggaggaggccgagcagctgcggcggcagaaggtggaggaggacaagagaagaaggctggaggaggtgaagctgaagcgggaggagcggctgaggaaggtgctgcaggcccgggagcgggtggagcagatgaaggaggagaagaagaagcagatcgagcagaagtttgcccagattgatgagaagacagagaaggccaaggaggagcggctggccgaggagaaggccaagaagaaggccgccgccaagaagatggaggaggtggaggcccggaggaagcaggaggaggaggcccggcggctgcgctggctgcagcaggaggaggaggagcggcggcaccaggagctgctgcagaagaagaaggaggaggagcaggagcggctgaggaaggctgctgaggccaagaggctggccgagcagcgggagcaggagcggcgggagcaggagcggcgggagcaggagcggcgggagcaggagcggcgggagcaggagcggcgggagcaggagcggcagctggccgagcaggagaggagaagagagcaggagcggctgcaggccgagcgggagctgcaggagcgggagaaggccctgcggctgcagaaggagcagctgcagcgggagctggaggagaagaagaagaaggaggagcagcagaggctggccgagcggcagctgcaggaggagcaggagaagaaggccaaggaggccgccggggccagcaaggccctgaatgtgacagtggatgtgcagagccctgcctgcaccagctaccagatgaccccccagggccaccgggccccacccaagatcaacccagacaactacggcatggacctgaacagtgatgacagcacagatgatgaggcccaccccaggaagcccatccccacctgggcccggggcacccccctgagccaggccatcatccaccagtactaccacccccccaacctgctggagctgtttggcaccatcctgcccctggacctggaggacatcttcaagaagagcaagccccgctaccacaagaggaccagcagcgctgtgtggaacagcccccccctgcagggcgcccgggtgcccagcagcctggcctacagcctgaagaagcactag

SEQ ID NO: 18604 - DNA, 4149 bp, Artificial Sequence
  Description of Artificial Sequence: Synthetic coding sequence
atggatgaggaggagaaccactacgtgtcccagctgcgggaggtgtacagcagctgtgacaccaccggcaccggcttcctggaccggcaggagctgacccagctgtgcctgaagctgcacctggagcagcagctgcctgtgctgctgcagaccctgctgggcaatgaccactttgcccgggtgaactttgaggagttcaaggagggctttgtggccgtgctgagcagcaatgctggggtgcggcccagtgatgaggacagcagcagcctggagagcgctgccagcagcgccatcccccccaagtatgtgaatggcagcaagtggtatggaagaagaagcaggcctgagctgtgtgatgctgccacagaggccaggagagtgcctgagcagcagacccaggccagcctgaagagccacctgtggaggtctgccagcctggagagcgtggagagccccaagagtgatgaggaggccgagagcaccaaggaggcccagaatgagctgtttgaggcccagggccagctgcagacctgggacagtgaagattttggcagcccccagaagagctgcagccccagctttgacaccccagagagccagatccggggcgtgtgggaggagctgggcgtgggcagcagcggccacctgtctgagcaggagctggccgtggtgtgccagagcgtgggcctgcagggcctggagaaggaggagctggaggacctcttcaacaagctggaccaggatggagatggcaaggtgtccctggaggagttccagctgggcctcttcagccatgagcccgccctgctgctggagagcagcaccagggtgaagcccagcaaggcctggagccactaccaggtgcctgaggagagcggctgccacaccaccaccaccagcagcctggtgtccctgtgcagcagcctgcggctcttcagcagcattgatgatggcagcggctttgccttcccagaccaggtgctggccatgtggacccaggagggcatccagaatggccgggagatcctgcagagcctggacttctctgtggatgagaaggtgaacctgctggagctgacctgggccctggacaatgagctgatgacagtggacagcgctgtgcagcaggccgccctggcctgctaccaccaggagctgagctaccagcagggccaggtggagcagctggcccgggagcgggacaaggcccggcaggacctggagcgggcagagaagaggaacctggagtttgtgaaggagatggatgactgccacagcaccctggagcagctgacagagaagaagatcaagcacctggagcagggctaccgggagcggctgagcctgctgcggtctgaggtggaggccgagcgggagctgttctgggagcaggcccaccggcagagagctgccctggagtgggatgtgggccgcctgcaggccgaggaggccggcctgcgggagaagctgaccctggccctgaaggagaacagccggctgcagaaggagatcgtggaggtggtggagaagctgagtgacagcgagcggctggccctgaagctgcagaaggacctggagtttgtgctgaaggacaagctggagccccagagcgctgagctgctggcccaggaggagagatttgctgctgtgctgaaggagtatgagctgaagtgccgggacctgcaggacagaaatgatgagctgcaggccgagctggagggcctgtgggcccggctgcccaagaacagacacagccccagctggagcccagatggaagaagacggcagctgcccggcctgggccctgctggcatctccttcctgggcaacagcgcccctgtgtccattgaaacagagctgatgatggagcaggtgaaggagcactaccaggacctgcggacccagctggagaccaaggtgaactactatgagcgggagattgctgccctgaagaggaactttgagaaggagaggaaggacatggagcaggcccggcggcgggaggtgtctgtgctggagggccagaaggctgacctggaggagctgcacgagaagagccaggaggtgatctggggcctgcaggagcagctgcaggacacagcccggggccctgagcctgagcagatgggcctggccccctgctgcacccaggccctgtgtggcctggccctgcggcaccacagccacctgcagcagatccggcgggaggccgaggccgagctgagcggggagctgagcggcctgggcgccctgcctgcccggcgggacctgaccctggagctggaggagcccccccagggccccctgccccggggcagccagaggtctgagcagctggagctggagcgggccctgaagctgcagccctgtgccagcgagaagagggcccagatgtgtgtgtccctggccctggaggaggaggagctggagctggcccggggcaagagggtggatggccccagcctggaggccgagatgcaggccctgcccaaggatggcctggtggccggcagcggccaggagggcacccggggcctgctgcccctgcggcccggctgtggggagcggcccctggcctggctggcccctggagatggccgggagagcgaggaggccgccggggccggcccccggcggcggcaggcccaggacacagaggccacccagagccctgccccagccccagccccagccagccacggccccagcgagcgctggagcaggatgcagccctgtggggtggatggagacatcgtgcccaaggagcctgagccctttggagccagcgctgctggcctggagcagcccggggcccgggagctgcccctgctgggcacagaaagagatgccagccagacccagcccaggatgtgggagccccccctgcggcctgctgccagctgccggggccaggccgagcggctgcaggccatccaggaggagcgggcccgctcctggagccggggcacccaggagcaggccagcgagcagcaggcccgggcagagggcgccctggagcccggctgccacaagcacagcgtggaggtggcccggcggggcagcctgcccagccacctgcagctggccgacccccagggctcctggcaggagcagctggccgcccctgaggagggggagaccaagatcgccctggagcgggagaaggatgacatggagaccaagctgctgcacctggaggatgtggtgcgggccctggagaagcacgtggacctgcgggagaatgaccggctggagttccaccggctgtctgaggagaacaccctgctgaagaatgacctgggccgggtgcggcaggagctggaggccgctgagagcacccatgatgcccagaggaaggagattgaggtgctgaagaaggacaaggagaaggcctgcagcgagatggaggtgctgaaccggcagaaccagaactacaaggaccagctgagccagctgaatgtgcgggtgctgcagctgggccaggaggccagcacccaccaggcccagaatgaggagcaccgggtgaccatccagatgctgacccagagcctggaggaggtggtgcgcagcggccagcagcagagcgaccagatccagaagctgcgggtggagctggagtgcctgaaccaggagcaccagagcctgcagctgccctggagcgagctgacccagaccctggaggagagccaggaccaggtgcagggcgcccacctgcggctgcggcaggcccaggcccagcacctgcaggaggtgcggctggtgccccaggacagagtggccgagctgcaccggctgctgagcctgcagggcgagcaggcccggcggcggctggatgcccagcgggaggagcacgagaagcagctgaaggccacagaggagcgggtggaggaggccgagatgatcctgaagaacatggagatgctgctgcaggagaaggtggacaagctgaaggagcagtttgagaagaacaccaagagtgacctgctgctgaaggagctgtatgtggagaatgcccacctggtgcgggccctgcaggccacagaggagaagcagagaggagctgagaagcagagccggctgctggaggagaaggtgcgggccctgaacaagctggtgtccagaattgccccagctgccctgtctgtgtag

SEQ ID NO: 18605 - DNA, 4383 bp, Artificial Sequence
  Description of Artificial Sequence: Synthetic coding sequence
atggccggccggcccctgcgcatcggggaccagctggtgctggaggaggactatgatgagacctacatccccagcgagcaggagatcctggagtttgcccgggagatcggcatcgaccccatcaaggagcctgagctgatgtggctggcccgggagggcatcgtggcccccctgcctggagagtggaagccctgccaggacatcactggagacatctactacttcaactttgccaacggccagagcatgtgggaccacccctgtgatgagcactaccgcagcctggtgatccaggagcgggccaagctgagcaccagcggggccatcaagaagaagaagaagaagaaggagaagaaggacaagaaggaccgggacccccccaagagcagcctggccctgggcagcagcctggcccctgtgcacgtgcccctgggcggcctggcccccctgcggggcctggtggacaccccaccttctgccctgcggggcagccagagcgtgtccctgggcagctctgtggagagcggccggcagctgggggagctgatgctgcccagccagggcctgaagaccagcgcctacaccaagggcctgctgggcagcatctatgaggacaagacagccctgagcctgctgggcctgggggaggagaccaatgaagaagatgaggaggagagtgacaaccagagcgtgcacagcagcagcgagcccctgaggaacctgcacctggacattggagccctgggcggggactttgaatatgaggagagcctgcggaccagccagcctgaggagaagaaggatgtgtccctggacagtgatgctgctggcccccccaccccctgcaagcccagcagccctggagctgacagcagcctgagcagcgctgtgggcaagggccggcagggcagcggggcccggcccggcctgcctgagaaggaggagaatgagaagtctgagcccaagatctgcaggaacctggtgacccccaaggctgaccccactggaagtgagcccgccaaggccagcgagaaggaggccccagaagatactgtggatgctggggaggagggcagccggcgggaggaggccgccaaggagcccaagaagaaggccagcgccctggaggagggcagcagtgatgccagccaggagctggagatcagcgagcacatgaaggagccccagctgagtgacagcatcgccagtgaccccaagagcttccacggcctggactttggcttccgcagccgcatcagcgagcacctgctggatgtggatgtgctgagccctgtgctgggcggggcctgccggcaggcccagcagcccctgggcatcgaggacaaggatgacagccagagcagccaggatgagctgcagagcaagcagagcaagggcctggaggagcggctgagcccccccctgccccatgaggagcgggcccagagcccccccaggagcctggccacagaggaggagcccccccagggccctgagggccagcctgagtggaaggaggccgaggagctgggggaggacagcgctgccagcctgagcctgcagctgagcctgcagcgggagcaggcccccagccccccagctgcctgtgagaagggcaaggagcagcacagccaggccgaggagctgggccctggccaggaggaggctgaagatcctgaggagaaggtggccgtgagccccaccccacctgtgtccccagaggtgcgcagcacagagcctgtggcccctcctgagcagctgtctgaggccgccctgaaggccatggaggaggccgtggcccaggtgctggagcaggaccagaggcacctgctggagagcaagcaggagaagatgcagcagctgcgggagaagctgtgccaggaggaggaggaggagatcctgcggctgcaccagcagaaggagcagagcctgagcagcctgcgggagcggctgcagaaggccatcgaggaggaggaggccaggatgagggaggaggagagccagaggctgtcctggctgcgggcccaggtgcagagcagcacccaggctgatgaggaccagatccgggcagagcaggaggccagcctgcagaagctgcgggaggagctggagagccagcagaaggccgagcgggccagcctggagcagaagaaccggcagatgctggagcagctgaaggaggagattgaggccagcgagaagtctgagcaggccgccctgaatgctgccaaggagaaggccctgcagcagctgcgggagcagctggagggggagaggaaggaggccgtggccaccctggagaaggagcacagcgctgagctggagcggctgtgcagcagcctggaggccaagcaccgggaggtggtgagcagcctgcagaagaagatccaggaggcccagcagaaggaggaggcccagctgcagaagtgcctgggccaggtggagcaccgggtgcaccagaagagctaccacgtggccggctatgagcacgagctgagcagcctgctgcgggagaagaggcaggaggtggagggggagcatgaaagaaggctggacaagatgaaggaggagcaccagcaggtgatggccaaggcccgggagcagtatgaagctgaggagaggaagcagagagctgagctgctgggccacctgactggagagctggagcggctgcagagggcccacgagcgggagctggagaccgtgcggcaggagcagcacaagaggctggaggacctgcggcggcggcaccgggagcaggagaggaagctgcaggacctggagctggacctggagacccgggccaaggatgtgaaggcccggctggccctgctggaggtgcaggaggagacagcccggcgggagaagcagcagctgctggatgtgcagaggcaggtggccctgaagtctgaggaggccacagccacccaccagcagctggaggaggcccagaaggagcacacccacctgctgcagagcaaccagcagctgcgggagatcctggatgagctgcaggccaggaagctgaagctggagagccaggtggacctgctgcaggcccagagccagcagctgcagaagcacttcagcagcctggaggccgaggcccagaagaagcagcacctgctgcgggaggtgacagtggaggagaacaatgccagcccccactttgagccagacctgcacatcgaggacctgaggaagagcctgggcaccaaccagaccaaggaggtgagcagcagcctgagccagagcaaagaagatctctacctggacagcctgagcagccacaacgtgtggcacctgctgtctgctgagggcgtggccctgcggagcgccaaggagttcctggtgcagcagaccaggtccatgagaagacggcagacagccctgaaggccgcccagcagcactggaggcatgagctggccagcgcccaggaggtggccaaggaccccccaggcatcaaggccctggaggacatgaggaagaacctggagaaggagaccaggcacctggatgagatgaagagcgccatgaggaagggccacaacctgctgaagaagaaggaggagaagctgaaccagctggagagcagcctgtgggaggaggccagtgatgagggcaccctgggcggcagccccaccaagaaggctgtgacctttgacctgagtgacatggacagcctgagcagcgagagcagcgagagcttcagccccccccaccgggagtggtggaggcagcagagaattgacagcacccccagcctgaccagcaggaagatccacggcctgagccacagcctgcggcagatcagcagccagctgagctctgtgctgagcatcctggacagcctgaacccccagagccccccacccctgctggcctccatgcctgcccagctgcccccccgggaccccaagagcacccccacccccacctactacggcagcctggcccgcttcagcgccctgagcagcgccacccccaccagcacccagtgggcctgggacagcggccagggcccccggctgcccagctctgtggcccagacagtggatgacttcctgctggagaagtggaggaagtacttccccagcggcatccccctgctgagcaacagccccacccccctggagagccggctgggctacatgtctgccagcgagcagctgcggctgctgcagcacagccacagccaggtgcctgaggccggcagcaccaccttccagggcatcatcgaggccaacagacgctggctggagcgggtgaagaatgacccccggctgcccctcttcagcagcacccccaagcccaaggccaccctgagcctgctgcagctgggcctggatgagcacaacagagtgaaggtgtaccgcttctag

SEQ ID NO: 18606 - DNA, 1881 bp, Artificial Sequence
  Description of Artificial Sequence: Synthetic coding sequence
atgatggccaatgatgccaagccagatgtgaagacagtgcaggtgctgcgggacacagccaaccggctgcgcatccacagcatccgggccacctgtgccagcggcagcggccagctgaccagctgctgcagcgctgctgaggtggtgtctgtgctcttcttccacaccatgaagtacaagcagacagatcctgagcacccagacaatgaccgcttcatcctgagccggggccatgctgcccccatcctgtatgctgcctgggtggaggtgggggacatcagcgagagtgacctgctgaacctgaggaagctgcacagcgacctggagcggcaccccaccccccggctgccctttgtggatgtggccaccggcagcctgggccagggcctgggcacagcctgtggcatggcctacacaggcaagtacctggacaaggccagctacagagtcttctgcctgatgggagatggagagagcagcgagggctctgtgtgggaggcctttgcctttgccagccactacaacctggacaacctggtggccgtgtttgatgtgaaccggctgggccagagcggccctgcccccctggagcacggggctgacatctaccagaactgctgtgaggccttcggctggaacacctacctggtggatggccatgatgtggaggccctgtgccaggccttctggcaggccagccaggtgaagaacaagcccacagccatcgtggccaagaccttcaagggccggggcatccccaacattgaagatgctgagaactggcacggcaagcctgtgcccaaggagcgggcagatgccatcgtgaagctgattgagagccagatccagaccaatgaaaacctgatccccaagagccctgtggaggacagcccccagatcagcatcacagacatcaagatgaccagccccccagcctacaaggtgggggacaagatcgccacccagaagacctacggcctggccctggccaagctgggccgggccaatgaaagagtcatcgtgctgagcggggacaccatgaacagcaccttcagcgagatcttcaggaaggagcaccctgagcgcttcatcgagtgcatcatcgccgagcagaacatggtgtctgtggccctgggctgtgccacccggggccgcaccatcgcctttgctggggcctttgctgccttcttcacccgggcctttgaccagctgaggatgggcgccatcagccaggccaacatcaacctgattggcagccactgcggcgtgtccactggagaagatggagtgtcccagatggccctggaggacctggccatgttccgcagcatccccaactgcaccgtcttctaccccagtgatgccatcagcacagagcacgccatctacctggccgccaacaccaagggcatgtgcttcatccgcaccagccagcctgagacagctgtgatctacaccccccaggagaactttgaaattggccaggccaaggtggtgagacatggagtgaatgacaaggtgaccgtcatcggggccggcgtgaccctgcacgaggccctggaggccgctgaccacctgagccagcagggcatctctgtgcgggtcatcgaccccttcaccatcaagcccctggatgctgccaccatcatcagcagcgccaaggccaccggcggccgggtcatcaccgtggaggaccactaccgggagggcggcatcggggaggccgtgtgtgccgctgtgtcccgggagccagacatcctggtgcaccagctggccgtgtctggagtgccccagaggggcaagaccagcgagctgctggacatgtttggcatcagcaccaggcacatcatcgctgctgtgaccctgaccctgatgaagtag

SEQ ID NO: 18607 - DNA, 999 bp, Artificial Sequence
  Description of Artificial Sequence: Synthetic coding sequence
atggccaccatcaagtctgagctgatcaagaactttgctgaggaggaggccatccaccacaacaagatcagcatcgtgggcaccggctctgtgggcgtggcctgtgccatcagcatcctgctgaagggcctgagtgatgagctggtgctggtggatgtggatgagggcaagctgaagggggagaccatggacctgcagcacggcagccccttcatgaagatgcccaacatcgtgagcagcaaggactacctggtgacagccaacagcaacctggtgatcatcacagctggggcccggcagaagaagggggagacccggctggacctggtgcagagaaatgtgtccatcttcaagctgatgatccccaacatcacccagtacagcccccactgcaagctgctgattgtgaccaaccctgtggacatcctgacctacgtggcctggaagctgagcggcttccccaagaacagagtgattggcagcggctgcaacctggacagcgcccgcttccgctacttcatcggccagaggctgggcatccacagcgagagctgccacggcctcatcctgggggagcacggggacagctctgtgcctgtgtggagcggcgtgaacattgctggggtgcccctgaaggacctgaacccagacatcggcacagacaaggaccctgagcagtgggagaatgtgcacaagaaggtgatcagcagcggctatgagatggtgaagatgaagggctacacctcctggggcatcagcctgtctgtggccgacctgacagagagcatcctgaagaacctgcggcgggtgcaccctgtgtccaccctgagcaagggcctgtatggcatcaatgaagacatcttcctgtctgtgccctgcatcctgggagaaaatggcatcacagacctgatcaaggtgaagctgaccctggaggaggaggcctgcctgcagaagtctgctgagaccctgtgggagatccagaaggagctgaagctgtag

SEQ ID NO: 18608 - DNA, 972 bp, Artificial Sequence
  Description of Artificial Sequence: Synthetic coding sequence
atgcctgagatgcctgaggacatggagcaggaggaggtgaacatccccaacagaagagtgctggtgactggagccaccggcctgctgggccgggctgtgcacaaggagttccagcagaacaactggcatgctgtgggctgcggcttccggcgggcccggcccaagtttgagcaggtgaacctgctggacagcaatgctgtgcaccacatcatccatgacttccagccccacgtgattgtgcactgtgccgctgagcggcggccagatgtggtggagaaccagccagatgctgccagccagctgaatgtggatgccagcggcaacctggccaaggaggccgctgctgtgggcgccttcctgatctacatcagcagtgactatgtgtttgatggcaccaaccccccctaccgggaggaggacatcccagcccccctgaacctgtatggcaagaccaagctggatggagagaaggctgtgctggagaacaacctgggcgctgctgtgctgcgcatccccatcctgtatggagaggtggagaagctggaggagagcgctgtgacagtgatgtttgacaaggtgcagttcagcaacaagagcgccaacatggaccactggcagcagcgcttccccacccacgtgaaggatgtggccaccgtgtgccggcagctggccgagaagaggatgctggaccccagcatcaagggcaccttccactggagcggaaatgagcagatgaccaagtatgagatggcctgtgccatcgcagatgccttcaacctgcccagcagccacctgcggcccatcacagacagccctgtgctgggcgcccagaggcccagaaatgcccagctggactgcagcaagctggagaccctgggcatcggccagaggacccccttccgcatcggcatcaaggagagcctgtggcccttcctgattgacaagcgctggaggcagaccgtcttccactag

SEQ ID NO: 18609 - DNA, 3285 bp, Artificial Sequence
  Description of Artificial Sequence: Synthetic coding sequence
atggccgagagcagcagcgagagtgaccacttccgctgccgggaccggctgagcccctgggccgcccggagcacccaccggggcaccaggagcctgcccaccgtggaggtgacagagaaggtgaacaccatcaccagcaccctgcaggacaccagcaggaacctgcggcaggtggaccagatgctgggccgctaccgggagtacagcaatggccaggccggggccatcgagcacctgaaggagagcctggagcagagcattgaccagctgcggagccagaggctgctgagaaattctgggggccgcagcatctctgtgaccagcctgagcgccagtgacctggatggcggcaccggcagcgagctgcaccacttcccccccaccagccccctgaaggactatggagacccccagggcatcaagaggatgaggagcaggactggagtgcgctttgtgcaggagacagatgacatgacccagctgcacggcttccaccagagcctgcgggacctgagcagcgagcagatccggctgggagatgacttcaaccgggagctgagccgccgcagcagaagtgatgctgagaccaagagggccctggaggagctgacagagaagctgaatgaggcccagaagcaggaggtggtgtctgacagagtggagcggcggctgcaggagctggagcgggagatgaggacagagcgggagctggtggagcggcggcaggaccagctgggcctgatgagcctgcagctgcaggaggccctgaagaagcaggaggccaaggcagatgagcacgagggcgccatcaagaacaagctgcggcagacagaaacagagaagaaccagctggagcaggagctggagctgagccggcggctgctgaaccagagcgagggcagccgggagaccctgctgcaccaggtggaggagctgcggacccagctgaccaaggccgagggggacaggaagggcctgcagcaccaggtgtcccagatcagcaagcagcagagcaactaccaggatgagcagggcgaggactggaggttcagaagaggagtggagcgggagaagcaggacctggagaagcagatgtctgacctgcgggtgcagctgaacttcagcgccatggccagcgagctggaggaggtgaagcgctgcatggagaggaaggacaaggagaaggcccacctggccagccaggtggagaacctgacccgggagctggagaatggagagaagcagcagctgcagatgctggaccggctgaaggagatccagaaccactttgacacctgtgaggccgagaggaagcacgccgacctgcagatcagcgagctgaccaggcatgctgaagatgccaccaagcaggccgagcgctacctgtctgagctgcagcagagcgaggccctgaaggaggaggccgagaagaggcgggaggacctgaagctgaaggcccaggagagcatccggcagtggaagctgaagcacaagaagctggagcgggccctggagaagcagagcgagaccgtggatgagctgaccgggaagaacaaccagatcctgaaggagaaggatgagctgaagacccagctgtatgctgccctgcagcagatcgagaacctgaggaaggagctgaatgatgtgctgaccaagagggccctgcaggaggaggagctgcacagcaaggaggagaagctgcgggacatcaagagccaccaggccgacctggagctggaggtgaagaacagcctggacaccatccaccggctggagagcgagctgaagaagcagagcaagatccagagccagatgaaggtggagaaggcccacctggaggaggagattgctgagctgaagaagagccaggcccaggacaaggccaagctgctggagatgcaggagagcatcaaggacctgagcgccatccgggctgacctggccaacaagctggccgaggaggagcgggccaagaaggctgtgctgaaggacctgagtgacctgacagcccaggccaagagcagagatgaggagacagccaccatcatcacccagctgaagctggagagagatgtgcaccagcgggagctgaaggacctgaccagcagcctgcagagcgtgaagaccaagcatgagcagaacatccaggagctgatgaagcacttcaagaaggagaagtctgaggccgagaaccacatccgcaccctgaaggccgagagcctggaggagaagaacatggccaagatccaccggggccagctggagaagctgaagagccagtgtgaccggctgacagaggagctgacccagaatgaaaatgaaaacaagaagctgaagctgaagtaccagtgcctgaaggaccagctggaggagcgggagaagcacatcagcattgaggaggagcacctgcggaggatggaggaggcccggctgcagctgaaggaccagctgctgtgcctggagacagagcaggagagcatcctgggcgtgattggcaaggagattgatgctgcctgcaagaccttcagcaaggacagcgtggagaagctgaaggtgttcagcagcggccctgacatccactatgacccccaccgctggctggccgagagcaagaccaagctgcagtggctgtgtgaggagctgaaggagagagaaaatcgggagaagaacctgcggcaccagctgatgctgtgccggcagcagctgaggaacctgacagagaacaaggagagcgagctgcagtgcctcttccagcagatcgagcggcaggagcagctgctggatgagatccaccgggagaagagggacctgctggaggagacccagaggaaggatgaggagatgggcagcctgcaggacagagtcatcgccctggagaccagcacccaggtggccctggaccacctggagagcgtgcctgagaagctgagcctgctggaggacttcaaggacttccgggacagctgcagcagcagcgagaggacagatggccgctacagcaagtacagagtgagaagaaacagcctgcagcaccaccaggatgacaccaagtaccgcaccaagagcttcaagggggacaggaccttcctggagggcagccacacccggggcctggaccacagcagctcctggcaggaccacagccgcttcctgagcagcccccgcttctcctatgtgaacagcttcaccaagaggacagtggccccagattctgccagcaacaaggaggatgccaccatgaatggcaccagcagccagcccaagaaggaggagtatggcagctag

SEQ ID NO: 18610 - DNA, 1011 bp, Artificial Sequence
  Description of Artificial Sequence: Synthetic coding sequence
atgaagaaggagcacgtgctgcactgccagttcagcgcctggtaccccttcttccggggcgtgaccatcaagagcgtcatcctgcccctgccccagaatgtgaaggactacctgctggatgatggcaccctggtggtgtctggaagagatgacccccccacccacagccagcctgacagtgatgatgaggccgaggagatccagtggagcgatgatgaaaatacagccaccctgacagcccctgagttccctgagtttgccaccaaggtgcaggaggccatcaacagcctgggcggcagcgtcttccccaagctgaactggagcgcccccagagatgcctactggatcgccatgaacagcagcctgaagtgcaagaccctgagtgacatcttcctgctcttcaagagcagtgacttcatcacccgggacttcacccagcccttcatccactgcacagatgacagcccagacccctgcatcgagtatgagctggtgctgaggaagtggtgtgagctgatccctggagctgagttccgctgctttgtgaaggagaacaagctgattggcatcagccagagggactacacccagtactatgaccacatcagcaagcagaaggaggagatccgccgctgcatccaggacttcttcaagaagcacatccagtacaagttcctggatgaggactttgtgtttgacatctacagagacagccggggcaaggtgtggctgattgacttcaacccctttggagaggtgacagacagcctgctcttcacctgggaggagctgatcagcgagaacaacctgaatggagacttcagcgaggtggatgcccaggagcaggacagccctgccttccgctgcaccaacagcgaggtgacagtgcagcccagcccctacctgagctaccgcctgcccaaggactttgtggacctgagcactggagaagatgcccacaagctgattgacttcctgaagctgaagaggaaccagcaggaggatgactag

SEQ ID NO: 18611 - DNA, 1248 bp, Artificial Sequence
  Description of Artificial Sequence: Synthetic coding sequence
atgaagctgagcctgaccaaggtggtgaatggctgccgcctgggcaagatcaagaacctgggcaagacaggagaccacaccatggacatccctggctgcctgctgtacaccaagacaggcagcgccccccacctgacccaccacaccctgcacaacatccacggcgtgcctgccatggcccagctgaccctgagcagcctggccgagcaccacgaggtgctgacagagtacaaggagggcgtgggcaagttcatcggcatgcctgagagcctgctgtactgcagcctgcatgaccctgtgagcccctgcccagctggctacgtgaccaacaagtctgtgtctgtgtggagcgtggccggccgggtggagatgacagtgtccaagttcatggccatccagaaggccctgcagcctgactggttccagtgcctgagtgatggagaggtgtcctgcaaggaggccaccagcatcaagagggtgaggaagtctgtggacaggagcctgctcttcctggacaactgcctgcggctgcaggaggagagcgaggtgctgcagaagagcgtcatcatcggcgtgattgaaggaggagatgtgatggaggagcggctgcggagcgcccgggagacagccaagaggcctgtgggcggcttcctgctggatggcttccagggcaaccccaccaccctggaggcccggctgcggctgctgagctctgtgacagctgagctgcctgaggacaagcccaggctcatcagcggcgtgtccaggccagatgaggtgctggagtgcatcgagcggggcgtggacctgtttgagagcttcttcccctaccaggtgacagagcggggctgtgccctgaccttctcctttgactaccagcccaaccctgaggagaccctgctgcagcagaatggcacccaggaggagatcaagtgcatggaccagatcaagaagattgagaccaccggctgcaaccaggagatcaccagctttgagatcaacctgaaggagaagaagtaccaggaggacttcaaccccctggtgcggggctgcagctgctactgctgcaagaaccacacccgggcctacatccaccacctgctggtgaccaatgagctgctggccggcgtgctgctgatgatgcacaactttgagcactacttcggcttcttccactacatccgggaggccctgaagagtgacaagctggcccagctgaaggagctgatccaccggcaggccagctag

SEQ ID NO: 18612 - DNA, 1770 bp, Artificial Sequence
  Description of Artificial Sequence: Synthetic coding sequence
atgcccaccgtgtctgtgaagagggacctgctcttccaggccctgggccgcacctacacagatgaggagtttgatgagctgtgctttgaatttggcctggagctggatgagatcaccagcgagaaggagatcatcagcaaggagcagggcaatgtgaaggctgctggggccagtgatgtggtgctgtacaagattgatgtgcctgccaacagatatgacctgctgtgcctggagggcctggtgcggggcctgcaggtgttcaaggagcgcatcaaggcccctgtgtacaagagggtgatgccagatggcaagatccagaagctgatcatcacagaggagacagccaagatccggccctttgctgtggccgctgtgctgaggaacatcaagttcaccaaggacagatatgacagcttcatcgagctgcaggagaagctgcaccagaacatctgcaggaagagggccctggtggccatcggcacccatgacctggacaccctgagcggccccttcacctacacagccaagaggcccagcgacatcaagttcaagcccctgaacaagaccaaggagtacacagcctgtgagctgatgaacatctacaagacagacaaccacctgaagcactacctgcacatcatcgagaacaagcccctgtaccctgtgatctatgacagcaatggagtggtgctgtccatgccacccatcatcaacggggaccacagccgcatcaccgtgaacaccaggaacatcttcatcgagtgcaccggcacagacttcaccaaggccaagatcgtgctggacatcatcgtgaccatgttttctgagtactgtgagaaccagttcaccgtggaggccgctgaggtggtgttccccaacgggaagagccacaccttccctgagctggcctacaggaaggagatggtgcgggctgacctgatcaacaagaaggtgggcatccgggagaccccagagaacctggccaagctgctgaccaggatgtacctgaagtctgaggtgattggagatggcaaccagattgaaattgagatcccccccaccagggctgacatcatccacgcctgtgacatcgtggaggatgctgccatcgcctacggctacaacaacatccagatgaccctgcccaagacctacaccatcgccaaccagttccccctgaacaagctgacagagctgctgcggcatgacatggctgctgctggcttcacagaggccctgacctttgccctgtgcagccaggaggacattgctgacaagctgggcgtggacatcagcgccaccaaggctgtgcacatcagcaaccccaagacagctgagttccaggtggcccggaccaccctgctgcccggcctgctgaagaccatcgccgccaacaggaagatgcccctgcccctgaagctgtttgagatcagtgacatcgtcatcaaggacagcaacacagatgtgggcgccaagaactaccgccacctgtgtgctgtgtactacaacaagaaccctggctttgagatcatccacggcctgctggaccgcatcatgcagctgctggatgtgcccccaggagaggacaagggcggctacgtgatcaaggccagcgagggccctgccttcttccctggccgctgtgccgagatctttgcccggggccagagcgtgggcaagctgggcgtgctgcacccagatgtgatcaccaagtttgagctgaccatgccctgcagcagcctggagatcaacgtgggccccttcctgtag

SEQ ID NO: 18613 - DNA, 477 bp, Artificial Sequence
  Description of Artificial Sequence: Synthetic coding sequence
atggccgcccagggcgtgggccctggccctggcagcgctgcccctcctggcctggaggccgcccggcagaagctggccctgcggaggaagaaggtgctgagcacagaggagatggagctgtatgagctggcccaggccgccggcggggccattgatcctgatgtgttcaagatcctggtggacctgctgaagctgaatgtggcccccctggccgtgttccagatgctgaagtccatgtgtgccggccagaggctggccagcgagccccaggaccctgctgctgtgtccctgcccaccagctctgtgcctgagacccggggcaggaacaagggcagcgctgccctgggcggggccctggccctggccgagaggagcagccgggagggcagcagccagaggatgccccggcagcccagcgccacccggctgcccaagggcggcggccctgggaagagccccacccggggcagcacctag

SEQ ID NO: 18614 - DNA, 675 bp, Artificial Sequence
  Description of Artificial Sequence: Synthetic coding sequence
atggtggaggatgagctggccctgtttgacaagagcatcaatgagttctggaacaagttcaagagcacagacaccagctgccagatggccggcctgcgggacacctacaaggacagcatcaaggcctttgctgagaagctgtctgtgaagctgaaggaggaggagaggatggtggagatgttcctggagtaccagaaccagatcagccggcagaacaagctgatccaggagaagaaggacaacctgctgaagctgattgctgaggtgaagggcaagaagcaggagctggaggtgctgacagccaacatccaggacctgaaggaggagtacagcaggaagaaggagaccatcagcacagccaacaaggccaatgctgagcggctgaagaggctgcagaagtctgctgacctgtacaaggaccggctgggcctggagatcaggaagatctacggggagaagctgcagttcatcttcaccaacatcgaccccaagaaccctgagagccccttcatgttcagcctgcacctgaatgaggcccgggactatgaggtgtctgattctgccccccacctggagggcctggccgagttccaggagaatgtgaggaagaccaacaacttcagcgccttcctggccaacgtgaggaaggccttcaccgccaccgtgtacaactag

SEQ ID NO: 18615 - DNA, 1728 bp, Artificial Sequence
  Description of Artificial Sequence: Synthetic coding sequence
atgaagctgacagacagcaccaagggctggatcgtgtgggccgccctggacagctccatgaggggcatgagcctgtctgctggcagcagccccctgcacagccccaagatcaccccccacaccagccctgcccccaggagaagaagccacacccccaacccagccagctacatggtgcccagcagcgccagcacctctgtgaacaaccctgtgtcccagacccccagcagcggccaggtgatccagaaggagaccgtgggcggcaccacctacttctacacagacaccaccccagcccccctgaccggcatggtgttccccaactaccacatctacccacccacagccccccacgtggcctacatgcagcccaaggccaatgcccccagcttcttcatggctgatgagctgcggcaggagctgatcaacagacacctgatcaccatggcccagattgaccaggccgacatgcctgctgtgcccacagaggtggacagctaccacagcctcttccccctggagcccctgcccccacccaaccgcatccagaagagcagcaactttggctacatcaccagctgctacaaggctgtgaacagcaaggatgacctgccctactgcctgcggcgcatccacggcttccggctggtgaacaccaagtgcatggtgctggtggacatgtggaagaagatccagcacagcaacatcgtgaccctgcgggaggtgttcaccaccaaggcctttgctgagcccagcctggtgtttgcctatgacttccacgccggcggggagaccatgatgagccgccacttcaatgaccccaatgctgatgcctacttcaccaagaggaagtggggccagcacgagggccccctgccccggcagcacgccggcctgctgcctgagagcctcatctgggcctacatcgtgcagctgagcagcgccctgcggaccatccacacagctggcctggcctgccgggtgatggaccccaccaagatcctgatcaccgggaagacccggctgcgggtgaactgtgtgggcgtgtttgatgtgctgacctttgacaacagccagaacaacaaccccctggccctgatggcccagtaccagcaggccgacctgatcagcctgggcaaggtggtgctggccctggcctgcaacagcctggccggcatccagcgggagaacctgcagaaggccatggagctggtgaccatcaactacagcagtgacctgaagaacctgatcctgtacctgctgacagaccagaacaggatgaggtctgtgaatgacatcatgcccatgattggagcccgcttctacacccagctggatgctgcccagatgagaaatgatgtgattgaggaggacctggccaaggaggtgcagaatggccgcctcttccggctgctggccaagctgggcaccatcaatgaaagacctgagttccagaaggaccccacctggagcgagactggagaccgctacctgctgaagctgttccgggaccacctgttccaccaggtgacagaagctggggccccctggattgacctgagccacatcatcagctgcctgaacaagctggatgctggggtgcctgagaagatcagcctcatcagcagagatgagaagtctgtgctggtggtgacctacagcgacctgaagcgctgctttgagaacaccttccaggagctgattgctgctgccaacggccagctgtag

SEQ ID NO: 18616 - DNA, 1785 bp, Artificial Sequence
  Description of Artificial Sequence: Synthetic coding sequence
atggagagcaaccacaagtctggagatggcctgagcggcacccagaaggaggccgccctgcgggccctggtgcagaggacaggctacagcctggtgcaggagaatggccagaggaaatatggaggccccccacctggctgggatgctgcccctcctgagcggggctgtgagatcttcatcggcaagctgccccgggacctgtttgaagatgagctgatccccctgtgtgagaagattggcaagatctatgagatgaggatgatgatggacttcaacggcaacaacagaggctacgcctttgtgaccttcagcaacaaggtggaggccaagaatgccatcaagcagctgaacaactatgagatcagaaatggccgcctgctgggcgtgtgtgcctctgtggacaactgccgcctgtttgtgggcggcatccccaagaccaagaagcgggaggagatcctgtctgagatgaagaaggtgacagagggcgtggtggatgtgattgtgtaccccagcgctgctgacaagaccaagaacagaggatttgcctttgtggagtatgagagccacagagctgctgccatggcccggaggaagctgctgcccggccgcatccagctgtggggccatggaattgctgtggactgggccgagcctgaggtggaggtggatgaggacaccatgagctctgtgaagatcctgtatgtgaggaacctgatgctgagcaccagcgaggagatgattgagaaggagttcaacaacatcaagccaggagctgtggagcgggtgaagaagatccgggactatgcctttgtgcacttcagcaacagagaagatgctgtggaggccatgaaggccctgaatggcaaggtgctggatggcagccccatcgaggtgaccctggccaagcctgtggacaaggacagctatgtgcgctacacccggggcaccggcggccggggcaccatgctgcagggcgagtacacctacagcctgggccaggtgtatgaccccaccaccacctacctgggcgcccctgtgttctacgccccccagacctacgccgccatccccagcctgcacttccctgccaccaagggccacctgagcaacagagccatcatccgggcccccagcgtgcgggagatctacatgaatgtgcctgtgggcgctgctggggtgcggggcctgggcggccggggctacctggcctacacaggcctgggccggggctaccaggtgaagggggacaagcgggaggacaagctgtatgacatcctgcccggcatggagctgacccccatgaaccctgtgaccctgaagccccagggcatcaagctggccccccagatcctggaggagatctgccagaagaacaactggggccagcctgtgtaccagctgcacagcgccatcggccaggaccagaggcagctgttcctgtacaagatcaccatcccagccctggccagccagaacccagccatccaccccttcaccccacccaagctgagcgcctttgtggatgaggccaagacctacgccgctgagtacaccctgcagaccctgggcatccccacagatggaggagatggcaccatggccacagctgctgctgctgccacagccttccctggctatgctgtgcccaatgccacagcccctgtgtctgctgcccagctgaagcaggccgtgaccctgggccaggacctggccgcctacaccacctatgaggtgtaccccacctttgctgtgacagcccggggagatggctacggcaccttctag

SEQ ID NO: 18617 - DNA, 1167 bp, Artificial Sequence
  Description of Artificial Sequence: Synthetic coding sequence
atgctggagggctcctggatcaacagaagagaggacaagctgggcgtgtacagcctggtgcacttcagccccaagatgctgggctctgtggccaccaccctgcccctgagcagcagcaacagcagcggcatgcccctgggctactacctgagcagcccccagatcagccgggtgaccatcagcaccaccggccagctgaccagcaaggccaccgtgggcagctgcagccgggtggagaacagcctggatgccagccccttctctgtgcccaagaagcaggatgagagccccatgattggagatggagaggactacttcctgagcctgtttggagacagcaagaagctgacagcccacagcaactacacccagaagaccctgaagtacttctccatgatcctggaggaggtgggccagttcaccagcagcagcctgggagatgtggagattgctgaggtgaatgtgaagggcctgtttgtgaagctgatcaacagcagcctggacaaggagatggccatcggggaccacatcctgcagcagaatgtgaatggccagaccatcagcctgtaccgcttcctgcccaacatcgtgatgcaggccaacagcacagtgacagtgtgggccgccgccagcgaggccaagcaccagcccccaagtgacttcctgtggaaggagcaggacaagttccgggccagcccagactgcatcaccatcctgtgcaagcccaacggccaggccatcgcctggtacacccccatccactggaagcaggcctgggagaagctggatgctgatgtggagttcaaccgctgcagcgtggtgagccccaccttcaggaagagggtcttccagtggacagccagcacagccaccatcaccaaggagaagcaggaccagcccaagaaggacatcagcaactaccaggtggagcaggcccaggtgctgctgaagcgggagaaggagatccccccaacagtgttccccaacagaagcccctggtgccagaacccctacgtgtctgcccacccctactgccccctcatcgagccccacaacaccagcacagctgggggccgcctggaccggcagcccaggaccaggagcacccggcccaacagagccagcggcagcaagaagaagaagaccagcgagagccagaagcagtag

SEQ ID NO: 18618 - DNA, 744 bp, Artificial Sequence
  Description of Artificial Sequence: Synthetic coding sequence
atggaggagcagccccagatgcaggatgctgatgagcctgctgacagcggcggggagggccgggccggcggccccccccaggtggccggggcccaggccgcctgcagcgaggacaggatgaccctgctgctgcggctgcgggcccagaccaagcagcagctgctggagtacaagtccatggtggatgccagcgaggagaagaccccagagcagatcatgcaggagaagcagatcgaggccaagattgaggacctggagaatgaaattgaggaggtgaaggtggcctttgagatcaagaagctggccctggacaggatgaggctgagcacagccctgaagaagaacctggagaagatcagccggcagagctctgtgctgatggacaacatgaagcacctgctggagctgaacaagctgatcatgaagagccagcaggagagctgggacctggaggagaagctgctggacatcaggaagaagaggctgcagctgaagcaggccagcgagagcaagctgctggagatccagacagagaagaacaagcagaagattgacctggacagcatggagaacagcgagcgcatcaagatcatccggcagaacctgcagatggagatcaagatcaccaccgtcatccagcacgtgttccagaacctgatcctgggcagcaaggtgaactgggccgaggaccctgccctgaaggagatcgtgctgcagctggagaagaatgtggacatgatgtag

SEQ ID NO: 18619 - DNA, 1458 bp, Artificial Sequence
  Description of Artificial Sequence: Synthetic coding sequence
atggagttcctgggcaccacccagacagccagctactgcggccccaagaagtgctgcggcctgaccagcctgcctgctgtgcaggcccctgtgatccaggagtgctaccagccctactacctgcccggctaccgctacctgaacagctggaggcccagcctcttctacaagatcgccaacgtgcagacctgcccagatgagagcaccagcaccctgcggccccccaccatcctgcccaccctgcggagcgccctcttcagccgctacagcccccatgactgggaccagagcaaccagctgcaggtgagaggagctgaggccagccggctgtgggccagccggctgacagatgacagcatgaggctgctgcaggacaaggaccagctgacccaccagatgcaggagggcacctgcaggaacctgggccagaggctgagtgacatcggcttctggaagtctgagctgtcctatgagctggaccggctgctgacagagaaccagaacctggagaccgtgaagaggcggctggagtgtgccgccaatgaggtgaactgccccctgcaggtggccctggagtgcctgtaccaccgggagaagagaattggaattgacctggtgcatgacaacgtggagaagaacctgatccgggaggtggacctgctgaagtgctgccaggagcagatgaggaagctggcccagagaattgacatccagatgagggacaacagagatgcccagcacgtgctggagcgggacctggaggacaagagcagcgcccagtgcattgatgagaagtgcttcaacctgaggaacaccagtgactgcatctccttcttccacggcatggagaagattgatggcaccatctctgtgcctgagacctgggccaagttcagcaatgacaacatcaagcacagccagaacatgagggccaacagcatccagctgcgggaggaggccgagcacctgtttgagaccctgagtgaccagatgtggaggcagttcacagacaccaacctggccttcaatgcccgcatcagcgaggtgacagatgtgaagaacaagctgcagacccagctggccaagaccctgcaggagatcttccaggccgagaacaccatcatgctgctggagaggagcatcatggccaaggagggccccctgaaggtggcccagacccggctggagtgcaggacccggcggcccaacatggagctgtgccgggacatcccccagctgaagctggtgaatgaggtgttcaccattgatgacaccctgcagaccctgaagctgcggctgcgggagacccaggacaccctgcagctgctggtgatgaccaagtgccgcctggagcacgagctggccatcaaggccaacaccctgtgcatcgacaaggagaagtgcatgggcatgaggaagaccttcccctgcaccccccggctggtgggccacacctag

SEQ ID NO: 18620 - DNA, 837 bp, Artificial Sequence
  Description of Artificial Sequence: Synthetic coding sequence
atgggcaagagcagcgagtggtgtgaaagaattgctggcatccagaagtttgtgctggagaagtggaccaagaaggccaagccagaggacaccctgaacctgtgccagctgctgaacaatgacctggccagcacagtggtgtcctaccccaggagatttgtgggcctgggcaccctgcccatgcaggcccctgagctggccgtgaaggagatggagcgctgtgtgaaggagctgggcttccctggggtgcagatcggcacccacgtgaatgagtgggacctgaatgcccaggagctgtttcctgtgtatgctgctgctgagcggctgaagtgcagcctgtttgtgcacccctgggacatgcagatggatggccgcatggccaagtactggctgccctggctggtgggcatgcctgctgagaccaccatcgccatctgcagcatgatcatgggcggcgtgtttgagaagttccccaagctgaaggtgtgctttgcccacggcggcggggccttccccttcaccgtgggccgcatcagccacggcttctccatgaggccagacctgtgtgcccaggacaaccccatgaaccccaagaagtacctgggcagcttctacacagatgccctggtgcatgaccccctgagcctgaagctgctgacagatgtgattggcaaggacaaggtgatcctgggcacagactaccccttccccctgggggagctggagcccgggaagctgattgaatccatggaggagtttgatgaggagaccaagaacaagctgaaggctggaaatgccctggccttcctgggcctggagaggaagcagtttgaatag

SEQ ID NO: 18621 - DNA, 2478 bp, Artificial Sequence
  Description of Artificial Sequence: Synthetic coding sequence
atgagcagcagccctgtgaatgtgaagaagctgaaggtgtctgagctgaaggaggagctgaagaagaggcggctgagtgacaagggcctgaaggccgagctgatggagcggctgcaggccgccctggatgatgaggaggccggcggccgcccagccatggagcctggaaatggcagcctggacctgggcggggacagcgctggccgcagcggggccggcctggagcaggaggccgctgctggaggagatgaggaggaggaggaggaggaggaggaggaggagggcatcagcgccctggatggagaccagatggagctgggggaggagaatggagctgctggagctgctgacagcggccccatggaggaggaggaggccgcctctgaagatgaaaatggagatgaccagggcttccaggagggggaggatgagctgggagatgaggaggagggcgctggagatgaaaatggccacggggagcagcagccccagcccccagccacccagcagcagcagccccagcagcagagaggagctgccaaggaggccgccggcaagagcagcggccccaccagcctgtttgctgtgacagtggcccctcctggggcccggcagggccagcagcaggccggcggcaagaagaaggccgagggcggcggcggcggcggccggcctggggccccagctgctggagatggcaagacagagcagaagggcggggacaagaagaggggcgtgaagaggcccagagaagatcatggccggggctactttgagtacatcgaggagaacaagtacagccgggccaagagcccccagccccctgtggaggaggaggatgagcactttgatgacacagtggtgtgcctggacacctacaactgtgacctgcacttcaagatcagccgggaccggctgagcgccagcagcctgaccatggagagctttgccttcctgtgggccggcggccgggccagctatggagtgtccaagggcaaggtgtgctttgagatgaaggtgacagagaagatccctgtgcgccacctgtacaccaaggacatcgacatccacgaggtgagaattggctggagcctgaccaccagcggcatgctgctgggggaggaggagttctcctatggctacagcctgaagggcatcaagacctgcaactgtgaaacagaggactatggagagaagtttgatgaaaatgatgtgatcacctgctttgccaactttgaaagtgatgaggtggagctgtcctatgccaagaatggccaggacctgggcgtggccttcaagatcagcaaggaggtgctggccggccggcccctcttcccccacgtgctgtgccacaactgtgctgtggagttcaactttggccagaaggagaagccctacttccccatccctgaggagtacaccttcatccagaatgtgcccctggaggacagagtgcggggccccaagggccctgaggagaagaaggactgtgaggtggtgatgatgattggcctgcccggggccggcaagaccacctgggtgaccaagcacgccgctgagaaccctgggaagtacaacatcctgggcaccaacaccatcatggacaagatgatggtggccggcttcaagaagcagatggctgacaccgggaagctgaacaccctgctgcagagggccccccagtgcctgggcaagttcattgaaattgctgccaggaagaagaggaacttcatcctggaccagaccaacgtgtctgctgctgcccagaggaggaagatgtgcctgtttgctggcttccagaggaaggctgtggtggtgtgccccaaggatgaggactacaagcagaggacccagaagaaggccgaggtggagggcaaggacctgcctgagcacgctgtgctgaagatgaagggcaacttcaccctgcctgaggtggctgaatgttttgatgagatcacctacgtggagctgcagaaggaggaggcccagaagctgctggagcagtacaaggaggagagcaagaaggccctgcccccagagaagaagcagaacacaggcagcaagaagagcaacaagaacaagagcggcaagaaccagttcaacagaggaggcggccaccggggccggggcggcttcaacatgaggggcggcaacttccggggcggggcccctggcaacagaggaggctacaacagaagaggcaacatgccccagaggggcggcggcggcggcggcagcggcggcatcggctacccctacccccgggcccctgtgtttcctggccggggcagctacagcaacagaggcaactacaacagaggaggcatgcccaacagaggcaactacaaccagaacttccggggccggggcaacaacagaggctacaagaaccagagccagggctacaaccagtggcagcagggccagttctggggccagaagccctggagccagcactaccaccagggctactactag

SEQ ID NO: 18622 - DNA, 945 bp, Artificial Sequence
  Description of Artificial Sequence: Synthetic coding sequence
atgcagaatgtcatcaacacagtgaagggcaaggccctggaggtggccgagtacctgacccctgtgctgaaggagagcaagttcaaggagactggagtcatcaccccagaggagtttgtggccgccggggaccacctggtgcaccactgccccacctggcagtgggccactggagaggagctgaaggtgaaggcctacctgcccaccgggaagcagttcctggtgaccaagaatgtgccctgctacaagcgctgcaagcagatggagtacagtgatgagctggaggccatcatcgaggaggatgatggagatggcggctgggtggacacctaccacaacacaggcatcaccggcatcacagaggccgtgaaggagatcaccctggagaacaaggacaacatccggctgcaggactgcagcgccctgtgtgaggaggaggaggatgaagatgaaggagaggccgctgacatggaggagtatgaggagagcggcctgctggagacagatgaggccaccctggacaccaggaagatcgtggaggcctgcaaggccaagacagatgctggaggagaagatgccatcctgcagaccaggacctatgacctgtacatcacctatgacaagtactaccagaccccccggctgtggctgtttggctatgatgagcagaggcagcccctgactgtggagcacatgtatgaggacatcagccaggaccacgtgaagaagacagtgaccatcgagaaccacccccacctgcccccaccacccatgtgcagcgtgcacccctgcagacatgctgaggtgatgaagaagatcatcgagaccgtggccgagggcggcggggagctgggcgtgcacatgtacctgctgatcttcctgaagtttgtgcaggccgtcatccccaccatcgagtatgactacaccaggcacttcaccatgtag

SEQ ID NO: 18623 - DNA, 900 bp, Artificial Sequence
  Description of Artificial Sequence: Synthetic coding sequence
atggtggacaagaagctggtggtggtgtttggaggcactggagcccagggcggctctgtggcccggaccctgctggaggatggcaccttcaaggtgcgggtggtgaccaggaaccccaggaagaaggccgccaaggagctgcggctgcagggcgctgaggtggtgcagggcgaccaggatgaccaggtgatcatggagctggccctgaatggagcctatgccaccttcatcgtgaccaactactgggagagctgcagccaggagcaggaggtgaagcagggcaagctgctggccgacctggcccggcggctgggcctgcactacgtggtgtacagcggcctggagaacatcaagaagctgacagctggccgcctggccgccgcccactttgatggaaaaggagaggtggaggagtacttccgggacattggagtgcccatgacctctgtgcggctgccctgctactttgagaacctgctgagccacttcctgccccagaaggccccagatggcaagagctacctgctgagcctgcccactggagatgtgcccatggatggcatgtctgtgtctgacctgggccctgtggtgctgagcctgctgaagatgcctgagaagtatgtgggccagaacatcggcctgagcacctgccgccacacagctgaggagtatgctgccctgctgaccaagcacaccaggaaggtggtgcatgatgccaagatgaccccagaggactatgagaagctgggcttccctggggcccgggacctggccaacatgttccgcttctacgccctgcggccagaccgggacatcgagctgaccctgcggctgaaccccaaggccctgaccctggaccagtggctggagcagcacaagggggacttcaacctgctgtag

SEQ ID NO: 18624 - DNA, 2571 bp, Artificial Sequence
  Description of Artificial Sequence: Synthetic coding sequence
atggacatcagcaagggcctgcccggcatgcagggcggcctgcacatctggatcagcgagaacaggaagatggtgcctgtgcctgagggcgcctacggcaacttctttgaggagcactgctacgtgatcctgcacgtgccccagagccccaaggccacccagggcgccagcagtgacctgcactactgggtgggcaagcaggccggggctgaggcccagggcgctgctgaggccttccagcagaggctgcaggatgagctgggcggccagacagtgctgcaccgggaggcccagggccacgagagtgactgcttctgcagctacttccggcccggcatcatctacagaaaaggaggcctggccagtgacctgaagcacgtggagaccaacctcttcaacatccagaggctgctgcacatcaagggcaggaagcacgtgtctgccacagaggtggagctgtcctggaacagcttcaacaagggggacatcttcctgctggacctgggcaagatgatgatccagtggaatggccccaagaccagcatcagcgagaaggcccggggcctggccctgacctacagcctgcgggaccgggagcggggcggcggccgggcccagattggagtggtggatgatgaggccaaggccccagacctgatgcagatcatggaggccgtgctgggcagaagagtgggcagcctgcgggccgccacccccagcaaggacatcaaccagctgcagaaggccaacgtgcggctgtaccacgtgtatgagaagggcaaggacctggtggtgctggagctggccaccccacccctgacccaggacctgctgcaggaggaggacttctacatcctggaccagggcggcttcaagatctacgtgtggcagggccgcatgagcagcctgcaggagaggaaggccgccttcagcagagctgtgggcttcatccaggccaagggctaccccacctacaccaacgtggaggtggtgaatgatggagctgagagcgctgccttcaagcagctgttccgcacctggagcgagaagagaagaagaaaccagaagctgggcggccgggacaagagcatccacgtgaagctggatgtgggcaagctgcacacccagcccaagctggccgcccagctgaggatggtggatgatggcagcggcaaggtggaggtgtggtgcatccaggacctgcaccggcagcctgtggaccccaagagacatggccagctgtgtgccggcaactgctacctggtgctgtacacctaccagaggctgggccgggtgcagtacatcctgtacctgtggcagggccaccaggccacagcagatgaaattgaggccctgaacagcaatgctgaggagctggatgtgatgtatggaggagtgctggtgcaggagcacgtgaccatgggcagcgagcccccccacttcctggccatcttccagggccagctggtgatcttccaggagcgggccggccaccacggcaagggccagagcgccagcaccaccaggctcttccaggtgcagggcacagacagccacaacaccaggaccatggaggtgcctgcccgggccagcagcctgaacagcagtgacatcttcctgctggtgacagcctctgtgtgctacctgtggtttgggaagggctgcaatggagaccagcgggagatggcccgggtggtggtgaccgtcatcagcaggaagaatgaggagaccgtgctggagggccaggagcccccccacttctgggaggccctgggcggccgggccccctaccccagcaacaagaggctgcctgaggaggtgcccagcttccagccccggctgtttgagtgcagcagccacatgggctgcctggtgctggccgaggtgggcttcttcagccaggaggacctggacaagtatgacatcatgctgctggacacctggcaggagatcttcctgtggctgggggaggccgccagcgagtggaaggaggccgtggcctggggccaggagtacctgaagacccaccctgctggccgcagccctgccacccccatcgtgctggtgaagcagggccacgagccccccaccttcatcggctggttcttcacctgggacccctacaagtggaccagccaccccagccacaaggaggtggtggatggcagccctgctgctgccagcaccatcagcgagatcacagctgaggtgaacaacctgcggctgagccgctggccaggaaatggccgggccggggctgtggccctgcaggccctgaagggcagccaggacagcagtgaaaatgacctggtgcgcagccccaagtctgctggcagcaggaccagcagctctgtgagcagcaccagcgccaccatcaatggaggcctgcggcgggagcagctgatgcaccaggccgtggaggacctgcctgagggcgtggaccctgcccggcgggagttctacctgagtgacagcgacttccaggacatctttgggaagagcaaggaggagttctacagcatggccacctggaggcagaggcaggagaagaagcagctgggcttcttctag

SEQ ID NO: 18625 - DNA, 987 bp, Artificial Sequence
  Description of Artificial Sequence: Synthetic coding sequence
atggaggccaacggcagccagggcaccagcggcagcgccaatgacagccagcacgaccccgggaagatgtttattggaggcctgtcctggcagaccagcccagacagcctgcgggactacttcagcaagtttggagagatccgggagtgcatggtgatgagggaccccaccaccaagaggagccggggcttcggctttgtgacctttgctgaccctgcctctgtggacaaggtgctgggccagccccaccacgagctggacagcaagaccatcgaccccaaggtggccttcccccggcgggcccagcccaagatggtgaccaggaccaagaagatctttgtgggcggcctgagcgccaacacagtggtggaggatgtgaagcagtactttgagcagtttgggaaggtggaggatgccatgctgatgtttgacaagaccaccaacagacaccggggctttggatttgtgacctttgaaaatgaagatgtggtggagaaggtgtgtgagatccacttccacgagatcaacaacaagatggtggagtgcaagaaggcccagcccaaggaggtgatgtttcctcctggcacccggggccgggcccggggcctgccctacaccatggatgccttcatgctgggcatgggcatgctgggctaccccaactttgtggccacctacggccggggctacccaggctttgcccccagctatggctaccagtttcctggcttccctgctgctgcctacggccctgtggccgctgctgctgtggccgccgcccggggcagcggcagcaacccagcccggcctgggggcttccctggggccaacagccctggccctgtggccgacctgtatggccctgccagccaggacagcggcgtgggcaactacatctctgctgccagcccccagcccggcagcggcttcggccacggcattgctggccccctgattgccacagccttcaccaacggctaccactag

SEQ ID NO: 18626 - DNA, 654 bp, Artificial Sequence
  Description of Artificial Sequence: Synthetic coding sequence
atggagagcgtggccctgtacagcttccaggccacagaaagtgatgagctggccttcaacaagggggacaccctgaagatcctgaacatggaggatgaccagaactggtacaaggccgagctgcggggcgtggagggcttcatccccaagaactacatccgggtgaagccccacccctggtacagcggccgcatcagccggcagctggccgaggagatcctgatgaagaggaaccacctgggcgccttcctgatccgggagagcgagagcagccctggagagttctctgtgtctgtgaactatggagaccaggtgcagcacttcaaggtgctgcgggaggccagcggcaagtacttcctgtgggaggagaagttcaacagcctgaatgagctggtggacttctaccgcaccaccaccatcgccaagaagaggcagatcttcctgagagatgaggagcccctgctgaagagccctggggcctgctttgcccaggcccagtttgacttcagcgcccaggaccccagccagctgtccttccggcggggggacatcatcgaggtgctggagaggccagacccccactggtggaggggccgcagctgtggccgggtgggcttcttccccaggagctatgtgcagcctgtgcacctgtag

SEQ ID NO: 18627 - DNA, 231 bp, Artificial Sequence
  Description of Artificial Sequence: Synthetic coding sequence
atgggcctgaagatgagctgcctgaagggcttccagatgtgtgtgagcagcagcagcagcagccatgatgaggcccctgtgctgaatgacaagcacctggatgtgcctgacatcatcatcaccccacccacccccaccggcatgatgctgccccgggacctgggcagcacagtgtggctggatgaaacaggcagctgcccagatgatggagaaattgatcctgaggcctag

SEQ ID NO: 18628 - DNA, 19863 bp, Artificial Sequence
  Description of Artificial Sequence: Synthetic coding sequence
atggaccagccccagttcagcggggccccccgcttcctgacccggcccaaggcctttgtggtgtctgtgggcaaggatgccaccctgagctgccagatcgtgggcaaccccaccccccaggtgtcctgggagaaggaccagcagcctgtggccgccggggcccgcttccggctggcccaggatggagacctgtaccgcctgaccatcctggacctggccctgggggacagcggccagtatgtgtgccgggccagaaatgccatcggggaggcctttgctgctgtgggcctgcaggtggatgctgaggccgcctgtgccgagcaggccccccacttcctgctgcggcccaccagcatccgggtgcgggagggcagcgaggccaccttccgctgccgggtgggcggcagccccaggcctgctgtgtcctggagcaaggatggccggcggctgggggagccagatggcccccgggtgcgggtggaggagctgggggaggccagcgccctgcgcatccgggccgcccggcccagagatggcggcacctatgaggtgcgggcagagaaccccctgggcgccgccagcgctgctgctgccctggtggtggacagtgatgctgctgacacagccagccggcccggcaccagcacagctgccctgctggcccacctgcagaggcggcgggaggccatgagagctgagggcgccccagccagcccccccagcacaggcaccaggacctgcaccgtgacagagggcaagcacgcccggctgagctgctacgtgactggagagcccaagccagagaccgtgtggaagaaggatggccagctggtgacagagggccgccgccacgtggtgtatgaagatgcccaggagaactttgtgctgaagatcctcttctgcaagcagagcgaccggggcctgtacacctgcacagccagcaacctggtgggccagacctacagctctgtgctggtggtggtgcgggagcctgctgtgcccttcaagaagaggctgcaggacctggaggtgcgggagaaggagagcgccaccttcctgtgtgaggtgccccagcccagcacagaagctgcctggttcaaggaggagacccggctgtgggccagcgccaagtatggcatcgaggaggagggcacagaaagaaggctgactgtgagaaatgtgtctgcagatgatgatgctgtgtacatctgtgagaccccagagggcagcaggacagtggccgagctggccgtgcagggcaacctgctgaggaagctgcccaggaagacagctgtgcgggtgggggacacagccatgttctgtgtggagctggccgtgcctgtgggccctgtgcactggctgaggaaccaggaggaggtggtggccggcggccgggtggccatctctgctgagggcaccaggcacaccctgaccatcagccagtgctgcctggaggatgtgggccaggtggccttcatggccggggactgccagaccagcacccagttctgtgtgtctgcccccaggaagccacccctgcagccccctgtggaccctgtggtgaaggccaggatggagagcagcgtcatcctgtcctggagccccccaccccacggggagaggcctgtgaccattgatggctacctggtggagaagaagaagctgggcacctacacctggatccgctgccacgaggccgagtgggtggccaccccagagctgactgtggctgatgtggccgaggagggcaacttccagttccgggtgtctgccctgaacagctttggccagagcccctacctggagttccctggcaccgtgcacctggcccccaagctggccgtgaggacccccctgaaggctgtgcaggccgtggagggcggggaggtgaccttctctgtggacctgactgtggccagcgctggggagtggttcctggatggccaggccctgaaggccagctctgtgtatgagatccactgtgacaggaccaggcacaccctgaccatccgggaggtgcctgccagcctgcacggggcccagctgaagtttgtggccaatggaattgagagcagcatccgcatggaggtgcgggccgcccctggcctgacagccaacaagcccccagctgctgctgcccgggaggtgctggcccggctgcacgaggaggcccagctgctggccgagctgagtgaccaggccgctgctgtgacctggctgaaggatggccgcaccctgagccctggccccaagtatgaggtgcaggccagcgctggccggcgggtgctgctggtgagagatgtggccagagatgatgctggcctgtatgaatgtgtgtcccggggcggcagaattgcctaccagctgtctgtgcagggcctggcccgcttcctgcacaaggacatggccggcagctgtgtggatgctgtggccggcggccctgcccagtttgaatgtgagaccagcgaggcccacgtgcacgtgcactggtacaaggatggcatggagctgggccacagcggggagcgcttcctgcaggaggatgtgggcaccaggcaccggctggtggccgccaccgtgacccggcaggatgagggcacctacagctgccgggtgggggaggacagcgtggacttccggctgcgggtgtctgagcccaaggtggtgtttgccaaggagcagctggcccggaggaagctgcaggccgaggccggggccagcgccaccctgagctgtgaggtggcccaggcccagacagaggtgacctggtacaaggatggcaagaagctgagcagcagcagcaaggtgtgcatggaggccaccggctgcacccggcggctggtggtgcagcaggccggccaggctgatgctggggagtacagctgtgaggccggcggccagaggctgtccttccacctggatgtgaaggagcccaaggtggtgtttgccaaggaccaggtggcccacagcgaggtgcaggccgaggccggggccagcgccaccctgagctgtgaggtggcccaggcccagacagaggtgatgtggtacaaggatggcaagaagctgagcagcagcctgaaggtgcacgtggaggccaagggctgcagaagaaggctggtggtgcagcaggccggcaagacagatgctggggactacagctgtgaggcccggggccagagggtgtccttccggctgcacatcacagagcccaagatgatgtttgccaaggagcagagcgtgcacaatgaggtgcaggccgaggccggggccagcgccatgctgagctgtgaggtggcccaggcccagacagaggtgacctggtacaaggatggcaagaagctgagcagcagcagcaaggtgggcatggaggtgaagggctgcacccggcggctggtgctgccccaggccggcaaggcagatgctggggagtacagctgtgaggccggcggccagagggtgtccttccacctgcacatcacagagcccaagggcgtgtttgccaaggagcagagcgtgcacaatgaggtgcaggccgaggccggcaccacagccatgctgagctgtgaggtggcccagccccagacagaggtgacctggtacaaggatggcaagaagctgagcagcagcagcaaggtgaggatggaggtgaagggctgcacccggcggctggtggtgcagcaggtgggcaaggcagatgctggggagtacagctgtgaggccggcggccagagggtgtccttccagctgcacatcacagagcccaaggctgtgtttgccaaggagcagctggtgcacaatgaggtgaggacagaggccggggccagcgccaccctgagctgtgaggtggcccaggcccagacagaggtgacctggtacaaggatggcaagaagctgagcagcagcagcaaggtgcgcatcgaggccgccggctgcatgaggcagctggtggtgcagcaggccggccaggctgatgctggggagtacacctgtgaggccggcggccagaggctgtccttccacctggatgtgtctgagcccaaggctgtgtttgccaaggagcagctggcccacaggaaggtgcaggccgaggccggggccatcgccaccctgagctgtgaggtggcccaggcccagacagaggtgacctggtacaaggatggcaagaagctgagcagcagcagcaaggtgaggatggaggccgtgggctgcacccggcggctggtggtgcagcaggcctgccaggccgacacaggagagtacagctgtgaggccggcggccagaggctgtccttcagcctggatgtggccgagcccaaggtggtgtttgccaaggagcagcctgtgcaccgggaggtgcaggcccaggccggggccagcaccaccctgagctgtgaggtggcccaggcccagacagaggtgatgtggtacaaggatggcaagaagctgtccttcagcagcaaggtgaggatggaggccgtgggctgcacccggcggctggtggtgcagcaggccggccaggccgtggccggggagtacagctgtgaggccggcagccagaggctgtccttccacctgcacgtggccgagcccaaggctgtgtttgccaaggagcagcctgccagccgggaggtgcaggccgaggccggcaccagcgccaccctgagctgtgaggtggcccaggcccagacagaggtgacctggtacaaggatggcaagaagctgagcagcagcagcaaggtgaggatggaggccgtgggctgcacccggcggctggtggtgcaggaggccggccaggctgatgctggggagtacagctgcaaggccggggaccagaggctgtccttccacctgcacgtggccgagcccaaggtggtgtttgccaaggagcagcctgcccaccgggaggtgcaggccgaggccggggccagcgccaccctgagctgtgaggtggcccaggcccagacagaggtgacctggtacaaggatggcaagaagctgagcagcagcagcaaggtgcgggtggaggccgtgggctgcacccggcggctggtggtgcagcaggccggccaggccgaggccggggagtacagctgtgaggccggcggccagcagctgtccttccggctgcaggtggccgagctggagccccagatcagcgagcggccctgccggcgggagcccctggtggtgaaggagcacgaggacatcatcctgacagccaccctggccacccccagcgctgccaccgtgacctggctgaaggatggagtggagatccgccgcagcaagagacatgaaacagccagccagggcgacacccacaccctgactgtgcatggagcccaggtgctggacagcgccatctacagctgccgggtgggcgctgagggccaggacttccctgtgcaggtggaggaggtggccgccaagttctgccgcctgctggagcctgtgtgtggggagctgggcggcaccgtgaccctggcctgtgagctgagccctgcctgtgccgaggtggtgtggaggtgtggcaacacccagctgcgggtgggcaagcgcttccagatggtggccgagggccctgtgcgcagcctgactgtgctgggcctgcgggcagaagatgctggggagtatgtgtgtgagagcagagatgaccacaccagcgcccagctgactgtgtctgtgccccgggtggtgaagttcatgagcggcctgagcacagtggtggccgaggagggcggggaggccaccttccagtgtgtggtgagccccagtgatgtggccgtggtgtggttcagagatggagccctgctgcagcccagcgagaagtttgccatcagccagagcggggccagccacagcctgaccatcagtgacctggtgctggaggatgctggccagatcaccgtggaggccgagggcgccagcagcagcgctgccctgcgggtgcgggaggcccctgtgctcttcaagaagaagctggagccccagacagtggaggagaggagctctgtgaccctggaggtggagctgacccggccctggccagagctgcgctggaccagaaatgccacagccctggcccctgggaagaatgtggagatccatgctgagggcgcccggcaccggctggtgctgcacaacgtgggctttgctgaccggggcttcttcggctgtgagaccccagatgacaagacccaggccaagctgactgtggagatgaggcaggtgcggctggtgcggggcctgcaggccgtggaggcccgggagcagggcacagccaccatggaggtgcagctgagccatgctgatgtggatggctcctggaccagagatggcctgcgcttccagcagggccccacctgccacctggccgtgcggggccccatgcacaccctgaccctgagcggcctgcggccagaagattctggcctgatggtgttcaaggccgagggcgtgcacaccagcgcccggctggtggtgacagagctgcctgtgtccttcagccggcccctgcaggatgtggtgaccacagagaaggagaaggtgaccctggagtgtgagctgagccggcccaacgtggatgtgcgctggctgaaggatggagtggagctgcgggccggcaagaccatggccatcgccgcccagggcgcctgccgcagcctgaccatctaccgctgtgaatttgctgaccagggcgtgtatgtgtgtgatgcccatgatgcccagagcagcgcctctgtgaaggtgcagggccgcacctacaccctcatctaccgccgggtgctggctgaagatgctggggagatccagtttgtggctgaaaatgctgagagccgggcccagctgcgggtgaaggagctgcctgtgaccctggtgcggcccctgcgggacaagatcgccatggagaagcacagaggagtgctggagtgccaggtgtcccgggccagcgcccaggtgcgctggttcaagggcagccaggagctgcagcccggccccaagtatgagctggtgtctgatggcctgtacaggaagctgatcatcagtgatgtgcatgctgaagatgaggacacctacacctgtgatgctggagatgtgaagaccagcgcccagttctttgtggaggagcagagcatcaccatcgtgcggggcctgcaggatgtgacagtgatggagcccgccccagcctggtttgaatgtgagaccagcatccccagcgtgcggccccccaagtggctgctgggcaagacagtgctgcaggccggcggcaatgtgggcctggagcaggagggcaccgtgcaccggctgatgctgcggaggacctgcagcaccatgacaggccctgtgcacttcaccgtgggcaagagccgcagcagcgcccggctggtggtgtctgacatccctgtggtgctgacccggcccctggagcccaagacaggccgggagctgcagagcgtggtgctgagctgtgacttccggcctgcccccaaggctgtgcagtggtacaaggatgacacccccctgagccccagcgagaagttcaagatgagcctggagggccagatggccgagctgcgcatcctgcggctgatgccagcagatgctggggtgtaccgctgccaggccggcagcgcccacagcagcacagaggtgacagtggaggcccgggaggtgacagtgacaggccccctgcaggatgctgaggccacagaggagggctgggccagcttcagctgtgagctgagccatgaagatgaggaggtggagtggagcctgaatggcatgcccctgtacaatgacagcttccacgagatcagccacaagggccgccgccacaccctggtgctgaagagcatccagagagcagatgctggcatcgtgcgggccagcagcctgaaggtgtccaccagcgcccggctggaggtgcgggtgaagcctgtggtgttcctgaaggccctggatgacctgtctgctgaggagcggggcaccctggccctgcagtgtgaggtgtctgaccctgaggcccacgtggtgtggaggaaggatggagtgcagctgggccccagcgacaagtatgacttcctgcacacagctggcacccggggcctggtggtgcatgatgtgtccccagaagatgctggcctgtacacctgccacgtgggcagcgaggagacccgggcccgggtgcgggtgcatgacctgcacgtgggcatcaccaagaggctgaagaccatggaggtgctggagggggagagctgcagctttgaatgtgtgctgagccatgaaagtgccagtgaccctgccatgtggacagtgggcggcaagacagtgggcagcagcagccgcttccaggccacccggcagggcaggaagtacatcctggtggtgcgggaggccgcccccagtgatgctggggaggtggtgttttctgtgcggggcctgaccagcaaggccagcctgattgtgcgggagaggcctgctgccatcatcaagcccctggaggaccagtgggtggcccctggagaagatgtggagctgcgctgtgagctgagcagagctggcacccctgtgcactggctgaaggacaggaaggccatcaggaagagccagaagtatgatgtggtgtgtgagggcaccatggccatgctggtgatccggggggccagcctgaaggatgctggggagtacacctgtgaggtggaggccagcaagagcacagccagcctgcacgtggaggagaaggccaactgcttcacagaggagctgaccaacctgcaggtggaggagaagggcacagctgtgttcacctgcaagacagagcaccctgctgccaccgtgacctggaggaagggcctgctggagctgcgggccagcggcaagcaccagcccagccaggagggcctgaccctgcggctgaccatcagcgccctggagaaggctgacagcgacacctacacctgtgacatcggccaggcccagagccgggcccagctgctggtgcagggcagaagagtgcacatcatcgaggacctggaggatgtggatgtgcaggagggcagcagcgccaccttccgctgccgcatcagccctgccaactatgagcctgtgcactggttcctggacaagacccccctgcacgccaatgagctgaatgaaattgatgcccagcccggcggctaccacgtgctgaccctgcggcagctggccctgaaggacagcggcaccatctactttgaggccggggaccagagggccagcgctgccctgcgggtgacagagaagcccagcgtcttcagccgggagctgacagatgccaccatcacagaaggagaggacctgaccctggtgtgtgagaccagcacctgtgacatccctgtgtgctggaccaaggatggcaagaccctgcggggcagcgcccgctgccagctgagccatgagggccaccgggcccagctgctgatcactggagccaccctgcaggacagcggccgctacaagtgtgaggccggcggggcctgcagcagcagcatcgtgcgggtgcacgcccggcctgtgcgcttccaggaggccctgaaggacctggaggtgctggagggcggggccgccaccctgcgctgtgtgctgagctctgtggccgcccctgtgaagtggtgctacggcaacaacgtgctgcggcctggggacaagtacagcctgcggcaggagggcgccatgctggagctggtggtgaggaacctgcggccccaggacagcggccgctacagctgcagctttggagaccagaccaccagcgccaccctgactgtgacagccctgcctgcccagttcatcggcaagctgaggaacaaggaggccacagagggcgccacagccaccctgcgctgtgagctgagcaaggccgcccctgtggagtggaggaaaggaagtgagaccctgagagatggagaccgctactgcctgcggcaggatggagccatgtgtgagctgcagatccggggcctggccatggtggatgctgctgagtacagctgtgtgtgtggggaggagaggaccagcgccagcctgaccatccggcccatgcctgcccacttcatcggccgcctgcggcaccaggagagcattgagggcgccacagccaccctgcgctgtgagctgagcaaggccgcccctgtggagtggaggaagggccgggagagcctgagagatggagacagacacagcctgcggcaggatggagctgtgtgtgagctgcagatctgtggcctggccgtggctgatgctggggagtacagctgtgtgtgtggggaggagaggaccagcgccaccctgactgtgaaggccctgcctgccaagttcacagagggcctgagaaatgaggaggccgtggagggcgccacagccatgctgtggtgtgagctgagcaaggtggcccctgtggagtggaggaaaggacctgagaacctgagagatggagaccgctacatcctgcggcaggagggcacccgctgtgagctgcagatctgtggcctggccatggctgatgctggggagtacctgtgtgtgtgtggccaggagaggaccagcgccaccctgaccatccgggccctgcctgcccgcttcattgaagatgtgaagaaccaggaggcccgggagggcgccacagctgtgctgcagtgtgagctgaacagcgctgcccctgtggagtggaggaaaggaagtgagaccctgagagatggagaccgctacagcctgcggcaggacggcaccaagtgtgagctgcagatccggggcctggccatggctgacacaggagagtacagctgtgtgtgtggccaggagaggaccagcgccatgctgactgtgcgggccctgcccatcaagttcacagagggcctgagaaatgaggaggccacagagggcgccacagctgtgctgcgctgtgagctgagcaagatggcccctgtggagtggtggaagggccacgagaccctgagagatggagacagacacagcctgcggcaggatggagcccgctgtgagctgcagatccggggcctggtggctgaagatgctggggagtacctgtgcatgtgtgggaaggagaggaccagcgccatgctgactgtgcgggccatgcccagcaagttcatcgagggcctgagaaatgaggaggccacagaaggagacacagccaccctgtggtgtgagctgagcaaggccgcccctgtggagtggaggaaaggacatgagaccctgagagatggagacagacacagcctgcggcaggacggcagccgctgtgagctgcagatccggggcctggccgtggtggatgctggggagtacagctgtgtgtgtggccaggagaggaccagcgccaccctgactgtgcgggccctgcctgcccgcttcattgaagatgtgaagaaccaggaggcccgggagggcgccacagctgtgctgcagtgtgagctgagcaaggccgcccctgtggagtggaggaaaggaagtgagaccctgcggggcggggaccgctacagcctgcggcaggacggcacccgctgtgagctgcagatccacggcctgtctgtggccgacacaggagagtacagctgtgtgtgtggccaggagaggaccagcgccaccctgactgtgcgggccccccagcccgtcttccgggagcccctgcagagcctgcaggccgaggagggcagcacagccaccctgcagtgtgagctgtctgagcccacagccaccgtggtgtggagcaagggcggcctgcagctgcaggccaacggccggcgggagccccggctgcagggctgcacagctgagctggtgctgcaggacctgcagcgggaggacaccggggagtacacctgcacctgtggcagccaggccaccagcgccaccctgactgtgacagctgcccctgtgcgcttcctgcgggagctgcagcaccaggaggtggatgaaggaggaacagcccacctgtgctgtgagctgagcagagctggggcctctgtggagtggaggaagggcagcctgcagctgttcccctgtgccaagtaccagatggtgcaggatggagctgctgctgagctgctggtgcggggcgtggagcaggaggatgctggggactacacctgtgacaccggccacacccagagcatggccagcctgtctgtgcgggtgccccggcccaagttcaagacccggctgcagagcctggagcaggagactggagacatcgcccggctgtgctgccagctgagtgatgctgagagcggggctgtggtgcagtggctgaaggagggcgtggagctgcatgctggccccaagtatgagatgaggagccagggcgccacccgggagctgctgatccaccagctggaggccaaggacaccggggagtatgcctgtgtgactggaggccagaagacagctgccagcctgcgggtgacagagcctgaggtgaccatcgtgcggggcctggtggatgctgaggtgacagcagatgaagatgtggagttcagctgtgaggtgtccagagctggggccaccggggtgcagtggtgcctgcagggcctgcccctgcagagcaatgaggtgacagaggtggccgtgagagatggccgcatccacaccctgcggctgaagggcgtgaccccagaagatgctggcaccgtgtccttccacctgggcaaccacgccagcagcgcccagctgactgtgcgggcccctgaggtgaccatcctggagcccctgcaggatgtgcagctgtctgagggccaggatgccagcttccagtgccgcctgagccgggccagcggccaggaggcccgctgggccctgggcggcgtgcccctgcaggccaatgagatgaatgacatcaccgtggagcagggcaccctgcacctgctgaccctgcacaaggtgaccctggaggatgctggcaccgtgtccttccacgtgggcacctgcagcagcgaggcccagctgaaggtgacagccaagaacacagtggtgcggggcctggagaatgtggaggccctggagggcggggaggccctgtttgagtgccagctgagccagcctgaggtggccgcccacacctggctgctggatgatgagcctgtgcacaccagtgaaaatgctgaggtggtgttctttgaaaatggcctgcggcacctgctgctgctgaagaacctgcggccccaggacagctgccgggtgaccttcctggccggggacatggtgaccagcgccttcctgactgtgcggggctggaggctggagatcctggagcccctgaagaatgctgctgtgcgggccggggcccaggcctgcttcacctgcaccctgtctgaggccgtgcctgtgggggaggcctcctggtacatcaatggagctgctgtgcagccagatgacagcgactggacagtgacagcagatggcagccaccacgccctgctgctgcggagcgcccagccccaccacgccggggaggtgacctttgcctgcagagatgctgtggccagcgcccggctgactgtgctgggcctgcctgaccccccagaagatgctgaggtggtggcccggagcagccacacagtgaccctgtcctgggccgcccccatgtctgatggcggcggcggcctgtgtggctacagagtggaggtgaaggagggcgccaccggccagtggaggctgtgccacgagctggtgcccggcccagaatgtgtggtggatggcctggcccctggagagacctaccgcttccgggtggccgctgtgggccctgtgggcgctggggagcctgtgcacctgccccagacagtgcggctggccgagccccccaagcctgtgcccccccagcccagcgcccctgagagccggcaggtggccgctggagaagatgtgtccctggagctggaggtggtggccgaggccggggaggtgatctggcacaagggcatggagcgcatccagcccggcggccgctttgaggtggtgtcccagggccggcagcagatgctggtgatcaagggcttcaccgctgaggaccagggcgagtaccactgcggcctggcccagggcagcatctgcccagctgctgccaccttccaggtggccctgagccctgcctctgtggatgaggccccccagcccagcctgcccccagaggccgcccaggagggggacctgcacctgctgtgggaggccctggccaggaagaggaggatgagccgggagcccaccctggacagcatcagcgagctgcctgaggaggatggccgcagccagaggctgccccaggaggccgaggaggtggccccagacctgtctgagggctacagcacagcagatgagctggccaggactggagatgctgacctgagccacaccagcagtgatgatgagagcagagctggcacccccagcctggtgacctacctgaagaaggccggccggcccggcaccagccccctggccagcaaggtgggcgccccagctgcccccagcgtgaagccccagcagcagcaggagcccctggccgctgtgcggccccccctgggggacctgagcaccaaggacctgggggaccccagcatggacaaggctgctgtgaagatccaggccgccttcaagggctacaaggtgaggaaggagatgaagcagcaggagggccccatgttcagccacaccttcggggacacagaggcccaggtgggagatgccctgcggctggagtgtgtggtggccagcaaggcagatgtgcgggcccgctggctgaaggatggagtggagctgacagatggccgccaccaccacatcgaccagctgggagatggcacctgcagcctgctgatcaccggcctggacagagcagatgctggctgctacacctgccaggtgagcaacaagtttggccaggtgacccacagcgcctgtgtggtggtgtctggcagcgagagcgaggccgagagcagcagtggaggagagctggatgatgccttccggcgggccgcccggcggctgcacaggctcttccgcaccaagagccctgctgaggtgtctgatgaggagctgttcctgtctgcagatgagggccctgctgagcctgaggagcctgctgactggcagacctacagagaagatgagcacttcatctgcatccgctttgaggccctgacagaggcccggcaggccgtgacccgcttccaggagatgtttgccaccctgggcatcggcgtggagatcaagctggtggagcagggcccccggcgggtggagatgtgcatcagcaaggagaccccagcccctgtggtgcccccagagcccctgcccagcctgctgaccagtgatgctgcccctgtgttcctgacagagctgcagaaccaggaggtgcaggacggctaccctgtgtcctttgactgtgtggtgacaggccagcccatgcccagcgtgcgctggttcaaggatggcaagctgctggaggaggatgaccactacatgatcaatgaagaccagcagggcggccaccagctgatcatcacagctgtggtgcctgctgacatgggcgtgtaccgctgcctggccgagaacagcatgggcgtgagcagcaccaaggccgagctgcgggtggacctgaccagcacagattatgacacagctgctgatgccacagagagcagcagctacttcagcgcccagggctacctgagcagccgggagcaggagggcacagagagcaccacagatgagggccagctgccccaggtggtggaggagctgcgggacctgcaggtggcccctggcacccggctggccaagttccagctgaaggtgaagggctacccagccccccggctgtactggttcaaggatggccagcccctgacagccagcgcccacatccgcatgacagacaagaagatcctgcacaccctggagatcatctctgtgacccgggaggacagcggccagtatgctgcctacatcagcaatgccatgggcgccgcctacagcagcgcccggctgctggtgcggggcccagatgagcctgaggagaagccagccagtgatgtgcatgagcagctggtgccccccaggatgctggagcgcttcacccccaagaaggtgaagaagggcagcagcatcaccttctctgtgaaggtggagggccggcctgtgcccaccgtgcactggctgcgggaggaggccgagcggggcgtgctgtggattggccctgacaccccaggctacacagtggccagcagcgcccagcagcacagcctggtgctgctggatgtgggccggcagcaccagggcacctacacctgcatcgccagcaatgctgctggccaggccctgtgcagcgccagcctgcacgtgtctggcctgcccaaggtggaggagcaggagaaggtgaaggaggccctgatcagcaccttcctgcagggcaccacccaggccatcagcgcccagggcctggagacagccagctttgctgacctgggcggccagaggaaggaggagcccctggccgccaaggaggccctgggccacctgagcctggccgaggtgggcacagaggagttcctgcagaagctgaccagccagatcacagagatggtgtctgccaagatcacccaggccaagctgcaggtgcctggaggagacagtgatgaggacagcaagaccccatctgccagccccaggcatggccgcagccggcccagcagcagcatccaggagagcagcagcgagagtgaagatggagatgcccggggggagatctttgacatctacgtggtgacagctgactacctgcccctgggcgctgagcaggatgccatcaccctgcgggagggccagtatgtggaggtgctggatgctgcccaccccctgcgctggctggtgaggaccaagcccaccaagagcagccccagccggcagggctgggtgtccccagcctacctggaccggcggctgaagctgagccctgagtggggcgctgctgaggcccctgagttccctggagaggccgtgtctgaagatgagtacaaggcccggctgagcagcgtcatccaggagctgctgagcagcgagcaggcctttgtggaggagctgcagttcctgcagagccaccacctgcagcacctggagcgctgcccccacgtgcccatcgctgtggccggccagaaggccgtcatcttcagaaatgtgcgggacatcggccgcttccacagcagcttcctgcaggagctgcagcagtgtgacacagatgatgatgtggccatgtgcttcatcaagaaccaggccgcctttgagcagtacctggagttcctggtgggccgggtgcaggccgagagcgtggtggtgtccacagccatccaggagttctacaagaagtatgcagaggaggccctgctggccggggaccccagccagcccccacctccacccctgcagcactacctggagcagcctgtggagcgggtgcagcgctaccaggccctgctgaaggagctgatccggaacaaggccaggaaccggcagaactgtgccctgctggagcaggcctatgctgtggtgtctgccctgccccagagagctgagaacaagctgcacgtgtccctgatggagaactacccaggcaccctgcaggccctgggggagcccatccggcagggccacttcatcgtgtgggagggcgcccctggggccaggatgccctggaagggccacaacagacatgtgttcctgttcaggaaccacctggtgatctgcaagccccggcgggacagcaggacagacacagtgtcctatgtgttcaggaacatgatgaagctgagcagcattgacctgaatgaccaggtggagggagatgaccgggcctttgaggtgtggcaggagcgggaggacagcgtgaggaagtacctgctgcaggccaggacagccatcatcaagagctcctgggtgaaggagatctgtggcatccagcagaggctggccctgcctgtgtggaggcccccagactttgaggaggagctggccgactgcacagctgagctgggggagaccgtgaagctggcctgccgggtgacaggcacccccaagcctgtgatctcctggtacaaggatggcaaggctgtgcaggtggacccccaccacatcctgattgaggaccctgatggcagctgtgccctgatcctggacagcctgactggagtggacagcggccagtacatgtgctttgctgccagcgctgctggcaactgcagcaccctgggcaagatcctggtgcaggtgcccccaagatttgtgaacaaggtgcgggccagcccctttgtggagggagaagatgcccagttcacctgcaccattgaaggagccccctacccccagatccgctggtacaaggatggagccctgctgaccaccggcaacaagttccagaccctgtctgagcccaggagcggcctgctggtgctggtgatccgggccgccagcaaagaagacctgggcctgtatgaatgtgagctggtgaaccggctgggcagcgcccgggccagcgctgagctgcgcatccagagccccatgctgcaggcccaggagcagtgccaccgggagcagctggtggccgctgtggaggtgacagagcaggagaccaaggtgcccaagaagacagtcatcatcgaggagaccatcaccaccgtggtgaagagcccccggggccagaggaggagccccagcaagagccccagccgcagccccagccgctgcagcgccagccccctgcggcccggcctgctggccccagacctgctgtacctgcccggggccggccagccccggcggcctgaggccgagcccggccagaagcctgtggtgcccaccctgtatgtgacagaggccgaggcccacagccctgccctgcccggcctgagcggcccccagcccaagtgggtggaggtggaggagaccatcgaggtgcgggtgaagaagatgggcccccagggcgtgagccccaccacagaggtgcccaggagcagcagcggccacctgttcaccctgcccggggccaccccaggaggagaccccaacagcaacaacagcaacaacaagctgctggcccaggaggcctgggcccagggcacagccatggtgggcgtgcgggagcccctggtgttccgggtggatgcccggggctctgtggactgggccgccagcggcatgggcagcctggaggaggagggcaccatggaggaggccggggaggaggagggagaagatggagatgcctttgtgacagaggagagccaggacacccacagcctgggggaccgggaccccaagatcctgacccacaacggccgcatgctgaccctggccgacctggaggactatgtgcctggagagggggagaccttccactgcggcggccctggccctggggccccagatgatcctccctgtgaggtgtctgtcatccagcgggagatcggggagcccaccgtgggccagcctgtgctgctgtctgtgggccacgccctgggcccccggggccccctgggcctcttccggcctgagcccaggggggccagccccccaggcccccaggtgcgcagcctggagggcaccagcttcctgctgcgggaggccccagcccggcctgtgggcagcgccccctggacccagagcttctgcacccgcatccgccgctctgctgacagcggccagagcagcttcaccacagagctgagcacccagacagtgaactttggaacagtgggggagaccgtgaccctgcacatctgcccagacagagatggagatgaagctgcccagccctag

SEQ ID NO: 18629 - DNA, 1407 bp, Artificial Sequence
  Description of Artificial Sequence: Synthetic coding sequence
atggccgccccagacctgagcaccaacctgcaggaggaggccacctgtgccatctgcctggactacttcacagatcctgtgatgacagactgtggccacaacttctgccgggagtgcatccgccgctgctggggccagcctgagggcccctatgcctgcccagaatgtcgggagctgagcccccagaggaacctgcggcccaaccggcccctggccaagatggccgagatggcccggcggctgcacccccccagccctgtgccccagggcgtgtgcccagcccaccgggagcccctggccgccttctgtggagatgagctgcggctgctgtgtgccgcctgtgagaggtctggagagcactgggcccaccgggtgcggcccctgcaggatgctgctgaggacctgaaggccaagctggagaagagcctggagcacctgaggaagcagatgcaggatgccctgctcttccaggcccaggctgatgagacctgtgtgctgtggcagaagatggtggagagccagaggcagaatgtgctgggggagtttgagcggctgcggcggctgctggccgaggaggagcagcagctgctgcagaggctggaggaggaggagctggaggtgctgccccggctgcgggagggcgccgcccacctgggccagcagagcgcccacctggccgagctgattgctgagctggagggccgctgccagctgcctgccctgggcctgctgcaggacatcaaggatgccctgcggcgggtgcaggatgtgaagctgcagcccccagaggtggtgcccatggagctgaggacagtgtgccgggtgcccggcctggtggagaccctgcggcgcttcagaggagatgtgaccctggaccctgacacagccaaccctgagctgatcctgtctgaggaccggcgctctgtgcagagaggagacctgcggcaggccctgcctgacagccctgagagatttgatcctggcccctgtgtgctgggccaggagcgcttcaccagcggccgccactactgggaggtggaggtgggggacaggacctcctgggccctgggcgtgtgcagagaaaatgtgaacaggaaggagaagggggagctgtctgctggaaatggcttctggatcctggtgttcctgggcagctactacaacagcagcgagcgggccctggcccccctgcgggaccccccccggcgggtgggcatcttcctggactatgaggccggccacctgtccttctacagcgccacagatggcagcctgctcttcatcttccctgagatccccttcagcggcaccctgcggcccctcttcagccccctgagcagcagccccacccccatgaccatctgccggcccaagggcggcagcggggacaccctggccccccagtag

SEQ ID NO: 18630 - DNA, 813 bp, Artificial Sequence
  Description of Artificial Sequence: Synthetic coding sequence
atgagccctggcagcggcgtgaagtctgagtacatgaagcgctaccaggagccccgctgggaggagtatggcccctgctaccgggagctgctgcactaccgcctgggccgccgcctgctggagcaggcccacgccccctggctgtgggatgactggggccctgctggcagcagtgaagattctgccagcagcgagagcagtggagctgggggccctgccccccgctgtgccccacccagccccccacctcctgtggagcccgccacccaggaggaggccgagcggcgggcccggggggcccctgaggagcaggatgctgaggccggagatgctgaggccgaggatgctgaagatgctgccctgcctgccctgcctgtgaaggatgtggaggacaagccagagcagcagaccaggacccgggagacagacaagagccccaccagcacagagccccggcagcagcccagcgccctgtttgcccggggcaacaggaaggctgtgaagagcccccagaggagcagcagcaagatcaaggagaacaagcacccctttgccctgtatggctggggcgagaagcagacagacaccggcagccagaagacccacaacgtgtgtgccagcgcccctgtgcatgagatccacgagagcgccctgcgggccaagaacagacggcaggtggagaagaggaagctggtggcccagaggcagagggcccacagcgtggatgtggagaagaacaggaagatgaaggccagcagcagcgagaacccctggatgacagagtacatgcgctgctacagcgcccgggcctag

SEQ ID NO: 18631 - DNA, 2667 bp, Artificial Sequence
  Description of Artificial Sequence: Synthetic coding sequence
atggatgagagcgccctgctggacctgctggagtgccctgtgtgcctggagcggctggatgccagcgccaaggtgctgccctgccagcacaccttctgcaagcgctgcctgctgggcatcgtgggcagcagaaatgagctgcgctgcccagaatgtaggaccctggtgggcagcggcgtggaggagctgcccagcaacatcctgctggtgcggctgctggatggcatcaagcagaggccctggaagccaggccctgggggcggcagcggcaccaactgcaccaatgccctgcggagccagagcagcacagtggccaactgcagcagcaaggacctgcagagcagccagggcggccagcagccccgggtgcagagctggagcccccctgtgcggggcatcccccagctgccctgtgccaaggccctgtacaactatgagggcaaggagcccggggacctgaagttcagcaaaggagacatcatcatcctgcggcggcaggtggatgagaactggtaccatggagaggtgaatggcatccacggcttcttccccaccaactttgtgcagatcatcaagcccctgccccagcccccaccccagtgcaaggccctgtatgactttgaggtgaaggacaaggaggccgacaaggactgcctgccctttgccaaggatgatgtgctgaccgtcatcagaagagtggatgagaactgggccgagggcatgctggccgacaagattggcatcttccccatctcctatgtggagttcaacagcgctgccaagcagctgattgagtgggacaagccccctgtgcctggggtggatgctggggagtgcagcagcgctgctgcccagagcagcacagcccccaagcacagcgacaccaagaagaacaccaagaagaggcacagcttcaccagcctgaccatggccaacaagagcagccaggccagccagaacagacacagcatggagatcagcccccctgtgctgatcagcagcagcaaccccacagctgctgcccgcatcagcgagctgagcggcctgagctgcagcgcccccagccaggtgcacatcagcaccaccggcctgattgtgaccccaccacccagcagccctgtgaccaccggccccagcttcaccttccccagtgatgtgccctaccaggccgccctgggcaccctgaacccccccctgcccccaccacccctgctggccgccaccgtgctggccagcaccccacctggggccacagctgctgctgctgctgctggcatgggcccccggcccatggccggcagcacagaccagatcgcccacctgcggccccagacccggcccagcgtgtatgtggccatctacccctacacccccaggaaagaagatgagctggagctgaggaagggggagatgttcctggtgtttgagcgctgccaggacggctggttcaagggcacctccatgcacaccagcaagattggagtcttccctggcaactacgtggcccctgtgaccagggctgtgaccaatgccagccaggccaaggtgcccatgagcacagctggccagaccagcagaggagtgaccatggtgagccccagcacagctgggggccctgcccagaagctgcagggcaatggagtggccggcagccccagcgtggtgcctgctgctgtggtgtctgctgcccacatccagaccagcccccaggccaaggtgctgctgcacatgacaggccagatgacagtgaaccaggccagaaatgctgtgaggacagtggccgcccacaaccaggagcggcccacagctgctgtgacccccatccaggtgcagaatgctgctggcctgagccctgcctctgtgggcctgagccaccacagcctggccagcccccagcctgcccccctgatgcctggcagcgccacccacacagctgccatcagcatcagccgggccagcgcccccctggcctgtgccgctgctgcccccctgaccagccccagcatcaccagcgccagcctggaggccgagcccagcggccgcatcgtgacagtgctgcccggcctgcccaccagcccagattctgccagcagcgcctgtggcaacagcagcgccaccaagccagacaaggacagcaagaaggagaagaagggcctgctgaagctgctgagcggggccagcaccaagaggaagccccgggtgagccccccagccagccccaccctggaggtggagctgggcagcgctgagctgcccctgcagggcgctgtgggccctgagctgcccccaggcggcggccacggccgggccggcagctgccctgtggatggagatggccctgtgaccacagctgtggccggggccgccctggcccaggatgccttccacaggaaggccagcagcctggacagcgctgtgcccatcgcccccccaccccggcaggcctgcagcagcctgggccctgtgctgaatgaaagcaggcctgtggtgtgtgagcggcaccgggtggtggtgtcctacccaccccagagcgaggccgagctggagctgaaggagggggacatcgtgtttgtgcacaagaagagagaagatggctggttcaagggcaccctgcagagaaatggcaagacaggcctcttccctggcagctttgtggagaacatctag

SEQ ID NO: 18632 - DNA, 570 bp, Artificial Sequence
  Description of Artificial Sequence: Synthetic coding sequence
atgccccagaccgtcatcctgcccggccctgccccctggggcttccggctgagcggcggcatcgacttcaaccagcccctggtgatcacccgcatcaccccaggcagcaaggctgctgctgccaacctgtgccctggagatgtgatcctggccattgatggctttggaacagagagcatgacccatgctgatgcccaggaccgcatcaaggccgccgcccaccagctgtgcctgaagattgacagaggagagacccacctgtggagcccccaggtgtctgaagatggcaaggcccaccccttcaagatcaacctggagagcgagccccaggagttcaagcccatcggcacagcccacaacagaagagcccagccctttgtggccgccgccaacattgatgacaagaggcaggtggtgtctgccagctacaacagccccatcggcctgtacagcaccagcaacatccaggatgccctgcacggccagctgcggggcctcatccccagcagcccccagaagacaggcaccaccctgaacaccagcatcatcttcggccccaacctgtcctag

SEQ ID NO: 18633 - DNA, 1095 bp, Artificial Sequence
  Description of Artificial Sequence: Synthetic coding sequence
atgccccagaccgtcatcctgcccggccctgccccctggggcttccggctgagcggcggcatcgacttcaaccagcccctggtgatcacccgcatcaccccaggcagcaaggctgctgctgccaacctgtgccctggagatgtgatcctggccattgatggctttggaacagagagcatgacccatgctgatgcccaggaccgcatcaaggccgccgcccaccagctgtgcctgaagattgacagaggagagacccacctgtggagcccccaggtgtctgaagatggcaaggcccaccccttcaagatcaacctggagagcgagccccaggacggcaactactttgagcacaagcacaacatccggcccaagcccttcgtcatccctggccgcagcagcggctgcagcaccccatctggaattgactgtggcagcggccgcagcacccccagctctgtgtccacagtgtccaccatctgccctggggacctgaaggtggccgccaagctggcccccaacatccccctggagatggagctgcccggggtgaagatcgtgcacgcccagttcaacacccccatgcagctgtacagtgatgacaacatcatggagaccctgcagggccaggtgtccacagccctgggggagacccccctgatgtctgagcccacagcctctgtgcccccagagagtgatgtgtacaggatgctgcatgacaacagaaatgagcccacccagccccggcagagcggcagcttccgggtgctgcagggcatggtggatgatggcagtgatgacaggcctgctggcaccaggtctgtgcgggcccctgtgaccaaggtgcacggcggcagcggcggggcccagaggatgcccctgtgtgacaagtgtggcagcggcatcgtgggcgctgtggtgaaggcccgggacaagtaccgccaccctgagtgctttgtgtgtgccgactgcaacctgaacctgaagcagaagggctacttcttcattgaaggagagctgtactgtgagacccacgcccgggcccggaccaagcccccagagggctatgacacagtgaccctgtaccccaaggcctag

SEQ ID NO: 18634 - DNA, 951 bp, Artificial Sequence
  Description of Artificial Sequence: Synthetic coding sequence
atgccccagaccgtcatcctgcccggccctgccccctggggcttccggctgagcggcggcatcgacttcaaccagcccctggtgatcacccgcatcaccccaggcagcaaggctgctgctgccaacctgtgccctggagatgtgatcctggccattgatggctttggaacagagagcatgacccatgctgatgcccaggaccgcatcaaggccgccgcccaccagctgtgcctgaagattgacagaggagagacccacctgtggagcccccaggtgtctgaagatggcaaggcccaccccttcaagatcaacctggagagcgagccccaggagttcaagcccatcggcacagcccacaacagaagagcccagccctttgtggccgccgccaacattgatgacaagaggcaggtggtgtctgccagctacaacagccccatcggcctgtacagcaccagcaacatccaggatgccctgcacggccagctgcggggcctcatccccagcagcccccagaatgagcccacagcctctgtgcccccagagagtgatgtgtacaggatgctgcatgacaacagaaatgagcccacccagccccggcagagcggcagcttccgggtgctgcagggcatggtggatgatggcagtgatgacaggcctgctggcaccaggtctgtgcgggcccctgtgaccaaggtgcacggcggcagcggcggggcccagaggatgcccctgtgtgacaagtgtggcagcggcatcgtgggcgctgtggtgaaggcccgggacaagtaccgccaccctgagtgctttgtgtgtgccgactgcaacctgaacctgaagcagaagggctacttcttcattgaaggagagctgtactgtgagacccacgcccgggcccggaccaagcccccagagggctatgacacagtgaccctgtaccccaaggcctag

SEQ ID NO: 18635 - DNA, 3303 bp, Artificial Sequence
  Description of Artificial Sequence: Synthetic coding sequence
atgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccaggcatcggccctgtggatgaaagtggcatccccacagccatccgcaccaccgtggaccggcccaaggactggtacaagaccatgttcaagcagatccacatggtgcacaagccagatgatgacacagacatgtacaacaccccctacacctacaatgccggcctgtacaaccccccctacagcgcccagagccaccctgctgccaagacccagacctaccggcccctgagcaagagccacagcgacaacagccccaatgccttcaaggatgccagcagccctgtgcccccaccccacgtgcccccacctgtgccccccctgcggccccgggacaggagcagcacagagaagcatgactgggaccccccagacaggaaggtggacaccaggaagttccgctctgagcccaggagcatctttgaatatgagcccgggaagagcagcatcctgcagcacgagaggcctgccagcctgtaccagagcagcattgacaggagcctggagcggcccatgagcagcgcctccatggccagtgacttcaggaagaggaggaagtctgagcctgctgtgggccccccccggggcctgggggaccagagcgccagcaggaccagccctggccgggtggacctgcccggcagcagcaccaccctgaccaagagcttcaccagcagcagccccagcagccccagccgggccaagggaggagatgacagcaagatctgccccagcctgtgcagctacagcggcctgaatggaaaccccagcagcgagctggactactgcagcacctaccggcagcacctggatgtgccccgggacagcccccgggccatctccttcaagaatggctggcagatggcccggcagaatgctgagatctggagcagcacagaggagaccgtgagccccaagatcaagagccgcagctgtgatgacctgctgaatgatgactgtgacagcttcccagaccccaaggtgaagtctgagagcatgggcagcctgctgtgtgaggaggacagcaaggagagctgccccatggcctggggcagcccctacgtgcctgaggtgcgcagcaatggccgcagccgcatccgccacaggtctgccagaaatgcccctggcttcctgaagatgtacaagaagatgcaccgcatcaacaggaaggacctgatgaacagcgaggtgatctgcagcgtgaagagccgcatcctgcagtatgagagcgagcagcagcacaaggacctgctgcgggcctggagccagtgcagcacagaggaggtgccccgggacatggtgcccacccgcatcagcgagtttgagaagctgatccagaagagcaagtccatgcccaacctgggagatgacatgctgagccctgtgaccctggagcccccccagaatggcctgtgccccaagaggcgcttcagcattgagtacctgctggaggaggagaaccagagcggccccccagcccggggccggcggggctgccagagcaatgccctggtgcccatccacatcgaggtgaccagtgatgagcagccccgggcccacgtggagttcagtgacagcgaccaggatggagtggtgtctgaccacagcgactacatccacctggagggcagcagcttctgcagcgagagtgactttgaccacttctccttcaccagcagcgagagcttctacggcagcagccaccaccaccaccaccaccaccaccaccaccaccgccacctgatcagcagctgcaagggccgctgcccagccagctacacccgcttcaccaccatgctgaagcatgagcgggcccggcatgagaacacagaggagccccggcggcaggagatggaccccggcctgagcaagctggccttcctggtgtcccctgtgcccttccggaggaagaagaacagcgcccccaagaagcagacagagaaggccaagtgcaaggcctctgtgtttgaggccctggacagcgccctgaaggacatctgtgaccagatcaaggccgagaagaagaggggcagcctgcctgacaacagcatcctgcacaggctcatcagcgagctgctgcctgatgtgcctgagaggaacagcagcctgcgggccctgcggcgcagccccctgcaccagcccctgcaccccctgcccccagatggagccatccactgccccccctaccagaatgactgtggccgcatgcccaggtctgccagcttccaggatgtggacacagccaacagcagctgccaccaccaggaccggggcggggccctgcaggaccgggagagccccaggagctacagcagcaccctgacagacatgggccgcagcgccccccgggagcggcggggcaccccagagaaggagaagctgcctgccaaggctgtgtatgacttcaaggcccagaccagcaaggagctgtccttcaagaagggggacacagtgtacatcctgaggaagattgaccagaactggtatgaaggagagcaccacggccgggtgggcatcttccccatctcctatgtggagaagctgaccccacctgagaaggcccagcctgcccggcccccacctccagcccagcctggagagatcggggaggccatcgccaagtacaacttcaatgctgacaccaacgtggagctgagcctgaggaaaggagacagagtcatcctgctgaagagggtggaccagaactggtatgagggcaagatccctggcaccaaccggcagggcatcttccctgtgtcctatgtggaggtggtgaagaagaacaccaagggagctgaggactacccagacccccccatcccccacagctacagcagtgaccgcatccacagcctgagcagcaacaagccccagaggcctgtgttcacccatgagaacatccagggcggcggggagcccttccaggccctgtacaactacaccccaagaaatgaagatgagctggagctgcgggagagtgatgtgattgatgtgatggagaagtgtgatgatggctggtttgtgggcaccagcaggaggaccaagttcttcggcaccttccctggcaactacgtgaagaggctgtag

SEQ ID NO: 18636 - DNA, 4389 bp, Artificial Sequence
  Description of Artificial Sequence: Synthetic coding sequence
atgttccggggccccaagccacccatcgcccccaagccccggctgacagccccaaatgagtggagggcctctgtgtacctgaatgacagcctgaacaagtgcagcaatggccgcctgccctgtgtggaccggggcctggatgagggccccaggagcatccccaagtgcagcgagagcgagacagatgaggactacatcgtggtgccccgggtgcccctgagagaagatgagcccaaggatgagggctctgtgggcaacaaggccctggtgtccccagagagcagcgctgaggaggaggaggagcgggaggagggcggggaggcctgtggcctggagggcaccggggccggggaggacagcgtggccccagctgcccctggggccggggccctgagccgggagggggaggagggcacagacctggccctggaggatgaaggagagggctgtgctgatgagcccggcaccctggagcaggtgagccgctctgaggaggaggagaagctggtgcagccccacagagaatgttccctggaggacagcggcccctgggccggggagggcgtcttccagagcgacctgctgctgccccacatccacggggaggaccaggagcccccagacaccccaggagaggccgaggaggatgatgaggagggctgtgccagcacagatcctgctggagcagatgagggcagcggccctgaccggcccacagaggacatgggccaggatgctgaggacaccagcgaggagcccccagagaaggaggagctggccggcgtgcaggaggccgagacagccacagactgcccagaggtgctggaggagggctgtgaggaggccactggagtgactggaggagagcaggtggacctgtctgagcccccagaccacgagaagaagaccaaccaggaggtggccgccgccaccctggaggaccacgcccaggatgagagcgctgaggagagctgccagatcgtgccctttgaaaatgactgcatggaggactttgtgaccagcctgaccggcagcccctatgagttcttccccacagagagcaccagcttctgcagcgagagctgcagccccctgtctgagagcgccaagggcctggagagcgagcaggcccccaagctgggcctgcgggcagaggagaaccccatggtgggcgccctgtgtggccagtgtggcagcctgcagggcggcgctgctgagggccctgctgccccagatgtggtggtggtgctggaggaggaggccctggatgatgccctggccaacccctacgtgatgggcgtgggcctgcccggccaggccgcccctggagagggcggccaggccgccagtgatgccctgggcggctacggcagcaaggaggagctgaactgtgaggccgagggcggcctggtgcctgctgacaggaagaacaccagcaccagggtgcggccccacagcggcaaggtggccggctacgtgcctgagaccgtgcctgaggagactggacctgaggccggcagcagcgcccctggcatcggcggcgctgctgaggaggtgggcaagaccctgctgagcctggagggcaagcccctggaggccagccgggccctgcctgccaagccccgggccttcaccctgtaccccaggagcttctctgtggagggccgggagatccctgtgtctgtgtaccaggagcctgagggcagcggcctggatgaccaccgcatcaagaggaaggaggacaacctgagcctgagctgtgtgattggcagcagcggcagcttcagccagaggaaccacctgcccagcagcggcaccagcacccccagctccatggtggacatccccccaccatttgacctggcctgcatcaccaagaagcccatcaccaagagcagccccagcctgctgattgaaagtgacagcccagacaagtacaagaagaagaagagcagcttcaagcgcttcctggccctgaccttcaagaagaagacagagaacaagctgcacgtggatgtgaatgtgagcagcagccgcagcagcagcgagagcagctaccacggccccagccgcatcctggaggtggacagaagaagcctgagcaacagcccccagctgaagagcaggacaggcaagctgcgggccagcgagagccccagcagcctcatcttctacagagatggcaagaggaaaggagtgcccttcagcaggacagtgtcccgggtggagagctttgaggacaggagcaggcctcccttcctgcccctgcccctgaccaagcccaggagcatctccttccccagcgctgacaccagtgactatgagaacatcccagccatgaacagcgactatgagaacatccagatccccccccggcggcctgcccgggccggggccttcaccaagctgtttgaggaccagagccgggccctgagcacagccaatgaaaatgatggctacgtggacatgagcagcttcaatgcctttgagagcaagcagcagagcgctgaccaggatgctgagagcgcctacacagagccctacaaggtgtgccccatcagcagcgctgcccccaaggaggacctgaccagtgatgaggagcagaggagcagcgaggaggaggacagcgccagccgggaccccagcgtgacccacaaggtggagggccagagccgggccctggtgattgcccaggagctgctgagcagcgagaaggcctacgtggagatgctgcagcacctgaacctggacttccatggagctgtgatgagggccctggatgacatggaccacgagggccgggacaccctggcccgggaggagctgcggcagggcctgtctgagctgcctgccatccatgacctgcaccagggcatcctggaggagctggaggagcggctgagcaactgggagagccagcagaaggtggctgatgtgttcctggcccgggagcagggctttgaccaccacgccacccacatcctgcagtttgaccgctacctgggcctgctgtctgagaactgcctgcacagcccccggctggccgctgctgtgcgggagtttgagcagagcgtgcagggcggcagccagacagccaagcaccggctgctgcgggtggtgcagaggctcttccagtaccaggtgctgctgacagactacctgaacaacctgtgcccagattctgcagaatatgacaacacccagggcgccctgagcctcatcagcaaggtgacagaccgggccaatgacagcatggagcagggcgagaacctgcagaagctggtgcacatcgagcacagcgtgcggggccagggcgacctgctgcagcccggccgggagttcctgaaggagggcaccctgatgaaggtgacaggcaagaacagaagacccaggcacctgttcctgatgaatgatgtgctgctgtacacctacccccagaaggatggcaagtaccgcctgaagaacaccctggccgtggccaacatgaaggtgtccaggcctgtgatggagaaggtgccctatgccctgaagattgagaccagcgagagctgcctgatgctgagcgccagcagctgtgccgagagagatgagtggtacggctgcctgagccgggccctgcctgaggactacaaggcccaggccctggccgccttccaccacagcgtggagatccgggagcggctgggcgtgtccctgggggagcggccccccaccctggtgcctgtgacccacgtgatgatgtgcatgaactgtggctgtgacttcagcctgaccctgcggcggcaccactgccacgcctgtgggaagatcgtgtgcaggaactgcagcaggaacaagtaccccctgaagtacctgaaggacaggatggccaaggtgtgtgatggctgctttggagagctgaagaagaggggccgggctgtgcccggcctgatgagggagaggcctgtgtccatgtccttccccctgagcagcccccgcttcagcggcagcgccttcagcagcgtcttccagagcatcaaccccagcaccttcaagaagcagaagaaggtgcccagcgccctgacagaggtggccgccagcggggagggcagcgccatcagcggctacctgagccgctgcaagaggggcaagaggcactggaagaagctgtggtttgtgatcaagggcaaggtgctgtacacctacatggccagcgaggacaaggtggccctggagagcatgcccctgctgggcttcaccatcgcccctgagaaggaggagggcagcagcgaggtgggccccatcttccacctgtaccacaagaagaccctcttctacagcttcaaggccgaggacaccaacagcgcccagcgctggattgaggccatggaggatgcctctgtgctgtag

SEQ ID NO: 18637 - DNA, 768 bp, Artificial Sequence
  Description of Artificial Sequence: Synthetic coding sequence
atggccagcagtgacctggagcagctgtgcagccacgtgaatgagaagattggcaacatcaagaagaccctgagcctgaggaactgtggccaggagcccaccctgaagacagtgctgaacaagattggagatgagatcatcgtcatcaatgagctgctgaacaagctggagctggagatccagtaccaggagcagaccaacaacagcctgaaggagctgtgtgagagcctggaggaggactacaaggacatcgagcacctgaaggaaaatgtgcccagccacctgccccaggtgacagtgacccagagctgtgtgaagggcagtgacctggaccctgaggagcccatcaaggtggaggagcctgagcctgtgaagaagccacccaaggagcagaggagcatcaaggagatgcccttcatcacctgtgatgagttcaacggggtgcccagctacatgaagagccggctgacctacaaccagatcaatgatgtgatcaaggagatcaacaaggctgtgatcagcaagtacaagatcctgcaccagcccaagaagtccatgaacagcgtgaccaggaacctgtaccaccgcttcattgatgaggagaccaaggacaccaagggccgctacttcatcgtggaggccgacatcaaggagttcaccaccctgaaggctgacaagaagttccacgtgctgctgaacatcctgcggcactgccggcggctgtctgaggtgcggggcggcggcctgacccgctacgtgatcacctag

SEQ ID NO: 18638 - DNA, 627 bp, Artificial Sequence
  Description of Artificial Sequence: Synthetic coding sequence
atgtctgctggaggagactttggaaaccccctgaggaagttcaagctggtgttcctgggggagcagagcgtgggcaagaccagcctcatcacccgcttcatgtatgacagctttgacaacacctaccaggccaccatcggcatcgacttcctgagcaagaccatgtacctggaggacagaacagtgcggctgcagctgtgggacacagctggccaggagcgcttccgcagcctcatccccagctacatccgggacagcacagtggccgtggtggtgtatgacatcaccaacctgaacagcttccagcagaccagcaagtggattgatgatgtgaggacagagcggggcagtgatgtgatcatcatgctggtgggcaacaagacagacctggccgacaagaggcagatcaccatcgaggagggggagcagagggccaaggagctgtctgtgatgtttattgagaccagcgccaagacaggctacaacgtgaagcagctgttccggcgggtggccagcgccctgcccggcatggagaatgtgcaggagaagagcaaggagggcatgattgacatcaagctggacaagccccaggagcccccagccagcgagggcggctgcagctgctag

SEQ ID NO: 18639 - DNA, 3168 bp, Artificial Sequence
  Description of Artificial Sequence: Synthetic coding sequence
atgacagtggagcagaatgtgctgcagcagagcgctgcccagaagcaccagcagaccttcctgaaccagctgcgggagatcaccggcatcaatgacacccagatcctgcagcaggccctgaaggacagcaatggaaacctggagctggccgtggccttcctgacagccaagaatgccaagaccccccagcaggaggagaccacctactaccagacagccctgcctggaaatgaccgctacatctctgtgggcagccaggccgacaccaacgtcatcgacctgactggagatgacaaggatgacctgcagagggccatcgccctgagcctggccgagagcaacagagccttccgggagaccggcatcacagatgaggagcaggccatcagccgggtgctggaggccagcattgctgagaacaaggcctgcctgaagaggacccccacagaggtgtggagggacagcaggaacccctatgacaggaagaggcaggacaaggcccctgtgggcctgaagaatgtgggcaacacctgctggttctctgctgtgatccagagcctcttcaacctgctggagttccggcggctggtgctgaactacaagccacccagcaatgcccaggacctgcccaggaaccagaaggagcacaggaacctgcccttcatgagggagctgcgctacctgtttgccctgctggtgggcaccaagaggaaatatgtggaccccagcagagctgtggagatcctgaaggatgccttcaagagcaatgacagccagcagcaggatgtgtctgagttcacccacaagctgctggactggctggaggatgccttccagatgaaggccgaggaggagacagatgaggagaagcccaagaaccccatggtggagctgttctacggccgcttcctggccgtgggcgtgctggagggcaagaagtttgaaaatacagagatgtttggccagtaccccctgcaggtgaatggcttcaaggacctgcatgaatgtctggaggccgccatgattgaaggagaaattgagagcctgcacagcgagaacagcggcaagagcggccaggagcactggttcacagagctgccccctgtgctgacctttgagctgagcagatttgagttcaaccaggccctgggccggcctgagaagatccacaacaagctggagttcccccaggtgctgtacctggaccgctacatgcacaggaaccgggagatcacccgcatcaagcgggaggagatcaagaggctgaaggactacctgactgtgctgcagcagaggctggagcgctacctgtcctatggcagcggccccaagcgcttccccctggtggatgtgctgcagtatgccctggagtttgccagcagcaagcctgtgtgcaccagccctgtggatgacattgatgccagcagccccccatctggcagcatccccagccagaccctgcccagcaccacagagcagcagggcgccctgagcagcgagctgcccagcaccagccccagctctgtggccgccatcagcagccgcagcgtcatccacaagcccttcacccagagccgcatccccccagacctgcccatgcacccagcccccaggcacatcacagaggaggagctgtctgtgctggagagctgcctgcaccgctggaggacagaaattgaaaatgacacccgggacctgcaggagagcatcagccgcatccacaggaccatcgagctgatgtacagcgacaagtccatgatccaggtgccctaccgcctgcatgctgtgctggtgcatgagggccaggccaatgccggccactactgggcctacatctttgaccaccgggagagccgctggatgaagtacaatgacattgctgtgaccaagagctcctgggaggagctggtgcgggacagctttggaggctacagaaatgccagcgcctactgcctgatgtacatcaatgacaaggcccagttcctgatccaggaggagttcaacaaggagaccggccagcccctggtgggcatcgagaccctgcccccagacctgcgggactttgtggaggaggacaaccagagatttgagaaggagctggaggagtgggatgcccagctggcccagaaggccctgcaggagaagctgctggccagccagaagctgcgggagagcgagacctctgtgaccacagcccaggccgccggggaccctgagtacctggagcagcccagcagaagtgacttcagcaagcacctgaaggaggagaccatccagatcatcaccaaggccagccatgaacatgaggacaagagccctgagaccgtgctgcagagcgccatcaagctggagtatgcccggctggtgaagctggcccaggaggacaccccacctgagacagactaccgcctgcaccacgtggtggtgtacttcatccagaaccaggcccccaagaagatcatcgagaagaccctgctggagcagtttggagacaggaacctgagctttgatgagcgctgccacaacatcatgaaggtggcccaggccaagctggagatgatcaagccagaggaggtgaacctggaggagtatgaggagtggcaccaggactacaggaagttccgggagaccaccatgtacctgatcatcggcctggagaacttccagcgggagagctacatcgacagcctgctcttcctgatctgtgcctaccagaacaacaaggagctgctgagcaagggcctgtaccggggccatgatgaggagctgatcagccactaccgccgggagtgcctgctgaagctgaatgagcaggccgctgagctgtttgaaagtggagaagatcgggaggtgaacaacggcctcatcatcatgaatgagttcatcgtgcccttcctgcccctgctgctggtggatgagatggaggagaaggacatcctggccgtggaggacatgaggaaccgctggtgcagctacctgggccaggagatggagccccacctgcaggagaagctgacagacttcctgcccaagctgctggactgcagcatggagatcaagagcttccacgagccccccaagctgcccagctacagcacccatgagctgtgtgaaagatttgcccgcatcatgctgagcctgagcaggaccccagcagatggaagatag

SEQ ID NO: 18640 - DNA, 3264 bp, Artificial Sequence
  Description of Artificial Sequence: Synthetic coding sequence
atgacagtggagcagaatgtgctgcagcagagcgctgcccagaagcaccagcagaccttcctgaaccagctgcgggagatcaccggcatcaatgacacccagatcctgcagcaggccctgaaggacagcaatggaaacctggagctggccgtggccttcctgacagccaagaatgccaagaccccccagcaggaggagaccacctactaccagacagccctgcctggaaatgaccgctacatctctgtgggcagccaggccgacaccaacgtcatcgacctgactggagatgacaaggatgacctgcagagggccatcgccctgagcctggccgagagcaacagagccttccgggagaccggcatcacagatgaggagcaggccatcagccgggtgctggaggccagcattgctgagaacaaggcctgcctgaagaggacccccacagaggtgtggagggacagcaggaacccctatgacaggaagaggcaggacaaggcccctgtgggcctgaagaatgtgggcaacacctgctggttctctgctgtgatccagagcctcttcaacctgctggagttccggcggctggtgctgaactacaagccacccagcaatgcccaggacctgcccaggaaccagaaggagcacaggaacctgcccttcatgagggagctgcgctacctgtttgccctgctggtgggcaccaagaggaaatatgtggaccccagcagagctgtggagatcctgaaggatgccttcaagagcaatgacagccagcagcaggatgtgtctgagttcacccacaagctgctggactggctggaggatgccttccagatgaaggccgaggaggagacagatgaggagaagcccaagaaccccatggtggagctgttctacggccgcttcctggccgtgggcgtgctggagggcaagaagtttgaaaatacagagatgtttggccagtaccccctgcaggtgaatggcttcaaggacctgcatgaatgtctggaggccgccatgattgaaggagaaattgagagcctgcacagcgagaacagcggcaagagcggccaggagcactggttcacagagctgccccctgtgctgacctttgagctgagcagatttgagttcaaccaggccctgggccggcctgagaagatccacaacaagctggagttcccccaggtgctgtacctggaccgctacatgcacaggaaccgggagatcacccgcatcaagcgggaggagatcaagaggctgaaggactacctgactgtgctgcagcagaggctggagcgctacctgtcctatggcagcggccccaagcgcttccccctggtggatgtgctgcagtatgccctggagtttgccagcagcaagcctgtgtgcaccagccctgtggatgacattgatgccagcagccccccatctggcagcatccccagccagaccctgcccagcaccacagagcagcagggcgccctgagcagcgagctgcccagcaccagccccagctctgtggccgccatcagcagccgcagcgtcatccacaagcccttcacccagagccgcatccccccagacctgcccatgcacccagcccccaggcacatcacagaggaggagctgtctgtgctggagagctgcctgcaccgctggaggacagaaattgaaaatgacacccgggacctgcaggagagcatcagccgcatccacaggaccatcgagctgatgtacagcgacaagtccatgatccaggtgccctaccgcctgcatgctgtgctggtgcatgagggccaggccaatgccggccactactgggcctacatctttgaccaccgggagagccgctggatgaagtacaatgacattgctgtgaccaagagctcctgggaggagctggtgcgggacagctttggaggctacagaaatgccagcgcctactgcctgatgtacatcaatgacaaggcccagttcctgatccaggaggagttcaacaaggagaccggccagcccctggtgggcatcgagaccctgcccccagacctgcgggactttgtggaggaggacaaccagagatttgagaaggagctggaggagtgggatgcccagctggcccagaaggccctgcaggagaagctgctggccagccagaagctgcgggagagcgagacctctgtgaccacagcccaggccgccggggaccctgagtacctggagcagcccagcagaagtgacttcagcaagcacctgaaggaggagaccatccagatcatcaccaaggccagccatgaacatgaggacaagagccctgagaccgtgctgcagagcatcatgatgacccccaacatgcagggcatcatcatggccatcggcaagagccgctctgtgtatgacagatgtggccctgaggccggcttcttcaaggccatcaagctggagtatgcccggctggtgaagctggcccaggaggacaccccacctgagacagactaccgcctgcaccacgtggtggtgtacttcatccagaaccaggcccccaagaagatcatcgagaagaccctgctggagcagtttggagacaggaacctgagctttgatgagcgctgccacaacatcatgaaggtggcccaggccaagctggagatgatcaagccagaggaggtgaacctggaggagtatgaggagtggcaccaggactacaggaagttccgggagaccaccatgtacctgatcatcggcctggagaacttccagcgggagagctacatcgacagcctgctcttcctgatctgtgcctaccagaacaacaaggagctgctgagcaagggcctgtaccggggccatgatgaggagctgatcagccactaccgccgggagtgcctgctgaagctgaatgagcaggccgctgagctgtttgaaagtggagaagatcgggaggtgaacaacggcctcatcatcatgaatgagttcatcgtgcccttcctgcccctgctgctggtggatgagatggaggagaaggacatcctggccgtggaggacatgaggaaccgctggtgcagctacctgggccaggagatggagccccacctgcaggagaagctgacagacttcctgcccaagctgctggactgcagcatggagatcaagagcttccacgagccccccaagctgcccagctacagcacccatgagctgtgtgaaagatttgcccgcatcatgctgagcctgagcaggaccccagcagatggaagatag

SEQ ID NO: 18641 - DNA, 2559 bp, Artificial Sequence
  Description of Artificial Sequence: Synthetic coding sequence
atgagctctgtgagccccatccagatccccagccggctgcccctgctgctgacccatgaaggagtgctgctgcccggcagcaccatgaggacctctgtggacagcgccaggaacctgcagctggtgcgcagccggctgctgaagggcaccagcctgcagagcaccatcctgggcgtcatccccaacaccccagaccctgccagtgatgcccaggacctgccccccctgcacagaattggaacagctgccctggccgtgcaggtggtgggcagcaactggcccaagccccactacaccctgctgatcaccggcctgtgccgcttccagatcgtgcaggtgctgaaggagaagccctaccccatcgccgaggtggagcagctggaccggctggaggagttccccaacacctgcaagatgagggaggagctgggggagctgtctgagcagttctacaagtatgctgtgcagctggtggagatgctggacatgtctgtgcctgctgtggccaagctgcggcggctgctggacagcctgccccgggaggccctgcctgacatcctgaccagcatcatccgcaccagcaacaaggagaagctgcagatcctggatgctgtgtccctggaggagcgcttcaagatgaccatccccctgctggtgcggcagatcgagggcctgaagctgctgcagaagaccaggaagcccaagcaggatgatgacaagagggtgattgccatccggcccatccgccgcatcacccacatcagcggcaccctggaggatgaagatgaagatgaagataatgatgacatcgtgatgctggagaagaagatccgcaccagctccatgcctgagcaggcccacaaggtgtgtgtgaaggagatcaagaggctgaagaagatgccccagagcatgccagaatatgccctgaccaggaactacctggagctgatggtggagctgccctggaacaagagcaccacagaccggctggacatccgggccgcccgcatcctgctggacaatgaccactacgccatggagaagctgaagaagagggtgctggagtacctggccgtgcggcagctgaagaacaacctgaagggccccatcctgtgctttgtgggccccccaggagtgggcaagacctctgtgggccgctctgtggccaagaccctgggccgggagttccacagaattgccctgggcggcgtgtgtgaccagagcgacatccggggccacaggaggacctacgtgggctccatgcctggccgcatcatcaatggcctgaagacagtgggcgtgaacaaccctgtgttcctgctggatgaggtggacaagctgggcaagagcctgcagggcgaccctgctgctgccctgctggaggtgctggaccctgagcagaaccacaacttcacagaccactacctgaatgtggcctttgacctgagccaggtgctcttcatcgccacagccaacaccacagccaccatcccagctgccctgctggacaggatggagatcatccaggtgcccggctacacccaggaggagaagattgaaattgcccaccgccacctgatccccaagcagctggagcagcacggcctgaccccccagcagatccagatcccccaggtgaccaccctggacatcatcacccgctacacccgggaggccggcgtgcgcagcctggacaggaagctgggcgccatctgcagagctgtggccgtgaaggtggccgagggccagcacaaggaggccaagctggacagaagtgatgtgacagagcgggagggctgccgggagcacatcctggaggatgagaagccagagagcatcagtgacaccacagacctggccctgcccccagagatgcccatcctgattgacttccacgccctgaaggacatcctgggcccccccatgtatgagatggaggtgtcccagaggctgagccagcccggggtggccatcggcctggcctggacccccctgggcggggagatcatgtttgtggaggccagcaggatggatggagagggccagctgaccctgaccggccagctgggagatgtgatgaaggagagcgcccacctggccatctcctggctgcggagcaatgccaagaagtaccagctgaccaatgccttcggcagctttgacctgctggacaacacagacatccacctgcacttccctgctggagctgtgaccaaggatggccccagcgctggggtgaccatcgtgacctgcctggccagcctcttcagcggccgcctggtgcggagtgatgtggccatgaccggggagatcaccctgcggggcctggtgctgcctgtgggcggcatcaaggacaaggtgctggccgcccacagagctggcctgaagcaggtgatcatccccaggagaaatgagaaggacctggagggcatccctggaaatgtgcggcaggacctgagctttgtgacagccagctgcctggatgaggtgctgaatgctgcctttgatggcggcttcaccgtgaagaccaggcctggcctgctgaacagcaagctgtag

SEQ ID NO: 18642 - DNA, 390 bp, Artificial Sequence
  Description of Artificial Sequence: Synthetic coding sequence
atggctgatggcggcggcggcggcggcaccggggctgtgggcggcggcggcaccagccaggccagcgctggagctgccactggagccaccggggccagcggcggcggcggccccatcaacccagccagcctgcccccaggggacccccagctgattgccctgattgtggagcagctgaagagccggggcctgtttgacagcttcagaagagactgcctggctgatgtggacaccaagccagcctaccagaacctgcggcagaaggtggacaactttgtgtccacccacctggacaagcaggagtggaaccccaccatgaacaagaaccagctgagaaatggcctgcggcagagcgtggtgcagatccggcagaccccatttgagagctag

SEQ ID NO: 18643 - DNA, 1425 bp, Artificial Sequence
  Description of Artificial Sequence: Synthetic coding sequence
atggatgaggccggcagcagcgccagcggcggcggcttccggcctggggtggacagcctggatgagccccccaacagccgcatcttcctggtgatcagcaagtacaccccagagagcgtgctgcgggagcgcttcagcccctttggagacatccaggacatctgggtggtgcgggacaagcacaccaaggagagcaagggcatcgcctttgtgaagtttgcccggagcagccaggcctgccgggccatggaggagatgcacggccagtgcctgggccccaatgacaccaagcccatcaaggtgttcatcgcccagagccgcagcagcggcagccacagagatgtggaggatgaggagctgacccgcatctttgtgatgatccccaagagctacacagaggaggacctgcgggagaagttcaaggtgtatggagacatcgagtactgcagcatcatcaagaacaaggtgactggagagagcaagggcctgggctacgtgcgctacctgaagcccagccaggccgcccaggccatcgagaactgtgacaggagcttccgggccatcctggccgagcccaagaacaaggccagcgagagcagcgagcaggactactacagcaacatgaggcaggaggccctgggccacgagccccgggtgaacatgttcccctttgagcagcagagcgagttcagcagctttgacaagaatgacagccggggccaggaggccatcagcaagaggctgtctgtggtgtcccgggtgcccttcacagaggagcagctgttcagcatctttgatattgtgcccggcctggagtactgtgaggtgcagagggacccctacagcaactacggccacggcgtggtgcagtacttcaacgtggccagcgccatctatgccaagtacaagctgcacggcttccagtacccacctggcaacagaattggagtgtccttcattgatgatggcagcaatgccacagacctgctgaggaagatggccacccagatggtggccgcccagctggcctccatggtgtggaacaaccccagccagcagcagttcatgcagtttggaggcagcagcggcagccagctgccccagatccagacagatgtggtgctgcccagctgcaagaagaaggccccagctgagacccctgtgaaggagcggctcttcatcgtgttcaacccccaccccctgcccctggatgtgctggaggacatcttctgccgctttggaaacctgattgaggtgtacctggtgtctgggaagaatgtgggctacgccaagtatgctgaccgcatcagcgccaatgatgccatcgccaccctgcacggcaagatcctgaatggagtgcggctgaaggtgatgctggccgacagcccccgggaggagagcaacaagaggcagaggacctactag

SEQ ID NO: 18644 - DNA, 1938 bp, Artificial Sequence
  Description of Artificial Sequence: Synthetic coding sequence
atgaggcccaggaaggccttcctgctgctgctgctgctgggcctggtgcagctgctggccgtggccggggctgagggcccagatgaggacagcagcaacagagaaaatgccattgaagatgaggaggaggaggaggaggaggatgatgatgaggaggaggatgacctggaggtgaaggaggagaatggagtgctggtgctgaatgatgccaactttgacaactttgtggccgacaaggacacagtgctgctggagttctacgccccctggtgtggccactgcaagcagtttgccccagaatatgagaagatcgccaacatcctgaaggacaaggacccccccatccctgtggccaagattgatgccaccagcgcctctgtgctggccagcagatttgatgtgtctggctaccccaccatcaagatcctgaagaagggccaggccgtggactatgagggcagcaggacccaggaggagatcgtggccaaggtgcgggaggtgtcccagcctgactggaccccacctcctgaggtgaccctggtgctgaccaaggaaaattttgatgaggtggtgaatgatgctgacatcatcctggtggagttctacgccccctggtgtggccactgcaagaagctggccccagaatatgagaaggccgccaaggagctgagcaagaggagcccccccatccccctggccaaggtggatgccacagctgagacagacctggccaagagatttgatgtgtctggctaccccaccctgaagatcttcaggaagggccggccctatgactacaacggcccccgggagaagtatggaattgtggactacatgattgagcagagcggcccccccagcaaggagatcctgaccctgaagcaggtgcaggagttcctgaaggatggagatgatgtgatcatcattggagtcttcaagggggagagtgaccctgcctaccagcagtaccaggatgctgccaacaacctgcgggaggactacaagttccaccacaccttcagcacagagatcgccaagttcctgaaggtgtcccagggccagctggtggtgatgcagcctgagaagttccagagcaaatatgagcccaggagccacatgatggatgtgcagggcagcacccaggacagcgccatcaaggactttgtgctgaagtatgccctgcccctggtgggccacaggaaggtgtccaatgatgccaagcgctacacccggcggcccctggtggtggtgtactacagcgtggacttctcctttgactacagagctgccacccagttctggaggagcaaggtgctggaggtggccaaggacttccctgagtacacctttgccatcgcagatgaggaggactatgctggggaggtgaaggacctgggcctgtctgagagcggggaggatgtgaatgctgccatcctggatgagagcggcaagaagtttgccatggagcctgaggagtttgacagcgacaccctgcgggagtttgtgacagccttcaagaagggcaagctgaagcctgtgatcaagagccagcctgtgcccaagaacaacaagggccctgtgaaggtggtggtgggcaagacctttgacagcatcgtgatggaccccaagaaggatgtgctgattgagttctacgccccctggtgtggccactgcaagcagctggagcctgtgtacaacagcctggccaagaagtacaagggccagaagggcctggtgattgccaagatggatgccacagccaatgatgtgcccagcgaccgctacaaggtggagggcttccccaccatctactttgcccccagcggggacaagaagaaccctgtgaagtttgaaggaggagaccgggacctggagcacctgagcaagttcatcgaggagcacgccaccaagctgagcaggaccaaggaggagctgtag

SEQ ID NO: 18645 - DNA, 1338 bp, Artificial Sequence
  Description of Artificial Sequence: Synthetic coding sequence
atgtaccccaaccccctcatctactgcacctgctgggacccctggaacctgggccccaggaagctgatcaagaccccccagctgcccaggaagaacagcacaggcagcagcaagctgacccccctggtgcctgcccccaagaaccacaactacctgcagcccaccaagcctgtggtgagccccaagatgaagatccacagcgcccggcaggaggagaccaacaagagcttctatgaggtgatcaacgtgtccccaggctaccagctggtgaggaaccgggagcagatctctgtgaccctgggagatgagatgtttgacaggaagaagcgctgggagagcgagatcccagacaagggccgcttcagcaggaccaacatcatcagtgacctggaggagcagatcagcgagctgacagccatcatcgagcagatgaacagagaccaccagagcgcccagaagctgctgagcagcgagatggacctgcgctgtgccgagatgaagcagaactttgagaacaagaaccgggagctgaaggaggcccatgaagctgagctgtctgagctggagaacaactacaaggccgccctgaaggccgagaagctggccgcccaggagaagctggaggagatgggcaaggagtacaagtacctgaagaacatgttccgcacctaccaggacagcatctatgatgagatggaggagaagtggagcaagcagaaggccaagtggaagaaggatgagaagtttgagcgggagaacatcctgctgcagcagaagaagaagatgaccaagaagtttgagatggagagcggggaggaggacaagaagatcaatgaaagctgcagcgctgtgtttgagaacttcatccaggagaaggaggagctgctgaagcagcaccagagcgacaccctgcagctggaggagctgaggaagaccaaggaggtgccctggaggcgggaccagatcaacagacactggcatgatgtgctgcagcagctgctgctgatgcaggtgatgcaggaggagctgcacgcccaggccctgatcctggagagcctgaacaccaacctgtactacacccagctggagctgcagaaggagaaggccatcgtgggcaacctggagaagatgctgcagaccaagtttgctgagacagaggagaagtacaagcacaccatccagatcctgacagaggagaacatccacctgaagcagaagatcatcagcaagaatgaggagatctgtgagggctgcagcggccgcctggccagcatcaccgtgtccaaggatgacagcgacacagtgcaggacggcagcaagaagggccaggagagctag

SEQ ID NO: 18646 - DNA, 1872 bp, Artificial Sequence
  Description of Artificial Sequence: Synthetic coding sequence
atggagcccccccaggagaccaaccggcccttcagcaccctggacaacagaagtggccaggtgcaggtgctgagcgccacccccctgctgcagaggaacccctacagcagcccagacatcatgcacatcaagggcagcgaggccagctctgtgccctatgccctgaaccagggcaccacagccctgcccaagaacaagaaccaggagggcaccggccaccggctgctgaacatgctgaggaagaccctgaaggagagtgacagcgaggagctggagatcacccaggagacccccaacctggtgccctttggagatgtggtgggctgcctgggcatccacatcaagaactgccgccacttcatgcccaagatcagcctgcagcactacgccaacctcttcatccgcatcagcatcaacaaggctgtgaagtgcaccaagatgtgcagcctgctgagcaagaatgatgagaagaacacagtcatcaagtttgatgaggtgaagtacttctctgtgcaggtgcccaggagatatgatgacaagaggaacaacatcctgctggagctgatccagtatgacaaccgggagaagagggccttcctgctgggctctgtgcagatccacctgtatgaagtcatccagaagggctgcttcatcgaggaggtgcaggtgctgcacggcaacatctttgtgtgccgcctggaggtggagttcatgttctcctatggcaactttggctacggcttcagccaccagctgaagcccctgcagaagatcacagagcccagcatgttcatgaacctggcccctcctcctgagaggacagatcctgtgaccaaggtgatcaccccccagacagtggagtacccagccttcctgagcccagacctgaatgtgacagtgggcaccccagctgtgcagagcagcaaccagcccagcgtggtgcggctggagaagctgcagcagcagccccgggagcggctggagaagatgaagaaggagtacagaaacctgaacacctggattgacaaggccaactacctggagagcatcctgatgcccaagctggagcacaaggacagcgaggagaccaacattgatgaggccagcgagaacaccaagagcaaccaccctgaggaggagctggagaacatcgtgggcgtggacatccccctggtgaatgaggaggccgagaccacagccaatgagctgctggacaatgacagcgagaagggcctgaccatccccaccctgaaccagagcgaccaggacaacagcacagcagatgccagcaagaatgatgagagcacccccagccccacagaggtgcacagcctgtgcaccatcagcaaccaggagaccatcaaggccggccgcatcccccccctgggggagcggcagagcgagagcatgccagacaggaagatgaagaatgtgttcttccccctggaggtgaagctgaaggacaactaccccagcatcctgaaggctgacagcagcctgtctgaggtggccttcagccccaaggagtacaacagccccagcttccggcctgagtacatcgagttcaagcccaagttccaggactgcagcgacaagtttgaggacctgcatgacatgaccagcttcacccacctgaagaaggtgaagagccgcagccggctgctgggcaagagcagtgatgacatccacaaccacgcccggcacagcgcccggccctacacagcccctgaggtgaacaagcagcgggagagctacagcggcaagttcaccagcaggaggatggtgagcagcggcctggtgcacatcaatgacaagaccagtgactatgagatgcacaagatgaggcccaagaagatcaagaggggctactag

SEQ ID NO: 18647 - DNA, 3594 bp, Artificial Sequence
  Description of Artificial Sequence: Synthetic coding sequence
atgcacatcaagagcatcatcctggagggcttcaagagctatgcccagaggacagaggtgaatggatttgaccccctcttcaatgccatcaccggcctgaatggcagcggcaagagcaacatcctggacagcatctgcttcctgctgggcatcagcaacctgagccaggtgcgggccagcaacctgcaggacctggtgtacaagaatggccaggccggcatcaccaaggcctctgtgtccatcacctttgacaacagcgacaagaagcagagccccctgggctttgaggtgcatgatgagatcaccgtgacccggcaggtggtgattggaggcaggaacaagtacctgatcaacggggtgaatgccaacaacaccagggtgcaggacctcttctgcagcgtgggcctgaatgtgaacaacccccacttcctgatcatgcagggccgcatcaccaaggtgctgaacatgaagcccccagagatcctgtccatgattgaggaggccgccggcaccaggatgtatgagtacaagaagattgctgcccagaagaccatcgagaagaaggaggccaagctgaaggagatcaagaccatcctggaggaggagatcacccccaccatccagaagctgaaggaggagaggagcagctacctggagtaccagaaggtgatgagagaaattgagcacctgagccggctgtacatcgcctaccagttcctgctggccgaggacaccaaggtgcgctctgctgaggagctgaaggagatgcaggacaaggtgatcaagctgcaggaggagctgtctgaaaatgacaagaagatcaaggccctgaaccatgaaattgaggagctggagaagaggaaggacaaggagaccggcggcatcctgcggagcctggaggatgccctggccgaggcccagagggtgaacaccaagagccagagcgcctttgacctgaagaagaagaacctggcctgtgaggagagcaagaggaaggagctggagaagaacatggtggaggacagcaagaccctggccgccaaggagaaggaggtgaagaagatcacagatggcctgcacgccctgcaggaggccagcaacaaggatgctgaggccctggccgccgcccagcagcacttcaatgctgtgtctgctggcctgagcagcaatgaagatggagctgaggccaccctggccggccagatgatggcctgcaagaatgacatcagcaaggcccagacagaggccaagcaggcccagatgaagctgaagcacgcccagcaggagctgaagaacaagcaggccgaggtgaagaagatggacagcggctacaggaaggaccaggaggccctggaggccgtgaagaggctgaaggagaagctggaggccgagatgaagaagctgaactatgaggagaacaaggaggagagcctgctggagaagaggcggcagctgagccgggacatcggccgcctgaaggagacctatgaggccctgctggcccgcttccccaacctgcgctttgcctacaaggaccctgagaagaactggaacagaaactgtgtgaagggcctggtggccagcctcatctctgtgaaggacaccagcgccaccacagccctggagctggtggccggggagcggctgtacaacgtggtggtggacacagaggtgacaggcaagaagctgctggagcggggggagctgaagaggcgctacaccatcatccccctgaacaagatcagcgcccgctgcatcgcccctgagaccctgcgggtggcccagaacctggtgggccctgacaacgtgcacgtggccctgagcctggtggagtacaagccagagctgcagaaggccatggagtttgtgtttggcaccacctttgtgtgtgacaacatggacaatgccaagaaggtggcctttgacaagaggatcatgaccaggacagtgaccctgggcggagatgtgtttgacccccacggcaccctgagcggcggggcccggagccaggccgccagcatcctgaccaagttccaggagctgaaggatgtgcaggatgagctgcgcatcaaggaaaatgagctgcgggccctggaggaggagctggccggcctgaagaacacagctgagaagtaccggcagctgaagcagcagtgggagatgaagacagaggaggccgacctgctgcagaccaagctgcagcagagcagctaccacaagcagcaggaggagctggatgccctgaagaagaccatcgaggagagcgaggagaccctgaagaacaccaaggagatccagaggaaggccgaggagaagtatgaggtgctggagaacaagatgaagaatgctgaggccgagcgggagcgggagctgaaggatgcccagaagaagctggactgtgccaagaccaaggcagatgccagcagcaagaagatgaaggagaagcagcaggaggtggaggccatcaccctggagctggaggagctgaagcgggagcacaccagctacaagcagcagctggaggccgtgaatgaggccatcaagagctatgagagccagatcgaggtgatggctgctgaggtggccaagaacaaggagagcgtgaacaaggcccaggaggaggtgaccaagcagaaggaggtgatcacagcccaggacaccgtcatcaaggccaagtatgcagaggtggccaagcacaaggagcagaacaatgacagccagctgaagatcaaggagctggaccacaacatcagcaagcacaagcgggaggctgaagatggagctgccaaggtgtccaagatgctgaaggactatgactggatcaatgctgagcggcacctgtttggccagcccaacagcgcctatgacttcaagaccaacaaccccaaggaggccggccagaggctgcagaagctgcaggagatgaaggagaagctgggcagaaatgtgaacatgagggccatgaatgtgctgacagaggccgaggagcgctacaatgacctgatgaagaagaagagaattgtggagaatgacaagagcaagatcctgaccaccatcgaggacctggaccagaagaagaaccaggccctgaacatcgcctggcagaaggtgaacaaggactttggcagcatcttcagcaccctgctgcccggggccaatgccatgctggcccctcctgagggccagacagtgctggatggcctggagttcaaggtggccctgggcaacacctggaaggagaacctgacagagctgagcggcggccagaggagcctggtggccctgagcctcatcctgtccatgctgctcttcaagccagcccccatctacatcctggatgaggtggatgctgccctggacctgagccacacccagaacatcggccagatgctgcggacccacttcacccacagccagttcatcgtggtgtccctgaaggagggcatgttcaacaatgccaacgtgctcttcaagaccaagtttgtggatggagtgtccacagtggcccgcttcacccagtgccagaatggcaagatcagcaaggaggccaagagcaaggccaagccacccaagggggcccacgtggaggtgtag

SEQ ID NO: 18648 - DNA, 1080 bp, Artificial Sequence
  Description of Artificial Sequence: Synthetic coding sequence
atgaggacagctgaccgggaggcccggcccggcctgcccagcctgctgctgctgctgctggccggggccggcctgtctgctgccagccccccagctgccccccgcttcaacgtgtccctggacagcgtgcctgagctgcgctggctgcctgtgctgcggcactatgacctggacctggtgcgggccgccatggcccaggtgattggagacagagtgcccaagtgggtgcacgtgctgattggcaaggtggtgctggagctggagcgcttcctgccccagcccttcaccggggagatccggggcatgtgtgacttcatgaacctgagcctggccgactgcctgctggtgaacctggcctatgagagctctgtgttctgcaccagcatcgtggcccaggacagccggggccacatctaccacggcaggaacctggactacccctttggaaatgtgctgaggaagctgactgtggatgtgcagttcctgaagaatggccagatcgccttcaccggcaccaccttcatcggctacgtgggcctgtggacaggccagagcccccacaagttcaccgtgtctggagatgagcgggacaagggctggtggtgggagaatgccatcgccgccctcttcagaagacacatccctgtgtcctggctgatccgggccaccctgtctgagagcgagaactttgaggccgctgtgggcaagctggccaagacccccctgattgctgatgtgtactacatcgtgggcggcaccagcccccgggagggcgtggtgatcaccaggaacagagatggccctgctgacatctggcccctggaccccctgaatggagcctggttccgggtggagaccaactatgaccactggaagccagcccccaaggaggatgacaggaggaccagcgccatcaaggccctgaatgccaccggccaggccaacctgagcctggaggccctcttccagatcctgtctgtggtgcctgtgtacaacaacttcaccatctacaccaccgtgatgtctgctggcagcccagacaagtacatgacccgcatccggaaccccagcaggaagtag

SEQ ID NO: 18649 - DNA, 1647 bp, Artificial Sequence
  Description of Artificial Sequence: Synthetic coding sequence
atggccctgcacgtgcccaaggcccctggctttgcccagatgctgaaggagggcgccaagcacttcagcggcctggaggaggccgtgtacagaaacatccaggcctgcaaggagctggcccagaccaccaggacagcctacggccccaacggcatgaacaagatggtgatcaaccacctggagaagctgtttgtgaccaatgatgctgccaccatcctgcgggagctggaggtgcagcaccctgctgccaagatgattgtgatggccagccacatgcaggagcaggaggtgggagatggcaccaactttgtgctggtgtttgctggggccctgctggagctggccgaggagctgctgagaattggcctgtctgtgtctgaggtgattgagggctatgagatcgcctgcaggaaggcccacgagatcctgcccaacctggtgtgctgcagcgccaagaacctgcgggacattgatgaggtgagcagcctgctgcggaccagcatcatgagcaagcagtatggaaatgaggtgttcctggccaagctgattgcccaggcctgtgtgtccatcttcccagacagcggccacttcaacgtggacaacatccgggtgtgcaagatcctgggcagcggcatcagcagcagctctgtgctgcacggcatggtgttcaagaaggagacagaaggagatgtgacctctgtgaaggatgccaagattgctgtgtacagctgcccctttgatggcatgatcacagagaccaagggcaccgtgctgatcaagacagctgaggagctgatgaacttcagcaagggggaggagaacctgatggatgcccaggtgaaggccatcgctgacaccggggccaacgtggtggtgactggaggcaaggtggccgacatggccctgcactacgccaacaagtacaacatcatgctggtgcggctgaacagcaagtgggacctgcggcggctgtgcaagacagtgggcgccacagccctgccccggctgaccccacctgtgctggaggagatgggccactgtgacagcgtgtacctgtctgaggtgggggacacccaggtggtggtgttcaagcatgagaaggaggatggagccatcagcaccatcgtgctgcggggcagcacagacaacctgatggatgacatcgagagagctgtggatgatggagtgaacaccttcaaggtgctgacccgggacaagaggctggtgcctgggggcggggccacagaaattgagctggccaagcagatcaccagctatggagagacctgccccggcctggagcagtatgccatcaagaagtttgctgaggcctttgaggccatcccccgggccctggccgagaacagcggcgtgaaggccaatgaagtcatcagcaagctgtatgctgtgcaccaggagggcaacaagaatgtgggcctggacatcgaggccgaggtgcctgctgtgaaggacatgctggaggccggcatcctggacacctacctgggcaagtactgggccatcaagctggccaccaatgctgctgtgacagtgctgcgggtggaccagatcatcatggccaagccagctgggggccccaagcccccatctgggaagaaggactgggatgatgaccagaatgactag

SEQ ID NO: 18650 - DNA, 690 bp, Artificial Sequence
  Description of Artificial Sequence: Synthetic coding sequence
atgaacatcagaaatgcccagccagatgacctgatgaacatgcagcactgcaacctgctgtgcctgcctgagaactaccagatgaagtactacctgtaccacggcctgtcctggccccagctgagctacatcgccgaggatgaagatggcaagatcgtgggctacgtgctggccaagatggaggaggagccagatgatgtgccccacggccacatcaccagcctggccgtgaagaggagccaccggcggctgggcctggcccagaagctgatggaccaggccagccgggccatgattgagaacttcaatgccaagtatgtgtccctgcacgtgaggaagagcaacagacctgccctgcacctgtacagcaacaccctgaacttccagatcagcgaggtggagcccaagtactatgcagatggagaagatgcctatgccatgaagagggacctgagccagatggctgatgagctgcggcggcagatggacctgaagaagggcggctacgtggtgctgggcagccgggagaaccaggagacccagggcagcaccctgagtgacagcgaggaggcctgccagcagaagaacccagccacagaggagagcggcagtgacagcaaggagcccaaggagagcgtggagagcaccaacgtgcaggacagcagcgagagcagtgacagcaccagctag

SEQ ID NO: 18651 - DNA, 1374 bp, Artificial Sequence
  Description of Artificial Sequence: Synthetic coding sequence
atgtctgccctgcggcgcagcggctacggccccagtgatggccccagctatggccgctactacggccctggaggaggagatgtgcctgtgcaccccccaccacccctgtaccccctgcggcctgagcccccccagccccccatctcctggagggtgcggggcggcggccctgctgagaccacctggctgggggagggcggcggcggagatggctactaccccagcggcggggcctggccagagcccggccgggccggcggcagccaccaggagcagcccccctaccccagctacaacagcaactactggaacagcacagcccggagccgggccccctaccccagcacctaccctgtgcggcctgagctgcagggccagagcctgaacagctacaccaatggagcctacggccccacctacccacctggccctggggccaacacagccagctacagcggggcctactatgcccctggctacacccagaccagctacagcacagaggtgcccagcacctaccgcagcagcggcaacagccccacccctgtgagccgctggatctacccccagcaggactgccagacagaggccccacccctgcggggccaggtgcccggctacccacccagccagaaccctggcatgaccctgccccactacccctatggagatggcaacagatctgtgccccagagcggccccaccgtgcggccccaggaggatgcctgggccagccctggggcctacggcatgggcggccgctacccctggcccagcagcgcccccagcgcccctcctggcaacctgtacatgacagagagcaccagcccctggcccagcagcggcagcccccagagcccccccagcccccctgtgcagcagcccaaggacagcagctacccctacagccagagcgaccagagcatgaacagacacaacttcccctgcagcgtgcaccagtatgagagcagcggcaccgtgaacaatgatgacagcgacctgctggacagccaggtgcagtacagcgctgagccccagctgtatggaaatgccaccagtgaccaccccaacaaccaggaccagagcagcagcctgcctgaggagtgtgtgcccagtgatgagagcaccccacccagcatcaagaagatcatccacgtgctggagaaggtgcagtacctggagcaggaggtggaggagtttgtgggcaagaagacagacaaggcctactggctgctggaggagatgctgaccaaggagctgctggagctggacagcgtggagaccggcggccaggacagcgtgcggcaggccaggaaggaggccgtgtgcaagatccaggccatcctggagaagctggagaagaagggcctgtag

SEQ ID NO: 18652 - DNA, 3201 bp, Artificial Sequence
  Description of Artificial Sequence: Synthetic coding sequence
atgcagagcacagacctgggcaacaaggagagcggcaagatctggcacaggaagcccagccctgccaccagagatggcatcatcgtgaacatcatccacaacaccagtgactaccaccccaaggtgctgcgcttcctgaatgtggcctttgatggcactggagactgcctgattgctggggaccaccagggcaacatctacgtgtttgacctgcacggcaaccgcttcaacctggtgcagaggacagcccaggcctgcacagccctggccttcaacctgcggaggaagtctgagttcctggtggccctggccgactacagcatcaagtgctttgacacagtgaccaaggagctggtgtcctggatgaggggccacgagagcagcgtcttcagcatctctgtgcacgccagcggcaagtatgccatcaccaccagcagtgacacagcccagctgtgggacctggacaccttccagaggaagaggaagctgaacatccggcagagcgtgggcatccagaaggtgttcttcctgcccctgagcaacaccatcctgagctgcttcaaggacaacagcatctttgcctgggagtgtgacaccctcttctgcaagtaccagctgcctgcccctcctgagagcagcagcatcctgtacaaggtgtttgctgtgaccagagatggccgcatcctggccgccggcggcaagagcaaccacctgcacctgtggtgcctggaggcccggcagctgttccgcatcatccagatgcccaccaaggtgcgggccatccgccacctggagttcctgcctgacagctttgatgctggcagcaaccaggtgctgggcgtgctgagccaggacggcatcatgaggttcatcaacatgcagacctgcaagctgctgtttgagatcggcagcctggatgagggcatcagcagcagcgccatcagcccccacggccgctacatcgccagcatcatggagaatggcagcctgaacatctacagcgtgcaggccctgacccaggagatcaacaagcccccaccacccctggtgaaggtgattgaggacctgcccaagaacaagctgagcagcagtgacctgaagatgaaggtgaccagcggccgggtgcagcagcctgccaagagccgggagagcaagatgcagacccgcatcctgaagcaggacctgaccggggactttgagagcaagaagaatgagctgcctgatggcctgaacaagaagaggctgcagatcctgctgaagggctacggggagtaccccaccaagtacaggatgttcatctggaggagcctgctgcagctgcctgagaaccacacagccttcagcaccctgattgacaagggcacccacgtggccttcctgaacctgcagaagaagtaccccatcaagagcaggaagctgctgcgggtgctgcagaggaccctgagcgccctggcccactggagcgtcatcttcagtgacaccccctacctgcccctgctggccttcccctttgtgaagctgttccagaacaaccagctgatctgctttgaggtgattgccaccctcatcatcaactggtgccagcactggtttgagtacttccccaacccccccatcaacatcctgtccatgattgaaaatgtgctggccttccatgacaaggagctgctgcagcacttcatcgaccatgacatcaccagccagctgtatgcctggcccctgctggagaccgtcttcagcgaggtgctgacccgggaggagtggctgaagctgtttgacaacatcttcagcaaccaccccagcttcctgctgatgacagtggtggcctacaacatctgcagcaggacccccctgctgagctgcaacctgaaggatgactttgagttcttcttccaccacaggaacaacctggacatcaacgtggtgatccggcaggtgtaccacctgatggagaccacccccacagacatccacccagacagcatgctgaatgtgtttgtggccctgaccaagggccagtaccctgtgttcaaccagtaccccaagttcatcgtggactaccagacccaggagcgggagcgcatcagaaatgatgagctggactacctgcgggagcggcagacagtggaggacatgcaggccaaggtggaccagcagagggtggaggatgaggcctggtaccagaagcaggagctgctgaggaaggccgaggagacccggcgggagatgctgctgcaggaggaggagaagatgatccagcagaggcagaggctggccgctgtgaagcgggagctgaaggtgaaggagatgcacctgcaggatgctgcccggcggcgcttcctgaagctgcagcaggaccagcaggagatggagctgcggcggctggatgatgaaattggaaggaaggtgtacatgagggaccgggagattgctgccacagcccgggacctggagatgaggcagctggagctggagagccagaagaggctgtatgagaagaacctgacagagaaccaggaggccctggccaaggagatgagagcagatgctgatgcctacagaaggaaggtggacctggaggagcacatgttccacaagctgattgaggccggggagacccagagccagaagacccagaaggtgatcaaggagaacctggccaaggccgagcaggcctgcctgaacacagactggcagatccagagcctgcacaagcagaagtgtgatgacctgcagaggaacaagtgctaccaggaggtggccaagctgctgcgggagaacagaaggaaggagattgagatcatcaatgccatggtggaggaggaggccaagaagtggaaggaggccgagggcaaggagttccggctgcggagcgccaagaaggccagcgccctgagtgatgccagcaggaagtggttcctgaagcaggagatcaatgctgctgtggagcacgccgagaacccctgccacaaggaggagccccgcttccagaatgagcaggacagcagctgcctgcccaggaccagccagctgaatgacagcagcgagatggaccccagcacccagatcagcctgaacagaagagctgtggagtgggacaccaccggccagaacctgatcaagaaggtgaggaacctgcggcagaggctgacagcccgggcccggcaccgctgccagaccccccacctgctggccgcctag

SEQ ID NO: 18653 - DNA, 618 bp, Artificial Sequence
  Description of Artificial Sequence: Synthetic coding sequence
atggagggcaatggacctgctgctgtgcactaccagcctgccagccccccaagagatgcctgtgtgtacagcagctgctactgtgaggagaacatctggaagctgtgtgagtacatcaagaaccacgaccagtaccccctggaggagtgctatgctgtgttcatcagcaatgaaaggaagatgatccccatctggaagcagcaggcccggcctggagatggccctgtgatctgggactaccacgtggtgctgctgcacgtgtcctctgggggccagaacttcatctatgacctggacacagtgctgcccttcccctgcctgtttgacacctacgtggaggatgccttcaagagtgatgatgacatccacccccagttccggaggaagttccgggtcatccgggctgacagctacctgaagaactttgccagtgacaggagccacatgaaggacagcagcggcaactggagggagcccccaccaccctacccctgcatcgagaccggggacagcaagatgaacctgaatgacttcatctccatggaccccaaggtgggctggggcgctgtgtacaccctgtctgagttcacccaccgcttcggcagcaagaactgctag

SEQ ID NO: 18654 - DNA, 1974 bp, Artificial Sequence
  Description of Artificial Sequence: Synthetic coding sequence
atgagccaggtgctcttccaccagctggtgcccctgcaggtgaagtgcaaggactgtgaggagcggcgggtgtccatccgcatgagcattgagctgcagagcgtgagcaaccctgtgcacaggaaggacctggtgatccggctgacagatgacacagaccccttcttcctgtacaacctggtgatcagcgaggaggacttccagagcctgaagttccagcagggcctgctggtggacttcctggccttcccccagaagttcatcgacctgctgcagcagtgcacccaggagcacgccaaggagatcccccgcttcctgctgcagctggtgtccccagctgccatcctggacaacagccctgccttcctgaatgtggtggagaccaaccccttcaagcacctgacccacctgagcctgaagctgctgcctggaaatgatgtggagatcaagaagttcctggccggctgcctgaagtgcagcaaggaggagaagctgagcctgatgcagagcctggatgatgccaccaagcagctggacttcaccaggaagaccctggccgagaagaagcaggagctggacaagctgagaaatgagtgggccagccacacagctgccctgaccaacaagcacagccaggagctgaccaatgagaaggagaaggccctgcaggcccaggtgcagtaccagcagcagcacgagcagcagaagaaggacctggagatcctgcaccagcagaacatccaccagctgcagaaccggctgtctgagctggaggccgccaacaaggacctgacagagaggaagtacaagggggacagcaccatccgggagctgaaggccaagctgtctggagtggaggaggagctgcagaggaccaagcaggaggtgctgagcctgcggcgggagaacagcaccctggatgtggagtgccacgagaaggagaagcacgtgaaccagctgcagaccaaggtggccgtgctggagcaggagatcaaggacaaggaccagctggtgctgcggaccaaggaggcctttgacaccatccaggagcagaaggtggtgctggaggagaatggagagaagaaccaggtgcagctgggcaagctggaggccaccatcaagagcctgtctgctgagctgctgaaggccaatgagatcatcaagaagctgcagggcgacctgaagaccctgatgggcaagctgaagctgaagaacacagtgaccatccagcaggagaagctgctggccgagaaggaggagaagctgcagaaggagcagaaggagctgcaggatgtgggccagagcctgcgcatcaaggagcaggaggtgtgcaagctgcaggagcagctggaggccaccgtgaagaagctggaggagagcaagcagctgctgaagaacaatgagaagctgatcacctggctgaacaaggagctgaatgaaaaccagctggtgaggaagcaggatgtgctgggccccagcaccaccccaccagcccacagcagcagcaacaccatccgcagcggcatcagccccaacctgaatgtggtggatggccgcctgacctaccccacctgtggcatcggctaccctgtgtcctctgcctttgccttccagaacaccttcccccacagcatcagcgccaagaacaccagccaccctggcagcggcaccaaggtgcagttcaacctgcagttcaccaagcccaatgccagcctgggagatgtgcagagcggggccaccatctccatgccctgcagcacagacaaggaaaatggagaaaatgtgggcctggagagcaagtacctgaagaagcgggaggacagcatccccctgcggggcctgagccagaacctcttcagcaacagcgaccaccagagagatggcaccctgggcgccctgcacaccagcagcaagcccacagccctgcccagcgccagcagcgcctacttccctggccagctgcccaacagctag

SEQ ID NO: 18655 - DNA, 237 bp, Artificial Sequence
  Description of Artificial Sequence: Synthetic coding sequence
atgaggttcatgatgatgagagctgagaacttcttcatcctgcggaggaagcctgtggagggctatgacatctccttcctgatcaccaacttccacacagagcagatgtacaagcacaagctggtggactttgtgatccacttcatggaggagattgacaaggagatcagcgagatgaagctgtctgtgaatgcccgggccagaattgtggccgaggagttcctgaagaacttctag

SEQ ID NO: 18656 - DNA, 933 bp, Artificial Sequence
  Description of Artificial Sequence: Synthetic coding sequence
atgcccctgctggtggagggccggcgggtgcggctgccccagagcgctggggacctggtgcgggcccacccccccctggaggagcgggcccggctgctgcggggccagagcgtgcagcaggtgggcccccagggcctgctgtatgtgcagcagcgggagctggccgtgaccagccccaaggatggcagcatcagcatcctgggcagtgatgatgccaccacctgccacatcgtggtgctgcggcacactggaaatggagccacctgcctgacccactgtgatggaacagacaccaaggccgaggtgcccctcatcatgaacagcatcaagagcttcagtgaccacgcccagtgtggccgcctggaggtgcacctggtgggcggcttcagtgatgaccggcagctgagccagaagctgacccaccagctgctgtctgaatttgaccggcaggaggatgacatccacctggtgaccctgtgtgtgacagagctgaatgaccgggaggagaatgaaaaccacttccctgtgatctacggcattgctgtgaacatcaagacagctgagatctaccgggccagcttccaggaccggggccctgaggagcagctgcgggccgcccggaccctggccggcggccccatgatcagcatctatgatgctgagacagagcagctgagaattggcccctacagctggacccccttcccccacgtggacttctggctgcaccaggatgacaagcagatcctggagaacctgagcaccagccccctggccgagcccccccactttgtggagcacatccgcagcaccctgatgttcctgaagaagcaccccagccctgcccacaccctcttcagcggcaacaaggccctgctgtacaagaagaatgaagatggcctgtgggagaagatcagcagccctggcagctag

SEQ ID NO: 18657 - DNA, 924 bp, Artificial Sequence
  Description of Artificial Sequence: Synthetic coding sequence
atgacagagaccaccaagacccacgtgatcctgctggcctgtggcagcttcaaccccatcaccaagggccacatccagatgtttgagcgggcccgggactacctgcacaagacaggccgcttcatcgtcatcggcggcatcgtgtcccctgtgcatgacagctatggcaagcagggcctggtgagcagccgccacaggctcatcatgtgccagctggccgtgcagaacagcgactggatccgggtggacccctgggagtgctaccaggacacctggcagaccacctgcagcgtgctggagcaccaccgggacctgatgaagagggtgacaggctgcatcctgagcaatgtgaacacccccagcatgacccctgtgattggccagccccagaatgagaccccccagcccatctaccagaacagcaatgtggccaccaagcccacagctgccaagatcctgggcaaggtgggggagagcctgagccgcatctgctgcgtgcggccccctgtggagcgcttcacctttgtggatgaaaatgccaacctgggcaccgtgatgagatatgaggagattgagctgcgcatcctgctgctgtgtggcagtgacctgctggagagcttctgcatccctggcctgtggaatgaggccgacatggaggtgattgtgggggactttggaattgtggtggtgcccagagatgctgctgacacagaccgcatcatgaaccacagcagcatcctgaggaagtacaagaacaacatcatggtggtgaaggatgacatcaaccaccccatgtctgtggtgagcagcaccaagagccggctggccctgcagcacggagatggccacgtggtggactacctgagccagcctgtgattgactacatcctgaagagccagctgtacatcaatgccagcggctag

SEQ ID NO: 18658 - DNA, 1476 bp, Artificial Sequence
  Description of Artificial Sequence: Synthetic coding sequence
atggaggagggcaagatggatgaaaatgagtggggctaccacggggagggcaacaagagcctggtggtggcccacgcccagagatgtgtggtgctgcgcttcctgaagttcccccccaacaggaagaagaccagcgaggagatcttccagcacctgcagaacatcgtggactttgggaagaatgtgatgaaggagttcctgggagaaaattatgtgcactacggggaggtggtgcagctgcccctggagtttgtgaagcagctgtgcctgaagatccagagcgagaggcctgagagccgctgtgacaaggacctggacaccctgagcggctacgccatgtgcctgcccaacctgacccggctgcagacctacagatttgctgagcaccggcccatcctgtgtgtggagatcaagcccaagtgtggcttcatccccttcagcagtgatgtgacccatgagatgaagcacaaggtgtgccgctactgcatgcaccagcacctgaaggtggccaccgggaagtggaagcagatcagcaagtactgccccctggacctgtacagcggcaacaagcagaggatgcactttgccctgaagagcctgctgcaggaggcccagaacaacctgaagatcttcaagaatggagagctgatctacggctgcaaggatgcccggagccctgtggccgactggagcgagctggcccaccacctgaagcccttcttcttccccagcaatggcctggccagcggcccccactgcacccgggccgtcatccgggagctggtgcacgtgatcaccagggtgctgctgagcggcagtgacaagggccgggccggcaccctgagccctggcctgggcccccagggcccccgggtgtgtgaggccagccccttcagccgcagcctgcgctgccagggcaagaacaccccagagaggagcggcctgcccaagggctgcctgctgtacaagaccctgcaggtgcagatgctggacctgctggacatcgagggcctgtaccccctgtacaacagagtggagcgctacctggaggagttccctgaggagaggaagaccctgcagattgatggcccctatgatgaggccttctaccagaagctgctggacctgagcacagaagatgatggcaccgtggcctttgccctgaccaaggtgcagcagtacagagtggccatgacagccaaggactgcagcatcatgattgccctgagcccctgcctgcaggatgccagcagtgaccagaggcctgtggtgcccagcagccgcagcagatttgccttctctgtgtctgtgctggacctggacctgaagccctatgagagcatcccccaccagtacaagctggatggcaagatcgtgaactactacagcaagacagtgcgggccaaggacaatgctgtgatgagcacccgcttcaaggagagcgaggactgcaccctggtgctgcacaaggtgtag

SEQ ID NO: 18659 - DNA, 2640 bp, Artificial Sequence
  Description of Artificial Sequence: Synthetic coding sequence
atgatgttctaccgcctgctgagcatcgtgggccggcagagggccagccctggctggcagaactggagcagcgccaggaacagcaccagcgctgctgaggcccgctccatggccctgcccacccaggcccaggtggtgatctgtggcggcggcatcaccggcacctctgtggcctaccacctgagcaagatgggctggaaggacatcgtgctgctggagcagggccgcctggccgccggcagcacccgcttctgtgccggcatcctgagcacagcccggcacctgaccatcgagcagaagatggctgactacagcaacaagctgtactaccagctggagcaggagaccggcatccagacaggctacaccaggacaggcagcatcttcctggcccagacccaggacaggctcatcagcctgaagaggatcaatgccggcctgaatgtcatcggcatccccagcgagatcatcagccccaagaaggtggccgagctgcaccacctgctgaatgtgcatgacctggtgggcgccatgcacgtgcctgaagatgctgtggtgagcagcgcagatgtggccctggccctggccagcgctgccagccagaatggagtgcagatctatgacaggacctctgtgctgcacgtgatggtgaagaagggccaggtgactggagtggagacagacaagggccagatcgagtgccagtactttgtgaactgtgccggccagtgggcctatgagctgggcctgagcaatgaggagcctgtgtccatccccctgcacgcctgtgagcacttctacctgctgacccggcccctggagacccccctgcagagcagcacccccaccatcgtggatgctgatggccgcatctacatccggaactggcagggcggcatcctgagcggcggctttgagaagaaccccaagcccatcttcacagagggcaagaaccagctggagatccagaacctgcaggaggactgggaccactttgagcccctgctgagcagcctgctgcggaggatgcctgagctggagaccctggagatcatgaagctggtgaactgcccagagaccttcaccccagacatgcgctgcatcatgggagagagccctgctgtgcagggctactttgtgctggccggcatgaacagcgctggcctgagctttggaggaggagctgggaagtacctggccgagtggatggtgcacggctaccccagtgaaaatgtgtgggagctggacctgaagagatttggagccctgcagagcagcaggaccttcctgcggcaccgggtgatggaggtgatgcccctgatgtatgacctgaaggtgccccgctgggacttccagacaggccggcagctgcggaccagccccctgtatgaccggctggatgcccagggcgcccgctggatggagaagcacggctttgagcggcccaagtactttgtgcccccagacaaggacctgctggccctggagcagagcaagaccttctacaagccagactggtttgatattgtggagagcgaggtgaagtgctgcaaggaggccgtgtgtgtgattgacatgagcagcttcaccaagtttgagatcaccagcactggagaccaggccctggaggtgctgcagtacctgttcagcaatgacctggatgtgcctgtgggccacatcgtgcacacaggcatgctgaatgaaggaggcggctatgaaaatgactgcagcatcgcccggctgaacaagaggagcttcttcatgatcagccccacagaccagcaggtgcactgctgggcctggctgaagaagcacatgcccaaggacagcaacctgctgctggaggatgtgacctggaagtacacagccctgaacctgattggccccagggctgtggatgtgctgtctgagctgtcctatgcccccatgaccccagaccacttccccagcctcttctgcaaggagatgtctgtgggctacgccaacggcatccgggtgatgtccatgacccacactggagagcccggcttcatgctgtacatccccattgaatatgccctgcacgtgtacaatgaggtgatgtctgtgggccagaagtatggcatcagaaatgccggctactatgccctgcggagcctgagaattgagaagttctttgccttctggggccaggacatcaacaacctgaccacccccctggagtgtggccgggagagccgggtgaagctggagaagggcatggacttcatcggcagagatgccctgctgcagcagaagcagaatggagtgtacaagaggctgaccatgttcatcctggatgaccatgacagcgacctggacctgtggccctggtggggcgagcccatctacagaaatggccagtatgtgggcaagaccaccagcagcgcctacagctacagcctggagagacatgtgtgcctgggctttgtgcacaacttcagcgaggacaccggggaggagcaggtggtgacagctgacttcatcaacagaggagaatatgaaattgatattgctggctaccgcttccaggccaaggccaagctgtaccctgtggccagcctcttcacccagaagaggaggaaggatgacatggagctgagtgacctgcacggcaagtag

SEQ ID NO: 18660 - DNA, 1440 bp, Artificial Sequence
  Description of Artificial Sequence: Synthetic coding sequence
atggccacagacagctgggccctggccgtggatgagcaggaggccgctgctgagagcctgagcaacctgcacctgaaggaggagaagatcaagccagacaccaatggagctgtggtgaagaccaatgccaatgctgagaagacagatgaggaggagaaggaggacagagctgcccagagcctgctgaacaagctgatccgcagcaacctggtggacaacaccaaccaggtggaggtgctgcagagggaccccaacagccccctgtacagcgtgaagagctttgaggagctgcggctgaagccccagctgctgcagggcgtgtatgccatgggcttcaaccggcccagcaagatccaggagaatgccctgcccctgatgctggccgagcccccccagaacctgattgcccagagccagagcggcaccgggaagacagctgcctttgtgctggccatgctgagccaggtggagcccgccaacaagtacccccagtgcctgtgcctgagccccacctatgagctggccctgcagacaggcaaggtgattgagcagatgggcaagttctacccagagctgaagctggcctatgctgtgcggggcaacaagctggagcggggccagaagatcagcgagcagatcgtgattggcaccccaggcaccgtgctggactggtgcagcaagctgaagttcatcgaccccaagaagatcaaggtgtttgtgctggatgaagcagatgtgatgattgccacccagggccaccaggaccagagcatccgcatccagaggatgctgcccaggaactgccagatgctgctcttcagcgccacctttgaggacagcgtgtggaagtttgcccagaaggtggtgcctgaccccaacgtcatcaagctgaagcgggaggaggagaccctggacaccatcaagcagtactacgtgctgtgcagcagcagagatgagaagttccaggccctgtgcaacctgtatggagccatcaccatcgcccaggccatgatcttctgccacaccaggaagacagcctcctggctggccgctgagctgagcaaggagggccaccaggtggccctgctgagcggggagatgatggtggagcagagagctgctgtgattgagcgcttccgggagggcaaggagaaggtgctggtgaccaccaacgtgtgtgcccggggcattgatgtggagcaggtgtctgtggtgatcaactttgacctgcctgtggacaaggatggcaacccagacaatgagacctacctgcacagaattggaagaacaggccgctttgggaagaggggcctggccgtgaacatggtggacagcaagcacagcatgaacatcctgaaccgcatccaggagcacttcaacaagaagattgagcggctggacacagatgacctggatgaaattgagaagatcgccaactag

SEQ ID NO: 18661 - DNA, 3255 bp, Artificial Sequence
  Description of Artificial Sequence: Synthetic coding sequence
atggagcagcccaagggcgtggactggacagtcatcatcctgacctgccagtacaaggacagcgtgcaggtgttccagcgggagctggaggtgcggcagaagcgggagcagatcccagctggcaccctgctgctggccgtggaggaccctgagaagagggtgggcagcggcggggccaccctgaatgccctgctggtggccgctgagcacctgagcgcccgggccggcttcaccgtggtgaccagtgatgtgctgcacagcgcctggatcctgatcctgcacatgggccgggacttcccctttgatgactgtggccgggccttcacctgcctgcctgtggagaaccctgaggcccctgtggaggccctggtgtgcaacctggactgcctgctggacatcatgacctaccgcctgggccctggcagccccccaggagtgtgggtgtgcagcacagacatgctgctgtctgtgcctgccaaccctggcatctcctgggacagcttccggggggcccgggtcatcgccctgcccggcagccctgcctatgcccagaaccacggcgtgtacctgacagacccccagggcctggtgctggacatctactaccagggcacagaagctgagatccagagatgtgtgcggccagatggccgggtgcccctggtgtctggagtggtgttcttctctgtggagacagctgagcggctgctggccacccacgtgtccccacccctggatgcctgcacctacctgggcctggacagcggggcccggcctgtgcagctgagcctcttctttgacatcctgcactgcatggccgagaatgtgacccgggaggacttcctggtgggccggcccccagagctgggccagggagatgctgatgtggccggctacctgcagagcgcccgggcccagctgtggagggagctgcgggaccagcccctgaccatggcctacgtgagcagcggcagctacagctacatgaccagcagcgccagcgagttcctgctgagcctgaccctgcccggggcccctggggcccagatcgtgcacagccaggtggaggagcagcagctgctggccgccggcagctctgtggtgtcctgcctgctggagggccctgtgcagctgggccctggctctgtgctgcagcactgccacctgcagggccccatccacatcggggccggctgcctggtgacaggcctggacacagcccacagcaaggccctgcacggccgggagctgcgggacctggtgctgcagggccaccacacccggctgcacggcagccctggccacgccttcaccctggtgggccgcctggacagctgggagcggcagggcgccggcacctacctgaatgtgccctggagcgagttcttcaagaggactggagtgcgggcctgggacctgtgggaccctgagaccctgcctgctgagtactgcctgcccagcgcccggctcttccctgtgctgcaccccagccgggagctgggcccccaggacctgctgtggatgctggaccaccaggaggatggaggagaggccctgcgggcctggagggcctcctggaggctgtcctgggagcagctgcagccctgcctggaccgggccgccaccctggccagccggcgggacctcttcttccggcaggccctgcacaaggcccggcacgtgctggaggcccggcaggacctgagcctgcggcccctcatctgggccgctgtgcgggagggctgccccggccccctgctggccaccctggaccaggtggccgccggggccggggaccccggggtggccgcccgggccctggcctgtgtggctgatgtgctgggctgcatggccgagggccggggcggcctgcggagcggccctgctgccaaccctgagtggatgaggcccttctcctacctggagtgtggggacctggccgccggcgtggaggccctggcccaggagcgggacaagtggctgagcaggcctgccctgctggtgcgggccgcccggcactatgagggcgccggccagatcctgatccggcaggccgtgatgtctgcccagcactttgtgtccacagagcaggtggagctgcccggccctggccagtgggtggtggccgagtgcccagcccgggtggacttcagcggcggctggagcgacaccccacccctggcctatgagctgggcggcgctgtgctgggcctggccgtgcgggtggatggaagaagacccatcggggcccgggcccggcgcatccctgagcctgagctgtggctggccgtgggcccccggcaggatgagatgacagtgaagatcgtgtgccgctgcctggccgacctgcgggactactgccagccccacgcccctggggccctgctgaaggccgccttcatctgtgccggcatcgtgcacgtgcacagcgagctgcagctgtctgagcagctgctgcggaccttcggcggcggctttgagctgcacacctggagcgagctgccccacggcagcggcctgggcaccagcagcatcctggccggcacagccctggccgccctgcagagagctgctggccgggtggtgggcacagaggccctgattcatgctgtgctgcacctggagcaggtgctgaccaccggcggcggctggcaggaccaggtgggcggcctgatgcctggcatcaaggtgggccgcagccgggcccagctgcccctgaaggtggaggtggaggaggtgacagtgcctgagggctttgtgcagaagctgaatgaccacctgctgctggtgtacaccgggaagacccggctggccaggaacctgctgcaggatgtgctgcgctcctggtacgcccggctgcctgctgtggtgcagaatgcccacagcctggtgcggcagacagaagaatgtgccgagggcttccggcagggcagcctgcccctgctgggccagtgcctgaccagctactgggagcagaagaagctgatggcccctggctgtgagcccctgactgtgcggaggatgatggatgtgctggcccctcatgtgcacggccagagcctggccggggccggcggcggcggcttcctgtacctgctgaccaaggagccccagcagaaggaggccctggaggccgtgctggccaagacagagggcctgggcaactacagcatccacctggtggaggtggacacccagggcctgagcctgaagctgctgggcacagaggccagcacctgctgccccttcccctag

SEQ ID NO: 18662 - DNA, 2139 bp, Artificial Sequence
  Description of Artificial Sequence: Synthetic coding sequence
atgcagcccggcagcgcccctcctcctggccgcatggaccccagcgccccccagcccagggctgagaccagcggcaaggacatctggcaccctggagagcgctgcctggcccccagcccagacaacgggaagctgtgtgaggccagcatcaagagcatcaccgtggatgaaaatggcaagagctttgctgtggtgctgtatgctgacttccaggagaggaagatccccctgaagcagctgcaggaggtgaagtttgtgaaggactgccccaggaacctgatctttgatgatgaggacctggagaagccctacttccccaacaggaagttccccagcagctctgtggccttcaagctgagtgacaacggggacagcatcccctacaccatcaaccgctacctgcgggactaccagcgggagggcacccgcttcctgtatggccactacatccatggaggcggctgcatcctgggagatgacatgggcctgggcaagacagtgcaggtgatctccttcctggccgctgtgctgcacaagaagggcacccgggaggacatcgagaacaacatgcctgagttcctgctgcgctccatgaagaaggagcccctgagcagcacagccaagaagatgttcctgattgtggcccccctgtctgtgctgtacaactggaaggatgagctggacacctggggctacttccgggtgacagtgctgcacggcaacaggaaggacaatgaactcatccgggtgaagcagaggaaatgtgaaattgccctgaccacctatgagaccctgcggctgtgcctggatgagctgaacagcctggagtggagcgctgtgattgtggatgaggcccaccgcatcaagaaccccaaggcccgggtgacagaggtgatgaaggccctgaagtgcaatgtgcgcatcggcctgaccggcaccatcctgcagaacaacatgaaggagctgtggtgtgtgatggactgggccgtgcccggcctgctgggcagcggcacctacttcaagaagcagttcagtgaccctgtggagcacggccagaggcacacagccaccaagcgggagctggccactggaaggaaggccatgcagaggctggccaagaagatgagcggctggttcctgcggaggaccaagaccctcatcaaggaccagctgcccaagaaggaggacaggatggtgtactgcagcctgacagacttccagaaggctgtgtaccagacagtgctggagacagaagatgtgaccctcatcctgcagagcagcgagccctgcacctgccgcagcggccagaagagaagaaactgctgctacaagaccaacagccacggggagaccgtgaagaccctgtacctgagctacctgactgtgctgcagaaggtggccaaccacgtggccctgctgcaggccgccagcaccagcaagcagcaggagaccctcatcaagaggatctgtgaccaggtgttcagccgcttcccagactttgtgcagaagagcaaggatgctgcctttgagaccctgagtgaccccaagtacagcggcaagatgaaggtgctgcagcagctgctgaaccactgcaggaagaacagagacaaggtgctgctcttctccttcagcaccaagctgctggatgtgctgcagcagtactgcatggccagcggcctggactacagaaggctggatggcagcaccaagtctgaggagcggctgaagatcgtgaaggagttcaacagcacccaggatgtgaacatctgcctggtgtccaccatggccggcggcctgggcctgaactttgtgggcgccaacgtggtggtgctgtttgaccccacctggaacccagccaatgacctgcaggccatcgaccgggcctacagaattggccagtgcagagatgtgaaggtgctgcggctcatcagcctgggcaccgtggaggagatcatgtacctgcggcagatctacaagcagcagctgcactgtgtggtggtgggctctgaaaatgccaagcgctactttgaggccgtgcagggcagcaaggagcaccagggcgagctgtttggcatccacaacctcttcaagttccgcagccagggcagctgcctgaccaaggacatcctggaggtgtag

SEQ ID NO: 18663 - DNA, 1212 bp, Artificial Sequence
  Description of Artificial Sequence: Synthetic coding sequence
atgaagcagaggaagggccagggcagcggcggcagccggggcaggaagaagaggggcctgagtgacatcagccccagcaccagcctgccccccctggtggagggccagctgcgctgcttcctgaagctgactgtgaacagagtcatctggaagatcgccaagccacccacctgtgtgctggtgcgggtgcgctggtggggcgagaccagtgatggcaccctcttctgccccagagatgccctgcagacagagcccaaggctgtgaggaccaccaccaggtatgccatccgctgtggccccaagcagttcaccagctacctgacagacatggctgtgctggtgctggaggtgatcaccaagctggatggcctgcccatcggccgggtgcagatcaatggcctggcccagctgagccccacccaccagatcaatggcttcttcaccatcgtgagcagcaccagcaagaagctgggggagctgcaggtgtccctggccctggagcccctgtctgagacctatgacagctaccaccccctgcccaccacagacatgacagaaaatgtgctgctgagcaagcagggcttcagagaaaatacagagcccagcagcacccagttccaggtgcccagccggccccgggacatccacaccatcaagattgatggcaaggagctggccgccaacagcagccgcagcaccaccccccggggcaaggaccacgtgtgctttgctgaaaatccagacaccatcaaggacagcagctttggcctgcagcacagcctgaacagcggccagagcctggagagcgtgaccctgaagggccgggcccccaggaagcagatgagcctgctgaacagcagcgagttccagccccagatcagaacagtggccaagagccacagcgacagctgcatcctgagcagcaacaacctgcccaccaaggacctgctgagcgccctgctggagcagggcaacaagctgagaaatgccatggtgatcagcgccatgaagagcagccctgagacctccatgctgctggaccaggtgcaccccctgctgatgaagatcctgctggagcaccagcacaggtctgagcccttcctgggcatcggcctgaagaccaccctgaagatcaccagcagcctgcagctgcgcatccactttggagacatgacccagaagctgatccctgagctgtacagctgctactag

SEQ ID NO: 18664 - DNA, 3663 bp, Artificial Sequence
  Description of Artificial Sequence: Synthetic coding sequence
atgggcaagaagcagaagaacaagtctgaggacagcaccaaggatgacatcgacctggatgccctggccgctgagattgagggcgctggggccgccaaggagcaggagccccagaagagcaagggcaagaagaagaaggagaagaagaagcaggactttgatgaagatgacatcctgaaggagctggaggagctgagcctggaggcccagggcatcaaggctgaccgggagaccgtggccgtgaagcccacagaaaataatgaggaggagttcaccagcaaggacaagaagaagaagggccagaagggcaagaagcagagctttgatgacaatgattctgaggagctggaggacaaggacagcaagagcaagaagacagccaagcccaaggtggagatgtacagcggcagtgatgatgatgatgacttcaacaagctgcccaagaaggccaagggcaaggcccagaagagcaacaagaagtgggatggcagcgaggaggatgaggacaacagcaagaagatcaaggagaggagccgcatcaacagcagtggagagagcggagatgaaagtgatgagttcctgcagagcaggaagggccagaagaagaaccagaagaacaagccaggccccaacatcgagagcggaaatgaagatgatgatgccagcttcaagatcaagacagtggcccagaagaaggccgagaagaaggagcgggagaggaagaagagagatgaggagaaggccaagctgaggaagctgaaggagaaggaggagctggagaccgggaagaaggaccagagcaagcagaaggagagccagaggaagtttgaggaggagaccgtgaagagcaaggtgacagtggacacaggagtcatcccagccagcgaggagaaggccgagacccccacagctgctgaagatgacaatgaaggagacaagaagaagaaggacaagaagaagaagaagggggagaaggaggagaaggagaaggagaagaagaagggccccagcaaggccaccgtgaaggccatgcaggaggccctggccaagctgaaggaggaggaggagcggcagaagcgggaggaggaggagcgcatcaagaggctggaggagctggaggccaagaggaaggaggaggagcggctggagcaggagaagcgggagaggaagaagcagaaggagaaggagaggaaggagcggctgaagaaggagggcaagctgctgaccaagagccagcgggaggcccgggcccgggcagaggccaccctgaagctgctgcaggcccagggcgtggaggtgcccagcaaggacagcctgcccaagaagaggcccatctatgaggacaagaagaggaagaagatcccccagcagctggagagcaaggaggtgtctgagagcatggagctgtgtgccgctgtggaggtgatggagcagggcgtgcctgagaaggaggagaccccacctcctgtggagcctgaggaggaggaggacacagaagatgctggcctggatgactgggaggccatggccagtgatgaggagacagagaaggtggagggcaacaaggtgcacatcgaggtgaaggaaaatcctgaggaggaggaggaggaggaggaggaggaggaggaggatgaggagagcgaggaggaggaggaggaggagggggagagcgagggctctgaaggagatgaagaagatgagaaggtgtctgatgagaaggacagcggcaagaccctggacaagaagcccagcaaggagatgagcagtgacagtgaatatgacagtgatgatgacaggaccaaggaggagcgggcctatgacaaggccaagagaagaattgagaagaggcggctggagcacagcaagaatgtgaacacagagaagctgcgggcccccatcatctgtgtgctgggccacgtggacaccgggaagaccaagatcctggacaagctgcggcacacccacgtgcaggatggagaggccggcggcatcacccagcagatcggggccaccaacgtgcccctggaggccatcaatgagcagaccaagatgatcaagaactttgacagagaaaatgtgcgcatccctggcatgctgatcatcgacaccccaggccacgagagcttcagcaacctgaggaacagaggcagcagcctgtgtgacatcgccatcctggtggtggacatcatgcacggcctggagccccagaccatcgagagcatcaacctgctgaagagcaagaagtgccccttcatcgtggccctgaacaagattgaccggctgtatgactggaagaagagcccagacagtgatgtggccgccaccctgaagaagcagaagaagaacaccaaggatgaatttgaggagcgggccaaggccatcatcgtggagtttgcccagcagggcctgaatgctgccctcttctatgagaacaaggaccccaggacctttgtgtccctggtgcccaccagcgcccacactggagatggcatgggcagcctcatctacctgctggtggagctgacccagaccatgctgagcaagaggctggcccactgtgaggagctgcgggcccaggtgatggaggtgaaggccctgcccggcatgggcaccaccattgatgtgatcctgatcaatggccgcctgaaggagggggacaccatcatcgtgcctggggtggagggccccatcgtgacccagatccggggcctgctgctgcccccacccatgaaggagctgcgggtgaagaaccagtatgagaagcacaaggaggtggaggccgcccagggcgtgaagatcctgggcaaggacctggagaagaccctggccggcctgcccctgctggtggcctacaaggaggatgagatccctgtgctgaaggatgagctgattcatgagctgaagcagaccctgaatgccatcaagctggaggagaagggcgtgtatgtgcaggccagcaccctgggcagcctggaggccctgctggagttcctgaagaccagcgaggtgccctatgccggcatcaacatcggccctgtgcacaagaaggatgtgatgaaggcctctgtgatgctggagcatgacccccagtatgctgtgatcctggcctttgatgtgagaattgaaagagatgcccaggagatggctgacagcctgggcgtgcgcatcttctctgctgagatcatctaccacctgtttgatgccttcaccaagtaccggcaggactacaagaagcagaagcaggaggagttcaagcacatcgctgtgttcccctgcaagatcaagatcctgccccagtacatcttcaacagccgggaccccatcgtgatgggcgtgacagtggaggccggccaggtgaagcagggcacccccatgtgtgtgcccagcaagaactttgtggacattggaattgtgaccagcattgagatcaaccacaagcaggtggatgtggccaagaagggccaggaggtgtgtgtgaagattgagcccatccctggagagagccccaagatgtttggccgccactttgaggccacagacatcctggtgtccaagatcagccggcagagcattgatgccctgaaggactggttcagagatgagatgcagaagagtgactggcagctgattgtggagctgaagaaggtgtttgagatcatctag

SEQ ID NO: 18665 - DNA, 138 bp, Artificial Sequence
  Description of Artificial Sequence: Synthetic coding sequence
atgtctgacaagccagacctgtctgaggtggagaagtttgacaggagcaagctgaagaagaccaacacagaggagaagaacaccctgcccagcaaggagaccatccagcaggagaaggaatgtgtgcagaccagctag

SEQ ID NO: 18666 - DNA, 1533 bp, Artificial Sequence
  Description of Artificial Sequence: Synthetic coding sequence
atgcctgggggcggggccagcgctgccagcggccgcctgctgacagctgctgagcagaggggcagccgggaggccgccggcagcgccagccgcagcggctttggaggcagcggcggcggccggggcggggccagcggccctggcagcggcagcggcggccctgggggccctgctggccgcatgagcctgacccccaaggagctgagcagcctgctgagcatcatcagcgaggaggccggcggcggcagcacctttgagggcctgagcacagccttccaccactacttcagcaaggctgaccacttccggctgggctctgtgctggtgatgctgctgcagcagcctgacctgctgcccagcgctgcccagaggctgacagccctgtacctgctgtgggagatgtacagaacagagcccctggccgccaacccctttgctgccagctttgcccacctgctgaacccagcccccccagcccggggcggccaggagccagaccggccccccctgagcggcttcctgccccccatcaccccacctgagaagttcttcctgagccagctgatgctggccccaccccgggagctgttcaagaagaccccccggcagatcgccctgatggatgtgggcaacatgggccagagcgtggacatcagcggcctgcagctggccctggccgagcggcagagcgagctgcccacccagagcaaggccagcttccccagcatcctgagtgaccctgaccctgacagcagcaacagcggctttgacagctctgtggccagccagatcacagaggccctggtgtctggccccaagccacccatcgagagccacttccggcctgagttcatccggcccccaccacccctgcacatctgtgaagatgagctggcctggctgaaccccacagagccagaccacgccatccagtgggacaagtccatgtgtgtgaagaacagcactggagtggagatcaagaggatcatggccaaggccttcaagagccccctgagcagcccccagcagacccagctgctgggggagctggagaaggaccccaagctggtgtaccacatcggcctgaccccagccaagctgcctgacctggtggagaacaaccccctggtggccatcgagatgctgctgaagctgatgcagagcagccagatcacagagtacttctctgtgctggtgaacatggacatgagcctgcacagcatggaggtggtgaaccggctgaccacagctgtggacctgcccccagagttcatccacctgtacatcagcaactgcatcagcacctgtgagcagatcaaggacaagtacatgcagaaccggctggtgcggctggtgtgtgtgttcctgcagagcctcatccggaacaagatcatcaacgtgcaggacctcttcatcgaggtgcaggccttctgcatcgagttcagccgcatccgggaggccgccggcctcttccggctgctgaagaccctggacacaggagagacccccagcgagaccaagatgagcaagtag

SEQ ID NO: 18667 - DNA, 2184 bp, Artificial Sequence
  Description of Artificial Sequence: Synthetic coding sequence
atgagcggcaggaagaggagcttcaccttcggggcctatggaggagtggacaagagcttcaccagcagaagatctgtgtggaggagtgatggccagaaccagcacttcccccaggccctggacctgagccgggtgaacctggtgcccagctacacccccagcctgtaccccaagaacacagacctgtttgagatgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggcaaggagcacttcaactactacagcctggatgctgccctgggccacctggtgttcagcctgaagtatgatgtgattggagaccaggagcacctgcggctgctgctgcggaccaagtgcaggacctaccatgatgtgatccccatcagctgcctgacagagttccccaacgtggtgcagatggccaagctggtgtgtgaagatgtgaatgtggaccgcttctaccctgtgctgtaccccaaggccagccggctgattgtgacctttgatgaacatgtgatcagcaacaacttcaagtttggagtcatctaccagaagctgggccagaccagcgaggaggagctgttcagcaccaatgaggagagccctgcctttgtggagttcctggagttcctgggccagaaggtgaagctgcaggacttcaagggcttccggggcggcctggatgtgacccacggccagacaggaacagagagcgtgtactgcaacttcaggaacaaggagatcatgtttcatgtgtccaccaagctgccctacacagaaggagatgcccagcagctgcagaggaagaggcacatcggaaatgacatcgtggccgtggtgttccaggatgagaacaccccatttgtgcctgacatgattgccagcaacttcctgcacgcctacgtggtggtgcaggccgagggcggcggcccagatggccccctgtacaaggtgtctgtgacagccagagatgatgtgcccttctttggaccacccctgcctgaccctgctgtgttcagaaaaggacctgagttccaggagttcctgctgaccaagctgatcaatgcagaatatgcctgctacaaggccgagaagtttgccaagctggaggagaggaccagggctgccctgctggagaccctgtatgaggagctgcacatccacagccagagcatgatgggcctgggcggagatgaggacaagatggagaatggcagcggcggcggcggcttctttgagagcttcaagagggtcatccgcagccgcagccagagcatggatgccatgggcctgagcaacaagaagcccaacacagtgtccaccagccacagcggcagctttgcccccaacaacccagacctggccaaggccgccggcatcagcctgattgtgcctgggaagagccccaccaggaagaagagcggccccttcggcagccgccgcagcagcgccatcggcatcgagaacatccaggaggtgcaggagaagcgggagagccccccagctggccagaagaccccagattctggccacgtgtcccaggagcccaagtctgagaacagcagcacccagagcagccctgagatgcccaccaccaagaacagagctgagacagctgcccagagagctgaggccctgaaggacttcagccgcagcagcagcagcgccagcagctttgcctctgtggtggaggagacagagggcgtggatggagaggacaccggcctggagagcgtgagcagcagcggcaccccccacaagagggacagcttcatctacagcacctggctggaggacagcgtgtccaccaccagcggcggcagcagccctggccccagccgcagcccccacccagatgctgggaagctgggggaccctgcctgcccagagatcaagatccagctggaggccagcgagcagcacatgccccagctgggctgctag

SEQ ID NO: 18668 - DNA, 873 bp, Artificial Sequence
  Description of Artificial Sequence: Synthetic coding sequence
atggtgctgctgcacgtgaagagaggagatgagagccagttcctgctgcaggcccctggcagcacagagctggaggagctgactgtgcaggtggcccgggtgtacaacggccgcctgaaggtgcagaggctgtgcagcgagatggaggagctggccgagcacggcatcttcctgccccccaacatgcagggcctgacagatgaccagatcgaggagctgaagctgaaggatgagtggggcgagaagtgtgtgcccagcggcggcgctgtgttcaagaaggatgacatcggcagaagaaatggccaggccccaaatgagaagatgaagcaggtgctgaagaagaccatcgaggaggccaaggccatcatcagcaagaagcaggtggaggccggcgtgtgtgtgaccatggagatggtgaaggatgccctggaccagctgcggggagctgtgatgattgtgtaccccatgggcctgcccccctatgaccccatccgcatggagtttgagaacaaggaggacctgagcggcacccaggccggcctgaatgtcatcaaggaggccgaggcccagctgtggtgggccgccaaggagctgcggaggaccaagaagctgagtgactatgtgggcaagaatgagaagaccaagatcatcgccaagatccagcagaggggccagggcgccccagcccgggagcccatcatcagcagcgaggagcagaagcagctgatgctgtactaccaccggcggcaggaggagctgaagaggctggaggagaatgatgatgatgcctacctgaacagcccctgggccgacaacacagccctgaagaggcacttccacggcgtgaaggacatcaagtggaggcccaggtag

SEQ ID NO: 18669 - DNA, 567 bp, Artificial Sequence
  Description of Artificial Sequence: Synthetic coding sequence
atggagcccccccggggccccccagccaacggggctgagcccagcagagctgtgggcaccgtgaaggtgtacctgcccaacaagcagaggacagtggtgacagtgagagatggcatgtctgtgtatgacagcctggacaaggccctgaaggtgcggggcctgaaccaggactgctgcgtggtgtaccgcctcatcaagggcaggaagacagtgacagcctgggacacagccatcgcccccctggatggagaggagctgattgtggaggtgctggaggatgtgcccctgaccatgcacaactttgtgaggaagaccttcttcagcctggccttctgtgacttctgcctgaagttcctgttccacggcttccgctgccagacctgtggctacaagttccaccagcactgcagcagcaaggtgcccaccgtgtgtgtggacatgagcaccaaccggcagcagttctaccacagcgtgcaggacctgagcggcggcagccggcagcacgaggcccccagcaaccggcccctgaatgagctgctgaccccccagggccccagctgcaggtag

SEQ ID NO: 18670 - DNA, 2034 bp, Artificial Sequence
  Description of Artificial Sequence: Synthetic coding sequence
atggatgatcctgactgtgacagcacctgggaggaggatgaagaagatgctgaagatgctgaagatgaggactgtgaagatggagaggccgccggggccagagatgctgatgctggagatgaagatgaggagagcgaggagccccgggccgcccggcccagcagcttccagagcaggatgacaggcagcaggaactggagggccacccgggacatgtgccgctaccgccacaactacccagacctggtggagcgggactgcaatggagacacccccaacctgtccttctacagaaatgagatccgcttcctgcccaacggctgcttcatcgaggacatcctgcagaactggacagacaactatgacctgctggaggacaaccacagctacatccagtggctgttccccctgcgggagcccggggtgaactggcacgccaagcccctgaccctgcgggaggtggaggtgttcaagagcagccaggagatccaggagcggctggtgcgggcctatgagctgatgctgggcttctacggcatccggctggaggaccggggcactggaacagtgggccgggcccagaactaccagaagcgcttccagaacctgaactggaggagccacaacaacctgcgcatcacccgcatcctgaagagcctgggggagctgggcctggagcacttccaggcccccctggtgcgcttcttcctggaggagaccctggtgagaagagagctgcccggggtgcggcagagcgccctggactacttcatgtttgctgtgcgctgccgccaccagaggcggcagctggtgcactttgcctgggagcacttccggccccgctgcaagtttgtgtggggcccccaggacaagctgcggcgcttcaagcccagcagcctgccccaccccctggagggcagcaggaaggtggaggaggagggcagccctggggaccctgaccacgaggccagcacccagggccgcacctgtggccctgagcacagcaagggcggcggccgggtggatgagggcccccagcccaggtctgtggagccccaggatgctggccccctggagaggagccagggagatgaggccggcggccatggagaagatagacctgagcccctgagccccaaggagagcaagaagaggaagctggagctgagcagaagagagcagcccccaacagagcccggcccccagagcgccagcgaggtggagaagatcgccctgaacctggagggctgtgccctgagccagggcagcctgaggacaggcacccaggaggtgggcggccaggaccccggggaggccgtgcagccctgccggcagcccctgggcgcccgggtggccgacaaggtgaggaagaggaggaaggtggatgagggcgctggggacagcgctgctgtggccagcggcggggcccagaccctggccctggccggcagccctgcccccagcggccaccccaaggccggccacagtgaaaatggagtggaggaggacacagagggccgcacaggccccaaggagggcaccccaggcagccccagcgagaccccaggccccagccctgctggccctgctggagatgagcctgctgagagccccagcgagaccccaggccccaggcctgctggccctgctggagatgagcctgctgagagccccagcgagaccccaggccccaggcctgctggccctgctggagatgagcctgctgagagccccagcgagaccccaggccccagccctgctggccccaccagagatgagcctgctgagagccccagcgagaccccaggccccaggcctgctggccctgctggagatgagcctgctgagagccccagcgagaccccaggccccaggcctgctggccctgctggagatgagcctgctgagagccccagcgagaccccaggccccagccctgctggccccaccagagatgagcccgccaaggccggggaggccgctgagctgcaggatgctgaggtggagagcagcgccaagagcggcaagccctag

SEQ ID NO: 18671 - DNA, 735 bp, Artificial Sequence
  Description of Artificial Sequence: Synthetic coding sequence
atgggcctggagctgttcctggacctggtgtcccagcccagcagagctgtgtacatctttgccaagaagaatggcatccccctggagctgaggacagtggacctggtgaagggccagcacaagagcaaggagttcctgcagatcaacagcctgggcaagctgcccaccctgaaggatggagacttcatcctgacagagagcagcgccatcctgatctacctgagctgcaagtaccagaccccagaccactggtaccccagcgacctgcaggcccgggcccgggtgcatgagtacctgggctggcatgctgactgcatccggggcaccttcggcatccccctgtgggtgcaggtgctgggccccctgattggagtgcaggtgcctgaggagaaggtggagaggaacagaacagccatggaccaggccctgcagtggctggaggacaagttcctgggggaccggcccttcctggccggccagcaggtgaccctggccgacctgatggccctggaggagctgatgcagcctgtggccctgggctatgagctgtttgagggccggccccggctggccgcctggaggggccgggtggaggccttcctgggcgctgagctgtgccaggaggcccacagcatcatcctgagcatcctggagcaggccgccaagaagaccctgcccacccccagccctgaggcctaccaggccatgctgctgcgcatcgcccgcatcccctag

SEQ ID NO: 18672 - DNA, 531 bp, Artificial Sequence
  Description of Artificial Sequence: Synthetic coding sequence
atggccgccagcacagacatggccggcctggaggagagcttcaggaagtttgccatccacggggaccccaaggccagcggccaggagatgaatggcaagaactgggccaagctgtgcaaggactgcaaggtggctgatggcaagtctgtgactggaacagatgtggacatcgtgttcagcaaggtgaagggcaagagcgcccgggtcatcaactatgaggagttcaagaaggccctggaggagctggccaccaagcgcttcaagggcaagagcaaggaggaggcctttgatgccatctgccagctggtggccggcaaggagcccgccaacgtgggcgtgaccaaggccaagacaggaggagctgtggaccggctgacagacaccagccgctacacaggcagccacaaggagagatttgatgagagcggcaagggcaagggcattgctggccggcaggacatcctggatgacagcggctacgtgtctgcctacaagaatgccggcacctatgatgccaaggtgaagaagtag

SEQ ID NO: 18673 - DNA, 930 bp, Artificial Sequence
  Description of Artificial Sequence: Synthetic coding sequence
atgtctgacctgggcagcgaggagctggaggaggagggggagaatgacattggagaatatgagggcggcagaaatgaagctggggagagacatggccggggccgggcccggctgcccaacggggacacctatgagggcagctatgaatttgggaagagacatggccagggcatctacaagttcaagaatggagcccgctacatcggggagtatgtgaggaacaagaagcacggccagggcaccttcatctacccagatggcagccgctatgaaggagagtgggccaatgacctgcggcacggccacggcgtgtactactacatcaacaatgacacctacaccggggagtggtttgcccaccagagacatggccagggcacctacctgtatgcagagaccggcagcaaatatgtgggcacctgggtgaatggccagcaggagggcacagctgagctgatccacctgaaccaccgctaccagggcaagttcctgaacaagaaccctgtgggccctgggaagtatgtgtttgatgtgggctgtgagcagcacggggagtaccgcctgacagacatggagcggggggaggaggaggaggaggaggagctggtgacagtggtgcccaagtggaaggccacccagatcacagagctggccctgtggacccccaccctgcccaagaagcccaccagcacagatggccctggccaggatgcccctggagctgagagcgctggggagcctggagaggaggcccaggccctgctggagggctttgaaggagagatggacatgaggcctggagatgaagatgctgatgtgctgcgggaggagagccgggagtatgaccaggaggagttccgctatgacatggatgagggcaacatcaacagcgaggaggaggagacccggcagagcgacctgcaggactag

SEQ ID NO: 18674 - DNA, 5943 bp, Artificial Sequence
  Description of Artificial Sequence: Synthetic coding sequence
atgaaccccaccaaccccttcagcggccagcagcccagcgccttcagcgccagcagcagcaatgtgggcaccctgcccagcaagccacccttccgcttcggccagcccagcctgtttggccagaacagcaccctgagcggcaagagcagcggcttcagccaggtgtcctccttccctgccagcagcggcgtgagccacagcagctctgtgcagaccctgggcttcacccagaccagctctgtgggccccttcagcggcctggagcacaccagcacctttgtggccaccagcggccccagcagcagctctgtgctgggcaacacaggcttctccttcaagagccccacctctgtgggcgccttccccagcaccagcgccttcggccaggaggccggggagatcgtgaacagcggctttgggaagacagagttctccttcaagcccctggagaatgctgtgttcaagcccatcctgggcgctgagagcgagcctgagaagacccagagccagatcgccagcggcttcttcaccttcagccaccccatcagcagcgcccctgggggcctggcccccttctccttcccccaggtgaccagcagcagcgccaccaccagcaacttcaccttcagcaagcctgtgagcagcaacaacagcctgagcgccttcaccccagccctgagcaaccagaatgtggaggaggagaagaggggccccaagagcatcttcggcagcagcaacaacagcttcagcagcttccctgtgagcagcgctgtgctgggggagcccttccaggccagcaaggccggcgtgcggcagggctgtgaggaggccgtgtcccaggtggagcccctgcccagcctgatgaagggcctgaagaggaaagaagaccaggacaggagcccccggcggcacggccacgagcctgctgaggacagcgaccccctgagcagaggagaccaccccccagacaagaggcctgtgcggctgaaccggccccggggcggcaccctgtttggccgcaccatccaggatgtgttcaagagcaacaaggaggtgggccgcctgggcaacaaggaggccaagaaggagaccggctttgtggagagcgctgagagtgaccacatggccatccctgggggcaaccagagcgtgctggcccccagccgcatccctggggtgaacaaggaggaggagacagagagccgggagaagaaggaggacagcctgcggggcaccccagcccggcagagcaacagaagtgagagcacagacagcctgggcggcctgagccccagcgaggtgacagccatccagtgcaagaacatcccagactacctgaatgacaggaccatcctggagaaccactttgggaagatcgccaaggtgcagaggatcttcacccggcgcagcaagaagctggccgtggtgcacttctttgaccacgccagcgctgccctggccaggaagaagggcaagagcctgcacaaggacatggccatcttctggcacaggaagaagatcagccccaacaagaagcccttcagcctgaaggagaagaagccaggagatggagaggtgagccccagcacagaagatgcccccttccagcacagccccctgggcaaggccgccggccgcactggagccagcagcctgctgaacaagagcagccctgtgaagaagcccagcctgctgaaggcccaccagtttgaaggagacagctttgattctgccagcgagggcagcgagggcctgggcccctgtgtgctgagcctgagcaccctcatcggcaccgtggccgagaccagcaaggagaagtaccgcctgctggaccagagggaccgcatcatgaggcaggcccgggtgaagaggacagacctggacaaggcccggacctttgtgggcacctgcctggacatgtgcccagagaaggagcgctacatgagggagaccaggagccagctgtctgtgtttgaggtggtgcccggcacagaccaggtggaccacgccgctgctgtgaaggagtacagccgcagcagcgctgaccaggaggagcccctgccccatgagctgcggcccctgcctgtgctgagcaggaccatggactacctggtgacccagatcatggaccagaaggagggcagcctgcgggactggtatgactttgtgtggaacagaacccggggcatcaggaaggacatcacccagcagcacctgtgtgaccccctgactgtgtccctcatcgagaagtgcacccgcttccacatccactgtgcccacttcatgtgtgaggagcccatgagcagctttgatgccaagatcaacaatgaaaacatgaccaagtgcctgcagagcctgaaggagatgtaccaggacctgaggaacaagggcgtcttctgtgccagcgaggccgagttccagggctacaacgtgctgctgagcctgaacaagggggacatcctgcgggaggtgcagcagttccaccctgctgtgaggaacagcagcgaggtgaagtttgctgtgcaggcctttgctgccctgaacagcaacaactttgtgcgcttcttcaagctggtgcagagcgccagctacctgaatgcctgcctgctgcactgctacttcagccagatcaggaaggatgccctgcgggccctgaactttgcctacacagtgtccacccagaggagcaccatcttccccctggatggagtggtgaggatgctgctcttccgggactgtgaggaggccacagacttcctgacctgccacggcctgactgtgtctgatggctgtgtggagctgaacagaagtgccttcctggagcctgagggcctgagcaagaccaggaagtctgtgttcatcaccaggaagctgactgtgtctgtgggggagatcgtgaatggaggccccctgccccctgtgcccaggcacacccctgtgtgcagcttcaacagccagaacaagtacatcggggagagcctggccgctgagctgcctgtgtccacccagaggcctggcagtgacacagtgggcggcggccgcggggaggagtgtggggtggagccagatgcccccctgagcagcctgccccagagcctgcctgccccagcccccagccctgtgcccctgccccctgtgctggccctgacccccagcgtggcccccagcctcttccagctgtctgtgcagcctgagcccccacctcctgagcctgtgcccatgtacagtgatgaggacctggcccaggtggtggatgagctgatccaggaggccctgcagagggactgtgaggaggtgggcagcgctggggccgcctatgctgctgctgccctgggcgtgtccaatgctgccatggaggacctgctgacagctgccaccaccggcatcctgcggcacatcgctgctgaggaggtgtccaaggagcgggagcggcgggagcaggagcggcagagagctgaggaggagcggctgaagcaggagcgggagctggtgctgtctgagctgagccagggcctggccgtggagctgatggagcgggtgatgatggagtttgtgcgggagacctgcagccaggagctgaagaatgctgtggagacagaccagagggtgcgggtggcccgctgctgtgaagatgtgtgtgcccacctggtggacctcttcctggtggaggagatcttccagacagccaaggagaccctgcaggagctgcagtgcttctgcaagtacctgcagcgctggagggaggccgtgacagccaggaagaagctgcggcggcagatgagggccttccctgctgccccctgctgcgtggatgtgtctgaccggctgcgggccctggcccccagcgctgagtgccccatcgccgaggagaacctggcccggggcctgctggacctgggccacgccggccgcctgggcatcagctgcacccggctgcggcggctgaggaacaagacagcccaccagatgaaggtgcagcacttctaccagcagctgctgagtgatgtggcctgggccagcctggacctgcccagcctggtggccgagcacctgcccggccggcaggagcacgtgttctggaagctggtgctggtgctgcctgatgtggaggagcagagccctgagagctgtggccgcatcctggccaactggctgaaggtgaagttcatgggagatgagggctctgtggatgacaccagcagtgatgctgggggcatccagaccctgagcctcttcaacagcctgagcagcaagggggaccagatgatctctgtgaatgtgtgcatcaaggtggcccatggagccctgagtgatggagccattgatgctgtggagacccagaaggacctgctgggcgccagcggcctgatgctgctgctgccccccaagatgaagtctgaggacatggccgaggaggatgtgtactggctgagcgccctgctgcagctgaagcagctgctgcaggccaagcccttccagcctgccctgcccctggtggtgctggtgcccagccctggaggagatgctgtggagaaggaggtggaggatggcctgatgctgcaggacctggtgtctgccaagctgatcagtgactacacagtgacagagatcccagacaccatcaatgacctgcagggcagcaccaaggtgctgcaggccgtgcagtggctggtgagccactgcccccacagcctggacctgtgctgccagaccctcatccagtatgtggaggatggcatcggccacgagttcagcggccgcttcttccatgaccggcgggagcggcggctgggcggcctggccagccaggagcccggggccatcatcgagctgttcaacagcgtgctgcagttcctggcctctgtggtgtcctctgagcagctgtgtgacctgtcctggcctgtgacagaatttgctgaggccggcggcagccggctgctgccccacctgcactggaatgcccctgagcacctggcctggctgaagcaggccgtgctgggcttccagctgccccagatggacctgccccccctgggcgccccctggctgcctgtgtgcagcatggtggtgcagtatgccagccagatccccagcagccggcagacccagcctgtgctgcagagccaggtggagaacctgctgcacaggacctactgccgctggaagagcaagagccccagccctgtgcacggggccggccccagcgtgatggagatcccctgggatgacctgattgccctgtgcatcaaccacaagctgcgggactggaccccaccccggctgcctgtgaccagcgaggccctgtctgaagatggccagatctgtgtgtacttcttcaagaatgacctgaagaagtatgatgtgcccctgtcctgggagcaggcccggctgcagacccagaaggagctgcagctgcgggagggccgcctggccatcaagcccttccaccccagcgccaacaacttccccatccccctgctgcacatgcacaggaactggaagaggagcacagaatgtgcccaggagggccgcatccccagcacagaggacctgatgagaggagccagcgctgaggagctgctggcccagtgcctgagcagcagcctgctgctggagaaggaggagaacaagagatttgaggaccagctgcagcagtggctgtctgaagattctggggccttcacagacctgaccagcctgcccctgtacctgccccagaccctggtgtccctgagccacaccatcgagcctgtgatgaagacctctgtgaccaccagcccccagagcgacatgatgagggagcagctgcagctgtctgaggccaccggcacctgcctgggggagcggctgaagcacctggagcggctcatccgcagcagccgggaggaggaggtggccagcgagctgcacctgagcgccctgctggacatggtggacatctag

SEQ ID NO: 18675 - DNA, 3147 bp, Artificial Sequence
  Description of Artificial Sequence: Synthetic coding sequence
atgtctgatgtgaacccccccagcgacacccccatccccttcagcagcagcagcacccacagcagccacatccccccctggaccttcagctgctacccaggcagcccctgtgaaaatggagtgatgctgtacatgagaaatgtgtcccatgaggagctgcagcgcttcaagcagctgctgctgacagagctgagcacaggcaccatgcccatcacctgggaccaggtggagacagcctcctgggccgaggtggtgcacctgctgattgagcgcttccctggaagaagagcctgggatgtgaccagcaacatctttgccatcatgaactgtgacaagatgtgtgtggtggtgcggcgggagatcaatgccatcctgcccaccctggagcctgaggacctgaatgtgggggagacccaggtgaacctggaggagggggagagcggcaagatccgccgctacaagagcaatgtgatggagaagttcttccccatctgggacatcaccacctggccaggcaaccagagggacttcttctaccagggcgtgcacagacatgaggagtacctgccctgcctgctgctgcccaagaggccccagggccggcagcccaagacagtggccatccagggcgcccctggcatcggcaagaccatcctggccaagaaggtgatgtttgagtgggccaggaacaagttctacgcccacaagcgctggtgtgccttctacttccactgccaggaggtgaaccagaccacagaccagagcttcagcgagctgattgagcagaagtggccaggcagccaggacctggtgtccaagatcatgagcaagccagaccagctgctgctgctgctggatggctttgaggagctgaccagcaccctgattgaccggctggaggacctgtctgaggactggaggcagaagctgcccggctctgtgctgctgagcagcctgctgagcaagaccatgctgcctgaggccaccctgctgatcatgatccgcttcacctcctggcagacctgcaagcccctgctgaagtgccccagcctggtgaccctgcccggcttcaacaccatggagaagatcaagtacttccagatgtacttcggccacacagaggagggggaccaggtgctgagctttgccatggagaacaccatcctcttctccatgtgccgggtgcctgtggtgtgctggatggtgtgcagcggcctgaagcagcagatggagcggggcaacaacctgacccagagctgccccaatgccacctctgtgtttgtgcgctacatcagcagcctcttccccaccagggctgagaacttcagcaggaagatccaccaggcccagctggagggcctgtgccacctggccgctgacagcatgtggcacaggaagtgggtgctgggcaaggaggacctggaggaggccaagctggaccagacaggagtgacagccttcctgggcatgagcatcctgcggagaattgctggggaggaggaccactacgtgttcaccctggtgaccttccaggagttctttgctgccctcttctacgtgctgtgcttcccccagaggctgaagaacttccacgtgctgagccacgtgaacatccagaggctcatcgccagcccccggggcagcaagagctacctgagccacatgggcctcttcctgtttggcttcctgaatgaggcctgtgccagcgctgtggagcagagcttccagtgcaaggtgtcctttggaaacaagaggaagctgctgaaggtgatccccctgctgcacaagtgtgacccccccagccctggcagcggcgtgccccagctgttctactgcctgcacgagatccgggaggaggcctttgtgtcccaggccctgaatgactaccacaaggtggtgctgcgcatcggcaacaacaaggaggtgcaggtgtctgccttctgcctgaagcgctgccagtacctgcacgaggtggagctgactgtgaccctgaacttcatgaatgtgtggaagctgagcagcagcagccaccctggcagcgaggcccctgagagcaatggcctgcaccgctggtggcaggacctgtgcagcgtgtttgccaccaatgacaagctggaggtgctgaccatgaccaacagcgtgctgggcccccccttcctgaaggccctggccgccgccctgcggcacccccagtgcaagctgcagaagctgctgctgcggcgggtgaacagcaccatgctgaaccaggacctgattggagtgctgaccggcaaccagcacctgcgctacctggagatccagcacgtggaggtggagagcaaggctgtgaagctgctgtgccgggtgctgcggagcccccgctgccgcctgcagtgcctgcggctggaggactgcctggccaccccccgcatctggacagacctgggcaacaacctgcagggcaatggccacctgaagaccctcatcctgaggaagaacagcctggagaactgtggggcctactacctgtctgtggcccagctggagcggctgagcattgagaactgcaacctgacccagctgacctgtgagagcctggccagctgcctgcggcagagcaagatgctgacccacctgagcctggccgagaatgccctgaaggatgaaggagccaagcacatctggaatgccctgccccacctgcgctgccccctgcagaggctggtgctgaggaaatgtgacctgaccttcaactgctgccaggacatgatcagcgccctgtgcaagaacaagaccctgaagagcctggacctgtccttcaacagcctgaaggatgatggagtcatcctgctgtgtgaggccctgaagaacccagactgcaccctgcagatcctggagctggagaactgcctcttcaccagcatctgctgccaggccatggcctccatgctgaggaagaaccagcacctgcggcacctggacctgagcaagaatgccatcggcgtgtatggcatcctgaccctgtgtgaggccttcagcagccagaagaagcgggaggaggtgatcttctgcatcccagcctggacccgcatcaccagcttcagccccaccccccaccccccagacttcaccgggaagagtgactgcctgagccagatcaacccctag

SEQ ID NO: 18676 - DNA, 3792 bp, Artificial Sequence
  Description of Artificial Sequence: Synthetic coding sequence
atgcctgccagaattggctactatgaaattgacaggaccatcggcaagggcaactttgctgtggtgaagagggccacccacctggtgaccaaggccaaggtggccatcaagatcatcgacaagacccagctggatgaggagaacctgaagaagatcttccgggaggtgcagatcatgaagatgctgtgccacccccacatcatccggctgtaccaggtgatggagacagagaggatgatctacctggtgacagaatatgccagcggcggggagatctttgaccacctggtggcccacggccgcatggccgagaaggaggcccggaggaagttcaagcagatcgtgacagctgtgtacttctgccactgcaggaacatcgtgcaccgggacctgaaggccgagaacctgctgctggatgccaacctgaacatcaagattgctgactttggcttcagcaacctcttcaccccaggccagctgctgaagacctggtgtggcagccccccctatgctgcccctgagctgtttgagggcaaggagtatgatggccccaaggtggacatctggagcctgggcgtggtgctgtatgtgctggtgtgtggggccctgccctttgatggcagcaccctgcagaacctgcgggcccgggtgctgagcggcaagttccgcatccccttcttcatgagcacagaatgtgagcacctgatccgccacatgctggtgctggaccccaacaagaggctgtccatggagcagatctgcaagcacaagtggatgaagctgggagatgctgaccccaactttgaccggctgattgctgagtgccagcagctgaaggaggagcggcaggtggaccccctgaatgaagatgtgctgctggccatggaggacatgggcctggacaaggagcagaccctgcagagcctgcggagtgatgcctatgaccactacagcgccatctacagcctgctgtgtgacagacacaagaggcacaagaccctgcggctgggcgccctgcccagcatgccccgggccctggccttccaggcccctgtgaacatccaggccgagcaggccggcacagccatgaacatctctgtgccccaggtgcagctgatcaaccctgagaaccagatcgtggagccagatggcaccctgaacctggacagtgatgaaggagaggagcccagccctgaggccctggtgcgctacctgtccatgaggaggcacacagtgggcgtggccgaccccaggacagaggtgatggaggacctgcagaagctgctgcccggcttccctggggtgaacccccaggcccccttcctgcaggtggccccaaatgtgaacttcatgcacaacctgctgcccatgcagaacctgcagcccaccggccagctggagtacaaggagcagagcctgctgcagccccccaccctgcagctgctgaatggcatgggccccctgggccggcgggccagtgatggaggagccaacatccagctgcacgcccagcagctgctgaagaggccccggggccccagccccctggtgaccatgaccccagctgtgcctgctgtgacccctgtggatgaggagagcagtgatggagagccagaccaggaggccgtgcagagcagcacctacaaggacagcaacaccctgcacctgcccacagagcgcttcagccctgtgcggcgcttcagtgatggagctgccagcatccaggccttcaaggcccacctggagaagatgggcaacaacagcagcatcaagcagctgcagcaggagtgtgagcagctgcagaagatgtatggaggccagattgatgagaggaccctggagaagacccagcagcagcacatgctgtaccagcaggagcagcaccaccagatcctgcagcagcagatccaggacagcatctgccccccccagcccagcccccccctgcaggccgcctgtgagaaccagcctgccctgctgacccaccagctgcagaggctgcgcatccagcccagcagccccccacccaaccaccccaacaaccacctgttccggcagcccagcaacagccccccacccatgagcagcgccatgatccagccccacggggccgccagcagcagccagttccagggcctgcccagccgcagcgccatcttccagcagcagcctgagaactgcagcagcccccccaacgtggccctgacctgcctgggcatgcagcagcctgcccagagccagcaggtgaccatccaggtgcaggagcctgtggacatgctgagcaacatgcctggaacagctgctggcagcagcggccggggcatcagcatcagccccagcgctggccagatgcagatgcagcacaggaccaacctgatggccaccctgtcctatggccaccggcccctgagcaagcagctgtctgctgacagcgctgaggcccacagcctgaatgtgaaccgcttcagccctgccaactatgaccaggcccacctgcacccccacctgttcagtgaccagagccggggcagccccagcagctacagccccagcactggagtgggcttcagccccacccaggccctgaaggtgccccccctggaccagttccccaccttcccccccagcgcccaccagcagcccccccactacaccaccagcgccctgcagcaggccctgctgagccccaccccaccagactacaccaggcaccagcaggtgccccacatcctgcagggcctgctgagccccaggcacagcctgaccggccacagcgacatccggctgcccccaacagaatttgcccagctgatcaagaggcagcagcagcagaggcagcagcagcagcagcagcagcagcagcaggagtaccaggagctgttccgccacatgaaccagggagatgctggcagcctggcccccagcctgggcggccagagcatgacagagcggcaggccctgagctaccagaatgctgacagctaccaccaccacaccagcccccagcacctgctgcagatccgggcccaggagtgtgtgtcccaggccagcagccccaccccacctcatggctacgcccaccagcctgccctgatgcacagcgagagcatggaggaggactgcagctgtgagggcgccaaggatggcttccaggacagcaagagcagcagcaccctgaccaagggctgccacgacagccccctgctgctgagcactggaggccctggggaccctgagagcctgctgggcaccgtgtcccatgcccaggagctgggcatccacccctacggccaccagcccacagctgccttcagcaagaacaaggtgcccagccgggagcccgtcatcggcaactgcatggacaggagcagccctggccaggccgtggagctgcctgaccacaacggcctgggctacccagcccggcccagcgtgcatgagcaccaccggccccgggccctgcagaggcaccacaccatccagaacagtgatgatgcctacgtgcagctggacaacctgcccggcatgagcctggtggccggcaaggccctgagcagcgccaggatgtctgatgctgtgctgagccagagcagcctgatgggcagccagcagttccaggatggagaaaatgaggagtgtggggccagcctgggcggccacgagcacccagacctgagtgatggcagccagcacctgaacagcagctgctaccccagcacctgcatcacagacatcctgctgagctacaagcaccctgaggtgtccttctccatggagcaggccggcgtgtag

SEQ ID NO: 18677 - DNA, 4395 bp, Artificial Sequence
  Description of Artificial Sequence: Synthetic coding sequence
atgtaccagccagaagatgacaacaacagtgatgtgaccagtgatgatgacatgaccaggaacagaagagagagcagccccccccacagcgtgcacagcttcagcggggaccgggactgggaccggcggggccgcagccgggacatggagccccgggaccgctggagccacaccaggaaccccaggagcaggatgccaccccgggacctgagcctgcctgtggtggccaagaccagctttgagatggacagagaagatgaccgggacagccgggcctatgagagccgcagccaggatgctgagagctaccagaatgtggtggacctggccgaggacaggaagccccacaacaccatccaggacaacatggagaactacaggaagctgctgagcctgggcgtgcagctggccgaggatgatggccacagccacatgacccagggccacagcagccgcagcaagaggtctgcctaccccagcaccagccggggcctgaagaccatgcctgaggccaagaagagcacccacagaagaggcatctgtgaagatgagagcagccatggagtcatcatggagaagttcatcaaggatgtgagccgcagcagcaagagcggccgggcccgggagagcagtgacaggagccagcgcttccccaggatgtctgatgacaactggaaggacatcagcctgaacaagcgggagagcgtcatccagcagagggtgtatgagggcaatgccttccggggcggcttccgcttcaacagcaccctggtgtccaggaagagggtgctggagaggaagaggcgctaccactttgacacagatggcaagggcagcatccatgaccagaagggctgccccaggaagaagccctttgaatgtggcagcgagatgaggaaggccatgtctgtgagcagcctgagcagcctgagcagccccagcttcacagagagccagcccatcgactttggagccatgccctacgtgtgtgatgaatgtggccgctccttcagcgtcatcagcgagtttgtggagcaccagatcatgcacacccgggagaacctgtatgaatatggagagagcttcatccacagcgtggccgtgtctgaggtgcagaagagccaggtgggcggcaagagatttgagtgcaaggactgtggggagaccttcaacaagtctgctgccctggccgagcacaggaagatccacgcccggggctacctggtggagtgcaagaaccaggagtgtgaggaggccttcatgcccagccccaccttcagcgagctgcagaagatctacggcaaggacaagttctatgagtgccgggtgtgcaaggagaccttcctgcacagcagcgccctgattgagcaccagaagatccactttggagatgacaaggacaatgaaagagagcacgagcgggagcgggagcgggagcggggggagaccttccggcccagccctgccctgaatgagttccagaagatgtatggcaaggagaagatgtatgagtgcaaggtgtgtggggagaccttcctgcacagcagcagcctgaaggagcaccagaagatccacacccggggcaacccctttgagaacaagggcaaggtgtgtgaggagaccttcatccctggccagagcctgaagaggcggcagaagacctacaacaaggagaagctgtgtgacttcacagatggaagagatgccttcatgcagagcagcgagctgtctgagcaccagaagatccacagcaggaagaacctgtttgagggccggggctatgagaagagcgtcatccacagcggccccttcacagagagccagaagagccacaccatcacccggcccctggagagtgatgaagatgagaaggccttcaccatcagcagcaacccctatgagaaccagaagatccccaccaaggaaaatgtgtatgaggccaagagctatgaaagaagtgtcatccacagcctggcctctgtggaggcccagaagagccacagcgtggccggccccagcaagcccaaggtgatggccgagagcaccatccagagctttgatgccatcaaccaccagagggtgcgggccggcggcaacaccagcgagggccgggagtacagccgcagcgtcatccacagcctggtggccagcaagcccccaagaagccacaatggaaatgagctggtggagagcaatgagaagggggagagcagcatctacatcagtgacctgaatgacaagaggcagaagatcccagcccgggagaacccctgtgagggcggcagcaagaacagaaattatgaggacagcgtcatccagagcgtcttccgggccaagccccagaagtctgtgcctggagagggcagcggggagttcaagaaggatggagagttctctgtgcccagcagcaatgtgcgggagtaccagaaggcccgggccaagaagaagtacatcgagcacaggagcaatgagaccagcgtcatccacagcctgccctttggagagcagaccttccggccccggggcatgctgtatgagtgccaggagtgtggggagtgctttgcccacagcagtgacctgacagagcaccagaagatccatgaccgggagaagcccagcggcagcaggaactatgagtggagcgtcatccgcagcctggcccccacagacccccagaccagctatgcccaggagcagtatgccaaggagcaggccaggaacaagtgcaaggacttccggcagttctttgccaccagcgaggacctgaacaccaaccagaagatctatgaccaggagaagagccatggagaggagagccagggcgagaacacagatggagaggagacccacagcgaggagacccacggccaggagaccattgaagatcctgtgatccagggcagtgacatggaggacccccagaaggatgatcctgatgacaagatctatgaatgtgaggactgtggcctgggctttgtggacctgacagacctgacagaccaccagaaggtgcacagcaggaagtgcctggtggacagccgggagtacacccacagcgtcatccacacccacagcatcagcgagtaccagagggactacaccggggagcagctgtatgagtgccccaagtgtggggagagcttcatccacagcagcttcctgtttgagcaccagagaattcatgagcaggaccagctgtacagcatgaagggctgtgatgatggcttcatcgccctgctgcccatgaagcccaggaggaacagagctgctgagaggaacccagccctggccggcagcgccatccgctgcctgctgtgtggccagggcttcatccacagcagcgccctgaatgagcacatgaggctgcacagagaagatgacctgctggagcagagccagatggccgaggaggccatcatccctggcctggccctgacagagttccagaggagccagacagaggagcggctgtttgaatgtgctgtgtgtggggagagctttgtgaacccagctgagctggccgaccacgtgacagtgcacaagaatgagccctatgaatatggcagcagctacacccacaccagcttcctgacagagcccctgaagggggccatccccttctatgagtgcaaggactgtgggaagagcttcatccacagcacagtgctgaccaagcacaaggagctgcacctggaggaggaggaggaggatgaagctgctgctgctgctgctgctgctgcccaggaggtggaggccaacgtgcacgtgccccaggtggtgctgcgcatccagggcctgaatgtggaggccgctgagcctgaggtggaggccgctgagcctgaggtggaggccgctgagcctgaggtggaggccgctgagcccaatggagaggccgagggcccagatggagaggccgctgagcccatcggggaggccggccagcccaacggggaggccgagcagcccaatggagatgctgatgagccagatggagctggcattgaagatcctgaggagagagctgaggagcctgagggcaaggccgaggagccagaaggagatgctgatgagccagatggagtgggcatcgaggaccctgaggagggggaggaccaggagatccaggtggaggagccctactatgactgccatgaatgtacagagaccttcaccagcagcacagccttcagcgagcacctgaagacccacgcctccatgatcatctttgagcccgccaatgcctttggagaatgttctggctacatcgagcgggccagcaccagcactggaggagccaaccaggctgatgagaagtacttcaagtgtgatgtgtgtggccagctgttcaatgaccggctgagcctggcccggcaccagaacacccacactggatag

SEQ ID NO: 18678 - DNA, 1302 bp, Artificial Sequence
  Description of Artificial Sequence: Synthetic coding sequence
atggccgaggcccagagcggcaccggccagctgcaggagcagaagaagggcctgctgattgctgtgtctgtgtctgtggacaagatcatcagccactttggagctgccaggaacctggtgcagaaggcccagctgggggacagccggctgagcccagatgtgggccacctggtgctgaccaccctgtgcccagccctgcacgccctggtggctgatggcctgaagcccttcaggaaggacctgatcaccggccagaggaggagcagcccctggagcgtggtggaggcctctgtgaagccaggcagcagcaccaggagcctgggcaccctgtacagccaggtgtcccggctggcccccctgagcagcagccgcagccgcttccacgccttcatcctgggcctgctgaacaccaagcagctggagctgtggttcagcagcctgcaggaggatgctggcctgctgagcctgctgtacctgcccaccggcttcttcagcctggcccggggcggctgccccagcctgagcacagagctgctgctgctgctgcagcccctgtctgtgctgaccttccacctggacctgctgtttgagcaccaccaccacctgcccctgggccccccccaggccccagcccctcctggccccccaccagccctgcagcagaccatgcaggccatgctgcactttggaggccgcctggcccagagcctgcggggcaccagcaaggaggccgccagtgaccccagcgacagccccaacctgcccaccccaggctcctggtgggagcagctgacccaggccagccgggtgtatgccagcggcggcacagagggcttccccctgagccgctgggcccctggaagacatggaacagctgctgaggagggcgcccaggagcggcccctgcccacagatgagatggcccctggccggggcctgtggctgggccgcctgtttggagtgcctgggggccctgcagaaaatgaaaatggagccctgaagagccggcggcccagctcctggctgcccccaacagtgtctgtgctggccctggtgaagagaggagcccctcctgagatgcccagcccccaggagctggaggccagcgcccccaggatggtgcagacccacagagctgtgcgggccctgtgtgaccacacagctgcccggccagaccagctgtccttcagaagaggagaggtgctgcgggtcatcaccaccgtggatgaggactggctgcgctgtggcagagatggcatggagggcctggtgcctgtgggctacaccagcctggtgctgtag

SEQ ID NO: 18679 - DNA, 1584 bp, Artificial Sequence
  Description of Artificial Sequence: Synthetic coding sequence
atggcccagaccctgcagatggagatccccaactttggaaacagcatcctggagtgcctgaatgagcagaggctgcagggcctgtactgtgatgtgtctgtggtggtgaagggccacgccttcaaggcccacagagctgtgctggccgccagcagcagctacttccgggacctcttcaacaacagccgctctgctgtggtggagctgcctgctgctgtgcagccccagagcttccagcagatcctgtccttctgctacacaggccgcctgtccatgaatgtgggggaccagttcctgctgatgtacacagctggcttcctgcagatccaggagatcatggagaagggcacagagttcttcctgaaggtgagcagccccagctgtgacagccagggcctgcatgctgaggaggcccccagcagcgagccccagagccctgtggcccagaccagcggctggccagcctgcagcacccccctgcccctggtgtcccgggtgaagacagagcagcaggagagtgacagcgtgcagtgcatgcctgtggccaagaggctgtgggacagcggccagaaggaggccggcggcggcggcaatggcagcaggaagatggccaagttcagcaccccagacctggccgccaaccggccccaccagcccccaccaccccagcaggcccctgtggtggccgccgcccagcctgctgtggccgccggggccggccagcctgctggaggagtggccgctgctggaggagtggtgtctggccccagcaccagcgagaggaccagccctggcaccagcagcgcctacaccagtgacagccctggcagctaccacaatgaggaggatgaggaggaggatggaggagaggagggcatggatgagcagtaccggcagatctgcaacatgtacaccatgtacagcatgatgaatgtgggccagacagctgagaaggtggaggccctgcctgagcaggtggcccctgagagcaggaaccgcatccgggtgcggcaggacctggccagcctgcctgctgagctgatcaaccagatcggcaaccgctgccaccccaagctgtatgatgaaggagaccccagcgagaagctggagctggtgacaggcaccaacgtgtacatcacccgggcccagctgatgaactgccacgtgtctgctggcaccaggcacaaggtgctgctgcggcggctgctggccagcttctttgacaggaacaccctggccaacagctgtggcaccggcatccgcagcagcaccaatgaccccaggaggaagcccctggacagccgggtgctgcatgctgtgaagtactactgccagaactttgcccccaacttcaaggagagcgagatgaatgccatcgctgctgacatgtgcaccaatgcccggcgggtggtgaggaagtcctggatgcccaaggtgaaggtgctgaaggcagaagatgatgcctacaccaccttcatcagcgagaccgggaagattgaaccagacatgatgggcgtggagcacggctttgaaacagccagccatgaaggagaggccggccccagcgctgaggccctgcagtag

SEQ ID NO: 18680 - DNA, 672 bp, Artificial Sequence
  Description of Artificial Sequence: Synthetic coding sequence
atggaggtgcagaaggaggcccagaggatcatgaccctgtctgtgtggaagatgtaccacagcaggatgcagaggggcggcctgcggctgcacaggagcctgcagctgagcctggtgatgaggtctgcccgggagctgtacctgagcgccaaggtggaggccctggagcctgaggtgtccctgcctgctgccctgcccagcgacccccggctgcaccccccccgggaggccgagagcacagctgagacagccaccccagatggagagcaccccttccctgagcccatggacacccaggaggcccccacagctgaggagaccagcgcctgctgtgcccccaggcctgccaaggtgtccaggaagaggaggagcagcagcctgagtgatggaggagatgctggcctggtgcccagcaagaaggcccggctggaggagaaggaggaggaggagggcgccagcagcgaggtggccgaccggctgcagcccccaccagcccaggccgagggcgccttccccaacctggcccgggtgctgcagaggcgcttcagcggcctgctgaactgcagccctgctgccccacccacagcccccccagcctgtgaggccaagccagcctgcaggcctgctgacagcatgctgaatgtgctggtgcgggctgtggtggccttctag

SEQ ID NO: 18681 - DNA, 1500 bp, Artificial Sequence
  Description of Artificial Sequence: Synthetic coding sequence
atgagggtgctggtgcccccagctgagaggagccaggacaccagggtgggcgccccagcctggagggaggccgcccaggccatggccaggacagcccacatcctgacagacagatgtggccaggaggccgtgaccatgtggcagcccaaggacagcgtgctggaccccaacgtggcccaccacctgggccgggccgcctacatccagccctggaggttccgggtggagatgatcaagggcggcggcaccctggagaagcccccacctggagagggcgtgaccctgtggaagggcaagatgaagcccccagcctggtacgcccggctgcccctgcccctgcacaggaaggcccgggccctgcagaccacagaggtggtgcacgcccacgcccggggggcccggctgacagctgcccggctgggccgggcccagcaccagatcaatggccgggtgcggcagctgctgcggcagcgggaggtgacagaccaccggctgtctgaggtgaggaagggcctgctgatcaaccagcagagcgtgaagctgcggggctaccggcccaagtctgagaaggtgcctgacaaggctgacagcatgctgacctgggagaaggaggagctgaagtccatgaagaggaagatggagcgggacatggagaagtctgaggtgctgctgaagaccctggccagctgccgggacaccctgaacttctgcttcaaggagcggctgcaggccgtggacctgatgaaccagcccctggacaaggtgctggagcaggcccggcggcacagctgggtgaacctgagccgggcccccacccccaggacccagggccagaagaccccacctccagaccctgtgggcacctacaacccagcctgtgccctggccctgaatgaggccaagaggctgctggtggagagcaaggacaccctggtggagatggccaagaatgaggtggatgtgcgggagcagcagctgcagatcagtgacagagtgtgtgccagcctggcccagaaggccagcgagaccctggagctgaaggagcggctgaacatgaccctgggcctgatgaggggcaccatcctgcgctgcaccaagtacaaccaggagctgtacaccacccacggcctcatcaagggccccctgagcaaggtgcacctggagacagctgagaagctggaccggcccctggtgaggatgtaccagagacatgtgggcacccagctgcctgaggccgcccggctggcccagggcacagacaagctgcagtgccacatcacctacctggagaagaacctggatgagctgctggccacccacaagaacctgtcctggggcctgaactgcaagaacatcggccacgaggtggatggaaatgtggtgcggctgcggctgcggcagaggcagccccacgtgtgctatgagcaggcccagaggctggtgaaggactgggaccccaggaccccaccacccaggagcaagagcagcgctgacccctag

SEQ ID NO: 18682 - DNA, 1827 bp, Artificial Sequence
  Description of Artificial Sequence: Synthetic coding sequence
atggagatggagagcgctgctgccagcacccgcttccaccagccccacatggagaggaagatgtctgccatggcctgtgagatcttcaatgagctgcggctggagggcaagctgtgtgatgtggtgatcaaggtgaatggatttgagttcagcgcccacaagaacatcctgtgcagctgcagcagctacttccgggccctcttcaccagcggctggaacaacacagagaagaaggtgtacaacatccctggcatcagcccagacatgatgaagctgatcatcgagtatgcctacaccaggacagtgcccatcaccccagacaacgtggagaagctgctggccgctgctgaccagttcaacatcatgggcatcgtgcggggctgctgtgagttcctgaagtctgagctgtgcctggacaactgcatcggcatctgcaagttcacagactactactactgcccagagctgcggcagaaggcctacatgttcatcctgcacaactttgaggagatggtgaaggtgtctgctgagttcctggagctgtctgtgacagagctgaaggacatcatcgagaaggatgagctgaatgtgaagcaggaggatgctgtgtttgaggccatcctgaagtggatcagccatgacccccagaacaggaagcagcacatcagcatcctgctgcccaaggtgcggctggccctgatgcacgccgagtacttcatgaacaacgtgaagatgaatgactatgtgaaggacagcgaggagtgcaagcctgtgatcatcaatgccctgaaggccatgtatgacctgaacatgaatggccccagcaacagcgacttcaccaaccccctgacccggccccggctgccctatgccatcctgtttgccatcggcggctggagcggcggcagccccaccaatgccatcgaggcctatgatgcccgggctgaccgctgggtgaatgtgacctgtgaggaggagagcccccgggcctaccacggggccgcctacctgaagggctacgtgtacatcatcggcggctttgattctgtggactacttcaacagcgtgaagagatttgatcctgtgaagaagacctggcaccaggtggcccccatgcacagccgccgctgctacgtgtctgtgacagtgctgggcaacttcatctatgccatgggcggctttgatggctacgtgcggctgaacacagctgagagatatgagcctgagaccaaccagtggaccctcatcgcccccatgcatgagcagaggagtgatgccagcgccaccaccctgtatggcaaggtgtacatctgtggcggcttcaatggaaatgaatgtctcttcaccgctgaggtgtacaacacagagagcaaccagtggacagtgattgcccccatgaggagcagaagaagtggcattggagtcatcgcctacggggagcacgtgtatgctgtgggcggctttgatggagccaaccggctgcggtctgctgaggcctacagccctgtggccaacacctggaggaccatccccaccatgttcaaccccaggagcaactttggcatcgaggtggtggatgacctgctgtttgtggtgggcggcttcaacggcttcaccaccaccttcaacgtggagtgctatgatgagaagacagatgagtggtatgatgcccatgacatgagcatctacagaagtgccctgagctgctgcgtggtgcccggcctggccaacgtggaggagtatgctgcccggcgggacaacttccctggcctggccctgagagatgaggtgaagtacagcgccagcaccagcaccctgcctgtgtag

SEQ ID NO: 18683 - DNA, 942 bp, Artificial Sequence
  Description of Artificial Sequence: Synthetic coding sequence
atggccgccctgacagacctgtccttcatgtaccgctggttcaagaactgcaacctggtgggcaacctgtctgagaagtatgtgttcatcaccggctgtgacagcggctttggaaacctgctggccaagcagctggtggaccggggcatgcaggtgctggccgcctgcttcacagaggagggcagccagaagctgcagagggacaccagctaccgcctgcagaccaccctgctggatgtgaccaagtctgagagcatcaaggctgctgcccagtgggtgcgggacaaggtgggggagcagggcctgtgggccctggtgaacaatgccggcgtgggcctgcccagcggccccaatgagtggctgaccaaggatgactttgtgaaggtgatcaacgtgaacctggtgggcctcatcgaggtgaccctgcacatgctgcccatggtgaagagggcccggggccgggtggtgaacatgagcagcagcggcggccgggtggccgtcatcggcggcggctactgtgtgtccaagtttggagtggaggccttcagtgacagcatcagaagagagctgtactactttggagtgaaggtgtgcatcatcgagcccggcaactacagaacagccatcctgggcaaggagaacctggagagcaggatgaggaagctgtgggagcggctgccccaggagacccgggacagctatggagaggactacttccgcatctacacagacaagctgaagaacatcatgcaggtggccgagccccgggtgagagatgtgatcaacagcatggagcacgccatcgtgagccgcagcccccgcatccgctacaaccctggcctggatgccaagctgctgtacatccccctggccaagctgcccacccctgtgacagacttcatcctgagccgctacctgcccaggcctgctgacagcgtgtag

SEQ ID NO: 18684 - DNA, 1461 bp, Artificial Sequence
  Description of Artificial Sequence: Synthetic coding sequence
atgacctgtggcagctactgcggcggccgggccttcagctgcatcagcgcctgtggcccccggcccggccgctgctgcatcacagctgccccctaccggggcatcagctgctaccggggcctgaccggcggcttcggcagccacagcgtgtgtggcggcttccgggccggcagctgtggccgcagctttggctacagaagtggaggagtgtgtggccccagccccccctgcatcaccaccgtgtctgtgaatgaaagcctgctgacccccctgaacctggagattgaccccaatgcccagtgtgtgaagcaggaggagaaggagcagatcaagagcctgaacagcagatttgctgccttcatcgacaaggtgcgcttcctggagcagcagaacaagctgctggagaccaagctgcagttctaccagaaccgggagtgctgccagagcaacctggagcccctgtttgagggctacatcgagaccctgcggcgggaggctgaatgtgtggaggccgacagcggccgcctggccagcgagctgaaccacgtgcaggaggtgctggagggctacaagaagaagtatgaggaggaggtgtccctgcgggccacagcagaaaatgaatttgtggccctgaagaaggatgtggactgtgcctacctgaggaagagtgacctggaggccaacgtggaggccctgatccaggagattgacttcctgcggcggctgtatgaggaggagatccgggtgctgcagagccacatcagtgacacctctgtggtggtgaagctggacaacagccgggacctgaacatggactgcatcatcgccgagatcaaggcccagtatgatgacatcgtgaccaggagcagagctgaggccgagagctggtaccgcagcaaatgtgaggagatgaaggccaccgtcatcagacatggagagaccctgcggaggaccaaggaggagatcaatgagctgaacaggatgatccagaggctgacagctgaggtggagaatgccaagtgccagaacagcaagctggaggccgctgtggcccagagcgagcagcagggcgaggccgccctgagtgatgcccgctgcaagctggccgagctggagggcgccctgcagaaggccaagcaggacatggcctgcctgatccgggagtaccaggaggtgatgaacagcaagctgggcctggacattgaaattgccacctacagaaggctgctggagggggaggagcagaggctgtgtgagggcgtgggctctgtgaatgtgtgtgtgagcagcagcagaggaggagtggtgtgtggggacctgtgtgccagcaccacagcccctgtggtgtccaccagggtgtcctctgtgcccagcaacagcaatgtggtggtgggcaccaccaatgcctgtgcccccagcgcccgggtgggcgtgtgtggcggcagctgcaagcgctgctag

SEQ ID NO: 18685 - DNA, 939 bp, Artificial Sequence
  Description of Artificial Sequence: Synthetic coding sequence
atggccgagctgacagccctggagagcctgattgagatgggcttcccccggggccgggcagagaaggccctggccctgactggaaaccagggcatcgaggccgccatggactggctgatggagcatgaagatgatcctgatgtggatgagcccctggagacccccctgggccacatcctgggccgggagcccaccagcagcgagcagggcggcctggagggcagcggcagcgctgctggggagggcaagccagccctgtctgaggaggagcggcaggagcagaccaagaggatgctggagctggtggcccagaagcagcgggagcgggaggagcgggaggagcgggaggccctggagcgggagcggcagaggcggcggcagggccaggagctgtctgctgcccggcagaggctgcaggaggatgagatgagaagagctgctgaggagaggagaagagagaaggccgaggagctggccgcccggcagagggtgcgggagaagattgaaagagacaaggccgagcgggccaagaagtatggaggctctgtgggcagccagcccccacctgtggcccctgagcccggccctgtgcccagcagccccagccaggagccccccaccaagcgggagtatgaccagtgccgcatccaggtgcggctgcctgatggcaccagcctgacccagaccttccgggcccgggagcagctggccgctgtgcggctgtatgtggagctgcacagaggagaggagctgggcggcggccaggaccctgtgcagctgctgagcggcttcccccggcgggccttcagcgaggccgacatggagcggcccctgcaggagctgggcatggccgcccggctggagaccaggaccaggaactggggcagccgggaggcctgcctgggcaaaggaggcatgcagcgggagggcgccctgtag

SEQ ID NO: 18686 - DNA, 405 bp, Artificial Sequence
  Description of Artificial Sequence: Synthetic coding sequence
atgcctgctgacctgagcggcacctggaccctgctgagcagtgacaactttgagggctacatgctggccctgggcatcgactttgccaccaggaagatcgccaagctgctgaagccccagaaggtgattgagcagaatggagacagcttcaccatccacaccaacagcagcctgaggaactactttgtgaagttcaaggtgggggaggagtttgatgaggacaacagaggcctggacaacaggaagtgcaagagcctggtgatctgggacaatgaccggctgacctgcatccagaagggggagaagaagaacagaggctggacccactggattgaaggagacaagctgcacctggagatgttctgtgagggccaggtgtgcaagcagaccttccagagggcctag

SEQ ID NO: 18687 - DNA, 1383 bp, Artificial Sequence
  Description of Artificial Sequence: Synthetic coding sequence
atggccggctacctgtctgagagtgactttgtgatggtggaggagggcttcagcacccgggacctgctgaaggagctgaccctgggcgccagccaggccaccacagatgaggtggccgccttctttgtggccgacctgggcgccatcgtgaggaagcacttctgcttcctgaagtgcctgccccgggtgcggcccttctatgctgtgaagtgcaacagcagccctggggtgctgaaggtgctggcccagctgggcctgggcttcagctgtgccaacaaggccgagatggagctggtgcagcacatcggcatcccagccagcaagatcatctgtgccaacccctgcaagcagatcgcccagatcaagtatgctgccaagcacggcatccagctgctgagctttgacaatgagatggagctggccaaggtggtgaagagccaccccagcgccaagatggtgctgtgcatcgccacagatgacagccacagcctgagctgcctgagcctgaagtttggagtgtccctgaagagctgccgccacctgctggagaatgccaagaagcaccacgtggaggtggtgggcgtgtccttccacatcggcagcggctgcccagacccccaggcctatgcccagagcattgctgatgcccggctggtgtttgagatgggcacagagctgggccacaagatgcacgtgctggacctgggcggcggcttccctggaacagagggcgccaaggtgcgctttgaggagatcgccagcgtcatcaacagcgccctggacctgtacttccctgagggctgcggcgtggacatctttgctgagctgggccgctactacgtgaccagcgccttcaccgtggccgtgtccatcatcgccaagaaggaggtgctgctggaccagcccggccgggaggaggagaatggcagcaccagcaagaccatcgtgtaccacctggatgagggcgtgtatggcatcttcaacagcgtgctgtttgacaacatctgccccacccccatcctgcagaagaagcccagcacagagcagcccctgtacagcagcagcctgtggggccctgctgtggatggctgtgactgtgtggccgagggcctgtggctgccccagctgcacgtgggggactggctggtgtttgacaacatgggcgcctacacagtgggcatgggcagccccttctggggcacccaggcctgccacatcacctacgccatgagccgggtggcctgggaggccctgcggcggcagctgatggctgctgagcaggaggatgatgtggagggcgtgtgcaagcccctgagctgtggctgggagatcacagacaccctgtgtgtgggccctgtgttcaccccagccagcatcatgtag

SEQ ID NO: 18688 - DNA, 1209 bp, Artificial Sequence
  Description of Artificial Sequence: Synthetic coding sequence
gggggcccccggggcagcggcagcgctgctgagaccatgcctgagatccgggtgacccccctgggcgccggccaggatgtgggccgcagctgcatcctggtgtccattgctgggaagaatgtgatgctggactgtggcatgcacatgggcttcaatgatgaccggcgcttcccagacttctcctacatcacccagaatggccgcctgacagacttcctggactgtgtgatcatcagccacttccacctggaccactgtggggccctgccctacttcagcgagatggtgggctatgatggccccatctacatgacccaccccacccaggccatctgccccatcctgctggaggactacaggaagattgctgtggacaagaagggggaggccaacttcttcaccagccagatgatcaaggactgcatgaacctgctggagaccttctgggagaggatgaacctgaaggtgcccatctacttcagcacaggcctgacagagaaggccaaccactactacaagctgttcatcccctggaccaaccagaagatcaggaagacctttgtgcagaggaacatgtttgagttcaagcacatcaaggcctttgaccgggcctttgctgacaaccctggccccatggtggtgtttgccaccccaggcatgctgcatgctggccagagcctgcagatcttcaggaagtgggccggaaatgagaagaacatggtgatcatgcctggctactgtgtgcagggcaccgtgggccacaagatcctgagcggccagaggaagctggagatggagggccggcaggtgctggaggtgaagatgcaggtggagtacatgtccttcagcgcccacgcagatgccaagggcatcatgcagctggtgtcctctgagcaggccctgaaggagctgggcctggccgagcaccagctgcgcttcacctgccgggtgcacctgcatgacaccaggaaggagcaggagacagccctgcgggtgtacagccacctgaagtctgtgctgaaggaccactgtgtgcagcacctgcctgatggctctgtgacagtggagagcgtgctgctgcaggccgccgcccccagtgaagatcctggcaccaaggtgctgctggtgtcctggacctaccaggatgaggagctgggcagcttcctgaccagcctgctgaagaagggcctgccccaggcccccagctag

SEQ ID NO: 18689 - DNA, 1863 bp, Artificial Sequence
  Description of Artificial Sequence: Synthetic coding sequence
atggagaaggctgtgaatgatggcagccacagcgaggagctgttctgccacctgaagaccatcagcgagaaggaggacctgccccgctgcaccagcgagagccacctgagctgcctgaagcaggacatcctgaatgagaagacagagctggaggccaccctgaaggaggccgagctggtgacccacagcgtggagctgctgctgcccctcttcaaggacaccatcgagaagatcaactttgaaaatgccaacctgagcgccctgaacctgaagatcagcgagcagaaggagatcctgatcaaggagctggacaccttcaagtctgtgaagctggccctggagcacctgctgaggaagagggactacaagcagacaggagacaacctgagctccatgctgctggagaacctgacagacaatgaaagtgagaacaccaacctgaagaagaaggtgtttgagaaggaggcccacatccaggagctgagctgcctcttccagagcgagaaggccaacaccctgaaggccaaccgcttcagccagagcgtgaaggtggtgcatgagcggctgcagatccagatccacaagcgggaggctgaaaatgacaagctgaaggagtatgtgaagagcctggagaccaagatcgccaagtggaacctgcagagcaggatgaacaagaatgaggccatcgtgatgaaggaggccagccggcagaagacagtggccctgaagaaggccagcaaggtgtacaagcagaggctggaccacttcaccggggccatcgagaagctgaccagccagatccgggaccaggaggccaagctgtctgagaccatcagcgccagcaatgcctggaagagccactatgagaagatcgtgattgagaagacagagctggaggtgcagatcgagaccatgaagaagcagatcatcaacctgctggaggacctgaagaagatggaggaccacggcaagaacagctgtgaggagatcctgaggaaggtgcacagcattgaatatgaaaatgagaccctgaacctggagaacaccaagctgaagaccaccctggccgccctgaaggatgaggtggtgtctgtggagaatgagctgtctgagctgcaggaggtggagaagaagcagaagaccctgattgagatgtacaagacccaggtgcagaagctgcaggaggccgctgagatcgtgaagagccgctgtgagaacctgctgcacaagaacaaccagatcaccaagaccaagaacaagaatgtggagaagatgaggggccagatggagagccacctgaaggagctggagcgggtgtgtgacagcctgacagctgctgagcggcggctgcacgagtgccaggagagcctgcagtgctgcaagggcaaatgtgccgaccaggagcacaccatccgggagctgcagggccagatcctgaagcagtgggaggagtacagcgtgctggcctgggtggatggcaaccacaacctgctgaccaagctgagcctggaggaggagaactgcctgatccagctgaagtgtgagaacctgcagcagaagctggagcagatggatgctgagaacaaggagctggagaagaagctggccaaccaggaggagtgcctgaagcacagcaacctgaagttcaaggagaagtctgctgagtacacagccctggcccggcagctggaggccgccctggaggagggccggcagaaggtggccgaggagattgagaagatgagcagccgggagagcgccctgcagatcaagatcctggacctggagacagagctgaggaagaagaatgaggagcagaaccagctggtgtgcaagatgaacagcgaccctgagaccccctag

SEQ ID NO: 18690 - DNA, 465 bp, Artificial Sequence
  Description of Artificial Sequence: Synthetic coding sequence
atgagcaagaacacagtgagcagcgcccgcttcaggaaggtggatgtggatgaatatgatgagaacaagtttgtggatgaggaggatggaggagatggccaggccggcccagatgaaggagaggtggacagctgcctgcggcacagcatcactggaaacatgacagctgccctgcaggccgccctgaagaacccccccatcaacaccaagagccaggccgtgaaggaccgggccggcagcatcgtgctgaaggtgctgatctccttcaaggccaatgacatcgagaaggctgtgcagagcctggacaagaatggagtggacctgctgatgaagtacatctacaagggctttgagagccccagcgacaacagcagcgccatgctgctgcagtggcatgagaaggccctggccgccggcggcgtgggcagcatcgtgcgggtgctgacagccaggaagacagtgtag

SEQ ID NO: 18691 - DNA, 2946 bp, Artificial Sequence
  Description of Artificial Sequence: Synthetic coding sequence
atgtctgagcaggagcgcatccaggagtgcctgaggaaggagatccgcagcctgctgatcagcaccaaggatggcctgagcccccaggagctggagaaggagtacctgctgatggtgggcaaccacctgcccctgcgcatcctgggctaccgcagcaccatggagctggtgctggacatgccagatgtggtgcgggtgtgccctggggccggcggcaccgtcatcctgaaggccatcccagatgagagcaccaagggcatcgccagcctggtggccaagcagaggagcagccacaagctgagaaattccatgcacaagggccggcccagcatctacagcggccccaggagccacagaagagtgccctaccggggccgggtggcccccatcctgcctgctgtggtgaagtctgagctgaaggacctgctggccctgagccctgtgctgctgagtgactttgagaaggcctttgccaagagatttggccgctccttccagtacatgcagtatggcttcctgtccatgtttgaggtgctgaatgctgccagtgatgtgatctctgtggagcagaccagggctggcagcctgctgatgctgaagaagtctgtgacagaggagaagccccggggctgcccagctgggaagatcttcacccagcccttcaggatgaagcagggcagctacagcacaggcttccctgtggccaagccctgcttcagccagcccaccagcaacatggagccccccaagcagatcatgtccatggagaagaccagcaagctgaatgtggtggagaccagccggctgaaccacacagagaagctgaaccagctggagaacaccttcaagagcgtcatcgcccagatcggccctgggggcaccatcagcagcgagctgaagcacaagatcaagtttgtggtgtccaagtttcctgagggcctcttcatcagcaagctgctgggggagtatgaagtcatcttcaaggagcagctgagccccaagaagctgggcttcctgaatgtgacagagctggtgggcgccctgagtgacatcctgcacgtggagttcaggaagggccaccaggacctgctggtgtttgatgctgacaagaagcccctgccccctgtgcagagcgacaagaagattgaggccaaggcctgtgtgagcagccccccaagaaacagcctgagcacagctgctgtgaaggagaccgtgtggaactgccccagcaagaagcagaaggagccccagcagaagatctgcaagaagcccaacctggtggtgaagcccctgcagctgcaggtggagaccaacaagtctgagctgaacctggccatggccaaccacgacatccccccagatgctgtgcccaacaagaagctgtgccgcctgccccccctggacaccagcagcctgattggagtgtttgtggagtacatcatcagccccagccagttctacatccgcatctacagccgggacagcagcgagctgctggaggacatgatgattgagatgaggcgctgctacagcaaccagctggtgtctgacagatatgtgatgcctgagtgcttcatccagcccggccacctgtgctgcgtgcgcatcagcgaggacaagtggtggtacagagtcatcatccaccgggtgctggagaagcaggaggtggaggtgttctacccagactttggaaacatcggcatcgtgcagaagagcagcctgcgcttcctgaagtgctgctacaccaagctgcctgcccaggccatcccctgcagcctggcctgggtgcggcctgtggaggagcactggaccagcaaggccatcctgcagttccagaagctgtgtggcctgaagcccctggtgggcgtggtggatgaatatgtggatggcatcctgaacatcttcctgtgtgacaccagcagcaatgaagatgtgtacttccaccacgtgctgaggacagagggccacgccatcgtgtgccgggagaacatcagcagcaagggcttcagcgagctgaaccccctggccctgtacaccaccagcagcggcggccctgaggacatcgtgctgacagagctgggctaccccagccagcagcactacttcaatgaagacaggaagatcagcccccagagcaaggagagcgagctgcgcatcctggatgagatccccaccggcatgccctgcctggagagcgtgaccatcggagatgacatctgggatgagaactggctgcccctgcaggccaagatgggcaaaggaggagatgctgccagccacctgttcaccgccagcctgggcggcaagaaccagtacagcagctgcaaggagatgccccagaaggactggtgcttcagcacccccaaggacacctgggatgacagctggcagcccagcggcctggtgaatggcaccaaggtggaggtgcacaagccagaggtgctgggcgcccaggagaagaacacaggcaccaacagaacccagaagcagctggacatcaatggcagcagtgacagcagcaccctgcccaagctggaggagttctgcaccagcctgacccagagcgagcagagcgcagatggcagccagagcgagcccaacaacagccagacccagcccaagcagatccagctgagcacagctgccccctgcagcaccacagctgtggatgacagcgctgagaagcccagcggctctgtggagagcagccctgagatcctgaagaatgaagacttcagcagcagccgggccatcaccctgtacaaggacaagaggcaggagagcgtggaccagctgagcctcatcctgtcctatgagtgccagatcagccagaagctgtacatccccaggagcacagccacagctgccctgggcgccgccgcccggctggccaccagccgcagcctgctgcactggtaccccagcgtgaagaggatggaggcctag

SEQ ID NO: 18692 - DNA, 909 bp, Artificial Sequence
  Description of Artificial Sequence: Synthetic coding sequence
atggagatccaggagctggaggagatccaggcctgccagggcctgtgggaggtgtttgtgaccctgtctgagcgggcccgggactacctgcacaagacaggccgcttcatcgtgattggaggcatcgtgtcccctgtgcatgacagctatggcaagcagggcctggtgagcagccgccacaggctcatcatgtgccagctggccgtgcagaacagcgactggatccgggtggacccctgggagtgctaccaggacacctggcagaccacctgcagcgtgctggagcaccaccgggacctgatgaagagggtgacaggctgcatcctgagcaatgtgaacacccccagcatgacccctgtgattggccagccccagaatgagaccccccagcccatctaccagaacagcaatgtggccaccaagcccacagctgccaagatcctgggcaaggtgggggagagcctgagccgcatctgctgcgtgcggccccctgtggagcgcttcacctttgtggatgaaaatgccaacctgggcaccgtgatgagatatgaggagattgagctgcgcatcctgctgctgtgtggcagtgacctgctggagagcttctgcatccctggcctgtggaatgaagctgacatggaggtgattgtgggggactttggcatcgtggtggtgcccagagatgctgctgacacagaccgcatcatgaaccacagcagcatcctgaggaagtacaagaacaacatcatggtggtgaaggatgacatcaaccaccccatgtctgtggtgagcagcaccaagagccggctggccctgcagcacggagatggccacgtggtggactacctgagccagcccgtcatcgactacatcctgaagagccagctgtacatcaatgccagcggctag

SEQ ID NO: 18693 - DNA, 861 bp, Artificial Sequence
  Description of Artificial Sequence: Synthetic coding sequence
atggagcggcggctgggcgtgcgggcctgggtgaaggaaaatagaggcagcttccagccccctgtgtgcaacaagctgatgcaccaggagcagctgaaggtgatgtttattggaggccccaacaccaggaaggactaccacatcgaggagggggaggaggtgttctaccagctggagggggacatggtgctgcgggtgctggagcagggcaagcacagagatgtggtgatccggcagggcgagatcttcctgctgcctgcccgggtgccccacagcccccagagatttgccaacacagtgggcctggtggtggagcggcggcggctggagacagagctggatggcctgcgctactacgtgggggacaccatggatgtgctgtttgagaagtggttctactgcaaggacctgggcacccagctggcccccatcatccaggagttcttcagcagcgagcagtacagaacaggcaagcccatcccagaccagctgctgaaggagccccccttccccctgagcaccaggagcatcatggagcccatgagcctggatgcctggctggacagccaccaccgggagctgcaggccggcacccccctgagcctgtttggagacacctatgagacccaggtgattgcctacggccagggcagcagcgagggcctgcggcagaatgtggatgtgtggctgtggcagctggagggcagctctgtggtgaccatgggcggccggcggctgagcctggccccagatgacagcctgctggtgctggccggcaccagctatgcctgggagaggacccagggctctgtggccctgtctgtgacccaggaccctgcctgcaagaagcccctgggctag

SEQ ID NO: 18694 - DNA, 1545 bp, Artificial Sequence
  Description of Artificial Sequence: Synthetic coding sequence
atgcaggagagcggctgccgcctggagcaccccagcgccaccaagttcagaaatcatgtgatggagggggactgggacaaggcagaaaatgacctgaatgagctgaagcccctggtgcacagcccccacgccatcgtggtgcggggggccctggagatcagccagaccctgctgggcatcatcgtgaggatgaagttcctgctgctgcagcagaagtacctggagtacctggaggatggcaaggtgctggaggccctgcaggtgctgcgctgtgagctgacccccctgaagtacaacacagagcgcatccacgtgctgagcggctacctgatgtgcagccatgctgaggacctgcgggccaaggccgagtgggagggcaaaggaacagccagccgcagcaagctgctggacaagctgcagacctacctgccccccagcgtgatgctgcccccccggcggctgcagaccctgctgcggcaggccgtggagctgcagagggaccgctgcctgtaccacaacaccaagctggacaacaacctggacagcgtgtccctgctgattgaccacgtgtgcagccggcggcagttcccctgctacacccagcagatcctgacagagcactgcaatgaggtgtggttctgcaagttcagcaatgatggcaccaagctggccaccggcagcaaggacaccaccgtcatcatctggcaggtggaccctgacacccacctgctgaagctgctgaagaccctggagggccacgcctatggagtgtcctacatcgcctggagcccagatgacaactacctggtggcctgtggcccagatgactgcagcgagctgtggctgtggaatgtgcagacaggagagctgcggaccaagatgagccagagccatgaggacagcctgacctctgtggcctggaacccagatggcaagagatttgtgactggaggccagaggggccagttctaccagtgtgacctggatggcaacctgctggacagctgggagggcgtgcgggtgcagtgcctgtggtgcctgagtgatggcaagacagtgctggccagtgacacccaccagaggatccggggctacaactttgaggacctgacagacagaaatattgtgcaggaggaccaccccatcatgtccttcaccatcagcaagaatggccgcctggccctgctgaatgtggccacccagggcgtgcacctgtgggacctgcaggacagagtgctggtgaggaagtaccagggcgtgacccagggcttctacaccatccacagctgctttggaggccacaatgaagacttcatcgccagcggcagcgaggaccacaaggtgtacatctggcacaagaggtctgagctgcccatcgccgagctgaccggccacaccaggacagtgaactgtgtgtcctggaacccccagatccccagcatgatggccagcgccagtgatgatggcaccgtgcgcatctggggccctgcccccttcatcgaccaccagaacatcgaggaggagtgcagctccatggacagctag

SEQ ID NO: 18695 - DNA, 540 bp, Artificial Sequence
  Description of Artificial Sequence: Synthetic coding sequence
atgggcatcctcttcacccgcatctggaggctcttcaaccaccaggagcacaaggtgatcatcgtgggcctggacaatgccggcaagaccaccatcctgtaccagttctccatgaatgaggtggtgcacaccagccccaccatcggcagcaatgtggaggagatcgtcatcaacaacacccgcttcctgatgtgggacattggaggccaggagagcctgcggagctcctggaacacctactacaccaacacagaatttgtgattgtggtggtggacagcacagaccgggagcgcatctctgtgacccgggaggagctgtacaagatgctggcccacgaggacctgaggaaggccggcctgctgatctttgccaacaagcaggatgtgaaggagtgcatgacagtggccgagatcagccagttcctgaagctgaccagcatcaaggaccaccagtggcacatccaggcctgctgtgccctgactggagagggcctgtgccagggcctggagtggatgatgagccggctgaagatcagatag

SEQ ID NO: 18696 - DNA, 1428 bp, Artificial Sequence
  Description of Artificial Sequence: Synthetic coding sequence
atgcagaagagcaccaacagcgacacctctgtggagaccctgaacagcacccggcagggcactggagctgtgcagatgaggatcaagaatgccaacagccaccacgaccggctgagccagagcaagtccatgatcctgacagatgtgggcaaggtgacagagcccatcagccgccacagaagaaaccacagccagcacatcctgaaggatgtgattcctcccctggagcagctgatggtggagaaggagggctacctgcagaaggccaagattgctgatggcggcaagaagctgaggaagaactggagcacctcctggatcgtgctgagcagccgccgcatcgagttctacaaggagagcaagcagcaggccctgagcaacatgaagacaggccacaagccagagagcgtggacctgtgtggggcccacatcgagtgggccaaggagaagagcagcaggaagaatgtgttccagatcaccaccgtgtctggaaatgagttcctgctgcagagcgacatcgacttcatcatcctggactggttccacgccatcaagaatgccatcgaccggctgcccaaggacagcagctgccccagcaggaacctggagctgttcaagatccagaggagcagcagcacagagctgctgagccactatgacagcgacatcaaggagcagaagccagagcacaggaagagcctgatgttccggctgcaccacagcgccagtgacaccagtgacaagaacagagtgaagagccggctgaagaagttcatcacccggcggcccagcctgaagaccctgcaggagaagggcctcatcaaggaccagatcttcggcagccacctgcacaaggtgtgtgagcgggagaacagcacagtgccctggtttgtgaagcagtgcatcgaggccgtggagaagaggggcctggatgtggatggcatctacagagtgtctggcaacctggccaccatccagaagctgcgcttcatcgtgaaccaggaggagaagctgaacctggatgacagccagtgggaggacatccacgtggtgactggagccctgaagatgttcttccgggagctgcctgagcccctcttcccctacagcttctttgagcagtttgtggaggccatcaagaagcaggacaacaacacccgcatcgaggccgtgaagagcctggtgcagaagctgcccccacccaacagagacaccatgaaggtgctgtttggccacctgaccaagatcgtggccaaggccagcaagaacctgatgagcacccagagcctgggcatcgtgtttggccccaccctgctgcgggcagaaaatgaaacaggcaacatggccatccacatggtgtaccagaaccagattgctgagctgatgctgtctgagtacagcaagatcttcggcagcgaggaggactag

SEQ ID NO: 18697 - DNA, 1308 bp, Artificial Sequence
  Description of Artificial Sequence: Synthetic coding sequence
atggcccagacagtgcccccctgtgagctgccctgcaaggagtatgatgtggccagaaatactggagcctacaccagcagcggcctggccacagccagcttccgcaccagcaagtacctgctggaggagtggttccagaactgctacgcccgctaccaccaggcctttgctgaccgggaccagagcgagcggcagagacatgagagccagcagctggccacagagacccaggccctggcccagaggacccagcaggacagcaccaggacagtgggggagcggctgcaggacacccacagctggaagtctgagctgcagcgggagatggaggccctggccgctgagaccaacctgctgctggcccagaagcagaggctggagcgggccctggatgccacagaggtgcccttcagcatcaccacagacaacctgcagtgccgggagcggcgggagcaccccaacctggtgcgggaccacgtggagacagagctgctgaaggaggccgagctgatccggaacatccaggagctgctgaagaggaccatcatgcaggccgtgtcccagatccggctgaaccgggagcacaaggagacctgtgagatggactggagcgacaagatggaggcctacaacattgatgagacctgtggccgccaccacagccagagcacagaggtgcaggcccacccctacagcaccaccttccaggagagcgccagcaccccagagacccgggccaagttcacccaggacaacctgtgccgggcccagcgggagcggctggccagcgccaacctgcgggtgctggtggactgcatcctgcgggacaccagcgaggacctgcggctgcagtgtgatgctgtgaacctggccttcggccgccgctgtgaggagctggaggatgcccgctacaagctgcaccaccacctgcacaagaccctgcgggagatcacagaccaggagcacaacgtggccgccctgaagcaggccatcaaggacaaggaggcccccctgcacgtggcccagacccggctgtacctgcggagccaccggcccaacatggagctgtgcagagatgctgcccagttccggctgctgtctgaggtggaggagctgaacatgagcctgacagccctgcgggagaagctgctggaggccgagcagagcctgaggaacctggaggacatccacatgagcctggagaaggacattgctgccatgaccaacagcctcttcatcgaccggcagaagtgcatggcccacaggacccgctaccccaccatcctgcagctggccggctaccagtag

SEQ ID NO: 18698 - DNA, 828 bp, Artificial Sequence
  Description of Artificial Sequence: Synthetic coding sequence
atgaggaagaggctgagcgcccctgagctgcggctgagcctgaccaagggccctggaaatgatggagccagccccacccagagcgcccccagcagcccagatggcagcagtgacctggagattgatgagctggagacccccagcgacagcgagcagctggacagcggccatgaatttgagtgggaggatgagctgcccagggctgagggcctgggcaccagcgagacagctgagcggctgggccggggctgcatgtgggatgtgactggagaagatggccaccactggagggtcttcaggatgggcccccgggagcagagggtggacatgacagtgattgagccctacaagaaggtgctgagccacggcggctaccatggagatggcctgaatgctgtgatcctgtttgccagctgctacctgcccaggagcagcatccccaactacacctacgtgatggagcacctgttccgctacatggtgggcaccctggagctgctggtggccgagaactacctgctggtgcacctgagcggcggcaccagccgggcccaggtgccccccctgtcctggatccggcagtgctaccgcaccctggaccggcggctgaggaagaacctgcgggccctggtggtggtgcacgccacctggtacgtgaaggccttcctggccctgctgcggcccttcatcagcagcaagttcaccaggaagatccgcttcctggacagcctgggggagctggcccagctgatcagcctggaccaggtgcacatccctgaggccgtgcggcagctggaccgggacctgcacggcagcggcggcacctag

SEQ ID NO: 18699 - DNA, 2391 bp, Artificial Sequence
  Description of Artificial Sequence: Synthetic coding sequence
atggaggaggaggccagccgctctgctgctgccaccaaccctggcagccggctgacccgctggcccccaccagacaagcgggagggcagcgctgtggaccccgggaagagaagaagcctggccgccacccccagcagcagcctgccctgcaccctgattgccctgggcctgcggcatgagaaggaggccaatgagctgatggaggacctgtttgagaccttccaggatgagatgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcctcttcaccaaggccgaggacaacaagtacctgctgacctgcaagacagcccggcagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgaccagggcctggagaaggacaacagcgagctgggcagcgagacccgctaccccctgctgctgcccaagggcgtggtgctgaagctgaagcctgtggccgaccgcttccccaagaaggcctggaggcagaagaggagctctgtgctgaagcccctgctgatccagcccagccccagcctgcagcccagcttcaaccctgggaagaccccagcccagagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgccatgcctcctgaggcccggaccagcttccccctgtctgagagccagaccctgctgagcagcgcccctgtgcccaaggtgatgatgcccagccctgccagctccatgttcaggaagccctacgtgagaagaagacccagcaagagaagaggagcccgggccttccgctgcatcaagccagcccctgtgatccacccagccagcgtcatcttcaccgtgcctgccaccaccgtgaagatcgtgtccctgggcggcggctgcaacatgatccagcctgtgaatgctgctgtggcccagagcccccagaccatccccatcgccaccctgctggtgaaccccaccagcttcccctgccccctgaaccagcccctggtggccagctctgtgagccccctgattgtgtctggcaacagcgtgaacctgcccatccccagcaccccagaggacaaggcccacatgaatgtggacatcgcctgtgctgtggctgatggagaaaatgccttccagggcctggagcccaagctggagccccaggagctgagccccctgagcgccaccgtcttccccaaggtggagcacagccctggccccccacctgtggacaagcagtgccaggagggcctgtctgagaacagcgcctaccgctggacagtggtgaagacagaggagggccggcaggccctggagcccctgccccagggcatccaggagagcctgaacaacagcagccctggggacctggaggaggtggtgaagatggagccagaagatgccacagaggagatcagcggcttcctgtag

SEQ ID NO: 18700 - DNA, 1380 bp, Artificial Sequence
  Description of Artificial Sequence: Synthetic coding sequence
atggccgccagcgccagcgctgctgctggggaggaggactgggtgctgcccagcgaggtggaggtgctggagagcatctacctggatgagctgcaggtgatcaagggaaatggaagaaccagcccctgggagatctacatcaccctgcacccagccacagctgaggaccaggacagccagtatgtgtgcttcaccctggtgctgcaggtgcctgctgagtacccccatgaggtgccccagatcagcatccggaacccccggggcctgagtgatgagcagatccacaccatcctgcaggtgctgggccacgtggccaaggccggcctgggcacagccatgctgtatgagctgattgagaagggcaaggagatcctgacagacaacaacatcccccacggccagtgtgtgatctgcctgtatggcttccaggagaaggaggccttcaccaagaccccctgctaccactacttccactgccactgcctggcccgctacatccagcacatggagcaggagctgaaggcccagggccaggagcaggagcaggagcggcagcacgccaccaccaagcagaaggctgtgggcgtgcagtgccctgtgtgccgggagcccctggtgtatgacctggccagcctgaaggccgcccctgagccccagcagcccatggagctgtaccagcccagcgctgagagcctgcggcagcaggaggagaggaagaggctgtaccagaggcagcaggagcggggcggcatcatcgacctggaggccgagaggaaccgctacttcatcagcctgcagcagcccccagccccagctgagcctgagagcgctgtggatgtgtccaagggcagccagccccccagcaccctggccgctgagctgagcaccagccctgctgtgcagagcaccctgcccccacccctgcctgtggccacccagcacatctgtgagaagatccctggcaccaggagcaaccagcagaggctgggggagacccagaaggccatgctggacccccccaagcccagccggggcccctggaggcagcctgagcggcggcaccccaagggaggagaatgtcatgcccccaagggcacccgggacacccaggagctgcccccacctgagggccccctgaaggagcccatggacctgaagccagagccccacagccagggcgtggagggccccccccaggagaagggccctggctcctggcagggccccccacccaggaggacccgggactgtgtgcgctgggagaggagcaagggccgcaccccaggcagcagctacccccggctgccccggggccagggcgcctaccggcccggcacccggcgggagagcctgggcctggagagcaaggatggcagctag

SEQ ID NO: 18701 - DNA, 2079 bp, Artificial Sequence
  Description of Artificial Sequence: Synthetic coding sequence
atgggcagcgctgctgatgtgcgcttcagcctgggcaccaccacccacgcccctcctggggtgcaccggcgctacagcgccctgcgggaggagagcgccaaggactgggagaccagccccctgcccggcatgctggccccagctgctggccctgcctttgacagcgaccctgagatcagtgatgtggatgaagatgagcccggcggcctggtgggcagcgcagatgtggtgagccccagcggccacagtgatgcccagaccctggccatgatgctgcaggagcagctggatgccatcaatgaggagatccgcatgatccaggaggagaaggagagcacagagctgcgggcagaggagattgagaccagggtgaccagcggctccatggaggccctgaacctgaagcagctgaggaagaggggcagcatccccaccagcctgacagccctgagcctggccagcgccagcccccccctgagcggccgcagcacccccaagctgaccagccgctctgctgcccaggacctggacaggatgggcgtgatgaccctgcccagcgacctgaggaagcacaggaggaagctgctgagccctgtgtcccgggaggagaaccgggaggacaaggccaccatcaagtgtgagaccagcccccccagcagccccaggaccctgcggctggagaagctgggccacccagccctgagccaggaggagggcaagagcgccctggaggaccagggcagcaaccccagcagcagcaacagcagccaggacagcctgcacaagggggccaagaggaagggcatcaagagcagcatcggccgcctgtttgggaagaaggagaagggccgcctcatccagctgagcagagatggagccaccggccacgtgctgctgacagacagcgagttctccatgcaggagcccatggtgcctgccaagctgggcacccaggccgagaaggaccggcggctgaagaagaagcaccagctgctggaggatgcccggaggaagggcatgccctttgcccagtgggatggccccaccgtggtgtcctggctggagctgtgggtgggcatgcctgcctggtacgtggccgcctgccgggccaacgtgaagagcggggccatcatgtctgccctgagtgacacagagatccagcgggagatcggcatcagcaatgccctgcaccggctgaagctgcggctggccatccaggagatggtgtccctgaccagccccagcgccccacccaccagcaggaccagcagtggaaatgtgtgggtgacccatgaggagatggagaccctggagaccagcaccaagaccaccctggcctatggagacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagaagagaagagaggagagccagcacgagatcaaggatgtgctggtgtggaccaatgaccaggtggtgcactgggtgcagagcatcggcctgcgggactatgccggcaacctgcatgaaagtggagtgcacggggccctgctggccctggatgagaactttgaccacaacaccctggccctgatcctgcagatccccacccagaacacccaggcccggcaggtgatggagcgggagttcaacaacctgctggccctgggcacagacaggaagctggatgatggagatgacaaggtgttcagaagagcccccagctggaggaagcgcttccggccccgggagcaccacggccggggcggcatgctgagcgccagcgctgagaccctgcctgctggcttccgggtgtccaccctgggcaccctgcagcccccaccagccccacccaagaagatcatgcctgaggcccacagccactacctgtatggccacatgctgagcgccttccgggactag

SEQ ID NO: 18702 - DNA, 369 bp, Artificial Sequence
  Description of Artificial Sequence: Synthetic coding sequence
atggccccccagaaggacaggaagcccaagaggagcacctggaggttcaacctggacctgacccaccctgtggaggatggcatctttgattctggcaactttgagcagttcctgcgggagaaggtgaaggtgaatggcaagacaggcaacctgggcaatgtggtgcacatcgagcgcttcaagaacaagatcaccgtggtgtctgagaagcagttcagcaagcgctacctgaagtacctgaccaagaagtacctgaagaagaacaacctgcgggactggctgcgggtggtggccagtgacaaggagacctatgagctgcgctacttccagatcagccaggatgaagatgagagcgagagtgaagattag

SEQ ID NO: 18703 - DNA, 936 bp, Artificial Sequence
  Description of Artificial Sequence: Synthetic coding sequence
atgcagtacatcagccacatctttggagtcatcaactgcaatggcttcaccctgagtgaccagaggggcctgcaggccgtgggcgtgggcatcttccccaacctgggcctggtgaaccacgactgctggcccaactgcaccgtcatcttcaacaacgggaagattgagctgcgggccctgggcaagatcagcgagggggaggagctgactgtgtcctacatcgacttcctgaatgtgtctgaggagaggaagaggcagctgaagaagcagtactactttgactgcacctgtgagcactgccagaagaagctgaaggatgacctcttcctgggcgtgaaggacaaccccaagcccagccaggaggtggtgaaggagatgatccagttcagcaaggacaccctggagaagattgacaaggcccggtctgagggcctgtaccacgaggtggtgaagctgtgcagagaatgtctggagaagcaggagcctgtgtttgctgacaccaacatctacatgctgaggatgctgagcatcgtgtctgaggtgctgagctacctgcaggcctttgaggaggccagcttctacgcccggaggatggtggatggctacatgaagctgtaccaccccaacaatgcccagctgggcatggctgtgatgagagctggcctgaccaactggcatgctggcaacatcgaggtgggccacggcatgatctgcaaggcctatgccatcctgctggtgacccacggccccagccaccccatcaccaaggacctggaggccatgagggtgcagacagagatggagctgaggatgttccggcagaatgagttcatgtactacaagatgagggaggccgccctgaacaaccagcccatgcaggtgatggccgagcccagcaatgagcccagccctgccctcttccacaagaagcagtag

SEQ ID NO: 18704 - DNA, 1542 bp, Artificial Sequence
  Description of Artificial Sequence: Synthetic coding sequence
atggccgagctgcagatgctgctggaggaggagatccctgggggccggcgggccctgtttgacagctacaccaacctggagcgggtggccgactactgtgagaacaactacatccagagcgctgacaagcagagggccctggaggagaccaaggcctacaccacccagagcctggcctctgtggcctacctgatcaacaccctggccaacaacgtgctgcagatgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacctggagaggcctgtgcgctacatcaggaagcccatcgactacaccatcctggatgacattggacatggagtgaagtggctgctgcgcttcaaggtgtccacccagaacatgaagatgggcggcctgcccaggaccaccccacccacccagaagccacccagcccccccatgtctgggaagggcaccctgggccgccacagcccctaccgcaccctggagcctgtgcggccccctgtggtgcccaatgactatgtgcccagccccaccaggaacatggcccccagccagcagagccctgtgaggacagcctctgtgaaccagaggaacagaacctacagcagcagcggcagcagcggcggcagccaccccagcagccgcagcagcagccgggagaacagcggcagcggctctgtgggcgtgcccatcgctgtgcccacccccagcccccccagcgtcttccctgccccagctggcagcgctggcaccccacccctgcctgccaccagcgccagcgccccagcccccctggtgcctgccaccgtgcccagcagcacagccccagatgctgctgctgggggcgcccagaccctggctgatggcttcaccagccccaccccacctgtggtgagcagcaccccacccaccggccaccctgtgcagttctacagcatgaacagacctgccagccgccacaccccacccaccatcggcggcagcctgccctaccgccggccccccagcatcaccagccagaccagcctgcagaaccagatgaatggaggccccttctacagccagaaccctgtgtctgacaccccacctcctcctcctcctgtggaggagcctgtgtttgatgagagccccccacctcctcctcctcctgaggactatgaggaggaggaggccgctgtggtggagtacagcgacccctatgcagaagaagatcctccctgggcccccaggagctacctggagaaggtggtggccatctatgactacaccaaggacaaggaggatgagctgtccttccaggagggcgccatcatctacgtgatcaagaagaatgatgatggctggtatgaaggagtgatgaatggagtgacaggcctcttccctggcaactacgtggagagcatcatgcactacagcgagtag

SEQ ID NO: 18705 - DNA, 1170 bp, Artificial Sequence
  Description of Artificial Sequence: Synthetic coding sequence
atgcccctggagaacctggaggaggagggcctgcccaagaacccagacctgagaattgcccagctgcgcttcctgctgagcctgcctgagcacagaggagatgctgctgtgagagatgagctgatggctgctgtgcgggacaacaacatggccccctactatgaggccctgtgcaagagcctggactggcagattgatgtggacctgctgaacaagatgaagaaggccaatgaagatgagctgaagaggctggatgaggagctggaggatgctgagaagaacctgggggagagcgagatcagagatgccatgatggccaaggccgagtacctgtgccgcatcggggacaaggagggcgccctgacagccttcaggaagacctatgacaagacagtggccctgggccaccggctggacatcgtgttctacctgctgagaattggcctcttctacatggacaatgacctgatcaccaggaacacagagaaggccaagagcctcatcgaggagggcggggactgggacagaagaaaccggctgaaggtgtaccagggcctgtactgtgtggccatccgggacttcaagcaggccgctgagctgttcctggacacagtgtccaccttcaccagctatgagctgatggactacaagacctttgtgacctacacagtgtatgtgtccatgattgccctggagaggccagacctgcgggagaaggtgatcaagggagctgagatcctggaggtgctgcacagcctgcctgctgtgcggcagtacctgttcagcctgtatgaatgtcgctacagcgtcttcttccagagcctggccgtggtggagcaggagatgaagaaggactggctgtttgccccccactaccgctactacgtgcgggagatgaggatccacgcctacagccagctgctggagagctaccgcagcctgaccctgggctacatggccgaggcctttggagtgggcgtggagttcatcgaccaggagctgagccgcttcatcgccgccggccgcctgcactgcaagattgacaaggtgaatgaaattgtggagaccaacagaccagacagcaagaactggcagtaccaggagaccatcaagaagggggacctgctgctgaacagagtgcagaagctgagcagggtcatcaacatgtag

SEQ ID NO: 18706 - DNA, 420 bp, Artificial Sequence
  Description of Artificial Sequence: Synthetic coding sequence
atggccaacattgctgtgcagaggatcaagcgggagttcaaggaggtgctgaagtctgaggagaccagcaagaaccagatcaaggtggacctggtggatgagaacttcacagagctgcggggggagattgctggccccccagacaccccctatgaaggaggccgctaccagctggagatcaagatccctgagacctaccccttcaacccccccaagtacaagcagaaccctgagatgttcaagcagacagcccggctgtgggcccacgtgtatgctggggcccctgtgagcagccctgagtacaccaagaagattgagaacctgtgtgccatgggctttgacagaaatgctgtgattgtggccctgagcagcaagtcctgggatgtggagacagccacagagctgctgctgagcaactag

SEQ ID NO: 18707 - DNA, 1203 bp, Artificial Sequence
  Description of Artificial Sequence: Synthetic coding sequence
atgaacttcaccgtgggcttcaagcccctgctgggagatgcccacagcatggacaacctggagaagcagctgatctgccccatctgcctggagatgttcagcaagcctgtggtgatcctgccctgccagcacaacctgtgcaggaaatgtgccaatgatgtgttccaggccagcaaccccctgtggcagagccggggcagcaccaccgtgagcagcggcggccgcttccgctgccccagctgcagacatgaggtggtgctggacagacatggagtgtatggcctgcagaggaacctgctggtggagaacatcatcgacatctacaagcaggagagcagccggcccctgcacagcaaggccgagcagcacctgatgtgtgaggagcacgaggaggagaagatcaacatctactgcctgagctgtgaggtgcccacctgcagcctgtgcaaggtgtttggagcccacaaggactgtgaggtggcccccctgcccaccatctacaagaggcagaagaagcaggacctgaccctgctgccccggctggagtgcagcggcaccaacaccacctactgcagcctggacctgcccagcagcagtgacccccccatcctggccagccagaacaccaagatcatcgacagcgagctgagtgatggcatcgccatgctggtggccggaaatgacagagtgcaggccgtcatcacccagatggaggaggtgtgccagaccatcgaggacaacagccggcggcagaagcagctgctgaaccagagatttgagagcctgtgtgctgtgctggaggagaggaagggggagctgctgcaggccctggcccgggagcaggaggagaagctgcagagggtgcggggcctcatccggcagtatggagaccacctggaggccagcagcaagctggtggagagcgccatccagagcatggaggagccccagatggccctgtacctgcagcaggccaaggagctgatcaacaaggtgggcgccatgagcaaggtggagctggccggccggcctgagcccggctatgagagcatggagcagttcaccgtgcgggtggagcacgtggccgagatgctgcggaccatcgacttccagcccggggccagcggggaggaggaggaggtggccccagatggagaggagggcagcgctggccctgaggaggagaggccagatggcccctag

SEQ ID NO: 18708 - DNA, 198 bp, Artificial Sequence
  Description of Artificial Sequence: Synthetic coding sequence
atgttcctgtctgctgtgttctttgccaagagcaagagcaagaacatcctggtgaggatggtgtctgaggccggcaccggcttctgcttcaacaccaagaggaaccggctgcgggagaagctgaccctgctgcactatgaccctgtggtgaagcagagggtgctgtttgtggagaagaagaagatccgcagcctgtag

SEQ ID NO: 18709 - DNA, 2919 bp, Artificial Sequence
  Description of Artificial Sequence: Synthetic coding sequence
atgaggcctgagggcgccggcatggagctgggcggcggggaggagcggctgcctgaggagagccggcgggagcactggcagctgctgggcaacctgaagaccaccgtggagggcctggtgtccaccaacagccccaacgtgtggagcaaatatggaggcctggagcggctgtgccgggacatgcagagcatcctgtaccacggcctcatccgggaccaggcctgccggcggcagacagactactggcagtttgtgaaggacatccgctggctgagcccccacagcgccctgcacgtggagaagttcatctctgtgcatgaaaatgaccagagcagcgcagatggagccagcgagagagctgtggccgagctgtggctgcagcacagcctgcagtaccactgcctgagcgcccagctgcggcccctgctgggggaccggcagtacatcaggaagttctacacagatgctgccttcctgctgagtgatgcccacgtgacagccatgctgcagtgcctggaggccgtggagcagaacaacccccggctgctggcccagattgatgcctccatgtttgccaggaagcatgagagccccctgctggtgaccaagagccagagcctgacagccctgcccagcagcacctacaccccacccaacagctatgcccagcacagctacttcggcagcttcagcagcctgcaccagagcgtgcccaacaacggcagcgagcggcgcagcaccagcttccccctgagcggcccccccaggaagccccaggagagccggggccacgtgtccccagctgaggaccagaccatccaggcccctcctgtgtctgtgtctgccctggcccgggacagccccctgaccccaaatgagatgagcagcagcaccctgaccagccccatcgaggcctcctgggtgagcagccagaatgacagccctggagatgccagcgagggccctgagtacctggccatcggcaacctggacccccggggccgcacagccagctgccagagccacagcagcaatgctgagagcagcagcagcaacctcttcagcagcagcagcagccagaagccagacagcgctgccagcagcctgggggaccaggagggcggcggggagagccagctgagctctgtgctgcggcgcagcagcttcagcgagggccagaccctgactgtgaccagcggggccaagaagagccacatccgcagccacagcgacaccagcatcgccagcagaggagcccctgagagctgcaatgacaaggccaagctgcggggccccctgccctacagcggccagagcagcgaggtgtccacccccagcagcctgtacatggagtatgagggcggccgctacctgtgcagcggggagggcatgttccggcggcccagcgagggccagagcctcatctcctacctgtctgagcaggactttggcagctgtgccgacctggagaaggaaaatgcccacttcagcatcagcgagagcctgattgctgccatcgagctgatgaagtgcaacatgatgagccagtgcctggaggaggaggaggtggaggaggaggacagcgaccgggagatccaggagctgaagcagaagatccggctgcggcggcagcagatccgcaccaagaacctgctgcccatgtaccaggaggccgagcacggcagcttccgggtgaccagcagcagcagccagttcagcagccgggacagcgcccagctgagtgacagcggcagcgcagatgaggtggatgaatttgagatccaggatgctgacatcagaagaaacacagccagcagcagcaagagctttgtgagcagccagagcttcagccactgcttcctgcacagcaccagcgctgaggccgtggccatgggcctgctgaagcagtttgagggcatgcagctgcctgctgccagcgagctggagtggctggtgcctgagcatgatgccccccagaagctgctgcccatcccagacagcctgcccatcagcccagatgatggccagcacgccgacatctacaagctgcgcatccgggtgcggggcaacctggagtgggccccaccccggccccagatcatcttcaacgtgcacccagcccccaccaggaagattgctgtggccaagcagaactaccgctgtgccggctgcggcatcagaacagatcctgactacatcaagaggctgcgctactgtgagtacctgggcaagtacttctgccagtgctgccatgaaaatgcccagatggccatccccagccgggtgctgaggaagtgggacttcagcaagtactacgtgagcaacttcagcaaggacctgctgatcaagatctggaatgaccccctcttcaacgtgcaggacatcaacagcgccctgtacaggaaggtgaagctgctgaaccaggtgcggctgctgcgggtgcagctgtgccacatgaagaacatgttcaagacctgccgcctggccaaggagctgctggacagctttgacacagtgcccggccacctgacagaggacctgcacctgtacagcctgaatgacctgacagccaccaggaagggggagctgggcccccggctggccgagctgaccagggctggggccacccacgtggagcgctgcatgctgtgccaggccaagggcttcatctgtgagttctgccagaatgaagatgacatcatcttcccctttgagctgcacaagtgcaggacctgtgaggagtgcaaggcctgctaccacaaggcctgcttcaagagcggcagctgcccccgctgtgagcggctgcaggcccggcgggaggccctggcccggcagagcctggagagctacctgagtgactatgaggaggagcctgctgaggccctggccctggaggccgctgtgctggaggccacctag

SEQ ID NO: 18710 - DNA, 1161 bp, Artificial Sequence
  Description of Artificial Sequence: Synthetic coding sequence
atggctgctgtggagaccagggtgtgtgaaacagatggctgcagcagcgaggccaagctgcagtgccccacctgcatcaagctgggcatccagggcagctacttctgcagccaggagtgcttcaagggctcctgggccacccacaagctgctgcacaagaaggccaaggatgagaaggccaagcgggaggtgtcctcctggacagtggagggggacatcaacacagacccctgggccggctaccgctacaccgggaagctgcggccccactaccccctgatgcccaccaggcctgtgcccagctacatccagaggccagactatgctgaccaccccctgggcatgtctgagagcgagcaggccctgaagggcaccagccagatcaagctgctgagcagcgaggacatcgagggcatgaggctggtgtgccgcctggcccgggaggtgctggatgtggccgccggcatgatcaagccaggagtgaccacagaggagattgaccatgctgtgcacctggcctgcatcgccaggaactgctaccccagccccctgaactactacaacttccccaagagctgctgcacctctgtgaatgaggtgatctgccacggcatcccagaccggcggcccctgcaggagggggacatcgtgaatgtggacatcaccctgtacagaaatggctaccatggagacctgaatgagaccttctttgtgggggaggtggatgatggagccaggaagctggtgcagaccacctatgagtgcctgatgcaggccattgatgctgtgaagccaggagtgcgctaccgggagctgggcaacatcatccagaagcacgcccaggccaacggcttctctgtggtgcgcagctactgcggccacggcatccacaagctgttccacacagccccaaatgtgccccactacgccaagaacaaggctgtgggcgtgatgaagagcggccacgtgttcaccatcgagcccatgatctgtgagggcggctggcaggatgagacctggccagatggctggacagctgtgaccagagatggcaagaggtctgcccagtttgagcacaccctgctggtgacagacaccggctgtgagatcctgacccggcggctggacagcgcccggccccacttcatgagccagttctag

SEQ ID NO: 18711 - DNA, 738 bp, Artificial Sequence
  Description of Artificial Sequence: Synthetic coding sequence
atgggccgcctggatggcaaggtgatcatcctgacagctgctgcccagggcatcggccaggccgccgccctggcctttgcccgggagggcgccaaggtgattgccacagacatcaatgaaagcaagctgcaggagctggagaagtacccaggcatccagaccagggtgctggatgtgaccaagaagaagcagattgaccagtttgccaatgaggtggagcggctggatgtgctcttcaacgtggccggctttgtgcaccacggcaccgtgctggactgtgaggagaaggactgggacttctccatgaacctgaatgtgcgctccatgtacctgatgatcaaggccttcctgcccaagatgctggcccagaagagcggcaacatcatcaacatgagctctgtggccagctctgtgaagggcgtggtgaacagatgtgtgtacagcaccaccaaggctgctgtgattggcctgaccaagtctgtggccgctgacttcatccagcagggcatccgctgcaactgtgtgtgccccggcaccgtggacacccccagcctgcaggagcgcatccaggcccggggcaaccctgaggaggccagaaatgacttcctgaagaggcagaagacaggccgctttgccacagctgaggagatcgccatgctgtgtgtgtacctggccagtgatgaaagtgcctacgtgactggaaatcctgtgatcattgatggcggctggagcctgtag

SEQ ID NO: 18712 - DNA, 2520 bp, Artificial Sequence
  Description of Artificial Sequence: Synthetic coding sequence
atgtctgtggtgggcatcgacctgggcttcctgaactgctacatcgctgtggcccggagcggcggcatcgagaccatcgccaatgagtacagcgaccgctgcaccccagcctgcatcagcctgggcagcaggacccgggccatcggaaatgctgccaagagccagatcgtgaccaacgtgaggaacaccatccacggcttcaagaagctgcacggccgcagctttgatgaccccatcgtgcagacagagcgcatccggctgccctatgagctgcagaagatgcccaacggcagcgctggggtgaaggtgcgctacctggaggaggagcggccctttgccatcgagcaggtgacaggcatgctgctggccaagctgaaggagaccagtgaaaatgccctgaagaagcctgtggccgactgtgtgatcagcatccccagcttcttcacagatgctgagaggagatctgtgatggctgctgcccaggtggccggcctgaactgcctgcggctgatgaatgagaccacagctgtggccctggcctacggcatctacaagcaggacctgccccccctggatgagaagcccagaaatgtggtgttcatcgacatgggccacagcgcctaccaggtgctggtgtgtgccttcaacaagggcaagctgaaggtgctggccaccacctttgacccctacctgggcggcaggaactttgatgaggccctggtggactacttctgtgatgagttcaagaccaagtacaagatcaacgtgaaggagaacagccgggccctgctgcggctgtaccaggagtgtgagaagctgaagaagctgatgtctgccaatgccagtgacctgcccctgaacatcgagtgcttcatgaatgacctggatgtgagcagcaagatgaacagagcccagtttgagcagctgtgtgccagcctgctggcccgggtggagccccccctgaaggctgtgatggagcaggccaacctgcagcgggaggacatcagcagcattgagatcgtgggcggggccacccgcatcccagctgtgaaggagcagatcaccaagttcttcctgaaggacatcagcaccaccctgaatgctgatgaagctgtggcccggggctgtgccctgcagtgtgccatcctgagccctgccttcaaggtgcgggagttcagcatcacagacctggtgccctacagcatcaccctgcgctggaagaccagctttgaagatggcagcggggagtgtgaggtgttctgcaagaaccacccagcccccttcagcaaggtgatcaccttccacaagaaggagccctttgagctggaggccttctacaccaacctgcacgaggtgccctacccagatgccagaattggcagcttcaccatccagaatgtgttcccccagagtgatggagacagcagcaaggtgaaggtgaaggtgcgggtgaacatccacggcatcttctctgtggccagcgccagcgtcatcgagaagcagaacctggagggggaccacagtgatgcccccatggagacagagaccagcttcaagaatgaaaacaaggacaacatggacaagatgcaggtggaccaggaggagggccaccagaagtgccacgccgagcacaccccagaggaggagattgaccacactggagccaagaccaagtctgctgtgtctgacaagcaggaccggctgaaccagaccctgaagaagggcaaggtgaagagcattgacctgcccatccagagcagcctgtgccggcagctgggccaggacctgctgaacagctacattgaaaatgaaggcaagatgatcatgcaggacaagctggagaaggagagaaatgatgccaagaatgctgtggaggagtatgtgtatgacttccgggaccggctgggcaccgtgtatgagaagttcatcaccccagaggacctgagcaagctgtctgctgtgctggaggacacagagaactggctgtatgaagatggagaggaccagcccaagcaggtgtatgtggacaagctgcaggagctgaagaagtatggccagcccatccagatgaagtacatggagcacgaggagcggcccaaggccctgaatgacctgggcaagaagatccagctggtgatgaaggtgattgaggcctacagaaacaaggatgaaagatatgaccacctggaccccacagagatggagaaggtggagaagtgcatcagtgatgccatgtcctggctgaacagcaagatgaatgcccagaacaagctgagcctgacccaggaccctgtggtgaaggtgtctgaaattgtggccaagagcaaggagctggacaacttctgcaaccccatcatctacaagcccaagcccaaggccgaggtgcctgaggacaagcccaaggccaacagcgagcacaacggccccatggatggccagagcggcacagagaccaagagtgacagcaccaaggacagcagccagcacaccaagagcagtggagagatggaggtggactag

SEQ ID NO: 18713 - DNA, 1224 bp, Artificial Sequence
  Description of Artificial Sequence: Synthetic coding sequence
atggccgccccctgtgccgaggaccccagcctggagcggcacttcaagggccacagagatgctgtgacctgtgtggacttcagcatcaacaccaagcagctggccagcggctccatggacagctgcctgatggtgtggcacatgaagccccagagccgggcctaccgcttcaccggccacaaggatgctgtgacctgtgtgaacttcagccccagcggccacctgctggccagcggcagccgggacaagacagtgcgcatctgggtgcccaacgtgaagggggagagcacagtgttccgggcccacacagccaccgtgcgctctgtgcacttctgcagtgatggccagagctttgtgacagccagtgatgacaagacagtgaaggtgtgggccacccaccggcagaagttcctgttcagcctgagccagcacatcaactgggtgcgctgtgccaagttctccccagatggccgcctcatcgtgtctgccagtgatgacaagacagtgaagctgtgggacaagagcagccgggagtgtgtgcacagctactgtgagcacggcggctttgtgacctacgtggacttccaccccagcggcacctgcatcgctgctgctggcatggacaacacagtgaaggtgtgggatgtgaggacccaccggctgctgcagcactaccagctgcacagcgctgctgtgaatggcctgtccttccaccccagcggcaactacctgatcacagccagcagtgacagcaccctgaagatcctggacctgatggagggccgcctgctgtacaccctgcacggccaccagggccctgccaccaccgtggccttcagcaggactggagagtactttgccagcggcggcagtgatgagcaggtgatggtgtggaagagcaactttgacatcgtggaccatggagaggtgaccaaggtgccccggcccccagccaccctggccagctccatgggcaacctgcctgaggtggacttccctgtgcccccaggccggggccgctctgtggagagcgtgcagagccagccccaggagcctgtgtctgtgccccagaccctgaccagcaccctggagcacatcgtgggccagctggatgtgctgacccagacagtgtccatcctggagcagaggctgaccctgacagaggacaagctgaagcagtgcctggagaaccagcagctgatcatgcagagggccaccccctag

SEQ ID NO: 18714 - DNA, 1173 bp, Artificial Sequence
  Description of Artificial Sequence: Synthetic coding sequence
atggccactggagacctgaagaggagcctgaggaacctggagcaggtgctgcggctgctgaactacccagaggaggtggactgtgtgggcctcatcaagggggaccctgctgccagcctgcccatcatctcctacagcttcaccagctacagcccctacgtgacagagctgatcatggagagcaatgtggagctgattgccaagaatgacctgcgcttcattgatgctgtgtacaagctgctgcgggaccagttcaactacaagcccatcctgaccaagaagcagttcatccagtgtggctttgctgagtggaagatccagatcgtgtgtgacatcctgaactgtgtgatgaagaagcacaaggagctgagcagcctgcagaagatccccagccagcagaggaagaagatcagcagcggcaagtctgagccccccctgggcaatgagaagatctctgctgaggccgtgggcgtggacatcagcggccgcttcatgaccagcggcaagaagaaggctgtggtgatccgccacctgtacaatgaagataatgtggacatcagcgaggacaccctgagccccatcacagatgtgaatgaggccgtggatgtgtctgacctgaatgccacagagatcaagatgcctgaggtgaaggtgcctgagatcaaggccgagcagcaggatgtgaatgtgaaccctgagatcacagccctgcagaccatgctggccgagtgccaggagaacctgaagaagctgaccagcattgagaagaggctggactgcctggagcagaagatgaagggcaaggtgatggtggatgagaacacctggaccaacctgctgagccgggtgaccctgctggagacagagatgctgctgagcaagaagaatgatgagttcatcgagttcaatgaggtgtctgaagattatgccagctgcagcgacatggacctgctgaacccccacaggaagtctgaggtggagaggcctgccagcatccccctgagcagcggctacagcacagccagcagtgacagcaccccccgggccagcacagtgaactactgcggcctgaatgagatcagcgaggagaccaccatccagaagatggagaggatgaagaagatgtttgaggagacagctgagctgctgaagtgccccaaccactacctgtag

SEQ ID NO: 18715 - DNA, 2601 bp, Artificial Sequence
  Description of Artificial Sequence: Synthetic coding sequence
atgcctgctgtgtccctgccccccaaggaaaatgccctcttcaagaggatcctgcgctgctatgagcacaagcagtacagaaatggcctgaagttctgcaagcagatcctgagcaaccccaagtttgctgagcacggggagaccctggccatgaagggcctgaccctgaactgcctgggcaagaaggaggaggcctatgagctggtgcggcggggcctgagaaatgacctgaagagccacgtgtgctggcacgtgtatggcctgctgcagaggagtgacaagaagtatgatgaggccatcaagtgctacagaaatgccctgaagtgggacaaggacaacctgcagatcctgcgggacctgagcctgctgcagatccagatgagggacctggagggctaccgggagacccgctaccagctgctgcagctgcggcctgcccagagggcctcctggattggctacgccatcgcctaccacctgctggaggactatgagatggccgccaagatcctggaggagttcaggaagacccagcagaccagcccagacaaggtggactatgagtacagcgagctgctgctgtaccagaaccaggtgctgcgggaggccggcctgtaccgggaggccctggagcacctgtgcacctatgagaagcagatctgtgacaagctggccgtggaggagaccaagggggagctgctgctgcagctgtgccgcctggaggatgctgctgatgtgtaccggggcctgcaggagagaaatcctgagaactgggcctactacaagggcctggagaaggccctgaagccagccaacatgctggagcggctgaagatctatgaggaggcctggaccaagtacccccggggcctggtgccccggcggctgcccctgaacttcctgagcggggagaagttcaaggagtgcctggacaagttcctgaggatgaacttcagcaagggctgcccccctgtgttcaacaccctgcggagcctgtacaaggacaaggagaaggtggccatcatcgaggagctggtggtgggctatgagaccagcctgaagagctgccgcctcttcaaccccaatgatgatggcaaggaggagccccccaccaccctgctgtgggtgcagtactacctggcccagcactatgacaagattggccagcccagcatcgccctggagtacatcaacacagccatcgagagcacccccaccctcatcgagctgttcctggtgaaggccaagatctacaagcatgctggcaacatcaaggaggccgcccgctggatggatgaggcccaggccctggacacagctgaccgcttcatcaacagcaaatgtgccaagtacatgctgaaggccaacctgatcaaggaggccgaggagatgtgcagcaagttcacccgggagggcaccagcgctgtggagaacctgaatgagatgcagtgcatgtggttccagacagaatgtgcccaggcctacaaggccatgaacaagtttggagaggccctgaagaagtgccatgaaattgagcggcacttcatcgagatcacagatgaccagtttgacttccacacctactgcatgaggaagatcaccctgcggagctatgtggacctgctgaagctggaggatgtgctgcggcagcaccccttctacttcaaggccgcccgcatcgccatcgagatctacctgaagctgcatgacaaccccctgacagatgagaacaaggagcacgaggccgacacagccaacatgtctgacaaggagctgaagaagctgaggaacaagcagaggcgggcccagaagaaggcccagatcgaggaggagaagaagaatgctgagaaggagaagcagcagaggaaccagaagaagaagaaggatgatgatgatgaggagattggaggccccaaggaggagctgatccctgagaagctggccaaggtggagacccccctggaggaggccatcaagttcctgacccccctgaagaacctggtgaagaacaagattgagacccacctgtttgcctttgagatctacttcaggaaggagaagttcctgctgatgctgcagagcgtgaagagggcctttgccatcgacagcagccacccctggctgcacgagtgcatgatccgcctcttcaacacagctgtgtgtgagagcaaggacctgagtgacacagtgaggacagtgctgaagcaggagatgaacagactctttggagccaccaaccccaagaacttcaatgagaccttcctgaagaggaacagcgacagcctgccccaccggctgtctgctgccaagatggtgtactacctggaccccagcagccagaagagggccatcgagctggccaccaccctggatgagagcctgaccaacagaaacctgcagacctgcatggaggtgctggaggccctgtatgatggcagcctgggggactgcaaggaggccgctgagatctaccgggccaactgccacaagctgttcccctatgccctggccttcatgcctcctggctatgaggaggacatgaagatcaccgtgaatggagacagcagcgctgaggccgaggagctggccaatgagatctag

SEQ ID NO: 18716 - DNA, 1293 bp, Artificial Sequence
  Description of Artificial Sequence: Synthetic coding sequence
atggccagcagcgccaagtctgctgagatgcccaccatcagcaagacagtgaaccccaccccagacccccaccaggagtacctggacccccgcatcaccatcgccctgtttgaaattggcagccacagccccagctcctggggcagcctgcccttcctgaagaacagcagccaccaggtgacagagcagcagacagcccagaagttcaacaacctgctgaaggagatcaaggacatcctgaagaacatggccggctttgaggagaagatcacagaggccaaggagctgtttgaggagaccaacatcacagaagatgtgtctgcccacaaggagaacatccggggcctggacaagatcaatgagatgctgagcaccaacctgcctgtgtccctggcccctgagaaggaggacaatgagaagaagcaggagatgatcctggagaccaacatcacagaagatgtgtctgcccacaaggagaacatccggggcctggacaagatcaatgagatgctgagcaccaacctgcctgtgtccctggcccctgagaaggaggacaatgagaagaagcagcagatgatcatggagaaccagaacagcgagaacacagcccaggtgtttgcccgggacctggtgaaccggctggaggagaagaaggtgctgaatgagacccagcagagccaggagaaggccaagaaccggctgaatgtgcaggaggagaccatgaagatccggaacaacatggagcagctgctgcaggaggccgagcactggagcaagcagcacacagagctgagcaagctgatcaagagctaccagaagagccagaaggacatcagcgagaccctgggcaacaatggagtgggcttccagacccagcccaacaatgaggtgtctgccaagcatgagctggaggagcaggtgaagaagctgagccatgacacctacagcctgcagctgatggccgccctgctggagaatgaatgccagatcctgcagcagagggtggagatcctgaaggagctgcaccaccagaagcagggcaccctgcaggagaagcccatccagatcaactacaagcaggacaagaagaaccagaagcccagcgaggccaagaaggtggagatgtacaagcagaacaagcaggccatgaagggcaccttctggaagaaggacaggagctgccgcagcctggatgtgtgcctgaacaagaaggcctgcaacacccagttcaacatccacgtggccaggaaggccctgcggggcaagatgaggtctgccagcagcctgaggtag

SEQ ID NO: 18717 - DNA, 5199 bp, Artificial Sequence
  Description of Artificial Sequence: Synthetic coding sequence
atggccgccatcggccggggccgcagcctgaagaacctgcgggtgcggggcagaaatgattctggagaggagaatgtgcccctggacctgacccgggagcccagcgacaacctgcgggagatcctgcagaatgtggcccggctgcagggcgtgagcaacatgaggaagctgggccacctgaacaacttcaccaagctgctgtgtgacatcggccacagcgaggagaagctgggcttccactatgaggacatcatcatctgcctgcggctggccctgctgaatgaggccaaggaggtgcgggccgccggcctgcgggccctgcgctacctgatccaggacagcagcatcctgcagaaggtgctgaagctgaaggtggactacctgattgcccgctgcatcgacatccagcagagcaatgaggtggagaggacccaggccctgcggctggtgaggaagatgatcaccgtgaatgccagcctcttccccagctctgtgaccaacagcctgattgctgtgggcaatgatggcctgcaggagcgggacaggatggtgcgggcctgcatcgccatcatctgtgagctggccctgcagaaccctgaggtggtggccctgcggggcggcctgaacaccatcctgaagaatgtcatcgactgccagctgagccgcatcaatgaggccctgatcaccaccatcctgcacctgctgaaccaccccaagacccggcagtatgtgcgggcagatgtggagctggagcgcatcctggccccctacacagacttccactaccgccacagcccagacacagctgagggccagctgaaggaggaccgggaggcccgcttcctggccagcaagatgggcatcatcgccaccttccgctcctgggccggcatcatcaacctgtgcaagccaggcaacagcggcatccagagcctgattggagtgctgtgcatccccaacatggagatccggcggggcctgctggaggtgctgtatgacatcttccggctgcccctgcctgtggtgacagaggagttcatcgaggccctgctgtctgtggaccccggccgcttccaggacagctggaggctgagtgatggctttgtggccgctgaggccaagaccatcctgccccaccgggcccggagcaggccagacctgatggacaactacctggccctgatcctgagcgccttcatcagaaatggcctgctggagggcctggtggaggtgatcaccaacagtgatgaccacatctctgtgcgggccaccatcctgctgggggagctgctgcacatggccaacaccatcctgccccacagccacagccaccacctgcactgcctgcccaccctgatgaacatggccgccagctttgacatccccaaggagaagaggctgcgggccagcgctgccctgaactgcctgaagcgcttccacgagatgaagaagaggggccccaagccctacagcctgcacctggaccacatcatccagaaggccatcgccacccaccagaagagggaccagtacctgcgggtgcagaaggacatcttcatcctgaaggacacagaggaggccctgctgatcaacctgcgggacagccaggtgctgcagcacaaggagaacctggagtggaactggaacctgattggcaccatcctgaagtggcccaacgtgaacctgaggaactacaaggatgagcagctgcacagatttgtgcggcggctgctgtacttctacaagcccagcagcaagctgtatgccaacctggacctggactttgccaaggccaagcagctgactgtggtgggctgccagttcacagagttcctgctggagagtgaagaagatggccagggctacctggaggacctggtgaaggacatcgtgcagtggctgaatgccagcagcggcatgaagccagagaggagcctgcagaacaacggcctgctgaccaccctgagccagcactacttcctgttcatcggcaccctgagctgccacccccatggagtgaagatgctggagaagtgcagcgtcttccagtgcctgctgaacctgtgcagcctgaagaaccaggaccacctgctgaagctgactgtgagcagcctggactacagcagagatggcctggcccgggtcatcctgagcaagatcctgacagctgccacagatgcctgccgcctgtatgccaccaagcacctgcgggtgctgctgcgggccaacgtggagttcttcaacaactggggcatcgagctgctggtgacccagctgcatgacaagaacaagaccatcagcagcgaggccctggacatcctggatgaggcctgtgaggacaaggccaacctgcacgccctgatccagatgaagccagccctgagccacctgggggacaagggcctgctgctgctgctgcgcttcctgagcatccccaagggcttctcctacctgaatgaaagaggctacgtggccaagcagctggagaagtggcaccgggagtacaacagcaaatatgtggacctgattgaggagcagctgaatgaggccctgaccacctacaggaagcctgtggatggagacaactacgtgagaagaagcaaccagaggctgcagaggcctcatgtgtacctgcccatccacctgtatggccagctggtgcaccacaagacaggctgccacctgctggaggtgcagaacatcatcacagagctgtgcagaaatgtgaggaccccagacctggacaagtgggaggagatcaagaagctgaaggccagcctgtgggccctgggcaacatcggcagcagcaactggggcctgaacctgctgcaggaggagaatgtcatcccagacatcctgaagctggccaagcagtgtgaggtgctgagcatccggggcacctgtgtgtatgtgctgggcctgattgccaagaccaagcagggctgtgacatcctgaagtgccacaactgggatgctgtgcgccacagcaggaagcacctgtggcctgtggtgcctgatgatgtggagcagctgtgcaatgagctgagcagcatccccagcaccctgagcctgaacagcgagagcaccagcagccgccacaacagcgagagcgagagcgtgcccagctccatgttcatcctggaggatgaccgcttcggcagcagcagcaccagcaccttcttcctggacatcaatgaagacacagagcccaccttctatgacaggagcggccccatcaaggacaagaacagcttccccttctttgccagcagcaagctggtgaagaaccgcatcctgaacagcctgaccctgcccaacaagaagcacaggagcagcagtgaccccaagggcggcaagctgagcagcgagagcaagaccagcaacagacgcatccgcaccctgacagagcccagcgtggacttcaaccacagtgatgacttcacccccatcagcacagtgcagaagaccctgcagctggagaccagcttcatgggcaacaagcacatcgaggacaccggcagcacccccagcatcggggagaatgacctgaagttcaccaagaactttggaacagagaaccaccgggagaacaccagccgggagcggctggtggtggagagcagcaccagcagccacatgaagatccgcagccagagcttcaacacagacaccaccaccagcggcatcagctccatgagcagcagccccagccgggagaccgtgggcgtggatgccaccaccatggacacagactgtggctccatgagcacagtggtgtccaccaagaccatcaagaccagccactacctgaccccccagagcaaccacctgagcctgagcaagagcaacagcgtgtccctggtgcccccaggcagcagccacaccctgccccggcgggcccagagcctgaaggcccccagcatcgccaccatcaagagcctggccgactgcaacttctcctacaccagcagcagagatgccttcggctacgccaccctgaagaggctgcagcagcagaggatgcaccccagcctgagccacagcgaggccctggccagccctgccaaggatgtgctcttcacagacaccatcaccatgaaggccaacagctttgagagccggctgacccccagcagaattgacttcaagaagaagcacgtgggcggcatccgcagcctgcggcccaccatcaccaacaacctcttccgcttcatgaaggccctgtcctatgccagcctggacaaggaggacctgctgagccccatcaaccagaacaccctgcagaggagcagctctgtgcgctccatggtgtcctctgccacctacggcggcagtgatgactacatcggcctggccctgcctgtggacatcaatgacatcttccaggtgaaggacatcccctacttccagaccaagaacatcccccctcatgatgacagaggagcccgggcctttgcccatgatgctgggggcctgcccagcggcaccggcggcctggtgaagaacagcttccacctgctgcggcagcagatgagcctgacagagatcatgaacagcatccacagtgatgccagcctcttcctggagagcacagaggacaccggcctgcaggagcacacagatgacaactgcctgtactgtgtgtgcatcgagatcctgggcttccagcccagcaaccagctgagcgccatctgcagccacagcgacttccaggacatcccctacagcgactggtgtgagcagaccatccacaaccccctggaggtggtgcccagcaagttcagcggcatcagcggctgcagtgatggagtgtcccaggagggcagcgccagcagcaccaagagcacagagctgctgctgggcgtgaagaccatcccagatgacacccccatgtgccgcatcctgctgaggaaggaggtgctgcggctggtgatcaacctgagcagctctgtgtccaccaagtgccacgagaccggcctgctgaccatcaaggagaagtacccccagacctttgatgacatctgcctgtacagcgaggtgagccacctgctgagccactgcaccttccggctgccctgccgccgcttcatccaggagctgttccaggatgtgcagttcctgcagatgcatgaggaggccgaggccgtgctggccaccccacccaagcagcccatcgtggacaccagcgctgagagctag

SEQ ID NO: 18718 - DNA, 1761 bp, Artificial Sequence
  Description of Artificial Sequence: Synthetic coding sequence
atgtctgccaccgtggtggatgctgtgaatgctgcccccctgagcggcagcaaggagatgagcctggaggagcccaagaagatgacccgggaggactggaggaagaagaaggagctggaggagcagaggaagctgggcaatgccccagctgaggtggatgaggagggcaaggacatcaacccccacatcccccagtacatcagctctgtgccctggtacatcgaccccagcaagaggcccaccctgaagcaccagaggccccagcctgagaagcagaagcagttcagcagcagcggggagtggtacaagaggggcgtgaaggagaacagcatcatcaccaagtacagaaaaggagcctgtgagaactgtggggccatgacccacaagaagaaggactgctttgagcggccccggcgggtgggcgccaagttcaccggcaccaacatcgccccagatgagcacgtgcagccccagctgatgtttgattatgatggcaagagggaccgctggaatggctacaaccctgaggagcacatgaagatcgtggaggagtatgccaaggtggacctggccaagaggaccctgaaggcccagaagctgcaggaggagctggccagcggcaagctggtggagcaggccaacagccccaagcaccagtggggcgaggaggagcccaacagccagatggagaaggaccacaacagtgaagatgaagatgaggacaagtatgcagatgacatcgacatgcctggccagaactttgacagcaagaggcgcatcaccgtgaggaacctgcgcatcagagaagatattgccaagtacctgaggaacctggaccccaacagcgcctactatgaccccaagacccgggccatgagggagaacccctatgccaatgctgggaagaacccagatgaggtgtcctatgctggggacaactttgtgcgctacaccggggacaccatctccatggcccagacccagctgtttgcctgggaggcctatgacaagggcagcgaggtgcacctgcaggccgaccccaccaagctggagctgctgtacaagagcttcaaggtgaagaaggaggacttcaaggagcagcagaaggagagcatcctggagaagtatggaggccaggagcacctggatgcccctcctgctgagctgctgctggcccagacagaagattatgtggagtacagcagacatggaacagtcatcaagggccaggagagagctgtggcctgcagcaaatatgaagaagatgtgaagatccacaaccacacccacatctggggcagctactggaaggagggccgctggggctacaagtgctgccacagcttcttcaagtacagctactgcaccggggaggccggcaaggagatcgtgaacagcgaggagtgcatcatcaatgagatcactggagaggagagcgtgaagaagccccagaccctgatggagctgcaccaggagaagctgaaggaggagaagaagaagaagaagaagaagaagaagaagcacaggaagagcagcagtgacagtgatgatgaggagaagaagcatgagaagctgaagaaggccctgaatgctgaggaggcccggctgctgcacgtgaaggagaccatgcagattgatgagaggaagaggccctacaacagcatgtatgagacccgggagcccacagaggaggagatggaggcctacaggatgaagaggcagaggccagatgaccccatggccagcttcctgggccagtag

SEQ ID NO: 18719 - DNA, 1185 bp, Artificial Sequence
  Description of Artificial Sequence: Synthetic coding sequence
atggccctggaggtgggggacatggaggatggccagctgagtgacagcgacagcgacatgacagtggcccccagcgaccggcccctgcagctgcccaaggtgctgggcggggacagcgccatgagggccttccagaacacagccacagcctgtgcccctgtgagccactacagagctgtggagagcgtggacagcagcgaggagagcttcagtgacagtgatgatgacagctgcctgtggaagaggaagaggcagaagtgcttcaaccccccacccaagccagagcccttccagtttggccagagcagccagaagccccctgtggccggcggcaagaagatcaacaacatctggggcgctgtgctgcaggagcagaaccaggatgctgtggccacagagctgggcatcctgggcatggagggcaccatcgacaggagccggcagagcgagacctacaactacctgctggccaagaagctgaggaaggagagccaggagcacaccaaggacctggacaaggagctggatgagtacatgcacggcggcaagaagatgggcagcaaggaggaggagaatggccagggccacctgaagaggaagaggcctgtgaaggaccggctgggcaacagacctgagatgaactacaagggccgctatgagatcacagctgaggacagccaggagaaggtggctgatgagatctccttccggctgcaggagcccaagaaggacctgattgcccgggtggtgcgcatcatcggcaacaagaaggccatcgagctgctgatggagacagctgaggtggagcagaatggaggcctcttcatcatgaatggcagcagaagaaggaccccaggaggagtcttcctgaacctgctgaagaacacccccagcatcagcgaggagcagatcaaggacatcttctacatcgagaaccagaaggagtatgagaacaagaaggccgccaggaagaggaggacccaggtgctgggcaagaagatgaagcaggccatcaagagcctgaacttccaggaggatgatgacaccagccgggagacctttgccagtgacaccaatgaggccctggccagcctggatgagagccaggagggccatgctgaggccaagctggaggccgaggaggccatcgaggtggaccacagccatgacctggacatcttctag

SEQ ID NO: 18720 - DNA, 789 bp, Artificial Sequence
  Description of Artificial Sequence: Synthetic coding sequence
atgttcctgttcagcaggaagaccaggacccccatcagcacctacagcgacagctaccgggcccccaccagcatcaaggaggtgtacaaggacccccccctgtgtgcctgggaggccaacaagttcctgaccccaggcctgacccacaccatggagcggcacgtggaccctgaggccctgcagaagatggccaagtgtgctgtgcaggactacacctaccggggcagcatcagcggccacccctacctgcctgagaagtactggctgagccaggaggaggccgacaagtgcagccccaactacctgggcagtgactggtacaacacctggaggatggagccctacaacagcagctgctgcaacaagtacaccacctacctgccccggctgcccaaggaggccaggatggagacagctgtgcggggcatgcccctggagtgcccccccaggcctgagcggctgaatgcctatgagcgggaggtgatggtgaacatgctgaacagcctgagcaggaaccagcagctgccccgcatcaccccccgctgtggctgtgtggaccccctgcccggccgcctgcccttccacggctatgaaagtgcctgcagcggccgccactactgcctgcggggcatggactactatgccagcggggccccctgcacagaccggcggctgcggccctggtgccgggagcagcccaccatgtgcaccagcctgcgggccccagccagaaatgctgtgtgctgctacaacagccctgctgtgatcctgcccatcagcgagccctag

SEQ ID NO: 18721 - DNA, 4206 bp, Artificial Sequence
  Description of Artificial Sequence: Synthetic coding sequence
atggaggagatccctgtgaaggtggccgtgcgcatccggcccctgctgtgcaaggaggccctgcacaaccaccaggtgtgtgtgcgggtcatccccaacagccagcaggtgatcatcggccgggacagagtcttcacctttgattttgtgtttgggaagaacagcacccaggatgaggtgtacaacacctgcatcaagcccctggtgctgagcctgattgagggctacaatgccaccgtgtttgcctacggccagacaggcagcggcaagacctacaccatcggcggcggccacatcgcctctgtggtggagggccagaagggcatcatcccccgggccatccaggagatcttccagagcatcagcgagcaccccagcattgacttcaacgtgaaggtgtcctacatcgaggtgtacaaggaggacctgcgggacctgctggagctggagacctccatgaaggacctgcacatccgggaggatgagaagggcaacacagtcatcgtgggcgccaaggaatgtcatgtggagagcgctggggaggtgatgagcctgctggagatgggaaatgctgcccggcacacaggcaccacccagatgaatgagcacagcagccgcagccacgccatcttcaccatcagcatctgccaggtgcacaagaacatggaggccgcagaagatggctcctggtacagccccaggcacatcgtgtccaagttccactttgtggacctggccggcagcgagcgggtgaccaagacaggcaacacaggagagcgcttcaaggagagcatccagatcaacagcggcctgctggccctgggcaatgtcatcagcgccctgggggaccccaggaggaagagcagccacatcccctacagagatgccaagatcacccggctgctgaaggacagcctgggcggcagcgccaagacagtgatgatcacctgtgtgagccccagcagcagcaactttgatgagagcctgaacagcctgaagtatgccaacagagccaggaacatccggaacaagcccaccgtgaacttcagccctgagagtgacagaattgatgagatggagtttgagatcaagctgctgcgggaggccctgcagagccagcaggccggcgtgtcccagaccacccagatcaaccgggagggcagcccagacaccaaccgcatccacagcctggaggagcaggtggcccagctgcagggagaatgtctgggctaccagtgctgcgtggaggaggccttcaccttcctggtggacctgaaggacacagtgcggctgaatgagaagcagcagcacaagctgcaggagtggttcaacatgatccaggaggtgaggaaggctgtgctgaccagcttccggggcatcggcggcacagccagcctggaggagggcccccagcacgtgacagtgctgcagctgaagcgggagctgaagaagtgccagtgtgtgctggccgcagatgaggtggtgttcaaccagaaggagctggaggtgaaggagctgaagaaccaggtgcagatgatggtgcaggagaacaagggccatgctgtgtccctgaaggaggcccagaaggtgaaccggctgcagaatgagaagatcatcgagcagcagctgctggtggaccagctgtctgaggagctgaccaagctgaacctgtctgtgaccagcagcgccaaggagaactgtggagatggcccagatgcccgcatccctgagcggcggccctacacagtgccctttgacacccacctgggccactacatctacatccccagccggcaggacagcaggaaggtgcacaccagcccccccatgtacagcctggaccgcatctttgctggcttccgcaccaggagccagatgctgctgggccacatcgaggagcaggacaaggtgctgcactgccagttcagtgacaacagtgatgatgaggagagcgagggccaggagaagagcggcacccgctgccgcagccgctcctggatccagaagccagacagcgtgtgcagcctggtggagctgagtgacacccaggatgagacccagaagagtgacctggagaatgaagacctgaagattgactgcctgcaggagagccaggagctgaacctgcagaagctgaagaacagcgagcgcatcctgacagaggccaagcagaagatgagggagctgaccatcaacatcaagatgaaggaggacctgatcaaggagctgatcaagacaggaaatgatgccaagtctgtgtccaagcagtacagcctgaaggtgaccaagctggagcatgatgctgagcaggccaaggtggagctgattgagacccagaagcagctgcaggagctggagaacaaggacctgagtgatgtggccatgaaggtgaagctgcagaaggagttcaggaagaagatggatgctgccaagctgcgggtgcaggtgctgcagaagaagcagcaggacagcaagaagctggccagcctgagcatccagaatgagaagagggccaatgagctggagcagagcgtggaccacatgaagtaccagaagatccagctgcagaggaagctgcgggaggagaatgagaagaggaagcagctggatgctgtgatcaagagggaccagcagaagatcaaggagatccagctgaagacaggccaggaggagggcctgaagcccaaggccgaggacctggatgcctgcaacctgaagaggaggaagggcagctttggcagcattgaccacctgcagaagctggatgagcagaagaagtggctggatgaggaggtggagaaggtgctgaaccagaggcaggagctggaggagctggaggccgacctgaagaagcgggaggccatcgtgtccaagaaggaggccctgctgcaggagaagagccacctggagaacaagaagctgcggagcagccaggccctgaacacagacagcctgaagatcagcacccggctgaacctgctggagcaggagctgtctgagaagaatgtgcagctgcagaccagcacagctgaggagaagaccaagatcagcgagcaggtggaggtgctgcagaaggagaaggaccagctgcagaagagaagacacaacgtggatgagaagctgaagaatggccgggtgctgagccctgaggaggagcacgtgctcttccagctggaggagggcatcgaggccctggaggccgccatcgagtacagaaatgaaagcatccagaaccggcagaagagcctgcgggccagcttccacaacctgagcagaggagaggccaacgtgctggagaagctggcctgcctgagccctgtggagatccgcaccatcctcttccgctacttcaacaaggtggtgaacctgcgggaggccgagaggaagcagcagctgtacaatgaggagatgaagatgaaggtgctggagcgggacaacatggtgcgggagctggagagcgccctggaccacctgaagctgcagtgtgaccggcggctgaccctgcagcagaaggagcacgagcagaagatgcagctgctgctgcaccacttcaaggagcaggatggagagggcatcatggagaccttcaagacctatgaggacaagatccagcagctggagaaggacctgtacttctacaagaagaccagccgggaccacaagaagaagctgaaggagctggtgggggaggccatccggcggcagctggcccccagcgagtaccaggaggccggagatggagtgctgaagccagagggcggcggcatgctgtctgaggagctgaagtgggccagcaggcctgagagcatgaagctgagcggccgggagcgggagatggacagcagcgccagcagcctgcggacccagcccaacccccagaagctgtgggaggacatccctgagctgccccccatccacagcagcctggcccctccttctggccacatgctgggcaatgaaaacaagacagaaacagatgacaaccagttcaccaagagccacagccggctgagcagccagatccaggtggtgggcaatgtgggccgcctgcatggagtgacccctgtgaagctgtgcaggaaggagctgcggcagatcagcgccctggagctgagcctgcggcgcagcagcctgggcgtgggcatcggctccatggctgctgacagcattgaggtgtccaggaagccccgggacctgaagacctag

SEQ ID NO: 18722 - DNA, 768 bp, Artificial Sequence
  Description of Artificial Sequence: Synthetic coding sequence
atggtgaagggggagaagggccccaagggcaagaagatcaccctgaaggtggccaggaactgcatcaagatcacctttgatggcaagaagaggctggacctgagcaagatgggcatcaccaccttccccaagtgcatcctgcggctgagtgacatggatgagctggacctgagcaggaacctgatcaggaagatcccagacagcatcagcaagttccagaacctgcgctggctggacctgcacagcaactacatcgacaagctgcctgagagcatcggccagatgaccagcctgctgtacctgaatgtgagcaacaaccggctgaccagcaatggcctgcctgtggagctgaagcagctgaagaacatccgggctgtgaacctgggcctgaaccacctggacagcgtgcccaccaccctgggcgccctgaaggagctgcacgaggtgggcctgcatgacaacctgctgaacaacatccctgtgtccatcagcaagctgcccaagctgaagaagctgaacatcaagaggaaccccttccccaagccaggagagagcgagatcttcatcgacagcatccggcggctggagaacctgtatgtggtggaggagaaggacctgtgtgccgcctgcctgaggaagtgccagaatgcccgggacaacctgaaccgcatcaagaacatggccaccaccacccccaggaagaccatcttccccaacctgatcagccccaacagcatggccaaggacagctgggaggactggaggtag

SEQ ID NO: 18723 - DNA, 645 bp, Artificial Sequence
  Description of Artificial Sequence: Synthetic coding sequence
atgggcagaagacctgcccgctgctaccgctactgcaagaacaagccctaccccaagagccgcttctgccggggcgtgcctgatgccaagatccgcatctttgacctgggcaggaagaaggccaaggtggatgagttccccctgggcggccacatggtgtctgatgaatatgagcagctgagcagcgaggccctggaggccgcccgcatctgtgccaacaagtacatggtgaagagctgtggcagagatggcttccacatgagggtgcggctgcaccccttccacgtgatccgcatcaacaagatgctgagctgtgccggggctgaccggctgcagacaggcatgagaggagccttcggcaagccccagggcaccgtggcccgggtgcacatcggccaggtgatcatgagcatccgcaccaagctgcagaatgaggagcacgtgattgaggccctgcggcgggccaagttcaagtttcctggccggcagaagatccacatcagcaagaagtggggcttcaccaagttcaatgctgatgaatttgaggacatggtggccaagaagtgcctgatcccagatggctgcggcgtgaagtatgtgcccagccacggccccctggacaagtggagggtgctgcacagctag

SEQ ID NO: 18724 - DNA, 3231 bp, Artificial Sequence
  Description of Artificial Sequence: Synthetic coding sequence
atgaagagccgcttcagcaccatcgacctgcgggctgtgctggccgagctgaatgccagcctgctgggcatgagggtgaacaacgtgtatgatgtggacaacaagacctacctgatccggctgcagaagccagacttcaaggccaccctgctgctggagagcggcatccgcatccacaccacagaatttgagtggcccaagaacatgatgcccagcagctttgccatgaagtgcaggaagcacctgaagagccggcggctggtgtctgccaagcagctgggcgtggaccgcatcgtggacttccagtttggaagtgatgaggccgcctaccacctgatcatcgagctgtatgaccggggcaacatcgtgctgacagattatgaatatgtgatcctgaacatcctgcgcttcagaacagatgaagcagatgatgtgaagtttgctgtgcgggagcgctaccccctggaccacgcccgggctgctgagcccctgctgaccctggagcggctgacagaaattgtggccagcgcccccaagggggagctgctgaagagggtgctgaaccccctgctgccctacggccctgccctgattgagcactgcctgctggagaatggcttctctggaaatgtgaaggtggatgagaagctggagaccaaggacatcgagaaggtgctggtgtccctgcagaaggccgaggactacatgaagaccaccagcaacttcagcggcaagggctacatcatccagaagcgggagatcaagcccagcctggaggccgacaagcctgtggaggacatcctgacctatgaggagttccaccccttcctgttcagccagcacagccagtgcccctacattgaatttgagagctttgacaaggctgtggatgagttctacagcaagattgagggccagaagattgacctgaaggccctgcagcaggagaagcaggccctgaagaagctggacaacgtgaggaaggaccatgaaaatcggctggaggccctgcagcaggcccaggagattgacaagctgaagggggagctgattgagatgaacctgcagatcgtggaccgggccatccaggtggtgcgcagcgccctggccaaccagattgactggacagagatcggcctgattgtgaaggaggcccaggcccagggcgaccctgtggccagcgccatcaaggagctgaagctgcagaccaaccacgtgaccatgctgctgaggaacccctacctgctgtctgaggaggaggatgatgatgtggatggagatgtgaatgtggagaagaatgaaacagagccccccaagggcaagaagaagaagcagaagaacaagcagctgcagaagccccagaagaacaagcccctgctggtggatgtggacctgagcctgagcgcctatgccaatgccaagaagtactatgaccacaagagatatgctgccaagaagacccagaagacagtggaggccgctgagaaggccttcaagtctgctgagaagaagaccaagcagaccctgaaggaggtgcagacagtgaccagcatccagaaggccaggaaggtgtactggtttgagaagttcctgtggttcatcagcagcgagaactacctgatcatcggcggccgggaccagcagcagaatgagatcatcgtgaagcgctacctgacccctggggacatctacgtgcatgctgacctgcacggggccaccagctgtgtgatcaagaaccccactggagagcccatcccccccaggaccctgacagaagctggcaccatggccctgtgctacagcgctgcctgggatgcccgggtcatcaccagcgcctggtgggtgtaccaccaccaggtgtccaagacagcccccaccggggagtacctgaccaccggcagcttcatgatccggggcaagaagaacttcctgcccccatcctacctgatgatgggcttctccttcctgttcaaggtggatgagagctgtgtgtggaggcaccagggcgagaggaaggtgcgggtgcaggatgaggacatggagaccctggccagctgcaccagcgagctgatcagcgaggagatggagcagctggatggaggagacaccagcagtgatgaggacaaggaggagcacgagacccctgtggaggtggagctgatgacccaggtggaccaggaggacatcaccctgcagagcggcagagatgagctgaatgaggagctgatccaggaggagagcagtgaagatgaaggagaatatgaggaggtgaggaaggaccaggacagcgtgggggagatgaaggatgaaggagaggagaccctgaactacccagacaccaccatcgacctgagccacctgcagccccagaggagcatccagaagctggccagcaaggaggagagcagcaacagcagtgacagcaagagccagagcagaagacacctgagcgccaaggagcggcgggagatgaagaagaagaagctgcccagcgacagcggggacctggaggccctggagggcaaggacaaggagaaggagagcacagtgcacatcgagacccaccagaacaccagcaagaatgtggccgctgtgcagcccatgaagaggggccagaagagcaagatgaagaagatgaaggagaagtacaaggaccaggatgaagaagatcgggagctgatcatgaagctgctgggcagcgctggcagcaacaaggaggagaagggcaagaagggcaagaagggcaagaccaaggatgagcctgtgaagaagcagccccagaagccccggggcggccagagggtgtctgacaacatcaagaaggagacccccttcctggaggtgatcacccatgagctgcaggactttgctgtggatgacccccatgatgacaaggaggagcaggacctggaccagcagggcaatgaggagaacctgtttgacagcctgaccggccagccccacccagaagatgtgctgctgtttgccatccccatctgtgccccctacaccaccatgaccaactacaagtacaaggtgaagctgaccccaggagtgcagaagaagggcaaggccgccaagacagccctgaacagcttcatgcacagcaaggaggccacagcccgggagaaggacctcttccgctctgtgaaggacacagacctgagcaggaacatccctgggaaggtgaaggtgtctgcccccaacctgctgaatgtgaagaggaagtag

SEQ ID NO: 18725 - DNA, 963 bp, Artificial Sequence
  Description of Artificial Sequence: Synthetic coding sequence
atgggagacatcccagctgtgggcctgagctcctggaaggccagccctgggaaggtgacagaggccgtgaaggaggccattgatgctggctaccgccactttgactgtgcctacttctaccacaatgaaagagaggtgggcgccggcatccgctgcaagatcaaggagggcgctgtgcggcgggaggacctcttcatcgccaccaagctgtggtgcacctgccacaagaagagcctggtggagacagcctgcaggaagagcctgaaggccctgaagctgaactacctggacctgtacctgatccactggcccatgggcttcaagccaccccaccctgagtggatcatgagctgcagcgagctgtccttctgcctgagccacccccgggtgcaggacctgcccctggatgagagcaacatggtgatccccagcgacacagacttcctggacacctgggaggccatggaggacctggtgatcaccggcctggtgaagaacattggagtgagcaacttcaaccacgagcagctggagcggctgctgaacaagccaggcctgcgcttcaagcccctgaccaaccagatcgagtgccacccctacctgacccagaagaacctgatctccttctgccagagcagagatgtgtctgtgacagcctaccggcccctgggcggcagctgtgaaggagtggacctgattgacaaccctgtgatcaagagaattgccaaggagcacggcaagagccctgcccagatcctgatccgcttccagatccagagaaatgtgattgtcatccctggcagcatcacccccagccacatcaaggagaacatccaggtgtttgattttgagctgacccagcacgacatggacaacatcctgagcctgaacagaaacctgcggctggccatgttccccatcaccaagaaccacaaggactaccccttccacatcgagtactag

SEQ ID NO: 18726 - DNA, 1239 bp, Artificial Sequence
  Description of Artificial Sequence: Synthetic coding sequence
atgagcggctaccagaggaggcctggggccacccccctgagccgggcccggagcctggccatcccagatgccccagccttctatgaaagaagaagctgcctgccccagctgaactgtgagcggccccacggccgggacctggacagccccttcttcggcatccggcctgccttcatgtgctacgtgcccagccctgtgctggcctctgtgggggacacagatgacagatttgaggacctggaggaggccaaccccttctccttccgggagttcctgaagaccaagaacctgggcctgagcaaggaggaccctgccagccgcatctatgccaaggaggccagccgccacagcctgggcctggaccacaacagcccccccagccagacaggaggctacggcctggagtaccagcagcccttctttgaggaccccactggagctggggacctgctggatgaggaggaggatgaggacaccggctggagcggggcctacctgcccagcgccatcgagcagacccaccctgagcgggtgcctgctggcaccagcccctgcagcacctacctgtccttcttcagcacccccagcgagctggccggccctgagagcctgcccagctgggccctgagtgacacagacagccgggtgtccccagccagccctgctggcagccccagcgctgactttgctgtgcacggggagagcctgggggacagacacctgcggaccctgcagatctcctatgatgccctgaaggatgagaacagcaagctgcggaggaagctgaatgaggtgcagagcttcagcgaggcccagacagagatggtgaggaccctggagaggaagctggaggccaagatgatcaaggaggagagtgactaccatgacctggagagcgtggtgcagcaggtggagcagaacctggagctgatgaccaagagagctgtgaaggcagaaaatcatgtggtgaagctgaagcaggagatcagcctgctgcaggcccaggtgagcaacttccagcgggagaatgaggccctgcgctgtggccagggcgccagcctgactgtggtgaagcagaatgctgatgtggccctgcagaacctgcgggtggtgatgaacagcgcccaggccagcatcaagcagctggtgtctggagctgagaccctgaacctggtggccgagatcctgaagagcattgaccgcatcagcgaggtgaaggatgaggaggaggacagctag

SEQ ID NO: 18727 - DNA, 1440 bp, Artificial Sequence
  Description of Artificial Sequence: Synthetic coding sequence
atggatgccaccatcgccccccaccgcatccccccagagatgccccagtatggagaggagaaccacatctttgagctgatgcagaacatgctggagcagctgctgatccaccagcctgaggaccccatccccttcatgatccagcacctgcaccgggacaatgacaacgtgccccgcatcgtcatcctgggccccccagccagcggcaagaccaccatcgccatgtggctgtgcaagcacctgaacagcagcctgctgaccctggagaacctgatcctgaatgagttctcctacacagccacagaggcccggcggctgtacctgcagaggaagacagtgcccagcgccctgctggtgcagctgatccaggagcggctggccgaggaggactgcatcaagcagggctggatcctggatggcatccctgagacccgggagcaggccctgcgcatccagaccctgggcatcacccccaggcatgtgattgtgctgagcgccccagacacagtgctgattgaaagaaacctgggcaagagaattgacccccagacaggagagatctaccacaccacctttgactggcccccagagagcgagatccagaaccggctgatggtgcctgaggacatcagcgagctggagacagcccagaagctgctggagtaccacaggaacatcgtgcgggtcatccccagctaccccaagatcctgaaggtgatctctgctgaccagccctgtgtggatgtgttctaccaggccctgacctacgtgcagagcaaccacaggaccaatgcccccttcaccccccgggtgctgctgctgggccctgtgggcagcggcaagagcctgcaggccgccctgctggcccagaagtaccgcctggtgaatgtgtgctgcggccagctgctgaaggaggccgtggccgacaggaccacctttggagagctgatccagcccttctttgagaaggagatggctgtgcctgacagcctgctgatgaaggtgctgagccagaggctggaccagcaggactgcatccagaagggctgggtgctgcatggagtgccccgggacctggaccaggcccacctgctgaaccggctgggctacaaccccaacagagtcttcttcctgaatgtgccctttgacagcatcatggagcggctgaccctgcggagaattgatcctgtgactggagagcgctaccacctgatgtacaagcccccacccaccatggagatccaggcccggctgctgcagaaccccaaggatgctgaggagcaggtgaagctgaagatggacctcttctacagaaacagcgctgacctggagcagctgtatggcagcgccatcaccctgaatggagaccaggacccctacacagtgtttgagtacatcgagagcggcatcatcaaccccctgcccaagaagatcccctag

SEQ ID NO: 18728 - DNA, 432 bp, Artificial Sequence
  Description of Artificial Sequence: Synthetic coding sequence
atggcccacgagatgattggcacccagatcgtgacagagcggctggtggccctgctggagagcggcacagagaaggtgctgctgattgacagccggccctttgtggagtacaacaccagccacatcctggaggccatcaacatcaactgcagcaagctgatgaagaggcggctgcagcaggacaaggtgctgatcacagagctgatccagcacagcgccaagcacaaggtggacatcgactgcagccagaaggtggtggtgtatgaccagagcagccaggatgtggccagcctgagcagtgactgcttcctgactgtgctgctgggcaagctggagaagagcttcaacagcgtgcacctgctggccggggctgatgctgctgagtgggactggctgtgtgtgaagtgccagcagtacctgagcaaggcctag

SEQ ID NO: 18729 - DNA, 1191 bp, Artificial Sequence
  Description of Artificial Sequence: Synthetic coding sequence
atggccagcctgagccgggccctgcgggtggccgccgcccacccccggcagagccccacccggggcatgggcccctgcaacctgagcagcgctgctggccccacagctgagaagtctgtgccctaccagaggaccctgaaggagggccagggcacctctgtggtggcccagggccccagccggcccctgcccagcacagccaacgtggtggtgattggaggcggcagcctgggctgccagaccctgtaccacctggccaagctgggcatgtctggagctgtgctgctggagcgggagcggctgaccagcggcaccacctggcacacagctggcctgctgtggcagctgcggcccagtgatgtggaggtggagctgctggcccacacccggcgggtggtgtcccgggagctggaggaggagaccggcctgcacacaggctggatccagaatggaggcctcttcatcgccagcaaccggcagaggctggatgagtacaagaggctgatgagcctgggcaaggcctatggagtggagagccacgtgctgagccctgctgagaccaagaccctgtaccccctgatgaatgtggatgacctgtatggcaccctgtatgtgccccatgatggcaccatggaccctgctggcacctgcaccaccctggcccgggccgccagcgcccggggggcccaggtgattgagaactgccctgtgacaggcatccgggtgtggacagatgactttggagtgcggcgggtggccggcgtggagacccagcacggcagcatccagaccccctgtgtggtgaactgtgccggcgtgtgggccagcgctgtgggccgcatggccggcgtgaaggtgcccctggtggccatgcaccacgcctacgtggtgacagaaagaattgagggcatccagagcttcaccctgctgcccaccctggagtacagcggcaccgtgtctgcccactgcaacctgcggctgcccggcagcagcaacagccgggccagcgccagccacgtggccggcatcaagtgtgcccggcaccacaccaggctcatcttcttctgcatcctggtggagacagagttccaccacgtggccaaggccggcctggagctgctgagcagcggcaacccccccatcagtgacttccagagcgcccgcatcaccggggtgagccaccacgcctag

SEQ ID NO: 18730 - DNA, 4416 bp, Artificial Sequence
  Description of Artificial Sequence: Synthetic coding sequence
atggagcctgagcctgtggaggactgtgtgcagagcaccctggccgccctgtaccccccatttgaggccacagcccccaccctgctgggccaggtgttccaggtggtggagaggacctaccgggaggatgccctgcgctacaccctggacttcctggtgcctgccaagcacctgctggccaaggtgcagcaggaggcctgtgcccagtacagcggcttcctgttcttccacgagggctggcccctgtgcctgcacgagcaggtggtggtgcagctggccgccctgccctggcagctgctgcggcctggggacttctacctgcaggtggtgcccagcgctgcccaggccccccggctggccctgaagtgcctggcccctgggggcggccgggtgcaggaggtgcctgtgcccaatgaggcctgtgcctacctgttcaccccagagtggctgcagggcatcaacaaggaccggcccaccggccgcctgagcacctgcctgctgagcgcccccagcggcatccagaggctgccctgggccgagctgatctgccccaggtttgtgcacaaggagggcctgatggtgggccaccagcccagcaccctgcccccagagctgcccagcggccccccaggcctgcccagcccccccctgcctgaggaggccctgggcaccaggagccctggagatggccacaatgcccctgtggagggccctgagggggagtatgtggagctgctggaggtgaccctgcctgtgcggggcagccccacagatgctgagggcagccctggcctgagccgggtgaggacagtgcccaccaggaaaggagctgggggcaagggccgccaccggcggcaccgggcctggatgcaccagaagggcctgggcccccggggccaggatggagcccggcccccaggagagggcagcagcactggagccagccctgagagccccccaggagctgaggccgtgcctgaggccgctgtgctggaggtgtctgagcccccagctgaggccgtgggggaggccagcggcagctgccccctgcggcctggagagctgcggggcggcggcggcggcggccagggcgctgagggccccccaggcaccccaagaagaactggaaaaggaaacagaaggaagaagagagctgctggccgcggggccctgagccggggcggggacagcgcccccctgagccctggggacaaggaggatgccagccaccaggaggccctgggcaacctgcccagccccagcgagcacaagctgcctgagtgccacctggtgaaggaggagtatgagggcagcggcaagccagagagcgagcccaaggagctgaagacagctggggagaaggagccccagctgtctgaggcctgtggccccacagaggagggcgctggggagcgggagctggagggccctggcctgctgtgcatggccggccacacaggccctgagggccccctgagtgacacccccaccccacccctggagaccgtgcaggagggcaaaggagacaacatccctgaggaggccctggccgtgtctgtgtctgaccacccagatgtggcctgggacctgatggccagcggcttcctgatcctgactggaggagtggaccagagcggccgggccctgctgaccatcaccccaccctgccccccagaggagcccccacccagccgggacaccctgaacaccaccctgcactacctgcacagcctgctgcggccagacctgcagaccctgggcctgtctgtgctgctggacctgcggcaggccccacccctgcccccagccctgatcccagccctgagccagctgcaggacagcggggacccccccctggtgcagaggctgctgatcctgattcatgatgacctgcccacagagctgtgtggcttccagggcgctgaggtgctgtctgaaaatgacctgaagagggtggccaagccagaggagctgcagtgggagctgggcggccaccgggaccccagccccagccactgggtggagatccaccaggaggtggtgcggctgtgccgcctgtgccagggcgtgctgggctctgtgcggcaggccatcgaggagctggagggcgctgctgagcctgaggaggaggaggccgtgggcatgcccaagcccctgcagaaggtgctggccgacccccggctgacagccctgcagagagatggaggagccatcctgatgaggctgcggagcacccccagcagcaagctggagggccagggccctgccaccctgtaccaggaggtggatgaggccatccaccagctggtgcggctgagcaacctgcacgtgcagcagcaggagcagaggcagtgcctgcggcggctgcagcaggtgctgcagtggctgagcggccctggagaggagcagctggccagctttgccatgcctggggacaccctgagcgccctgcaggagacagagctgcgcttccgggccttctctgctgaggtgcaggagcggctggcccaggcccgggaggccctggccctggaggagaatgccaccagccagaaggtgctggacatctttgagcagaggctggagcaggtggagagcggcctgcaccgggccctgcggctgcagcgcttcttccagcaggcccacgagtgggtggatgagggctttgcccggctggccggggccggccctggccgggaggccgtgctggccgccctggccctgcggcgggcccctgagcccagcgctggcaccttccaggagatgagggccctggccctggacctgggcagccctgctgccctgcgggagtggggccgctgccaggcccgctgccaggagctggagcggcgcatccagcagcacgtgggggaggaggccagcccccggggctacagaagaagaagagcagatggagccagcagtggaggagcccagtggggccccaggagccccagccccagcctgagcagcctgctgctgcccagcagccctggccccaggcctgcccccagccactgcagcctggccccctgtggggaggactatgaggaggagggccctgagctggcccctgaggccgagggccggccccccagggctgtgctgatccggggcctggaggtgaccagcacagaggtggtggacaggacctgcagcccccgggagcacgtgctgctgggccgggcccggggcccagatggcccctggggcgtgggcacccccaggatggagaggaagaggagcatcagcgcccagcagaggctggtgtctgagctgattgcctgtgagcaggactatgtggccaccctgtctgagcctgtgcccccacctggccctgagctgaccccagagctgcggggcacctgggccgccgccctgagcgcccgggagcggctgcgctccttccacaggacccacttcctgcgggagctgcagggctgtgccacccaccccctgagaattggagcctgcttcctgcggcacggggaccagttcagcctgtatgcccagtatgtgaagcaccgccacaagctggagaatggcctggccgccctgagccccctgagcaagggctccatggaggccggcccctacctgccccgggccctgcagcagcccctggagcagctgaccaggtatggccgcctgctggaggagctgctgcgggaggccggccctgagctgagcagcgagtgccgggccctgggcgctgctgtgcagctgctgcgggagcaggaggcccggggccgggacctgctggccgtggaggccgtgcggggctgtgaaattgacctgaaggagcagggccagctgctgcaccgggaccccttcaccgtcatctgtggcaggaagaagtgcctgcggcacgtgttcctgtttgagcacctgctgctcttcagcaagctgaagggccctgagggcggcagcgagatgtttgtgtacaagcaggccttcaagacagctgacatgggcctgacagagaacatcggggacagcggcctgtgctttgagctgtggttcagaagaagaagagcccgggaggcctacaccctgcaggccaccagccctgagatcaagctgaagtggaccagcagcatcgcccagctgctgtggaggcaggccgcccacaacaaggagctgcgggtgcagcagatggtgtccatgggcatcggcaacaagcccttcctggacatcaaggccctgggggagaggaccctgagcgccctgctgaccggccgggcccctgagaccctggacagcagtggagatgtgtccccaggccccaggaacagccccagcctgcagcccccccaccctggcagcagcacccccaccctggccagccggggcatcctgggcctgagccggcagagccacgcccgggccctgagtgaccccaccacccccctgtag

SEQ ID NO: 18731 - DNA, 4560 bp, Artificial Sequence
  Description of Artificial Sequence: Synthetic coding sequence
atggagcctgagcctgtggaggactgtgtgcagagcaccctggccgccctgtaccccccatttgaggccacagcccccaccctgctgggccaggtgttccaggtggtggagaggacctaccgggaggatgccctgcgctacaccctggacttcctggtgcctgccaagcacctgctggccaaggtgcagcaggaggcctgtgcccagtacagcggcttcctgttcttccacgagggctggcccctgtgcctgcacgagcaggtggtggtgcagctggccgccctgccctggcagctgctgcggcctggggacttctacctgcaggtggtgcccagcgctgcccaggccccccggctggccctgaagtgcctggcccctgggggcggccgggtgcaggaggtgcctgtgcccaatgaggcctgtgcctacctgttcaccccagagtggctgcagggcatcaacaaggaccggcccaccggccgcctgagcacctgcctgctgagcgcccccagcggcatccagaggctgccctgggccgagctgatctgccccaggtttgtgcacaaggagggcctgatggtgggccaccagcccagcaccctgcccccagagctgcccagcggccccccaggcctgcccagcccccccctgcctgaggaggccctgggcaccaggagccctggagatggccacaatgcccctgtggagggccctgagggggagtatgtggagctgctggaggtgaccctgcctgtgcggggcagccccacagatgctgagggcagccctggcctgagccgggtgaggacagtgcccaccaggaaaggagctgggggcaagggccgccaccggcggcaccgggcctggatgcaccagaagggcctgggcccccggggccaggatggagcccggcccccaggagagggcagcagcactggagccagccctgagagccccccaggagctgaggccgtgcctgaggccgctgtgctggaggtgtctgagcccccagctgaggccgtgggggaggccagcggcagctgccccctgcggcctggagagctgcggggcggcggcggcggcggccagggcgctgagggccccccaggcaccccaagaagaactggaaaaggaaacagaaggaagaagagagctgctggccgcggggccctgagccggggcggggacagcgcccccctgagccctggggacaaggaggatgccagccaccaggaggccctgggcaacctgcccagccccagcgagcacaagctgcctgagtgccacctggtgaaggaggagtatgagggcagcggcaagccagagagcgagcccaaggagctgaagacagctggggagaaggagccccagctgtctgaggcctgtggccccacagaggagggcgctggggagcgggagctggagggccctggcctgctgtgcatggccggccacacaggccctgagggccccctgagtgacacccccaccccacccctggagaccgtgcaggagggcaaaggagacaacatccctgaggaggccctggccgtgtctgtgtctgaccacccagatgtggcctgggacctgatggccagcggcttcctgatcctgactggaggagtggaccagagcggccgggccctgctgaccatcaccccaccctgccccccagaggagcccccacccagccgggacaccctgaacaccaccctgcactacctgcacagcctgctgcggccagacctgcagaccctgggcctgtctgtgctgctggacctgcggcaggccccacccctgcccccagccctgatcccagccctgagccagctgcaggacagcggggacccccccctggtgcagaggctgctgatcctgattcatgatgacctgcccacagagctgtgtggcttccagggcgctgaggtgctgtctgaaaatgacctgaagagggtggccaagccagaggagctgcagtgggagctgggcggccaccgggaccccagccccagccactgggtggagatccaccaggaggtggtgcggctgtgccgcctgtgccagggcgtgctgggctctgtgcggcaggccatcgaggagctggagggcgctgctgagcctgaggaggaggaggccgtgggcatgcccaagcccctgcagaaggtgctggccgacccccggctgacagccctgcagagagatggaggagccatcctgatgaggctgcggagcacccccagcagcaagctggagggccagggccctgccaccctgtaccaggaggtggatgaggccatccaccagctggtgcggctgagcaacctgcacgtgcagcagcaggagcagaggcagtgcctgcggcggctgcagcaggtgctgcagtggctgagcggccctggagaggagcagctggccagctttgccatgcctggggacaccctgagcgccctgcaggagacagagctgcgcttccgggccttctctgctgaggtgcaggagcggctggcccaggcccgggaggccctggccctggaggagaatgccaccagccagaaggtgctggacatctttgagcagaggctggagcaggtggagagcggcctgcaccgggccctgcggctgcagcgcttcttccagcaggcccacgagtgggtggatgagggctttgcccggctggccggggccggccctggccgggaggccgtgctggccgccctggccctgcggcgggcccctgagcccagcgctggcaccttccaggagatgagggccctggccctggacctgggcagccctgctgccctgcgggagtggggccgctgccaggcccgctgccaggagctggagcggcgcatccagcagcacgtgggggaggaggccagcccccggggctacagaagaagaagagcagatggagccagcagtggaggagcccagtggggccccaggagccccagccccagcctgagcagcctgctgctgcccagcagccctggccccaggcctgcccccagccactgcagcctggccccctgtggggaggactatgaggaggagggccctgagctggcccctgaggccgagggccggccccccagggctgtgctgatccggggcctggaggtgaccagcacagaggtggtggacaggacctgcagcccccgggagcacgtgctgctgggccgggcccggggcccagatggcccctggggcgtgggcacccccaggatggagaggaagaggagcatcagcgcccagcagaggctggtgtctgagctgattgcctgtgagcaggactatgtggccaccctgtctgagcctgtgcccccacctggccctgagctgaccccagagctgcggggcacctgggccgccgccctgagcgcccgggagcggctgcgctccttccacaggacccacttcctgcgggagctgcagggctgtgccacccaccccctgagaattggagcctgcttcctgcggcacggggaccagttcagcctgtatgcccagtatgtgaagcaccgccacaagctggagaatggcctggccgccctgagccccctgagcaagggctccatggaggccggcccctacctgccccgggccctgcagcagcccctggagcagctgaccaggtatggccgcctgctggaggagctgctgcgggaggccggccctgagctgagcagcgagtgccgggccctgggcgctgctgtgcagctgctgcgggagcaggaggcccggggccgggacctgctggccgtggaggccgtgcggggctgtgaaattgacctgaaggagcagggccagctgctgcaccgggaccccttcaccgtcatctgtggcaggaagaagtgcctgcggcacgtgttcctgtttgagcacctgctgctcttcagcaagctgaagggccctgagggcggcagcgagatgtttgtgtacaagcaggccttcaagacagctgacatgggcctgacagagaacatcggggacagcggcctgtgctttgagctgtggttcagaagaagaagagcccgggaggcctacaccctgcaggccaccagccctgagatcaagctgaagtggaccagcagcatcgcccagctgctgtggaggcaggccgcccacaacaaggagctgcgggtgcagcagatggtgtccatgggcatcggcaacaagcccttcctggacatcaaggccctgggggagaggaccctgagcgccctgctgaccggccgggccgcccggacccgggcctctgtggccgtgagcagctttgaacatgctggccccagcctgcccggcctgagccctggggcctgcagcctgcctgcccgggtggaggaggaggcctgggacctggatgtgaagcagatcagcctggcccctgagaccctggacagcagtggagatgtgtccccaggccccaggaacagccccagcctgcagcccccccaccctggcagcagcacccccaccctggccagccggggcatcctgggcctgagccggcagagccacgcccgggccctgagtgaccccaccacccccctgtag

SEQ ID NO: 18732 - DNA, 2709 bp, Artificial Sequence
  Description of Artificial Sequence: Synthetic coding sequence
atgtttcctgccctggagacccacctgaagcagaccatcccagacccctatgaggacttcatgtaccgccacctgcagtactacggctacttcaaggcccagaggggcagcctgcccaacagcgccacccaccagcacgtgaggaagaacaacccccagtgcctgctgaatggcagcctgggggagaaggatgacctgatcccagacaccctgcagaaggagaagctgctgtggcccatcagcctgagcagcgctgtgcaccggcagatcgaggccatcaacagagacttccacagctgcctgggctggatgcagtggaggggcctgagcagcctgcagcccccaccaccccgcttcaaggacagccctgccagcgccttccgggtggccggcatcacagacagccacatgctgagcctgccccacctgcggagccggcagctgctgtatgatgagctggatgaggtgaacccccggctgcgggagccccaggagctgttcagcatcctgagcaccaagaggcccctgcaggccccccgctggcccattgaatgtgaggtgatcaaggagaacatccaccacatcgagtgggccccaccccagcctgagtacttctaccagcccaagggaaatgagaaggtgcctgagatcgtgggggagaagaagggcaccgtggtgtaccagctggacagcgtgcccatcgagggcagctacttcaccagcagccgggtgggcggcaagaggggcatcgtgaaggagctggccgtgaccctgcagggccctgaggacaacaccctgctgtttgagagcagatttgagagcggcaacctgcagaaggctgtgcgggtggacacctatgaatatgagctgaccctgaggacagacctgtacaccaacaagcacacccagtggttctacttccgggtgcagaacaccaggaaggatgccacctaccgcttcaccatcgtgaacctgctgaagcccaagagcctgtacacagtgggcatgaagcccctgctgtacagccagctggatgccaacaccagaaatattggctggaggcgggagggcaatgagatcaagtactacaagaacaacacagatgatggccagcagcccttctactgcctgacctggaccatccagttcccctatgaccaggacacctgcttctttgcccacttctacccctacacctacacagacctgcagtgctacctgctgtctgtggccaacaaccccatccagagccagttctgcaagctgcagaccctgtgccgcagcctggccggcaacacagtgtacctgctgaccatcaccaaccccagccagaccccccaggaggccgccgccaagaaggctgtggtgctgagcgcccgggtgcaccctggagagagcaatggctcctgggtgatgaagggcttcctggacttcatcctgagcaacagcccagatgcccagctgctgcgggacatctttgtgttcaaggtgctgcccatgctgaacccagatggagtgattgtgggcaactaccgctgcagcctggccggccgggacctgaacagacactacaagaccatcctgaaggagagcttcccctgcatctggtacaccaggaacatgatcaagaggctgctggaggagcgggaggtgctgctgtactgtgacttccacggccacagcaggaagaacaacatcttcctgtatggctgcaacaacaacaacaggaagtactggctgcacgagagggtcttccccctgatgctgtgcaagaatgccccagacaagttctccttccacagctgcaacttcaaggtgcagaagtgcaaggagggcaccggccgggtggtgatgtggaggatgggcatcctgaacagctacaccatggagagcacctttggaggcagcaccctgggcaacaagagggacacccacttcaccatcgaggacctgaagagcctgggctaccacgtgtgtgacaccctgctggacttctgtgaccctgaccagatgaagttcacccagtgcctggccgagctgaaggagctgctgcggcaggagatccacaagaagttccacgagctgggccaggatgtggacctggagggctcctggagcgacatcagcctgagtgacatcgagagcagcaccagcggcagtgacagcagcctgagtgatggcctgcctgtgcacctggccaacattgctgatgagctgacccagaagaagaagatgttcaagaagaagaagaagaagagcctgcagaccaggaagcagagaaatgagcagtaccagaagaagaacctgatgcagaagctgaagctgacagaggacaccagcgagaaggccggctttgccagcaccctgcagaagcagcccaccttcttcaagaacagcgagaacagcagcttcctgcccatgaagaatgaaaacccccggctgaatgagaccaacctgaacagaagagacaaggacacccccctggaccccagcatggccaccctcatcctgcccaagaacaagggccgcatgcagaacaagaagccaggcttcaccgtgtcctgcagccccaagaggaccatcaacagcagccaggagcccgcccctggcatgaagcccaactggcccaggagccgctacccagccaccaagaggggctgtgccgccatggccgcctaccccagcctgcacatctacacctacccctag

SEQ ID NO: 18733 - DNA, 3234 bp, Artificial Sequence
  Description of Artificial Sequence: Synthetic coding sequence
atggaggtgcaggtgtcccaggccagcctgggctttgagctgacctctgtggagaagagcctgcgggagtggagccggctgagccgggaggtgattgcctggctgtgccccagcagccccaacttcatcctgaacttccccccacctccttctgccagctctgtgtccatggtgcagctgttcagcagccccttcggctaccagagccccagcggccacagcgaggaggagcgggagggcaacatgaagagcgccaagccccaggtgaaccacagccagcacggggagagccagagggccctgagccccctgcagagcaccctgagcagcgctgccagccccagccaggcctatgagacctacattgaaaatggcctcatctgcctgaagcacaagatccggaacatcgagaagaagaagctgaagctggaggactacaaggaccggctgaagagcggggagcacctgaacccagaccagctggaggccgtggagaagtatgaggaggtgctgcacaacctggagtttgccaaggagctgcagaagaccttcagcggcctgagcctggacctgctgaaggcccagaagaaggcccagaggcgggagcacatgctgaagctggaggccgagaagaagaagctgcggaccatcctgcaggtgcagtatgtgctgcagaacctgacccaggagcacgtgcagaaggacttcaagggcggcctgaatggagctgtgtacctgcccagcaaggagctggactacctgatcaagttcagcaagctgacctgcccagagagaaatgaaagcctgtctgtggaggaccagatggagcagagcagcctgtacttctgggacctgctggagggcagcgagaaggctgtggtgggcaccacctacaagcacctgaaggacctgctgagcaagctgctgaacagcggctactttgagagcatccctgtgcccaagaatgccaaggagaaggaggtgcccctggaggaggagatgctgatccagagcgagaagaagacccagctgagcaagacagaatctgtgaaggagagcgagagcctgatggagtttgcccagcctgagatccagccccaggagttcctgaacagacgctacatgacagaggtggactacagcaacaagcagggcgaggagcagccctgggaggccgactatgccaggaagcccaacctgcccaagcgctgggacatgctgacagagccagatggccaggagaagaagcaggagagcttcaagtcctgggaggccagcggcaagcaccaggaggtgtccaagccagctgtgtccctggagcagaggaagcaggacaccagcaagctgcggagcaccctgcctgaggagcagaagaagcaggagatcagcaagagcaagcccagccccagccagtggaagcaggacacccccaagagcaaggccggctacgtgcaggaggagcagaagaagcaggagacccccaagctgtggcctgtgcagctgcagaaggagcaggaccccaagaagcagacccccaagtcctggacccccagcatgcagagcgagcagaacaccaccaagtcctggaccacccccatgtgtgaggagcaggacagcaagcagcctgagacccccaagtcctgggagaacaacgtggagagccagaagcacagcctgaccagccagagccagatcagccccaagtcctggggcgtggccacagccagcctcatccccaatgaccagctgctgcccaggaagctgaacacagagcccaaggatgtgcccaagcctgtgcaccagcctgtgggcagcagcagcaccctgcccaaggaccctgtgctgaggaaggagaagctgcaggacctgatgacccagatccagggcacctgcaacttcatgcaggagagcgtgctggactttgacaagcccagcagcgccatccccaccagccagcccccatctgccaccccaggcagccctgtggccagcaaggagcagaacctgagcagccagagcgacttcctgcaggagcccctgcaggccaccagcagccctgtgacctgcagcagcaatgcctgcctggtgaccacagaccaggccagcagcggcagcgagacagagttcatgaccagcgagaccccagaggtgttcaacgtgaatgcccccctgccccccaggaaggagcaggagatcaaggagagcccctacagccctggctacaaccagagcttcaccacagccagcacccagaccccaccccagtgccagctgcccagcatccacgtggagcagacagtgcacagccaggagacagccaactaccacccagatggcaccatccaggtgtccaatggcagcctggccttctacccagcccagaccaacgtgttcccccggcccacccagccctttgtgaacagccggggctctgtgcggggctgcacccggggcggccgcctcatcaccaacagctaccgcagccctgggggctacaagggctttgacacctaccggggcctgcccagcatcagcaatggaaactacagccagctgcagttccaggcccgggagtacagcggggccccctacagccagagggacaacttccagcagtgctacaagagaggaggcaccagcggcggcccccgggccaacagcagagctggctggagcgacagcagccaggtgagcagccctgagcgggacaatgagaccttcaacagcggggacagcggccagggcgacagccgctccatgacccctgtggatgtgcctgtgaccaacccagctgccaccatcctgcctgtgcacgtgtaccccctgccccagcagatgagggtggccttctctgctgcccggaccagcaacctggcccctggcaccctggaccagcccatcgtgtttgacctgctgctgaacaacctgggggagacctttgacctgcagctgggccgcttcaactgccctgtgaatggcacctacgtgttcatcttccacatgctgaagctggccgtgaatgtgcccctgtatgtgaacctgatgaagaatgaggaggtgctggtgtctgcctatgccaatgatggagccccagaccatgaaacagccagcaaccacgccatcctgcagctgttccagggcgaccagatctggctgcggctgcacagaggagccatctacggcagctcctggaagtacagcaccttcagcggctacctgctgtaccaggactag

SEQ ID NO: 18734 - DNA, 1056 bp, Artificial Sequence
  Description of Artificial Sequence: Synthetic coding sequence
atgaccctgcggctgctggaggactggtgccggggcatggacatgaaccccaggaaggccctgctgattgctggcatcagccagagctgcagcgtggccgagattgaggaggccctgcaggccggcctggcccccctgggggagtaccgcctgctgggccgcatgttcagaagagatgagaacaggaaggtggccctggtgggcctgacagctgagaccagccacgccctggtgcccaaggagatccctggaaaaggaggcatctggagggtcatcttcaagcccccagaccctgacaacaccttcctgagccggctgaatgagttcctggccggggagggcatgacagtgggggagctgagccgggccctgggccatgaaaatggcagcctggaccctgagcagggcatgatccctgagatgtgggcccccatgctggcccaggccctggaggccctgcagcctgccctgcagtgcctgaagtacaagaagctgcgggtcttcagcggccgggagagccctgagcccggggaggaggagtttggccgctggatgttccacaccacccagatgatcaaggcctggcaggtgcctgatgtggagaagagaagaaggctgctggagagcctgcggggccctgccctggatgtgatccgggtgctgaagatcaacaaccccctcatcaccgtggatgagtgcctgcaggccctggaggaggtgtttggagtgacagacaacccccgggagctgcaggtgaagtacctgaccacctaccagaaggatgaggagaagctgagcgcctacgtgctgcggctggagcccctgctgcagaagctggtgcagagaggagccatcgagagagatgctgtgaaccaggcccggctggaccaggtgattgctggagctgtgcacaagaccatccggcgggagctgaacctgcctgaagatggccctgcccctggcttcctgcagctgctggtgctgatcaaggactatgaggccgctgaggaggaggaggccctgctgcaggccatcctggagggcaacttcacctag

SEQ ID NO: 18735 - DNA, 2559 bp, Artificial Sequence
  Description of Artificial Sequence: Synthetic coding sequence
atgagcggccgggcccgggtgaaggcccggggcatcgcccggagccccagcgccacagaggtgggccgcatccaggccagccccctgcccaggtctgtggacctgagcaacaatgaggccagcagcagcaatggcttcctgggcaccagccgcatcagcaccaatgacaagtatggcatcagcagtggagatgctggcagcaccttcatggagcggggcgtgaagaacaagcaggacttcatggacctgagcatctgcacccgggagaagctggcccacgtgaggaactgcaagacaggcagcagcggcatccctgtgaagctggtgaccaacctcttcaacctggacttcccccaggactggcagctgtaccagtaccacgtgacctacatcccagacctggccagccggcggctgagaattgccctgctgtacagccacagcgagctgagcaacaaggccaaggcctttgatggagccatcctcttcctgagccagaagctggaggagaaggtgacagagctgagcagcgagacccagagaggagagaccatcaagatgaccatcaccctgaagcgggagctgcccagcagcagccctgtgtgcatccaggtgttcaacatcatcttcaggaagatcctgaagaagctgtccatgtaccagatcggcaggaacttctacaaccccagcgagcccatggagatcccccagcacaagctgagcctgtggccaggctttgccatctctgtgtcctactttgagaggaagctgctcttcagcgcagatgtgtcctacaaggtgctgagaaatgagaccgtgctggagttcatgacagccctgtgccagaggacaggcctgagctgcttcacccagacctgtgagaagcagctgattggcctgattgtgctgacccgctacaacaacagaacctacagcattgatgacatcgactggagcgtgaagcccacccacaccttccagaagagagatggaacagagatcacctacgtggactactacaagcagcagtatgacatcaccgtgtctgacctgaaccagcccatgctggtgtccctgctgaagaagaagagaaatgacaacagcgaggcccagctggcccacctgatccctgagctgtgcttcctgaccggcctgacagaccaggccaccagtgacttccagctgatgaaggctgtggccgagaagacccggctgagccccagcggccggcagcagaggctggcccggctggtggacaacatccagaggaacaccaatgccaggtttgagctggagacctggggcctgcacttcggcagccagatcagcctgaccggccgcatcgtgcccagcgagaagatcctgatgcaggaccacatctgccagcctgtgtctgctgctgactggagcaaggacatccgcacctgcaagatcctgaatgcccagagcctgaacacctggctgatcctgtgcagcgacagaacagaatatgtggccgagagcttcctgaactgcctgcggcgggtggccggctccatgggcttcaacgtggactaccccaagatcatcaaggtgcaggagaacccagctgcctttgtgcgggccatccagcagtatgtggaccctgatgtgcagctggtgatgtgcatcctgcccagcaaccagaagacctactatgacagcatcaagaagtacctgagcagtgactgccctgtgcccagccagtgtgtgctggcccggaccctgaacaagcagggcatgatgatgagcatcgccaccaagatcgccatgcagatgacctgcaagctgggcggggagctgtgggccgtggagatccccctgaagagcctgatggtggtgggcattgatgtgtgcaaggatgccctgagcaaggatgtgatggtggtgggctgtgtggcctctgtgaacccccgcatcacccgctggttcagccgctgcatcctgcagaggaccatgacagatgtggccgactgcctgaaggtgttcatgactggagccctgaacaagtggtacaagtacaaccacgacctgcctgcccgcatcatcgtgtacagagctggggtgggagatggccagctgaagaccctcatcgagtatgaggtgccccagctgctgagctctgtggccgagagcagcagcaacaccagcagccggctgtctgtgattgtggtgaggaagaagtgcatgccccgcttcttcacagagatgaacagaacagtgcagaacccccccctgggcaccgtggtggacagcgaggccaccagaaatgagtggtatgacttctacctgatcagccaggtggcctgccggggcaccgtgagccccacctactacaacgtcatctatgatgacaatggcctgaagccagaccacatgcagaggctgaccttcaagctgtgccacctgtactacaactggccaggcatcgtgtctgtgcctgccccctgccagtatgcccacaagctgaccttcctggtggcccagagcatccacaaggagcccagcctggagctggccaaccacctgttctacctgtag

SEQ ID NO: 18736 - DNA, 2163 bp, Artificial Sequence
  Description of Artificial Sequence: Synthetic coding sequence
atgtatggcagcgcccggtctgtgggcaaggtggagcccagcagccagagccctggccgcagcccccggctgcccaggagcccccggctgggccacaggaggaccaacagcactggaggcagcagcggcagctctgtgggcggcggcagcggcaagaccctgtccatggagaacatccagagcctgaatgctgcctatgccaccagcggccccatgtacctgagtgaccatgaaaatgtgggcagcgagacccccaagagcaccatgaccctgggccgcagcggcggccgcctgccctacggcgtgaggatgacagccatgggcagcagccccaacatcgccagcagcggcgtggccagtgacaccatcgcctttggagagcaccacctgccccctgtgtccatggccagcacagtgccccacagcctgcggcaggcccgggacaacaccatcatggacctgcagacccagctgaaggaggtgctgcgggagaatgacctgctgaggaaggatgtggaggtgaaggagagcaagctgagcagctccatgaacagcatcaagaccttctggagccctgagctgaagaaggagcgggccctgaggaaggatgaggccagcaagatcaccatctggaaggagcagtacagagtggtgcaggaggagaaccaggtggatgccctgcggctgcggctggaggagaaggagaccatgctgaacaagaagaccaagcagatccaggacatggccgaggagaagggcacccaggccggggagatccatgacctgaaggacatgctggatgtgaaggagaggaaggtgaatgtgctgcagaagaagattgagaacctgcaggagcagctgcgggacaaggagaagcagatgagcagcctgaaggagcgggtgaagagcctgcaggccgacaccaccaacacagacacagccctgaccaccctggaggaggccctggccgagaaggagaggaccatcgagcggctgaaggagcagagggacagagatgagcgggagaagcaggaggagattgacaactacaagaaggacctgaaggacctgaaggagaaggtgtccctgctgcagggcgacctgtctgagaaggaggccagcctgctggacctgaaggagcacgccagcagcctggccagcagcggcctgaagaaggacagccggctgaagaccctggagatcgccctggagcagaagaaggaggagtgcctgaagatggagagccagctgaagaaggcccatgaagctgccctggaggcccgggccagccctgagatgtctgaccgcatccagcacctggagcgggagatcacccgctacaaggatgagagcagcaaggcccaggccgaggtggaccggctgctggagatcctgaaggaggtggagaatgagaagaatgacaaggacaagaagattgctgagctggagagcctcttcagccggcaggtgaaggaccagaacaagaaggtggccaacctgaagcacaaggagcaggtggagaagaagaagagcgcccagatgctggaggaggcccggcggcgggaggacaacctgaatgacagcagccagcagctgcaggacagcctgaggaagaaggatgacagaattgaggagctggaggaggccctgcgggagagcgtgcagatcacagctgagcgggagatggtgctggcccaggaggagagcgcccggaccaatgctgagaagcaggtggaggagctgctgatggccatggagaaggtgaagcaggagctggagagcatgaaggccaagctgagcagcacccagcagagcctggccgagaaggagacccacctgaccaacctgcgggcagagaggaggaagcacctggaggaggtgctggagatgaagcaggaggccctgctggccgccatcagcgagaaggatgccaacatcgccctgctggagctgagcagcagcaagaagaagacccaggaggaggtggccgccctgaagcgggagaaggaccggctggtgcagcagctgaagcagcagacccagaacaggatgaagctgatggctgacaactatgaagatgaccacttcaagagcagccacagcaaccagaccaaccacaagcccagcccagaccaggatgaggaggagggcatctgggcctag

SEQ ID NO: 18737 - DNA, 1344 bp, Artificial Sequence
  Description of Artificial Sequence: Synthetic coding sequence
atggacatgggcaaccagcaccccagcatcagccggctgcaggagatccagaaggaggtgaagtctgtggagcagcaggtgattggcttcagcggcctgagtgatgacaagaactacaagaagctggagcgcatcctgaccaagcagctgtttgaaattgattctgtggacacagagggcaaaggagacatccagcaggccaggaagagagctgcccaggagacagagcggctgctgaaggagctggagcagaatgccaaccacccccaccgcatcgagatccagaacatctttgaggaggcccagagcctggtgcgggagaagatcgtgcccttctacaacggcggcaactgtgtgacagatgaatttgaggagggcatccaggacatcatcctgcggctgacccacgtgaagacaggaggcaagatcagcctgaggaaggcccgctaccacaccctgaccaagatctgtgctgtgcaggagatcatcgaggactgcatgaagaagcagcccagcctgcccctgtctgaagatgcccaccccagcgtggccaagatcaactttgtgatgtgtgaggtgaacaaggcccggggcgtgctgattgccctgctgatgggcgtgaacaacaatgagacctgccgccacctgagctgtgtgctgagcggcctgattgctgacctggatgccctggatgtgtgtggccgcacagagatccggaactaccgccgggaggtggtggaggacatcaacaagctgctgaagtacctggacctggaggaggaggccgacaccaccaaggcctttgacctgcggcagaaccacagcatcctgaagattgagaaggtgctgaagaggatgagggagatcaagaatgagctgctgcaggcccagaaccccagcgagctgtacctgagcagcaagacagagctgcagggcctcatcggccagctggatgaggtgtccctggagaagaacccctgcatccgggaggccaggagaagagctgtgattgaggtgcagaccctcatcacctacatcgacctgaaggaggccctggagaagaggaagctgtttgcctgtgaggagcaccccagccacaaggctgtgtggaatgtgctgggcaacctgtctgagatccagggcgaggtgctgagctttgatggcaacagaacagacaagaactacatccggctggaggagctgctgaccaagcagctgctggccctggatgctgtggacccccagggcgaggagaagtgcaaggccgccaggaagcaggccgtgcggctggcccagaacatcctgagctacctggacctgaagagtgatgagtgggagtactag

SEQ ID NO: 18738 - DNA, 1476 bp, Artificial Sequence
  Description of Artificial Sequence: Synthetic coding sequence
atggcccagagcggcggggaggcccggcccggccccaagacagctgtgcagatccgggtggccatccaggaggccgaggatgtggatgagctggaggatgaggaggagggcgctgagaccagaggagctggggaccctgcccgctacctgagccctggctggggcagcgccagcgaggaggagcccagccggggccacagcggcaccacagccagcggaggagaaaatgaaagagaggacctggagcaggagtggaagcccccagatgaggagctgatcaagaagctggtggaccagatcgagttctacttcagtgatgagaacctggagaaggatgccttcctgctgaagcacgtgagaagaaacaagctgggctacgtgtctgtgaagctgctgaccagcttcaagaaggtgaagcacctgacccgggactggaggaccacagcccacgccctgaagtacagcgtggtgctggagctgaatgaagaccacaggaaggtgcggaggaccacccctgtgcccctcttccccaatgaaaacctgcccagcaagatgctgctggtgtatgacctgtacctgagccccaagctgtgggccctggccaccccccagaagaatggccgggtgcaggagaaggtgatggagcacctgctgaagctgtttggcaccttcggggtcatcagctctgtgcgcatcctgaagccaggccgggagctgcccccagacatccgccgcatcagcagccgctacagccaggtgggcacccaggagtgtgccatcgtggagtttgaggaggtggaggccgccatcaaggcccacgagttcatgatcacagagagccagggcaaggagaacatgaaggctgtgctgattggcatgaagccacccaagaagaagccagccaaggacaagaaccatgatgaggagcccacagccagcatccacctgaacaagagcctgaacaagagggtggaggagctgcagtacatgggagatgagagcagcgccaacagcagcagtgaccctgagagcaaccccaccagccccatggccggcagaagacatgctgccaccaacaagctgagccccagcggccaccagaacctcttcctgagccccaatgccagcccctgcaccagcccctggagcagccccctggcccagaggaagggcgtgtccaggaagagccccctggccgaggagggccgcctgaactgcagcaccagccctgagatcttcaggaagtgcatggactacagcagtgacagctctgtgacccccagcggcagcccctgggtgagaagaagacggcaggccgagatgggcacccaggagaagagccctggcaccagccccctgctgagcaggaagatgcagacagcagatggcctgcctgtgggcgtgctgcggctgccccggggccctgacaacacccggggcttccacggccacgagaggagccgggcctgtgtgtag

SEQ ID NO: 18739 - DNA, 315 bp, Artificial Sequence
  Description of Artificial Sequence: Synthetic coding sequence
atggccggcaaggcccaccggctgtctgctgaggagcgggaccagctgctgcccaacctgcgggctgtgggctggaatgagctggagggcagagatgccatcttcaagcagttccacttcaaggacttcaacagagccttcggcttcatgaccagggtggccctgcaggccgagaagctggaccaccaccctgagtggttcaacgtgtacaacaaggtgcacatcaccctgagcacccatgaatgtgccggcctgtctgagcgggacatcaacctggccagcttcatcgagcaggtggccgtgtccatgacctag

SEQ ID NO: 18740 - DNA, 738 bp, Artificial Sequence
  Description of Artificial Sequence: Synthetic coding sequence
atgattggagtgtcctttgaggaggccaagagcatcatcaccggggccaagctgagcacccggctggagagcgcctgggagatcgccttcatccggcagaagagtgacaacatccagcctgagaacctgagctgcaccagcctgattgaggccagcggggagtatggcccccaggccagcaccctgagcctcttcagcagccccccagagatcctgatccccaagaccagcagcacccccaagaccaacaatgacatcctgagcagctgtgagatcaagacaggctacaacaagacagtgcagatccccatcaccagcgagaacagcacagtgggcctgagcaacacagatgtggccagcgcctggacagagaactacggcctgcaggagaagatcagcctgaaccccagcgtgcgcttcaaggccgagaagctggagatggccctgaactacctgggcatccagcccaccaaggagcagcaccaggccctgcggcagcaggtgcaggccgacagcaaaggaacagtgtcctttggagactttgtgcaggtggccaggaacctcttctgcctgcagctggatgaggtgaatgtgggcgcccacgagatcagcaacatcctggacagccagctgctgccctgtgacagcagcgaggctgatgagatggagcggctgaagtgtgaaagagatgatgccctgaaggaggtgaacaccctgaagtggccaggccagaactag

SEQ ID NO: 18741 - DNA, 849 bp, Artificial Sequence
  Description of Artificial Sequence: Synthetic coding sequence
atgggcggcgctgtgtctgctggagaagataatgatgagctgattgacaacctgaaggaggcccagtacatcagaacagagctggtggagcaggccttccgggccatcgacagagctgactactacctggaggagttcaaggaaaatgcctacaaggacctggcctggaagcacggcaacatccacctgagcgccccctgcatctacagcgaggtgatggaggccctggacctgcagcccggcctgtccttcctgaacctgggcagcggcaccggctacctgagctccatggtgggcctcatcctgggcccctttggagtgaaccacggcgtggagctgcacagtgatgtgattgaatatgccaagcagaagctggacttcttcatccgcaccagtgacagctttgacaagtttgacttctgtgagcccagctttgtgactggaaactgcctggagatcagcccagactgcagccagtatgacagagtgtactgtggggccggcgtgcagaaggagcacgaggagtacatgaagaacctgctgaaggtgggcggcatcctggtgatgcccctggaggagaagctgaccaagatcaccaggacaggccccagcgcctgggagaccaagaagatcctggccgtgtcctttgcccccctcatccagccctgccacagcgagagcggcaagagccggctggtgcagctgcggagccccagctttgtgcagggctggagcgtggtggtgctgagccagctgacagctgccagcaccttccaggccgaggccatcctgcccagccagagccccacctggctgaccctgcaggtgctggccaccatgcccaactag

SEQ ID NO: 18742 - DNA, 612 bp, Artificial Sequence
  Description of Artificial Sequence: Synthetic coding sequence
atggcccggccccggccccgggagtacaaggccggggacctggtgtttgccaagatgaagggctacccccactggccagccagaattgatgagctgcctgagggcgctgtgaagcccccagccaacaagtaccccatcttcttcttcggcacccatgaaacagccttcctgggccccaaggacctcttcccctacaaggagtacaaggacaagtttgggaagagcaacaagaggaagggcttcaatgaaggcctgtgggagattgagaacaaccctggggtgaagttcaccggctaccaggccatccagcagcagagcagcagcgagacagaaggagagggcggcaacacagcagatgccagcagcgaggaggagggggacagagtggaggaggatggcaagggcaagaggaagaatgagaaggccggcagcaagaggaagaagagctacaccagcaagaagagcagcaagcagagcaggaagagccctggagatgaagatgacaaggactgcaaggaggaggagaacaagagcagcagcgagggcggagatgctggaaatgacaccaggaacaccaccagtgacctgcagaagaccagcgagggcacctag

SEQ ID NO: 18743 - DNA, 540 bp, Artificial Sequence
  Description of Artificial Sequence: Synthetic coding sequence
atgaagacccctgtggagctggccgtgtctggcatgcagaccctgggcctgcagcaccgctgccggggcggctacagagtgaaggcccggaccagctatgtggatgagaccctgtttggcagccctgctggcacccggcccaccccaccagactttgaccccccctgggtggagaaggccaacagaacccggggcgtgggcaaggaggccagcaaggccctgggcgccaagggcagctgtgagaccacccccagccggggcagcacccccaccctgacccccaggaagaagaacaagtaccggcccatcagccacacccccagctactgtgatgagagcctgtttggcagccgctctgagggcgccagctttggagcccccaggatggccaagggagatgctgccaagctgcgggccctgctgtggaccccaccacccaccccccggggcagccacagcccccggccccgggaggcccctcctcctgtgccccccacccagatgggcctgcgcatcagcggcctgccccggcagggctag

SEQ ID NO: 18744 - DNA, 1104 bp, Artificial Sequence
  Description of Artificial Sequence: Synthetic coding sequence
atggatggagaggacatcccagacttcagcagcctgaaggaggagacagcctactggaaggagctgagcctgaagtacaagcagagcttccaggaggccagagatgagctggtggagttccaggagggcagccgggagctggaggccgagctggaggcccagctggtgcaggccgagcagaggaacagagacctgcaggccgacaaccagaggctgaagtatgaggtggaggccctgaaggagaagctggagcaccagtatgcccagagctacaagcaggtgtctgtgctggaggatgacctgagccagacccgggccatcaaggagcagctgcacaagtatgtgcgggagctggagcaggccaatgatgacctggagcgggccaagagggccaccatcgtgtccctggaggactttgagcagaggctgaaccaggccattgaaagaaatgccttcctggagagcgagctggatgagaaggagagcctgctggtgtctgtgcagaggctgaaggatgaggcccgggacctgcggcaggagctggccgtgcgggagcggcagcaggaggtgaccaggaagagcgcccccagcagccccaccctggactgtgagaagatggacagcgctgtgcaggccagcctgagcctgcctgccacccctgtgggcaaaggaacagagaacaccttccccagccccaaggccatccccaatggatttggcaccagccccctgaccccatctgcccgcatcagcgccctgaacatcgtgggggacctgctgaggaaggtgggcgccctggagagcaagctggccgcctgcaggaactttgccaaggaccaggccagcaggaagagctacatctctggaaatgtgaactgtggggtgctgaatggaaatggcaccaagttcagccgcagcggccacaccagcttctttgacaagggcagcagcagcagctgtgccatccgggccagcagaagacgcttcagcagcagcagcgctgacctggccggccggggcggcggagatggcagcatcccagcccagcacagcactggagccagcggcaaggcccccccacccaccctgctgctggagacctag

SEQ ID NO: 18745 - DNA, 591 bp, Artificial Sequence
  Description of Artificial Sequence: Synthetic coding sequence
atgggcagccgcagcagccacgccgctgtgatcccagatggagacagcatccggcgggagaccggcttcagccaggccagcctgctgcggctgcaccaccgcttccgggccctggacaggaacaagaagggctacctgagcaggatggacctgcagcagatcggggccctggccgtgaaccccctgggggaccgcatcatcgagagcttcttcccagatggcagccagagggtggacttccctggctttgtgcgggtgctggcccacttccggcctgtggaggatgaggacacagagacccaggaccccaagaagccagagcccctgaacagcagaagaaacaagctgcactacgccttccagctgtatgacctggacagagatggcaagatcagcagacatgagatgctgcaggtgctgcggctgatggtgggcgtgcaggtgacagaggagcagctggagaacattgctgacagaacagtgcaggaggctgatgaagatggagatggagctgtgtcctttgtggagttcaccaagagcctggagaagatggatgtggagcagaagatgagcatccgcatcctgaagtag

SEQ ID NO: 18746 - DNA, 2313 bp, Artificial Sequence
  Description of Artificial Sequence: Synthetic coding sequence
atgttccgctatgagagcctggaggactgccccctggatgaagatgaagatgccttccagggcctgggggaggaggatgaggagattgaccagttcaatgatgacacctttggaagtggagctgtggatgatgactggcaggaggcccacgagcggctggccgagctggaggagaagctgcctgtggccgtgaatgagcagacaggaaatggagagagagatgagatggacctgctgggggaccacgaggagaacctggccgagcggctgagcaagatggtgattgaaaatgagctggaggaccctgccatcatgagagctgtgcagaccaggcctgtgctgcagccccagcccggcagcctgaacagcagcatctgggatggcagcgaggtgctgcggcgcatccggggccccctgctggcccaggagatgcccaccgtgtctgtgctggagtatgccctgccccagaggcctccccagggcccagaagatgaccgggacctgtctgagcgggccctgcccaggaggagcaccagccccatcatcggcagcccccctgtgcgggctgtgcccatcggcaccccacccaagcagatggctgtgcccagcttcacccagcagatcctgtgccccaagcctgtgcacgtgcggccccccatgccaccccgctacccagccccctacggggagaggatgagccccaaccagctgtgcagcgtgcccaacagcagcctgctgggccaccccttccccccatctgtgccccctgtgctgagccccctgcagagggcccagctgctgggcggggcccagctgcagcccggccgcatgagccccagccagtttgcccgggtgcccggctttgtgggcagccccctggccgccatgaaccccaagctgctgcagggccgggtgggccagatgctgcccccagcccctggcttccgggccttcttcagcgccccacccagcgccaccccaccaccccagcagcaccccccaggccctggcccccacctgcagaacctgcggagccaggcccccatgttccggccagacaccacccacctgcacccccagcaccggcggctgctgcaccagaggcagcagcagaacagaagccagcacaggaacctgaatggagctggggaccggggcagccacaggagcagccaccaggaccacctgaggaaggacccctatgccaacctgatgctgcagcgggagaaggactgggtgtccaagatccagatgatgcagctgcagagcacagacccctacctggatgacttctactaccagaactactttgagaagctggagaagctgtctgctgctgaggagatccagggagatggccccaagaaggagaggaccaagctgatcaccccccaggtggccaagctggagcacgcctacaagcctgtgcagtttgagggcagcctgggcaagctgactgtgtcctctgtgaacaaccccaggaagatgattgatgctgtggtgaccagccgctcagaagatgatgagaccaaggagaagcaggtgcgggacaagaggaggaagaccctggtgatcatcgagaagacctacagcctgctgctggatgtggaggactatgaaagacgctacctgctgagcctggaggaggagaggcctgccctgatggatgacaggaagcacaagatctgcagcatgtatgacaacctgcggggcaagctgcccggccaggagcggcccagtgatgaccactttgtgcagatcatgtgcatcaggaagggcaagaggatggtggcccgcatcctgcccttcctgagcacagagcaggccgctgacatcctgatgaccacagccaggaacctgcccttcctgatcaagaaggatgcccaggatgaggtgctgccctgcctgctgagccccttcagcctgctgctgtaccacctgcccagcgtgtccatcaccagcctgctgcggcagctgatgaacctgccccagagcgctgccaccccagccctgagcaacccccacctgacagctgtgctgcagaacaagtttggcctgagcctgctgctgatcctgctgagcagaggagaggacctgcagagcagtgaccctgccacagagagcacccagaacaaccagtggacagaggtgatgttcatggccacccgggagctgctgcgcatcccccaggccgccctggccaagcccatcagcatccccaccaacctggtgtccctcttcagccgctacgtggaccggcagaagctgaacctgctggagaccaagctgcagctggtgcagggcatcagatag

SEQ ID NO: 18747 - DNA, 1518 bp, Artificial Sequence
  Description of Artificial Sequence: Synthetic coding sequence
atgaggctgcggcggctggccctcttccctggggtggccctgctgctggccgccgcccggctggccgccgccagtgatgtgctggagctgacagatgacaactttgagagccgcatcagtgacaccggcagcgctggcctgatgctggtggagttctttgccccctggtgtggccactgcaagaggctggccccagaatatgaagctgctgccacccggctgaagggcatcgtgcccctggccaaggtggactgcacagccaacaccaacacctgcaacaagtatggagtgtctggctaccccaccctgaagatcttcagagatggagaggaggccggggcctatgatggccccaggacagcagatggcatcgtgagccacctgaagaagcaggccggccctgcctctgtgcccctgaggacagaggaggagttcaagaagttcatcagtgacaaggatgccagcatcgtgggcttctttgatgacagcttcagcgaggcccacagcgagttcctgaaggccgccagcaacctgcgggacaactacagatttgcccacaccaacgtggagagcctggtgaatgaatatgatgacaatggagagggcatcatcctcttccggcccagccacctgaccaacaagtttgaggacaagacagtggcctacacagagcagaagatgaccagcggcaagatcaagaagttcatccaggagaacatcttcggcatctgcccccacatgacagaggacaacaaggacctgatccagggcaaggacctgctgattgcctactatgatgtggactatgagaagaatgccaagggcagcaactactggaggaacagagtgatgatggtggccaagaagttcctggatgctggccacaagctgaactttgctgtggccagcaggaagaccttcagccatgagctgagtgactttggcctggagagcacagctggggagatccctgtggtggccatcagaacagccaagggggagaagtttgtgatgcaggaggagttcagcagagatggcaaggccctggagcgcttcctgcaggactactttgatggcaacctgaagcgctacctgaagtctgagcccatccctgagagcaatgatggccctgtgaaggtggtggtggccgagaactttgatgaaattgtgaacaatgaaaacaaggatgtgctgattgagttctacgccccctggtgtggccactgcaagaacctggagcccaagtacaaggagctgggggagaagctgagcaaggaccccaacatcgtgattgccaagatggatgccacagccaatgatgtgcccagcccctatgaggtgcggggcttccccaccatctacttctccccagccaacaagaagctgaaccccaagaagtatgaaggaggccgggagctgagtgacttcatctcctacctgcagcgggaggccaccaacccccctgtgatccaggaggagaagcccaagaagaagaagaaggcccaggaggacctgtag

SEQ ID NO: 18748 - DNA, 684 bp, Artificial Sequence
  Description of Artificial Sequence: Synthetic coding sequence
atgtctgtggtgccccccaacagaagccagacaggctggccccggggcgtgacccagtttggaaacaagtacatccagcagaccaagcccctgaccctggagaggaccatcaacctgtaccccctgaccaactacaccttcggcaccaaggagcccctgtatgagaaggacagctctgtggccgcccgcttccagaggatgagggaggagtttgacaagattggcatgagaagaacagtggagggcgtgctgattgtgcatgagcaccggctgccccacgtgctgctgctgcagctgggcaccaccttcttcaagctgcctggaggagagctgaaccctggagaagatgaggtggagggcctgaagaggctgatgacagagatcctgggccggcaggatggagtgctgcaggactgggtgattgatgactgcatcggcaactggtggaggcccaactttgagcccccccagtacccctacatcccagcccacatcaccaagcccaaggagcacaagaagctgttcctggtgcagctgcaggagaaggccctgtttgctgtgcccaagaactacaagctggtggccgcccccctgtttgagctgtatgacaatgcccctggctacggccccatcatcagcagcctgccccagctgctgagccgcttcaacttcatctacaactag

SEQ ID NO: 18749 - DNA, 2244 bp, Artificial Sequence
  Description of Artificial Sequence: Synthetic coding sequence
atgagccaggtgaagagcagctacagctatgatgcccccagcgacttcatcaacttcagcagcctggatgatgaaggagacacccagaacatcgacagctggtttgaggagaaggccaacctggagaacaagctgctgggcaagaatggaactggaggcctcttccagggcaagacccccctgaggaaggccaacctgcagcaggccatcgtgacccccctgaagcctgtggacaacacctactacaaggaggccgagaaggagaacctggtggagcagagcatccccagcaatgcctgcagcagcctggaggtggaggccgccatcagcaggaagaccccagcccagccccagaggaggagcctgcggctgagcgcccagaaggacctggagcagaaggagaagcaccacgtgaagatgaaggccaagagatgtgccacccctgtgatcattgatgagatcctgcccagcaagaagatgaaggtgagcaacaacaagaagaagccagaggaggagggcagcgcccaccaggacacagctgagaagaatgccagcagccctgagaaggccaagggccgccacacagtgccctgcatgcccccagccaagcagaagttcctgaagagcacagaggagcaggagctggagaagtccatgaagatgcagcaggaggtggtggagatgaggaagaagaatgaggagttcaagaagctggccctggccggcatcggccagcctgtgaagaagtctgtgtcccaggtgaccaagtctgtggacttccacttcagaacagatgagcgcatcaagcagcaccccaagaaccaggaggagtacaaggaggtgaacttcaccagcgagctgaggaagcaccccagcagccctgcccgggtgaccaagggctgcaccatcgtgaagcccttcaacctgagccagggcaagaagaggacctttgatgagaccgtgtccacctacgtgcccctggcccagcaggtggaggacttccacaagaggacccccaaccgctaccacctgcggagcaagaaggatgacatcaacctgctgcccagcaagagctctgtgaccaagatctgccgggacccccagacccctgtgctgcagaccaagcaccgggcccgggctgtgacctgcaagagcacagctgagctggaggccgaggagctggagaagctgcagcagtacaagttcaaggcccgggagctggacccccgcatcctggagggcggccccatcctgcccaagaagccccctgtgaagccacccacagagcccatcggctttgacctggagattgagaagaggatccaggagcgggagagcaagaagaagacagaagatgagcactttgagttccacagccggccctgccccaccaagatcctggaggatgtggtgggcgtgcctgagaagaaggtgctgcccatcaccgtgcccaagagccctgcctttgccctgaagaaccgcatccgcatgcccaccaaggaggatgaggaggaggatgagcctgtggtgatcaaggcccagcctgtgccccactatggagtgcccttcaagccccagatccctgaggccaggacagtggagatctgccccttctcctttgacagccgggacaaggagcggcagctgcagaaggagaagaagatcaaggagctgcagaagggggaggtgcccaagttcaaggccctgcccctgccccactttgacaccatcaacctgcctgagaagaaggtgaagaatgtgacccagatcgagcccttctgcctggagacagacagaagaggagccctgaaggcccagacctggaagcaccagctggaggaggagctgcggcagcagaaggaggccgcctgcttcaaggcccggcccaacacagtcatcagccaggagccctttgtgcccaagaaggagaagaagtctgtggccgagggcctgagcggcagcctggtgcaggagcccttccagctggccacagagaagagggccaaggagcggcaggagctggagaagaggatggccgaggtggaggcccagaaggcccagcagctggaggaggcccggctgcaggaggaggagcagaagaaggaggagctggcccggctgcggcgggagctggtgcacaaggccaaccccatcaggaagtaccagggcctggagatcaagagcagtgaccagcccctgactgtgcctgtgagccccaagttcagcacccgcttccactgctag

SEQ ID NO: 18750 - DNA, 360 bp, Artificial Sequence
  Description of Artificial Sequence: Synthetic coding sequence
atgaagctggtgcgcttcctgatgaagctgagccatgagaccgtgaccatcgagctgaagaatggcacccaggtgcacggcaccatcaccggggtggatgtgtccatgaacacccacctgaaggctgtgaagatgaccctgaagaaccgggagcctgtgcagctggagaccctgagcatccggggcaacaacatccgctacttcatcctgcctgacagcctgcccctggacaccctgctggtggatgtggagcccaaggtgaagagcaagaagcgggaggccgtggccggccggggccggggccggggccggggccggggccggggccggggccggggccggggcggccccaggaggtag

SEQ ID NO: 18751 - DNA, 555 bp, Artificial Sequence
  Description of Artificial Sequence: Synthetic coding sequence
atgatgggcgccagcaccctgcaggagcccgccctgagccctggccgctgcccccggcagcccctgcggagcaagtttggccaccagggcagcacagtgcagaggaagtgcagcaagaccaatgccctgaatgtgtcccagaagatgattgagatgtttgtgaggaccaagcacaagattgacaagagccatgaatttgccctggtggtggtgaatgatgacacagcctggctgagcggcctgaccagtgacccccgggagctgtgcagctgcctgtatgacctggagacagccagctgcagcaccttcaacatcagcggggccagccctgcccggcagcagaagacagagctgcctgtgacagaaaatgtgcagaccatccccccaccctacgtggtgaggaccatcctggtgtacagccggcccccctgccagccccagttcagcctgacagagcccatgaagaagatgttccagtgcccctacttcttctttgatgtggtgtacatccacaacggcacagaggagaaggaggaggagatgtcctggaagtag

SEQ ID NO: 18752 - DNA, 1203 bp, Artificial Sequence
  Description of Artificial Sequence: Synthetic coding sequence
atggccagcgagaagcccctggccgctgtgacctgcacagcccctgtgaacattgctgtgatcaagtactggggcaagagagatgaggagctggtgctgcccatcaacagcagcctgtctgtgaccctgcaccaggaccagctgaagaccaccaccacagctgtgatcagcaaggacttcacagaggaccgcatctggctgaatggccgggaggaggatgtgggccagccccggctgcaggcctgcctgcgggagatccgctgcctggccaggaagagaagaaacagcagagatggagaccccctgcccagcagcctgagctgcaaggtgcacgtggcctctgtgaacaacttccccacagctgctggcctggccagcagcgctgctggctacgcctgcctggcctacaccctggcccgggtgtatggagtggagagtgacctgtctgaggtggcccggcggggcagcggcagcgcctgccgcagcctgtatggaggctttgtggagtggcagatgggagagcaggctgatggcaaggacagcatcgcccggcaggtggcccctgagagccactggccagagctgcgggtgctgatcctggtggtgtctgctgagaagaagctgaccggcagcacagtgggcatgagggcctctgtggagaccagccccctgctgcgcttccgggcagagagcgtggtgcctgccaggatggccgagatggcccgctgcatccgggagcgggacttccccagctttgcccagctgaccatgaaggacagcaaccagttccacgccacctgcctggacaccttcccccccatctcctacctgaatgccatctcctggaggatcatccacctggtgcaccgcttcaatgcccaccacggggacaccaaggtggcctacacctttgatgctggccccaatgctgtgatcttcaccctggatgacacagtggccgagtttgtggccgctgtgtggcacggcttccccccaggcagcaatggagacaccttcctgaagggcctgcaggtgcggcctgcccccctgtctgctgagctgcaggccgccctggccatggagcccacccctgggggcgtgaagtacatcatcgtgacccaggtgggccctggcccccagatcctggatgacccctgtgcccacctgctgggcccagatggcctgcccaagccagctgcctag

SEQ ID NO: 18753 - DNA, 1350 bp, Artificial Sequence
  Description of Artificial Sequence: Synthetic coding sequence
atgagggagtgcatcagcatccacgtgggccaggccggcgtgcagattggaaatgcctgctgggagctgtactgcctggagcacggcatccagccagatggccagatgcccagcgacaagaccatcggcggcggagatgacagcttcaacaccttcttcagcgagaccggggccggcaagcacgtgcccagggctgtgtttgtggacctggagcccaccgtgattgatgaggtgaggacaggcacctaccggcagctgttccaccctgagcagctgatcaccgggaaggaggatgctgccaacaactatgcccggggccactacaccatcggcaaggagatcatcgacctggtgctggaccgcatcaggaagctggccgaccagtgcaccggcctgcagggcttcctggtgttccacagctttggaggcggcactggaagtggcttcaccagcctgctgatggagcggctgtctgtggactatggcaagaagagcaagctggagttcagcatctacccagccccccaggtgtccacagctgtggtggagccctacaacagcatcctgaccacccacaccaccctggagcacagcgactgtgccttcatggtggacaatgaggccatctatgacatctgcagaagaaacctggacatcgagcggcccacctacaccaacctgaacagactcatcagccagatcgtgagcagcatcacagccagcctgcgctttgatggagccctgaatgtggacctgacagagttccagaccaacctggtgccctacccccgcatccacttccccctggccacctacgcccctgtgatctctgctgagaaggcctaccacgagcagctgactgtggccgagatcaccaatgcctgctttgagcccgccaaccagatggtgaagtgtgaccccaggcatggcaagtacatggcctgctgcctgctgtacagaggagatgtggtgcccaaggatgtgaatgctgccatcgccaccatcaagaccaagaggaccatccagtttgtggactggtgccccaccggcttcaaggtgggcatcaactaccagcccccaacagtggtgcctggaggagacctggccaaggtgcagagagctgtgtgcatgctgagcaacaccacagctgtggccgaggcctgggcccggctggaccacaagtttgacctgatgtatgccaagagggcctttgtgcactggtacgtgggggagggcatggaggagggggagttcagcgaggcccgggaggacatggccgccctggagaaggactatgaggaggtgggcgctgacagcgcagatggagaagatgaaggagaggagtactag

SEQ ID NO: 18754 - DNA, 1365 bp, Artificial Sequence
  Description of Artificial Sequence: Synthetic coding sequence
atgagcaccttccggcaggaggatgtggaggaccactatgagatgggagaggagctgggcagcggccagtttgccatcgtgaggaaatgtcggcagaagggcaccgggaaggagtatgctgccaagttcatcaagaagaggcggctgagcagcagcagaagaggagtgtcccgggaggagattgagcgggaggtgaacatcctgcgggagatccgccaccccaacatcatcaccctgcatgacatctttgagaacaagacagatgtggtgctgatcctggagctggtgtctggaggagagctgtttgacttcctggccgagaaggagagcctgacagaagatgaggccacccagttcctgaagcagatcctggatggagtgcactacctgcacagcaagagaattgcccactttgacctgaagccagagaacatcatgctgctggacaagaatgtgcccaacccccgcatcaagctgattgactttggcatcgcccacaagattgaggccggaaatgagttcaagaacatcttcggcaccccagagtttgtggcccctgagatcgtgaactatgagcccctgggcctggaggccgacatgtggagcattggagtcatcacctacatcctgctgagcggggccagccccttcctgggggagaccaagcaggagaccctgaccaacatctctgctgtgaactatgactttgatgaggagtacttcagcaacaccagcgagctggccaaggacttcatccggcggctgctggtgaaggaccccaagaggaggatgaccatcgcccagagcctggagcacagctggatcaaggccatcagaagaagaaatgtgcggggggaggacagcggcaggaagccagagcggcggcggctgaagaccacccggctgaaggagtacaccatcaagagccacagcagcctgccccccaacaacagctatgctgactttgagcgcttcagcaaggtgctggaggaggccgctgctgctgaggagggcctgcgggagctgcagaggagccggcggctgtgccatgaagatgtggaggccctggccgccatctatgaggagaaggaggcctggtaccgggaggagagtgacagcctgggccaggacctgcggcggctgcggcaggagctgctgaagacagaggccctgaagaggcaggcccaggaggaggccaagggggccctgctgggcaccagcggcctgaagaggcgcttcagccggctggagaacagatatgaggccctggccaagcaggtggccagcgagatgagatttgtgcaggacctggtgcgggccctggagcaggagaagctgcagggcgtggagtgtggcctgaggtag

SEQ ID NO: 18755 - DNA, 1326 bp, Artificial Sequence
  Description of Artificial Sequence: Synthetic coding sequence
atgaagaagttcttccaggagttcaaggctgacatcaagttcaagtctgctggccctggccagaagctgaaggagagcgtgggggagaaggcccacaaggagaagcccaaccagcctgcccccaggcctccccggcagggccccaccaatgaggcccagatggctgctgctgctgccctggcccggctggagcagaagcagagccgggcctggggccccaccagccaggacaccatccggaaccaggtgaggaaggagctgcaggccgaggccaccgtgtctggcagccctgaggcccctggcaccaacgtggtgtctgagccccgggaggagggcagcgcccacctggccgtgcctggggtgtacttcacctgccccctgaccggggccaccctgaggaaggaccagagagatgcctgcatcaaggaggccatcctgctgcacttcagcacagatcctgtggccgccagcatcatgaagatctacaccttcaacaaggaccaggacagagtgaagctgggcgtggacaccatcgccaagtacctggacaacatccacctgcaccctgaggaggagaagtacaggaagatcaagctgcagaacaaggtgttccaggagcgcatcaactgcctggagggcacccatgagttctttgaggccatcggcttccagaaggtgctgctgcctgcccaggaccaggaggaccctgaggagttctacgtgctgtctgagaccaccctggcccagccccagagcctggagcggcacaaggagcagctgctggccgctgagcctgtgcgggccaagctggaccggcagaggagggtcttccagcccagccccctggccagccagtttgagctgcccggggacttcttcaacctgacagctgaggagatcaagcgggagcagaggctgcggtctgaggccgtggagcggctgtctgtgctgcggaccaaggccatgagggagaaggaggagcagaggggcctgaggaagtacaactacaccctgctgcgggtgcggctgcctgatggctgcctgctgcagggcaccttctacgcccgggagcggctgggcgctgtgtatggctttgtgcgggaggccctgcagagcgactggctgccctttgagctgctggccagcggcggccagaagctgtctgaagatgagaacctggccctgaatgaatgtggcctggtgcccagcgccctgctgaccttctcctgggacatggctgtgctggaggacatcaaggctgctggagctgagccagacagcatcctgaagccagagctgctgagcgccatcgagaagctgctgtag

SEQ ID NO: 18756 - DNA, 900 bp, Artificial Sequence
  Description of Artificial Sequence: Synthetic coding sequence
atgagggacctgctgctgcactggggccctggcccccccatccgggccccccaggaggaggccgaggccctgctggagctgcagggccgcctgcaggaggcccaggacaccacagaggccctgcgggcccagctgggcgtgcaggaggtgcagctgcagggcctgcagggcgccctgcagcagctgcagcaggagacagagcagaactgcagaagagagctgcagcagatgcacggccagctggccggcctgcgggccaggatggccagcctgcggcagggctgtggggacctgcggggcctggtgtccaccttcacccagagctgccagggcagcctgtctgaggcccggggccaggtgtcctgggccctgggcgccctgagcagcggcggccctggcacccagctgcctgagggccagcagggccccccagctggctgccccggccgcctgcctgagctgaagggcaacatccgggtgctgtgccgcctgcggcccggcaccagcagcagcctggtgtctgtggagcccggccctgggggcaccgtgaccacctgctaccggggccgccaccggcgcttccggctggactgggtgtttcctccagatgccagccaggaggaggtgttccgggagctggagcctgctgtgctgagctgcctgcggggctacagcgtgtgcatcttcacctacggccagacaggcaccgggaagacctacagcatggagggccccccagaagatcctggcatcgtgccccgggccctgcagagcctcttccgggagatgggcgccggccggcagcaccggcgctaccacggccgctgcctgagccctgctgagagccctgagcacccccggcccggcctgcccccctgccgggcccggagccccctgtag

SEQ ID NO: 18757 - DNA, 2517 bp, Artificial Sequence
  Description of Artificial Sequence: Synthetic coding sequence
atgtatgccttctacagcctgctgatctacatcttctacagcctcttcagaagagatggaggagctgctgctgctgctgagcccggggaccctgcccagagggccaggaagccccggggcagaagaagaccagacctgcctgcccctgagctgtggacagagctgaccggcctggccgccagcagcgagccagaagatggcagcgagggcgctgctgagggccgggctgctgctgtgtccctggaggaggccctgctgcggctggccgagttcctgtctgtgcagctgggcgctgaggagagctgtggcggccctgctgacctgggccagagcggggaggtgcccagcctgctgactgtgaccagccagctgctggccctgctggcctggctgcggagcccccggggccggcaggccctgctgcagggcacccagcctgccccccgggtgcggccccccagcccagatggcagcaccagccaggaggagagccccagccacttcaccgctgtgcctggagagcccctgggagatgagacccagggccagcagcccctgcagctggaggaggaccagagggcctggcagaggctggagcagctgatcctgggccagctggaggagctgaagcagcagctggagcagcaggaggaggagctgggccgcctgcggctgggcgtgggcgccacagacagcgagaagagggtgcagcacctgaccctggagaatgaggccctgaagcagagcctgagcctgatgagggacctgctgctgcactggggccctggcccccccatccgggccccccaggaggaggccgaggccctgctggagctgcagggccgcctgcaggaggcccaggacaccacagaggccctgcgggcccagctgggcgtgcaggaggtgcagctgcagggcctgcagggcgccctgcagcagctgcagcaggagacagagcagaactgcagaagagagctgcagcagatgcacggccagctggccggcctgcgggccaggatggccagcctgcggcagggctgtggggacctgcggggcctggtgtccaccttcacccagagctgccagggcagcctgtctgaggcccggggccaggtgtcctgggccctgggcgccctgagcagcggcggccctggcacccagctgcctgagggccagcagggccccccagctggctgccccggccgcctgcctgagctgaagggcaacatccgggtgctgtgccgcctgcggcccggcaccagcagcagcctggtgtctgtggagcccggccctgggggcaccgtgaccacctgctaccggggccgccaccggcgcttccggctggactgggtgtttcctccagatgccagccaggaggaggtgttccgggagctggagcctgctgtgctgagctgcctgcggggctacagcgtgtgcatcttcacctacggccagacaggcaccgggaagacctacagcatggagggccccccagaagatcctggcatcgtgccccgggccctgcagagcctcttccgggagatgggcgccggccggcagcaccgggtgaccctgtccatggtggagatctacaatgaggccgtgcgggacctgctggcccctggccccccagagcggctggccgtgcggcagggccctgagggccagggcggcatccaggtggccggcctgacccactgggatgtgcccaacctggagaccctgcaccagatgctgaagctgggccgcagcaacagagccacagctgccacagccatgaaccagaggagcagccgcagccacgccctggtgaccctgaccctgcgggccgccagccccccccgggcccctggaacagctggcaccctgcacctggtggacctggccggcagcgagcgggccaggaaggccggggccgccggcccccccaggggggaccctgatggagcccggcggctgcgggaggcccagaccatcaacagaagcctgctggccctgggcggcgtgatggccgccctgcgggcccaccggccccacgtgcccttccgggacagccagctgacccggctgctgcagcctgccctgggccctggcaccacagctgtgctgctgctgcaggtgggcgctggggccggccaggtgtgtgcctgccgcagcccccccacccgggcccggcccccagcccccctggcccggcgcagcccccggggccgccgcatcagcggccggcagagcgcccccagcagcagccccacagagtgggtgaagtggagctggggccagcccggggctgctggcagccgggcccctcctggccgcctgctgcccagcgcccccaccctgcggagccctggccccccagcccccctgcggcggcccctggccgtgctgcacgcccctgtgcccaccacagcccgggcccggctgagccggccccagagggcctgccccagcagccctggcagccggccctgcccctggggcctgcggcccggcctgtgctggcagaggaggtag

SEQ ID NO: 18758 - DNA, 597 bp, Artificial Sequence
  Description of Artificial Sequence: Synthetic coding sequence
atggccagcggaaatgcccgcatcggcaagccagccccagacttcaaggccacagctgtggtggatggagccttcaaggaggtgaagctgagtgactacaagggcaagtatgtggtgctcttcttctaccccctggacttcacctttgtgtgccccacagagatcatcgccttcagcaacagagctgaggacttcaggaagctgggctgtgaggtgctgggcgtgtctgtggacagccagttcacccacctggcctggatcaacacccccaggaaggagggcggcctgggccccctgaacatccccctgctggctgatgtgacccggcggctgtctgaagattatggagtgctgaagacagatgagggcatcgcctaccggggcctcttcatcattgatggaaaaggagtgctgcggcagatcaccgtgaatgacctgcctgtgggccgctctgtggatgaggccctgcggctggtgcaggccttccagtacacagatgagcacggggaggtgtgcccagctggctggaagccaggcagtgacaccatcaagcccaacgtggatgacagcaaggagtacttcagcaagcacaactag

SEQ ID NO: 18759 - DNA, 1380 bp, Artificial Sequence
  Description of Artificial Sequence: Synthetic coding sequence
atgtctgtgcgcttcagcagcaccagccggcggctgggcagctgtggcggcaccggctctgtgcggctgagcagtggaggagctggctttggagctggcaacacctgtggggtgcccggcatcggcagcggcttcagctgtgcctttggaggcagcagcagcgctgggggctacggcggcggcctgggcggcggcagcgccagctgtgccgccttcaccggaaatgaacatggcctgctgtctggaaatgagaaggtgaccatgcagaacctgaatgaccggctggccagctacctggagaatgtgcgggccctggaggaggccaatgctgacctggagcagaagatcaagggctggtatgagaagtttggacctggcagctgccggggcctggaccatgactacagccgctacttccccatcattgatgagctgaagaaccagatcatcagcgccaccaccagcaatgcccacgtggtgctgcagaatgacaatgcccggctgacagcagatgacttccggctgaagtttgaaaatgagctggccctgcaccagagcgtggaggccgacatcaatggcctgcggcgggtgctggatgagctgaccctgtgcaggacagacctggagatccagctggagaccctgtctgaggagctggcctacctgaagaagaaccacgaggaggagatgaaggccctgcagtgtgccgccggcggcaatgtgaatgtggagatgaatgctgcccctggggtggacctgactgtgctgctgaacaacatgagagcagaatatgaggccctggccgagcagaacagaagagatgctgaggcctggttcaatgagaagagcgccagcctgcagcagcagatcagtgatgatgctggggccaccaccagcgccagaaatgagctgattgagatgaagaggaccctgcagaccctggagattgagctgcagagcctgctggccaccaagcacagcctggagtgcagcctgacagaaacagagagcaactactgtgcccagctggcccagatccaggcccagatcggggccctggaggagcagctgcaccaggtgaggacagaaacagagggccagaagctggagtatgagcagctgctggacatcaaggtgcacctggagaaggagattgagacctactgcctgctgattgatggagaagatggcagctgcagcaagagcaagggctatggaggccctggcaaccagaccaaggacagcagcaagaccaccatcgtgaagacagtggtggaggagattgacccccggggcaaggtgctgagcagccgggtgcacacagtggaggagaagagcaccaaggtgaacaacaagaatgagcagagggtgagcagctag

SEQ ID NO: 18760 - DNA, 834 bp, Artificial Sequence
  Description of Artificial Sequence: Synthetic coding sequence
atgcccagcgtgtccaaggctgctgctgctgccctgagcggcagccccccccagacagagaagcccacccactaccgctacctgaaggagttcagaacagagcagtgccccctcttcagccagcacaagtgtgcccagcaccggcccttcacctgcttccactggcacttcctgaaccagaggagaagaagacccctgcggaggagagatggcaccttcaactacagcccagatgtgtactgcagcaagtacaatgaggccaccggggtgtgcccagatggagatgagtgcccctacctgcacaggaccaccggggacacagagaggaagtaccacctgcgctactacaagacaggcacctgcatccatgaaacagatgcccggggccactgtgtgaagaatggcctgcactgtgcctttgcccacggccccctggacctgcggccccctgtgtgtgatgtgcgggagctgcaggcccaggaggccctgcagaatggccagctgggcggcggggagggcgtgcctgacctgcagcccggggtgctggccagccaggccatgattgagaagatcctgtctgaggacccccgctggcaggatgccaactttgtgctgggcagctacaagacagagcagtgccccaagccaccccggctgtgccggcagggctacgcctgcccccactaccacaacagccgggacagaagaagaaacccccggcgcttccagtacagctggcagctgggccggcgggtgctgcggctgagcccccgggccaacaacccccgggtggccctgccccgggtgcacacaggccccagcagcacagcctag

SEQ ID NO: 18761 - DNA, 918 bp, Artificial Sequence
  Description of Artificial Sequence: Synthetic coding sequence
atggacctgagcggcgtgaagaagaagagcctgctgggcgtgaaggagaacaacaagaagagcagcacccgggcccccagccccaccaagaggaaggacagaagtgatgagaagagcaaggacaggagcaaggacaagggggccaccaaggagagcagcgagaaggaccggggccgggacaagaccaggaagagaagaagtgccagcagcggcagcagcagcaccaggagccgcagcagcagcaccagcagcagcggcagcagcaccagcacaggcagcagcagcggcagcagcagcagcagcgccagcagccgcagcggcagcagcagcaccagccgcagcagcagcagcagcagcagcagcggcagccccagccccagcagaagaagacatgacaacagaagaagaagccgcagcaagagcaagccacccaagagagatgagaaggagaggaagagaagaagccccagccccaagcccaccaaggtgcacatcggccgcctgaccagaaatgtgaccaaggaccacatcatggagatcttcagcacctacggcaagatcaagatgattgacatgcctgtggagaggatgcacccccacctgagcaagggctacgcctacgtggagtttgaaaatccagatgaggccgagaaggccctgaagcacatggatggcggccagattgatggccaggagatcacagccacagctgtgctggccccctggccccggcccccaccccggcgcttcagcccccccaggaggatgctgcccccaccacccatgtggaggaggagcccccccaggatgagaagaagaagccgcagccccaggagaagaagccctgtgagaagaagaagccgcagccctggaagaagaagacacaggagccgcagcagcagcaacagcagcaggtag

SEQ ID NO: 18762 - DNA, 3198 bp, Artificial Sequence
  Description of Artificial Sequence: Synthetic coding sequence
atgaggaagcaggaggtgaggacaggccgggaggccggccagggccacggcaccggcagccctgctgagcaggtgaaggccctgatggacctgctggccggcaagggcagccagggcagccaggccccccaggccctggacaggaccccagatgcccccctgggcccctgcagcaatgacagccgcatccagaggcacaggaaggccctgctgagcaaggtgggcggcggccctgagctgggcggcccctggcaccggctggccagcctgctgctggtggagggcctgacagacctgcagctgcgggagcatgacttcacccaggtggaggccacccggggcggcggccacccagccaggacagtggccctggacaggctcttcctgcccctgagccgggtgtctgtgcccccccgggtgtccatcaccatcggcgtggccggcatgggcaagaccaccctggtgcgccactttgtgcggctgtgggcccacggccaggtgggcaaggacttcagcctggtgctgcccctgaccttccgggacctgaacacccatgagaagctgtgtgccgacaggctcatctgcagcgtcttcccccacgtgggggagcccagcctggccgtggccgtgcctgcccgggccctgctgatcctggatggcctggatgaatgtaggacccccctggacttcagcaacacagtggcctgcacagaccccaagaaggagatccctgtggaccacctgatcaccaacatcatccggggcaacctcttccctgaggtgtccatctggatcaccagccggcccagcgccagcggccagatccctgggggcctggtggacaggatgacagagatccggggcttcaatgaggaggagatcaaggtgtgcctggagcagatgtttcctgaggaccaggccctgctgggctggatgctgagccaggtgcaggccgaccgggccctgtacctgatgtgcaccgtgcctgccttctgccgcctgaccggcatggccctgggccacctgtggaggagcaggacaggcccccaggatgctgagctgtggccacccaggaccctgtgtgagctgtacagctggtacttcaggatggccctgtctggagagggccaggagaagggcaaggccagcccccgcatcgagcaggtggcccatggaggcaggaagatggtgggcaccctgggccgcctggccttccacggcctgctgaagaagaagtatgtgttctatgagcaggacatgaaggcctttggagtggacctggccctgctgcagggcgccccctgcagctgcttcctgcagcgggaggagaccctggccagctctgtggcctactgcttcacccacctgagcctgcaggagtttgtggccgccgcctactactacggggccagccggcgggccatctttgacctcttcacagagagcggcgtgtcctggccccggctgggcttcctgacccacttccgctctgctgcccagagggccatgcaggccgaggatggccgcctggatgtgttcctgcgcttcctgagcggcctgctgagcccccgggtgaatgccctgctggccggcagcctgctggcccagggcgagcaccaggcctaccgcacccaggtggccgagctgctgcagggctgcctgcggccagatgctgctgtgtgtgcccgggccatcaacgtgctgcactgcctgcacgagctgcagcacacagagctggcccggtctgtggaggaggccatggagagcggggccctggcccggctgaccggccctgcccaccgggccgccctggcctacctgctgcaggtgtctgatgcctgtgcccaggaggccaacctgagcctgagcctgagccagggcgtgctgcagagcctgctgccccagctgctgtactgcaggaagctgcggctggacaccaaccagttccaggaccctgtgatggagctgctgggctctgtgctgagcggcaaggactgccgcatccagaagatcagcctggccgagaaccagatcagcaacaagggggccaaggccctggcccggagcctgctggtgaacagaagcctgaccagcctggacctgcggggcaacagcatcggcccccagggcgccaaggccctggctgatgccctgaagatcaacagaaccctgaccagcctgagcctgcagggcaacacagtgagagatgatggagcccgctccatggccgaggccctggccagcaacagaaccctgtccatgctgcacctgcagaagaacagcatcggccccatgggcgcccagaggatggctgatgccctgaagcagaacagaagcctgaaggagctgatgttcagcagcaacagcattggagatggaggagccaaggccctggccgaggccctgaaggtgaaccagggcctggagagcctggacctgcagagcaacagcatcagtgatgctggggtggccgccctgatgggcgccctgtgcaccaaccagaccctgctgagcctgagcctgagagaaaattccatcagccctgagggcgcccaggccatcgcccacgccctgtgtgccaacagcaccctgaagaacctggacctgacagccaacctgctgcatgaccagggcgcccgggccatcgctgtggccgtgcgggagaacagaaccctgaccagcctgcacctgcagtggaacttcatccaggccggggccgcccaggccctgggccaggccctgcagctgaacagaagcctgaccagcctggacctgcaggagaatgccatcggagatgatggagcctgtgctgtggcccgggccctgaaggtgaacacagccctgacagccctgtacctgcaggtggccagcatcggggccagcggggcccaggtgctgggggaggccctggccgtgaacagaaccctggagatcctggacctgcggggaaatgccatcggcgtggccggggccaaggccctggccaatgccctgaaggtgaacagcagcctgcggcggctgaacctgcaggagaacagcctgggcatggatggagccatctgcatcgccacagccctgagcggcaaccaccggctgcagcacatcaacctgcagggcaaccacatcggggacagcggggccaggatgatcagcgaggccatcaagaccaatgcccccacctgcaccgtggagatgtag

SEQ ID NO: 18763 - DNA, 927 bp, Artificial Sequence
  Description of Artificial Sequence: Synthetic coding sequence
atgaaccccatcgtggtggtgcacggcggcggggccggccccatcagcaaggacaggaaggagcgggtgcaccagggcatggtgcgggccgccaccgtgggctacggcatcctgcgggagggcggcagcgctgtggatgctgtggagggcgctgtggtggccctggaggatgatcctgagttcaatgccggctgcggctctgtgctgaacaccaacggggaggtggagatggatgccagcatcatggatggcaaggacctgtctgctggagctgtgtctgctgtgcagtgcatcgccaaccccatcaagctggcccggctggtgatggagaagaccccccactgcttcctgacagaccagggcgccgcccagtttgctgctgccatgggcgtgcctgagatccctggagagaagctggtgacagaaagaaacaagaagaggctggagaaggagaagcatgagaagggggcccagaagacagactgccagaagaacctgggcaccgtgggcgctgtggccctggactgcaagggaaatgtggcctatgccaccagcactggaggcatcgtgaacaagatggtgggccgggtgggggacagcccctgcctgggcgccggcggctatgctgacaatgacattggagctgtgtccaccactggacatggagagagcatcctgaaggtgaacctggcccggctgaccctcttccacatcgagcagggcaagacagtggaggaggccgctgacctgagcctgggctacatgaagagccgggtgaagggcctgggcggcctcatcgtggtgtccaagacaggagactgggtggccaagtggaccagcacctccatgccctgggccgccgccaaggatggcaagctgcactttggaattgatcctgatgacaccaccatcacagacctgccctag

SEQ ID NO: 18764 - DNA, 1212 bp, Artificial Sequence
  Description of Artificial Sequence: Synthetic coding sequence
atggccggccggcgggcccagacaggcagcgccccacccaggcctgctgccccccaccccccagccagccgggccttcccccagcactgccggcccagagatgctgagcggccccccagccccaggagccccctgatgcctggctgtgagctgcctgtgggcacctgcccagacatgtgcccagctgctgagcgggcccagcgggagcgggagcaccggctgcaccggctggaggtggtgcccggctgccggcaggacccccccagggctgacccccagagagctgtgaaggagtacagcaggcctgctgctgggaagccccggcccccacccagccagctgcggccccccagcgtgctgctggccaccgtgcgctacctggccggggaggtggccgagagcgctgacatcgcccgggcagaggtggccagctttgtggccgaccggctgcgggctgtgctgctggacctggccctgcagggcgctggagatgctgaggccgctgtggtgctggaggccgccctggccaccctgctgactgtggtggcccggctgggcccagatgctgcccggggccctgctgaccctgtgctgctgcaggcccaggtgcaggagggcttcggcagcctgcggcgctgctacgcccggggggccggcccccacccccggcagcctgccttccagggcctcttcctgctgtacaacctgggctctgtggaggccctgcacgaggtgctgcagctgcctgctgccctgcgggcctgcccccccctgaggaaggccctggccgtggatgctgccttccgggagggcaatgctgcccggctcttccggctgctgcagaccctgccctacctgcccagctgtgctgtgcagtgccacgtgggccacgcccggcgggaggccctggccaggtttgcccgggccttcagcacccccaagggccagaccctgcccctgggcttcatggtgaacctgctggccctggatggcctgcgggaggcccgggacctgtgccaggcccacggcctgcccctggatggagaggagcgggtggtgttcctgcggggccgctacgtggaggagggcctgcccccagccagcacctgcaaggtgctggtggagagcaagctgcggggccgcaccctggaggaggtggtgatggccgaggaggaggatgagggcacagacaggcctggcagccctgcctag

SEQ ID NO: 18765 - DNA, 894 bp, Artificial Sequence
  Description of Artificial Sequence: Synthetic coding sequence
atggccgagctgacagccctggagagcctgattgagatgggcttcccccggggccgggcagagaaggccctggccctgactggaaaccagggcatcgaggccgccatggactggctgatggagcatgaagatgatcctgatgtggatgagcccctggagacccccctgggccacatcctgggccgggagcccaccagcagcgagcagggcggcctggagggcagcggcagcgctgctggggagggcaagccagccctgtctgaggaggagcggcaggagcagaccaagaggatgctggagctggtggcccagaagcagcgggagcgggaggagcgggaggagcgggaggccctggagcgggagcggcagaggcggcggcagggccaggagctgtctgctgcccggcagaggctgcaggaggatgagatgagaagagctgctgaggagaggagaagagagaaggccgaggagctggccgcccggcagagggtgcgggagaagattgaaagagacaaggccgagcgggccaagaagtatggaggctctgtgggcagccagcccccacctgtggcccctgagcccggccctgtgcccagcagccccagccaggagccccccaccaagcgggagtatgaccagtgccgcatccaggtgcggctgcctgatggcaccagcctgacccagaccttccgggcccgggagcagctggccgctgtgcggctgtatgtggagctgcacagaggagaggagctgggcggcggccaggaccctgtgcagctgctgagcggcttcccccggcgggccttcagcgaggccgacatggagcggcccctgcaggagctgggcctggtgcccagcgctgtgctgattgtggccaagaagtgccccagctag

SEQ ID NO: 18766 - DNA, 570 bp, Artificial Sequence
  Description of Artificial Sequence: Synthetic coding sequence
atgaggctgagcctgcccctgctgctgctgctgctgggcgcctgggccatccctgggggcctgggggaccgggcccccctgacagccacagccccccagctggatgatgaggagatgtacagcgcccacatgcctgcccacctgcgctgtgatgcctgcagagctgtggcctaccagatgtggcagaacctggccaaggccgagaccaagctgcacaccagcaacagcggcggcagaagagagctgtctgagctggtgtacacagatgtgctggacaggagctgcagcaggaactggcaggactatggagtgcgggaggtggaccaggtgaagaggctgaccggccctggcctgtctgagggccctgagcccagcatctctgtgatggtgactggaggcccctggcccacccggctgagcaggacctgcctgcactacctgggggagtttggagaggaccagatctatgaggcccaccagcagggccgcggggccctggaggccctgctgtgtggcggcccccagggcgcctgcagcgagaaggtgtctgccacccgggaggagctgtag

SEQ ID NO: 18767 - DNA, 3129 bp, Artificial Sequence
  Description of Artificial Sequence: Synthetic coding sequence
atggccaatgacagccctgccaagagcctggtggacatcgacctgagcagcctgcgggaccctgctggcatctttgagctggtggaggtggtgggcaatggcacctacggccaggtgtacaagggccgccacgtgaagacaggccagctggccgccatcaaggtgatggatgtgacagaagatgaggaggaggagatcaagctggagatcaacatgctgaagaagtacagccaccacaggaacatcgccacctactacggggccttcatcaagaagagccccccaggccatgatgaccagctgtggctggtgatggagttctgtggggccggcagcatcacagacctggtgaagaacaccaagggcaacaccctgaaggaggactggatcgcctacatcagccgggagatcctgcggggcctggcccacctgcacatccaccacgtgatccaccgggacatcaagggccagaatgtgctgctgacagaaaatgctgaggtgaagctggatgaaacagaatatgagtacagcggcagcgaggaggaggaggaggaggtgcctgagcaggagggggagcccagcagcatcgtgaatgtgcctggagagagcaccctgcggcgggacttcctgcggctgcagcaggagaacaaggagaggtctgaggccctgcggcggcagcagctgctgcaggagcagcagctgcgggagcaggaggagtacaagaggcagctgctggccgagcggcagaagagaattgagcagcagaaggagcagaggcggcggctggaggagcagcagaggcgggagcgggaggcccggcggcagcaggagcgggagcagaggcggcgggagcaggaggagaagaggcggctggaggagctggagaggaggaggaaggaggaggaggagaggagaagagctgaggaggagaagagaagagtggagcgggagcaggagtacatccggcggcagctggaggaggagcagaggcacctggaggtgctgcagcagcagctgctgcaggagcaggccatgctgctggagtgccgctggagggagatggaggagcaccggcaggccgagcggctgcagaggcagctgcagcaggagcaggcctacctgctgagcctgcagcacgaccaccggcggccccacccccagcacagccagcagcccccaccaccccagcaggagaggagcaagcccagcttccacgcccctgagcccaaggcccactatgagcctgctgaccgggcccgggaggtgcctgtgaggaccaccagccgcagccctgtgctgagcagaagagacagccccctgcagggcagcggccagcagaacagccaggccggccagaggaacagcaccagcagcattgagccccggctgctgtgggagcgggtggagaagctggtgcccaggcctggcagcggcagcagcagcggcagcagcaacagcggcagccagcccggcagccaccctggcagccagagcggcagcggggagcgcttccgggtgcgcagcagcagcaagtctgagggcagccccagccagaggctggagaatgctgtgaagaagccagaggacaagaaggaggtgttccggcccctgaagccagctgtgagaattgacctgacagccctggccaaggagctgcgggctgtggaggatgtgcggcccccccacaaggtgacagactacagcagcagcagcgaggagagcggcaccacagatgaggaggatgatgatgtggagcaggagggcgcagatgagagcaccagcggccctgaggacaccagggctgccagcagcctgaacctgagcaatggagaaacagagagcgtgaagaccatgattgtgcatgatgatgtggagagcgagcccgccatgacccccagcaaggagggcaccctgattgtgcggcagacccagagcgccagcagcaccctgcagaagcacaagagcagcagcagcttcacccccttcatcgacccccggctgctgcagatcagccccagcagcggcaccaccgtgacctctgtggtgggcttcagctgtgatggcatgaggcctgaggccatccggcaggaccccaccaggaaaggatctgtggtgaatgtgaaccccaccaacacccggccccagagcgacaccccagagatcaggaagtacaagaagcgcttcaacagcgagatcctgtgtgccgccctgtggggcgtgaacctgctggtgggcacagagagcggcctgatgctgctggacaggagcggccagggcaaggtgtaccccctcatcaacagaagacgcttccagcagatggatgtgctggagggcctgaatgtgctggtgaccatcagcggcaagaaggacaagctgcgggtgtactacctgtcctggctgaggaacaagatcctgcacaatgaccctgaggtggagaagaagcagggctggaccaccgtgggggacctggagggctgtgtgcactacaaggtggtgaagtatgaaagaatcaagttcctggtgattgccctgaagagctctgtggaggtgtatgcctgggcccccaagccctaccacaagttcatggccttcaagagctttggagagctggtgcacaagcccctgctggtggacctgactgtggaggagggccagaggctgaaggtgatctacggcagctgtgccggcttccacgctgtggatgtggacagcggctctgtgtatgacatctacctgcccacccacatccagtgcagcatcaagccccacgccatcatcatcctgcccaacacagatggcatggagctgctggtgtgctatgaagatgagggcgtgtatgtgaacacctacggccgcatcaccaaggatgtggtgctgcagtggggcgagatgcccacctctgtggcctacatccgcagcaaccagaccatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgggccgcaccagcctgctgtcctggtag

SEQ ID NO: 18768 - DNA, 1113 bp, Artificial Sequence
  Description of Artificial Sequence: Synthetic coding sequence
atgggcttcaaccggcccagcaagatccaggagaatgccctgcccatgatgctggccgagcccccccagaacctgattgcccagagccagagcggcaccgggaagacagctgcctttgtgctggccatgctgagccgggtggagcccagcgaccgctacccccagtgcctgtgcctgagccccacctatgagctggccctgcagacaggcaaggtgattgagcagatgggcaagttctacccagagctgaagctggcctatgctgtgcggggcaacaagctggagcggggccagaagatcagcgagcagatcgtcatcggcaccccaggcaccgtgctggactggtgcagcaagctgaagttcatcgaccccaagaagatcaaggtgtttgtgctggatgaagcagatgtgatgattgccacccagggccaccaggaccagagcatccgcatccagaggatgctgcccaggaactgccagatgctgctcttcagcgccacctttgaagattctgtgtggaagtttgcccagaaggtggtgcctgaccccaacgtcatcaagctgaagcgggaggaggagaccctggacaccatcaagcagtactacgtgctgtgcagcagcagagatgagaagttccaggccctgtgcaacctgtatggagccatcaccatcgcccaggccatgatcttctgccacaccaggaagacagcctcctggctggccgctgagctgagcaaggagggccaccaggtggccctgctgtctggagagatgatggtggagcagagagctgctgtgattgagcgcttccgggagggcaaggagaaggtgctggtgaccaccaacgtgtgtgcccggggcattgatgtggagcaggtgtctgtggtgatcaactttgacctgcctgtggacaaggatggcaacccagacaatgagacctacctgcaccgcatcggccgcacaggccgctttgggaagaggggcctggccgtgaacatggtggacagcaagcacagcatgaacatcctgaaccgcatccaggagcacttcaacaagaagattgaaaggctggacacagatgacctggatgaaattgagaagatcgccaactag

SEQ ID NO: 18769 - DNA, 1437 bp, Artificial Sequence
  Description of Artificial Sequence: Synthetic coding sequence
atggccacagacagctgggccctggccgtggatgagcaggaggccgctgtgaagtccatgaccaacctgcagatcaaggaggagaaggtgaaggctgacaccaacggcatcatcaagaccagcaccacagctgagaagacagatgaggaggagaaggaggaccgggccgcccagagcctgctgaacaagctgatccgcagcaacctggtggacaacaccaaccaggtggaggtgctgcagagggaccccaacagccccctgtacagcgtgaagagctttgaggagctgcggctgaagccccagctgctgcagggcgtgtatgccatgggcttcaaccggcccagcaagatccaggagaatgccctgcccatgatgctggccgagcccccccagaacctgattgcccagagccagagcggcaccgggaagacagctgcctttgtgctggccatgctgagccgggtggagcccagcgaccgctacccccagtgcctgtgcctgagccccacctatgagctggccctgcagacaggcaaggtgattgagcagatgggcaagttctacccagagctgaagctggcctatgctgtgcggggcaacaagctggagcggggccagaagatcagcgagcagatcgtcatcggcaccccaggcaccgtgctggactggtgcagcaagctgaagttcatcgaccccaagaagatcaaggtgtttgtgctggatgaagcagatgtgatgattgccacccagggccaccaggaccagagcatccgcatccagaggatgctgcccaggaactgccagatgctgctcttcagcgccacctttgaagattctgtgtggaagtttgcccagaaggtggtgcctgaccccaacgtcatcaagctgaagcgggaggaggagaccctggacaccatcaagcagtactacgtgctgtgcagcagcagagatgagaagttccaggccctgtgcaacctgtatggagccatcaccatcgcccaggccatgatcttctgccacaccaggaagacagcctcctggctggccgctgagctgagcaaggagggccaccaggtggccctgctgtctggagagatgatggtggagcagagagctgctgtgattgagcgcttccgggagggcaaggagaaggtgctggtgaccaccaacgtgtgtgcccggggcattgatgtggagcaggtgtctgtggtgatcaactttgacctgcctgtggacaaggatggcaacccagacaatgagacctacctgcaccgcatcggccgcacaggccgctttgggaagaggggcctggccgtgaacatggtggacagcaagcacagcatgaacatcctgaaccgcatccaggagcacttcaacaagaagattgaaaggctggacacagatgacctggatgaaattgagaagatcgccaactag

SEQ ID NO: 18770 - DNA, 2238 bp, Artificial Sequence
  Description of Artificial Sequence: Synthetic coding sequence
atggtgggccctggccccacagctgctgctgctgtggaggagcggcagaggaagctgcaggagtacctggccgccaagggcaagctgaagagccagaacaccaagccctacctgaagagcaagaacaactgccagaaccagccccccagcaagagcaccatccggcccaagaatgatgtgaccaaccacgtggtgctgcctgtgaagcccaagaggagcatcagcatcaagctgcagccccggccccccaacacagctggcagccagaagcccaagctggagccccccaagctgctgggcaagaggctgaccagtgaatgtgtgagcagcaacccctacagcaagcccagcagcaagagcttccagcagtgtgaggccggcagcagcaccactggagagctgagcaggaagcctgtgggcagcctgaacatcgagcagctgaagaccaccaagcagcagctgacagaccagggcaatggaaaatgtattgacttcatgaacaacatccacgtggagaatgaaagcctggacaacttcctgaaggagaccaacaaggagaacctgctggacatcctgacagagcctgagaggaagccagaccccaagctgtacaccaggagcaagcccaagacagacagctacaaccagaccaagaacagcctggtgcccaagcaggccctgggcaagagctctgtgaacagcgctgtgctgaaggacagagtgaacaagcagtttgtgggggagacccagagcaggaccttccctgtgaagagccagcagctgagcagaggagctgacctggcccggcctggggtgaagcccagcaggacagtgcccagccacttcatccgcaccctgagcaaggtgcagagcagcaagaagcctgtggtgaagaacatcaaggacatcaaggtgaacagaagccagtatgaaagaccaaatgagaccaagatccgcagctaccctgtgacagagcagagggtgaagcacaccaagcccaggacctaccccagcctgctgcagggcgagtacaacaacagacaccccaacatcaagcaggaccagaagagcagccaggtgtgcatcccccagaccagctgtgtgctgcagaagagcaaggccatcagccagaggcccaacctgactgtgggccgcttcaacagcgccatccccagcacccccagcatccggcccaacggcaccagcggcaacaagcacaacaacaacggcttccagcagaaggcccagaccctggacagcaagctgaagaaggctgtgccccagaaccacttcctgaacaagacagcccccaagacccaggctgatgtgaccaccgtgaatggcacccagaccaaccccaacatcaagaagaaggccacagctgaggacaggaggaagcagctggaggagtggcagaagagcaagggcaagacctacaagaggcctcccatggagctgaagaccaagaggaaggtgatcaaggagatgaacatctccttctggaagagcattgagaaggaggaggaggagaagaaggcccagctggagctgagcagcaagatcaacaacaccctgacagaatgtctgaacctgattgagggcggcgtgcccagcaatgagatcctgaacatcctgagcagcatccctgaggccgagaagtttgccaagttctggatctgcaaggccaagctgctggccagcaagggcacctttgatgtgattggcctgtatgaggaggccatcaagaatggagccacccccatccaggagctgaggaaggtggtgctgaacatcctgcaggacagcaacagaaccacagagggcatcaccagtgacagcctggtggccgagaccagcatcacctctgtggaggagctggccaagaagatggagagcgtgaagagctgcctgagccccaaggagcgggagcaggtgacagccaccccaagaattgccaaggccgagcagcacaactacccaggcatcaagctgcagatcggccccatcccccgcatcaatggcatgcctgaggtgcaggacatgaagttcatcacccctgtgcggcgcagcagcagaattgaaagagctgtgagccgctacccagagatgctgcaggagcatgacctggtggtggccagcctggatgagctgctggaggtggaggagaccaagtgcttcatcttcagaagaaatgaggccctgcctgtgaccctgggcttccagaccccagagagctag

SEQ ID NO: 18771 - DNA, 378 bp, Artificial Sequence
  Description of Artificial Sequence: Synthetic coding sequence
atgagcagcaccctgggcaagctgagcaaccaggtggaggagaccctgcccctgctgaagaaggtgcctgccaactacttccacatctgcagcgccatcctgatgggcttcagcctgagcaagagcgccacccaggtgtctgccatccacatggacagcaaggtggatgaccacctgatccggggcacagagaagagccggctggagcccgccacccagctgttccagaacaccaagaagatccggctggaggacaccaaccaggagaacttcacccgcatcgagggcactggaacaggcagcctgagcggcaaggccctgggctctgtggtgtatgtgaaggagagtgatggcctggagatgacagatgtggagtag

SEQ ID NO: 18772 - DNA, 4284 bp, Artificial Sequence
  Description of Artificial Sequence: Synthetic coding sequence
atgtccatgctgaagcccagcggcctgaaggcccccaccaagatcctgaagccaggcagcacagccctgaagacccccacagctgtggtggcccctgtggagaagaccatcagcagcgagaaggccagcagcacccccagcagcgagacccaggaggagtttgtggatgacttccgggtgggggagcgggtgtgggtgaatggaaacaagccaggcttcatccagttcctgggggagacccagtttgcccctggccagtgggccggcatcgtgctggatgagcccatcggcaagaatgatggctctgtggccggcgtgcgctacttccagtgtgagcccctgaagggcatcttcacccggcccagcaagctgaccaggaaggtgcaggctgaagatgaggccaacggcctgcagaccaccccagccagccgggccaccagccccctgtgcaccagcacagcctccatggtgagcagcagccccagcacccccagcaacatcccccagaagcccagccagcctgctgccaaggagcccagcgccaccccacccatcagcaacctgaccaagacagccagcgagagcatcagcaacctgtctgaggccggcagcatcaagaagggggagcgggagctgaagatcggggacagagtgctggtgggcggcaccaaggccggcgtggtgcgcttcctgggggagacagactttgccaagggggagtggtgtggggtggagctggatgagcccctgggcaagaatgatggagctgtggccggcacccgctacttccagtgccagcccaagtatggcctgtttgcccctgtgcacaaggtgaccaagattggcttccccagcaccaccccagccaaggccaaggccaatgctgtgagaagagtgatggccaccaccagcgccagcctgaagaggagccccagcgccagcagcctgagctccatgagctctgtggccagctctgtgagcagccggcccagcaggacaggcctgctgacagagaccagcagccgctatgccaggaagatcagcggcaccacagccctgcaggaggccctgaaggagaagcagcagcacatcgagcagctgctggccgagcgggacctggagcgggcagaggtggccaaggccaccagccacgtgggggagattgagcaggagctggccctggccagagatggccatgaccagcacgtgctggagctggaggccaagatggaccagctgcggaccatggtggaggccgctgaccgggagaaggtggagctgctgaaccagctggaggaggagaagaggaaggtggaggacctgcagttccgggtggaggaggagagcatcaccaagggggacctggagacccagaccaagctggagcacgcccgcatcaaggagctggagcagagcctgctgtttgagaagaccaaggctgacaagctgcagcgggagctggaggacaccagggtggccaccgtgtctgagaagagccgcatcatggagctggagaaggacctggccctgcgggtgcaggaggtggccgagctgcggcggcggctggagagcaacaagccagctggagatgtggacatgagcctgagcctgctgcaggagatcagcagcctgcaggagaagctggaggtgaccaggacagaccaccagcgggagatcaccagcctgaaggagcactttggagcccgggaggagacccaccagaaggagatcaaggccctgtacacagccacagagaagctgagcaaagaaaatgaaagcctgaagagcaagctggagcacgccaacaaggagaacagtgatgtgattgccctgtggaagagcaagctggagacagccatcgccagccaccagcaggccatggaggagctgaaggtgtccttcagcaagggcctgggcacagaaacagctgagtttgctgagctgaagacccagatcgagaagatgaggctggactaccagcatgaaattgagaacctgcagaaccagcaggacagcgagagagctgcccacgccaaggagatggaggccctgcgggccaagctgatgaaggtgatcaaggagaaggagaacagcctggaggccatccgcagcaagctggacaaggccgaggaccagcacctggtggagatggaggacaccctgaacaagctgcaggaggccgagatcaaggtgaaggagctggaggtgctgcaggccaagtgcaatgagcagaccaaggtgattgacaacttcaccagccagctgaaggccacagaggagaagctgctggacctggatgccctgaggaaggccagcagcgagggcaagtctgagatgaagaagctgcggcagcagctggaggccgctgagaagcagatcaagcacctggagattgagaagaatgctgagagcagcaaggccagcagcatcacccgggagctgcagggccgggagctgaagctgaccaacctgcaggagaacctgtctgaggtgtcccaggtgaaggagaccctggagaaggagctgcagatcctgaaggagaagtttgctgaggccagcgaggaggccgtgtctgtgcagaggtccatgcaggagaccgtgaacaagctgcaccagaaggaggagcagttcaacatgctgagcagtgacctggagaagctgcgggagaacctggccgacatggaggccaagttccgggagaaggatgagcgggaggagcagctgatcaaggccaaggagaagctggagaatgacattgctgagatcatgaagatgtctggggacaacagcagccagctgaccaagatgaatgatgagctgcggctgaaggagagagatgtggaggagctgcagctgaagctgaccaaggccaatgaaaatgccagcttcctgcagaagagcattgaggacatgacagtgaaggccgagcagagccagcaggaggccgccaagaagcatgaggaggagaagaaggagctggagaggaagctgagtgacctggagaagaagatggagaccagccacaaccagtgccaggagctgaaggcccgctatgaaagagccaccagcgagaccaagaccaagcatgaggagatcctgcagaacctgcagaagaccctgctggacacagaggacaagctgaagggggcccgggaggagaacagcggcctgctgcaggagctggaggagctgaggaagcaggccgacaaggccaaggccgcccagacagcagaagatgccatgcagatcatggagcagatgaccaaggagaagacagagaccctggccagcctggaggacaccaagcagaccaatgccaagctgcagaatgagctggacaccctgaaggagaacaacctgaagaatgtggaggagctgaacaagagcaaggagctgctgactgtggagaaccagaagatggaggagttcaggaaggagattgagaccctgaagcaggccgccgcccagaagagccagcagctgagcgccctgcaggaggagaatgtgaagctggccgaggagctgggccgcagcagagatgaggtgaccagccaccagaagctggaggaggagaggtctgtgctgaacaaccagctgctggagatgaagaagcgggagagcaagttcatcaaggatgctgatgaggagaaggccagcctgcagaagagcatcagcatcaccagcgccctgctgacagagaaggatgctgagctggagaagctgagaaatgaggtgacagtgctgcggggagaaaatgccagcgccaagagcctgcacagcgtggtgcagaccctggagagtgacaaggtgaagctggagctgaaggtgaagaacctggagctgcagctgaaggagaacaagaggcagctgagcagcagcagcggcaacacagacacccaggctgatgaagatgagcgggcccaggagagccagattgacttcctgaacagcgtgattgtggacctgcagaggaagaaccaggacctgaagatgaaggtggagatgatgtctgaggccgccctgaatggaaatggagatgacctgaacaactatgacagtgatgaccaggagaagcagagcaagaagaagcccaggctcttctgtgacatctgtgactgctttgacctgcatgacacagaggactgccccacccaggcccagatgtctgaggaccccccccacagcacccaccacggcagcagaggagaggagcggccctactgtgagatctgtgagatgtttggccactgggccaccaactgcaatgatgatgagaccttctag

SEQ ID NO: 18773 - DNA, 975 bp, Artificial Sequence
  Description of Artificial Sequence: Synthetic coding sequence
atggccagcagcaacacagtgctgatgaggctggtggccagcgcctacagcatcgcccagaaggccggcatgattgtgagaagagtgattgctgagggggacctgggcatcgtggagaagacctgtgccacagacctgcagaccaaggctgaccggctggcccagatgagcatctgcagcagcctggccaggaagttccccaagctgaccatcatcggggaggaggacctgcccagcgaggaggtggaccaggagctgattgaggacagccagtgggaggagatcctgaagcagccctgccccagccagtacagcgccatcaaggaggaggacctggtggtgtgggtggaccccctggatggcaccaaggagtacacagagggcctgctggacaacgtgacagtgctgattggaattgcctatgagggcaaggccatcgccggggtcatcaaccagccctactacaactatgaagctggcccagatgctgtgctgggccgcaccatctggggcgtgctgggcctgggcgccttcggcttccagctgaaggaggtgcctgctgggaagcacatcatcaccaccaccaggagccacagcaacaagctggtgacagactgtgtggccgccatgaacccagatgctgtgctgcgggtgggcggggccggcaacaagatcatccagctgattgagggcaaggccagcgcctacgtgtttgccagccctggctgcaagaagtgggacacctgtgcccctgaggtgatcctgcatgctgtgggcggcaagctgacagacatccacggcaatgtgctgcagtaccacaagggcgtgagccacaggacctggcccaagccagacttcttccgggcccagttcttcctggagagccacagctgcttcagcaacttcaagaatgtgtccacccccatcaagaacatctatgatgtgatcatctatgcctatgaaacagacctgtag

SEQ ID NO: 18774 - DNA, 270 bp, Artificial Sequence
  Description of Artificial Sequence: Synthetic coding sequence
atgggcaccaagcgggaggccatcctgaaggtgctggagaacctgaccccagaggagctgaagaagttcaagatgaagctgggcaccgtgcccctgcgggagggctttgagcgcatccccaggggggccctgggccagctggacatcgtggacctgacagacaagctggtggccagctactatgaggactatgctgctgagctggtggtggccgtgctgcgggacatgaggatgctggaggaggccgcccggctgcagagagctgcctag

SEQ ID NO: 18775 - DNA, 867 bp, Artificial Sequence
  Description of Artificial Sequence: Synthetic coding sequence
atgacagtgggcaagagcagcaagatgctgcagcacatcgactacaggatgcgctgcatcctgcaggacggccgcatcttcatcggcaccttcaaggcctttgacaagcacatgaacctgatcctgtgtgactgtgatgagttcaggaagatcaagcccaagaacagcaagcaggccgagcgggaggagaagagggtgctgggcctggtgctgctgcggggggagaacctggtgtccatgacagtggagggccccccacccaaggacaccggcatcgcccgggtgcccctggccggggctgctgggggccctggcatcggccgggccgccggccggggcatcccagctggggtgcccatgccccaggccccagctggcctggccggccctgtgcggggcgtgggcggccccagccagcaggtgatgaccccccagggccggggcaccgtggccgctgctgctgctgctgccacagccagcattgctggggcccccacccagtacccacctggccggggcggccccccaccacccatgggccgcggggcccctcctcctggcatgatgggccccccacctggcatgaggcctcccatgggcccccccatgggcatccccccaggccggggcacccccatgggcatgcctcctcctggcatgaggcctcctcctcctggctgtgaggccttctttgacccctggccccagagcatggaggtggccccccagaggcggggcctggacagcagcggcccccgctaccacaggcctgtgtgcttcctgtgctgctgctcctggagcctgatgggcctgagcggcttcctgaccggccccccacctcctggcatgaggcctccccggccctag

SEQ ID NO: 18776 - DNA, 3300 bp, Artificial Sequence
  Description of Artificial Sequence: Synthetic coding sequence
atgcacatcaagagcatcatcctggagggcttcaagagctatgcccagaggacagaggtgaatggatttgaccccctcttcaatgccatcaccggcctgaatggcagcggcaagagcaacatcctggacagcatctgcttcctgctgggcatcagcaacctgagccaggtgcgggccagcaacctgcaggacctggtgtacaagaatggccaggccggcatcaccaaggcctctgtgtccatcacctttgacaacagcgacaagaagcagagccccctgggctttgaggtgcatgatgagatcaccgtgacccggcaggtggtgattggaggcaggaacaagtacctgatcaacggggtgaatgccaacaacaccagggtgcaggacctcttctgcagcgtgggcctgaatgtgaacaacccccacttcctgatcatgcagggccgcatcaccaaggtgctgaacatgaagcccccagagatcctgtccatgattgaggaggccgccggcaccaggatgtatgagtacaagaagattgctgcccagaagaccatcgagaagaaggaggccaagctgaaggagatcaagaccatcctggaggaggagatcacccccaccatccagaagctgaaggaggagaggagcagctacctggagtaccagaaggtgatgagagaaattgagcacctgagccggctgtacatcgcctaccagttcctgctggccgaggacaccaaggtgcgctctgctgaggagctgaaggagatgcaggacaaggtgatcaagctgcaggaggagctgtctgaaaatgacaagaagatcaaggccctgaaccatgaaattgaggagctggagaagaggaaggacaaggagaccggcggcatcctgcggagcctggaggatgccctggccgaggcccagagggtgaacaccaagagccagagcgcctttgacctgaagaagaagaacctggcctgtgaggagagcaagaggaaggagctggagaagaacatggtggaggacagcaagaccctggccgccaaggagaaggaggtgaagaagatcacagatggcctgcacgccctgcaggaggccagcaacaaggatgctgaggccctggccgccgcccagcagcacttcaatgctgtgtctgctggcctgagcagcaatgaagatggagctgaggccaccctggccggccagatgatggcctgcaagaatgacatcagcaaggcccagacagaggccaagcaggcccagatgaagctgaagcacgcccagcaggagctgaagaacaagcaggccgaggtgaagaagatggacagcggctacaggaaggaccaggaggccctggaggccgtgaagaggctgaaggagaagctggaggccgagatgaagaagctgaactatgaggagaacaaggaggagagcctgctggagaagaggcggcagctgagccgggacatcggccgcctgaaggagacctatgaggccctgctggcccgcttccccaacctgcgctttgcctacaaggaccctgagaagaactggaacagaaactgtgtgaagggcctggtggccagcctcatctctgtgaaggacaccagcgccaccacagccctggagctggtggccggggagcggctgtacaacgtggtggtggacacagaggtgacaggcaagaagctgctggagcggggggagctgaagaggcgctacaccatcatccccctgaacaagatcagcgcccgctgcatcgcccctgagaccctgcgggtggcccagaacctggtgggccctgacaacgtgcacgtggccctgagcctggtggagtacaagccagagctgcagaaggccatggagtttgtgtttggcaccacctttgtgtgtgacaacatggacaatgccaagaaggtggcctttgacaagaggatcatgaccaggacagtgaccctgggcggagatgtgtttgacccccacggcaccctgagcggcggggcccggagccaggccgccagcatcctgaccaagttccaggagctgaaggatgtgcaggatgagctgcgcatcaaggaaaatgagctgcgggccctggaggaggagctggccggcctgaagaacacagctgagaagtaccggcagctgaagcagcagtgggagatgaagacagaggaggccgacctgctgcagaccaagctgcagcagagcagctaccacaagcagcaggaggagctggatgccctgaagaagaccatcgaggagagcgaggagaccctgaagaacaccaaggagatccagaggaaggccgaggagaagtatgaggtgctggagaacaagatgaagaatgctgaggccgagcgggagcgggagctgaaggatgcccagaagaagctggactgtgccaagaccaaggcagatgccagcagcaagaagatgaaggagaagcagcaggaggtggaggccatcaccctggagctggaggagctgaagcgggagcacaccagctacaagcagcagctggaggccgtgaatgaggccatcaagagctatgagagccagatcgaggtgatggctgctgaggtggccaagaacaaggagagcgtgaacaaggcccaggaggaggtgaccaagcagaaggaggtgatcacagcccaggacaccgtcatcaaggccaagtatgcagaggtggccaagcacaaggagcagaacaatgacagccagctgaagatcaaggagctggaccacaacatcagcaagcacaagcgggaggctgaagatggagctgccaaggtgtccaagatgctgaaggactatgactggatcaatgctgagcggcacctgtttggccagcccaacagcgcctatgacttcaagaccaacaaccccaaggaggccggccagaggctgcagaagctgcaggagatgaaggagaagctgggcagaaatgtgaacatgagggccatgaatgtgctgacagaggccgaggagcgctacaatgacctgatgaagaagaagagaattgtggagaatgacaagagcaagatcctgaccaccatcgaggacctggaccagaagaagaaccaggccctgaacatcgcctggcagaaggtgaacaaggactttggcagcatcttcagcaccctgctgcccggggccaatgccatgctggcccctcctgagggccagacagtgctggatggcctggagttcaaggtggccctgggcaacacctggaaggagaacctgacagagctgagcggcggccagaggcagaagcagcagaaccacaccaccggctag

SEQ ID NO: 18777 - DNA, 381 bp, Artificial Sequence
  Description of Artificial Sequence: Synthetic coding sequence
atgttccagaaggatgagtactgcatcctgatcctgggcctggacaatgccggcaagaccaccttcctggagcagagcaagacccgcttcaacaagaactacaagggcatgagcctgagcaagatcaccaccaccgtgggcctgaacatcggcaccgtggatgtgggcaaggcccggctgatgttctgggacctgggcggccaggaggagctgcagagcctgtgggacaaggacaagaccaagtgtggggacctgggcaccctgcacagcagcaaggtgtctgccagcttccggctgcgggacctggccgctgaccaccacaggacccagaagtggcagaggccagatgtgggcacagctggctggctgcccctgccctag

SEQ ID NO: 18778 - DNA, 1119 bp, Artificial Sequence
  Description of Artificial Sequence: Synthetic coding sequence
atgaccttccagttcaacttcaccatcgaggaccacctggagaatgagctgacccccatcagagatggagccctgaccctggacagcagcaaggagctgtctgtgtctgagagccagaagggggaggagcgggacagaaaatgttctgctgagcagtttgacctgccccaggaccacctgtgggagcacaagtccatggagaatgctgcccccagccaggacacagacagccccctgtctgctgccagcagcagcaggaacctggagccccacggcaagcagcccagcctgcgggccgccaaggagcacgccatgcccaaggacctgaagaagatgctggagaacaaggtgattgagaccctgcccggcttccagcacgtgaagctgtctgtggtgaagaccatcctgctgaaggagaacttccctggagagaacatcgtgtccaagagcttcagcagccacagcgacctgatcactggagtgtatgagggcggcctgaagatctgggagtgcacctttgacctgctggcctacttcaccaaggccaaggtgaagtttgctgggaagaaggtgctggacctgggctgcggcagcggcctgctgggcatcacagccttcaagggcggcagcaaggagatccacttccaggactacaacagcatggtgattgatgaggtgaccctgcccaacgtggtggccaacagcaccctggaggatgaagaaaatgatgtgaatgaaccagatgtgaagcgctgcaggaagcccaaggtgacccagctgtacaagtgccgcttcttctctggagagtggagcgagttctgcaagctggtgctgagcagcgagaagctgtttgtgaagtatgacctgatcctgaccagcgagaccatctacaacccagactactacagcaacctgcaccagaccttcctgcggctgctgagcaagaatggccgggtgctgctggccagcaaggcccactactttggagtgggcggcggcgtgcacctgttccagaagtttgtggaggagagagatgtgttcaagacccgcatcctgaagatcattgatgagggcctgaagcgcttcatcatcgagatcaccttcaagtttcctggatag

SEQ ID NO: 18779 - DNA, 1635 bp, Artificial Sequence
  Description of Artificial Sequence: Synthetic coding sequence
atgaagtgccactatgaggccctgggcgtgagaagagatgccagcgaggaggagctgaagaaggcctacaggaagctggccctgaagtggcacccagacaagaacctggacaatgctgctgaggccgctgagcagttcaagctgatccaggccgcctatgatgtgctgagtgacccccaggagcgggcctggtatgacaaccaccgggaggccctgctgaagggcggctttgatggagagtaccaggatgacagcctggacctgctgcgctacttcaccgtgacctgctacagcggctatggagatgatgagaagggcttctacacagtgtacagaaatgtgtttgagatgattgccaaggaggagctggagagcgtgctggaggaggaggtggatgacttccccacctttggagacagccagagcgactatgacacagtggtgcaccccttctacgcctactggcagagcttctgcacccagaagaactttgcctggaaggaggagtatgacacccggcaggccagcaaccgctgggagaagagggccatggagaaggagaacaagaagatccgggacaaggccaggaaggagaagaatgagctggtgcggcagctggtggccttcatcaggaagagggacaagagggtgcaggcccacaggaagctggtggaggagcagaatgctgagaaggccaggaaggccgaggagatgaggcggcagcagaagctgaagcaggccaagctggtggagcagtaccgggagcagagctggatgaccatggccaacctggagaaggagctgcaggagatggaggcccgctatgagaaggagtttggagatggcagtgatgaaaatgagatggaggagcacgagctgaaggatgaagaagatggcaaggacagtgatgaagcagaagatgctgagctgtatgatgacctgtactgcccagcctgtgacaagagcttcaagacagagaaggccatgaagaaccacgagaagagcaagaagcaccgggagatggtggccctgctgaagcagcagctggaggaggaggaggagaacttcagccggccccagattgatgagaaccccctggatgacaacagcgaggaggagatggaggatgcccccaagcagaaggtgaagtacctgaccttccgcttcatctttgccctgcggctgagcaagaagcagaagaagaagaagcagaagccagcccagaactatgatgacaacttcaacgtgaatggacctggagagggcgtgaaggtggaccctgaggacaccaacctgaaccaggacagcgccaaggagctggaggacagcccccaggagaatgtgtctgtgacagagatcatcaagccctgtgatgaccccaagtctgaggccaagtctgtgcccaagcccaagggcaagaagaccaaggacatgaagaagcctgtgcgggtgcctgctgagccccagaccatgtctgtgctgatcagctgcaccacctgccacagcgagttccccagcaggaacaagctgtttgaccacctgaaggccactggacatgcccgggcccccagcagcagcagcctgaacagcgccaccagcagccagagcaagaaggagaagaggaagaacagatag

SEQ ID NO: 18780 - DNA, 945 bp, Artificial Sequence
  Description of Artificial Sequence: Synthetic coding sequence
atgcctggcttcacctgctgcgtgcccggctgctacaacaacagccaccgggacaaggccctgcacttctacaccttccccaaggatgctgagctgcggcggctgtggctgaagaatgtgtccagagctggggtgtctggctgcttcagcaccttccagcccaccaccggccaccggctgtgcagcgtgcacttccagggcggcaggaagacctacacagtgcgggtgcccaccatcttccccctgcggggcgtgaatgaaaggaaggtggcccggcggcctgctggagctgctgctgcccggcggcggcagcagcagcagcagcagcagcagcagcagcagcagcagcagcagcagcagcagcagcagcagcagcagcagcagcagcagcagcagagcagccccagcgccagcacagcccagacagcccagctgcagcccaacctggtgtctgccagcgctgctgtgctgctgaccctgcaggccaccgtggacagcagccaggcccctggctctgtgcagcctgcccccatcacccccactggagaagatgtgaagcccatcgacctgactgtgcaggtggagtttgctgctgctgagggcgctgctgctgctgctgctgccagcgagctgcaggccgccacagctggcctggaggccgctgagtgccccatgggcccccagctggtggtggtgggggaggagggcttcccagacaccggcagtgaccacagctacagcctgagcagcggcaccacagaggaggagctgctgaggaagctgaatgagcagagggacatcctggccctgatggaggtgaagatgaaggagatgaagggcagcatccgccacctgcggctgacagaggccaagctgcgggaggagctgcgggagaaggaccggctgctggccatggccgtcatcaggaagaagcacggcatgtag

SEQ ID NO: 18781 - DNA, 645 bp, Artificial Sequence
  Description of Artificial Sequence: Synthetic coding sequence
atggccggggagaactttgccacccccttccacggccacgtgggccgcggggccttcagtgatgtgtatgagcctgctgaggacaccttcctgctgctgaatgccctggaggccgctgctgctgagctggccggcgtggagatctgcctggaggtgggcagcggcagcggcgtggtgtctgccttcctggcctccatgattggcccccaggccctgtacatgtgcacagacatcaaccctgaggccgccgcctgcaccctggagacagcccgctgcaacaaggtgcacatccagcctgtgatcacagacctggtgaagggcctgctgccccggctgacagagaaggtggacctgctggtgttcaaccccccctacgtggtgaccccaccccaggaggtgggcagccacggcatcgaggccgcctgggccggcggcaagaatggccgggaggtgatggaccgcttcttccccctggtgcctgacctgctgagccccaagggcctcttctacctggtgaccatcaaggagaacaaccctgaggagatcctgaagatcatgaagaccaagggcctgcagggcaccacagccctgagccggcaggccggccaggagaccctgtctgtgctgaagttcaccaagagctag

SEQ ID NO: 18782 - DNA, 1536 bp, Artificial Sequence
  Description of Artificial Sequence: Synthetic coding sequence
atgtctgggggctttgagctgcagcccagagatggcggcccccgggtggccctggcccctggagaaacagtgattggccggggccccctgctgggcatcacagacaagagggtgtccagaagacatgccatcctggaggtggccggcggccagctgcgcatcaagcccatccacaccaacccctgcttctaccagagcagcgagaagagccagctgctgcccctgaagcccaacctgtggtgctacctgaaccctggggacagcttcagcctgctggtggacaagtacatcttccgcatcctgagcatccccagcgaggtggagatgcagtgcaccctgaggaacagccaggtgctggatgaggacaacatcctgaatgagacccccaagagccctgtgatcaacctgccccatgagaccactggagccagccagctggagggcagcacagagatcgccaagacccagatgacccccaccaacagcgtgtccttcctgggggagaacagagactgcaacaagcagcagcccatcctggccgagaggaagaggatcctgcccacctggatgctggccgagcacctgagtgaccagaacctgtctgtgcctgccatcagcggcggcaatgtcatccagggcagcggcaaggaggagatctgcaaggacaagagccagctgaacaccacccagcagggccggcggcagctgatcagcagcggcagcagcgagaacaccagcgctgagcaggacacaggagaggagtgcaagaacacagaccaggaggagagcaccatcagcagcaaggagatgccccagagcttcagcgccatcaccctgagcaacacagagatgaacaacatcaagaccaatgcccagaggaacaagctgcccatcgaggagctgggcaaggtgtccaagcacaagatcgccaccaagaggaccccccacaaggaggatgaggccatgagctgcagcgagaactgcagcagcgcccagggcgacagcctgcaggatgagagccagggcagccacagcgagagcagcagcaaccccagcaaccctgagaccctgcacgccaaggccacagacagcgtgctgcagggcagcgagggcaacaaggtgaagaggaccagctgcatgtatggagccaactgctacaggaagaaccctgtgcacttccagcacttcagccaccctggggacagcgactatggaggagtgcagatcgtgggccaggatgaaacagatgacaggcctgagtgcccctacggccccagctgctacaggaagaacccccagcacaagattgagtaccgccacaacaccctgcctgtgagaaatgtgctggatgaagataatgacaacgtgggccagcccaatgaatatgacctgaatgacagcttcctggatgatgaggaggaggactatgagcccacagatgaagattctgactgggagcccgggaaggaggatgaggagaaggaggatgtggaggagctgctgaaggaggccaagcgcttcatgaagaggaagtag

SEQ ID NO: 18783 - DNA, 984 bp, Artificial Sequence
  Description of Artificial Sequence: Synthetic coding sequence
atggctgctgctgctgctgctgctgctgccaccaacggcaccggcggcagcagcggcatggaggtggatgctgctgtggtgcccagcgtgatggcctgtggggtgacaggctctgtgtctgtggccctgcaccccctggtgatcctgaacatcagtgaccactggatccgcatgaggagccaggagggccggcctgtgcaggtgattggagccctgattggcaagcaggagggcagaaatattgaggtgatgaacagctttgagctgctgagccacacagtggaggagaagatcatcatcgacaaggagtactactacaccaaggaggagcagttcaagcaggtgttcaaggagctggagttcctgggctggtacaccactggaggccccccagaccccagcgacatccacgtgcacaagcaggtgtgtgagatcatcgagagccccctcttcctgaagctgaaccccatgaccaagcacacagacctgcctgtgtctgtgtttgagagcgtcatcgacatcatcaacggggaggccaccatgctgtttgctgagctgacctacaccctggccacagaggaggccgagcgcatcggcgtggaccacgtggccaggatgacagccactggaagtggagagaacagcacagtggccgagcacctgattgcccagcacagcgccatcaagatgctgcacagccgggtgaagctgatcctggagtatgtgaaggccagcgaggccggggaggtgcccttcaaccacgagatcctgcgggaggcctatgccctgtgccactgcctgcctgtgctgagcacagacaagttcaagacagacttctatgaccagtgcaatgatgtgggcctgatggcctacctgggcaccatcaccaagacctgcaacaccatgaaccagtttgtgaacaagttcaacgtgctgtatgaccggcagggcatcggccgcaggatgaggggcctcttcttctag

SEQ ID NO: 18784 - DNA, 2574 bp, Artificial Sequence
  Description of Artificial Sequence: Synthetic coding sequence
atgaactaccagcagcagctggccaacagcgctgccatccgggcagagatccagagatttgagagcgtgcaccccaacatctacagcatctatgagctgctggagcgggtggaggagcctgtgctgcagaaccagatccgggagcacgtgattgccattgaagatgcctttgtgaacagccaggagtggaccctgagccgctctgtgcctgagctgaaggtgggcatcgtgggcaacctggccagcggcaagagcgccctggtgcaccgctacctgaccggcacctacgtgcaggaggagagccctgagggcggccgcttcaagaaggagatcgtggtggatggccagagctacctgctgctgatcagagatgagggcggccccccagaggcccagtttgccatgtgggtggatgctgtgatctttgtgttcagcctggaggatgagatctccttccagacagtgtaccactactacagcaggatggccaactacagaaacaccagcgagatccccctggtgctggtgggcacccaggatgccatcagcagcgccaacccccgggtgattgatgatgcccgggccaggaagctgagcaatgacctgaagcgctgcacctactatgagacctgtgccacctacggcctgaatgtggagagggtcttccaggatgtggcccagaagatcgtggccaccaggaagaagcagcagctgagcatcggcccctgcaagagcctgcccaacagccccagccacagctctgtgtgcagcgcccaggtgtctgctgtgcacatcagccagaccagcaatggaggcggcagcctgagtgactacagcagctctgtgcccagcacccccagcaccagccagaaggagctgagaattgatgtgcccccaacagccaacacccccacccctgtgaggaagcagagcaagagaagaagcaacctcttcaccagcaggaagggcagtgaccctgacaaggagaagaagggcctggagagcagagctgacagcatcggcagcggccgggccatccccatcaagcagggcatgctgctgaagaggtctgggaagagcctgaacaaggagtggaagaagaagtatgtgaccctgtgtgacaatggagtgctgacctaccaccccagcctgcatgactacatgcagaatgtgcacggcaaggagattgacctgctgcggaccaccgtgaaggtgcctgggaagaggcctccccgggccaccagcgcctgtgcccccatcagcagccccaagaccaacggcctgagcaaggacatgagcagcctgcacatcagccccaacagcggaaatgtgaccagcgccagcggcagccagatggccagcggcatcagcctggtgtccttcaacagcaggccagatggcatgcaccagaggagctacagcgtgtcctctgctgaccagtggagcgaggccaccgtgattgccaacagcgccatcagcagtgacaccggcctgggggacagcgtgtgcagcagccccagcatcagcagcaccaccagccccaagctggaccccccacccagcccccacgccaacaggaagaagcacaggaggaagaagagcaccagcaacttcaaggcagatggcctgagcggcacagctgaggagcaggaggagaactttgagttcatcatcgtgtccctgaccggccagacctggcactttgaggccaccacctatgaggagagagatgcctgggtgcaggccatcgagagccagatcctggccagcctgcagagctgtgagagcagcaagaacaagagccggctgaccagccagagcgaggccatggccctgcagagcatccggaacatgaggggcaacagccactgtgtggactgtgagacccagaaccccaactgggccagcctgaacctgggcgccctgatgtgcatcgagtgcagcggcatccacaggaacctgggcacccacctgagccgggtgcgcagcctggacctggatgactggcctgtggagctgatcaaggtgatgagcagcattggaaatgagctggccaacagcgtgtgggaggagagcagccagggccgcaccaagcccagcgtggacagcacccgggaggagaaggagcgctggatccgggccaagtatgagcagaagctgttcctggcccccctgccctgcacagagctgagcctgggccagcacctgctgcgggccacagcagatgaggacctgaggacagccatcctgctgctggcccacggcagcagagatgaggtgaatgagacctgtggggagggagatggccgcacagccctgcacctggcctgcaggaaaggaaatgtggtgctggcccagctgctgatctggtatggagtggatgtgacagccagagatgcccacggcaacacagccctggcctatgcccggcaggccagcagccaggagtgcattgatgtgctgctgcagtatggctgcccagatgaaagatttgtgctgatggccacccccaacctgagcagaagaaacaacaacagaaacaacagcagcggccgggtgcccaccatcatctag

SEQ ID NO: 18785 - DNA, 1653 bp, Artificial Sequence
  Description of Artificial Sequence: Synthetic coding sequence
atgagccagaccagcctgaagcagaagaagaatgaacctggcatgaggagcagcaaggagagcctggaggccgagaagaggaaggagagtgacaagacaggagtgcggctgagcaaccagggcagccaggagagcagcctgaggaagacagacagccggggctacctggtgcgcagccagtggagccgcatcagccgcagccccagcaccaaggcccccagcattgatgagcccaggagcaggaacaccagcgccaagctgcccagcagcagcaccagcagcaggacccccagcaccagccccagcctgcatgacagcagccccccacccctgagcggccagcccagcctgcagcccccagccagcccccagctgcccaggagcctggacagcaggcctcccaccccacctgagccagaccccggcagccgccgcagcaccaagatgcaggagaaccctgaggcctgggcccagggcatcgtgcgggagatccggcagacccgggacagccagcccctggagtacagcaggaccagccccacagagtggaagagcagcagccagaggcggggcatctacccagccagcacccagctggacaggaacagcctgtctgagcagcagcagcagcagagagaagatgaagatgattatgaggccgcctactgggcctccatgaggagcttctatgagaagaaccccagctgcagccggccctggccacccaagcccaagaatgccatcaccatcgccctgagcagctgtgccctcttcaacatggtggatggcaggaagatctatgagcaggagggcctggagaagtacatggagtaccagctgaccaatgaaaatgtcatcctgaccccaggccctgccttccgctttgtgaaggccctgcagtatgtgaatgcccggctgcgggacctgtacccagatgagcaggacctgtttgatattgtgctgatgaccaacaaccacgcccaggtgggcgtgcggctcatcaacagcgtgaaccactacggcctgctgattgaccgcttctgcctgaccggcggcaaggaccccatcggctacctgaaggcctacctgaccaacctgtacatcgctgctgacagcgagaaggtgcaggaggccatccaggagggcatcgccagcgccaccatgtttgatggagccaaggacatggcctactgtgacacccagctgcgggtggcctttgatggagatgctgtgctcttcagtgatgaaagtgagcacttcaccaaggagcacggcctggacaagttcttccagtatgacaccctgtgtgagagcaagcccctggcccagggccccctgaagggcttcctggaggacctgggccgcctgcagaagaagttctacgccaagaatgaaaggctgctgtgccccatccgcacctacctggtgacagcccggtctgctgccagcagcggggcccgggtgctgaagaccctgcggcgctggggcctggagattgatgaggccctcttcctggccggggcccccaagagccccatcctggtgaagatccggccccacatcttctttgatgaccacatgttccacatcgagggcgcccagaggctgggcagcattgctgcctacggcttcaacaagaagttcagcagctag

SEQ ID NO: 18786 - DNA, 888 bp, Artificial Sequence; identical to SEQ ID NO: 18344
  Description of Artificial Sequence: Synthetic coding sequence

SEQ ID NO: 18787 - DNA, 549 bp, Artificial Sequence
  Description of Artificial Sequence: Synthetic coding sequence
atgagcggccgctctgtgccccacgcccacccagccacagcagaatatgaatttgccaaccccagccggctgggggagcagagatttggagagggcctgctgcctgaggagatcctgacccccaccctgtaccacggctactacgtgcggcccagggctgccccagctggggagggcagccgggccggggccagcgagctgcggctgtctgagggcaagttccaggccttcctggatgtgagccacttcaccccagatgaggtgacagtgaggacagtggacaacctgctggaggtgtctgcccggcacccccagaggctggacagacatggctttgtgtcccgggagttctgcaggacctacgtgctgcctgcagatgtggacccctggagggtgcgggccgccctgagccatgatggcatcctgaacctggaggccccccggggcggccgccacctggacacagaggtgaatgaggtgtacatcagcctgctgcctgcccccccagaccctgaggaggaggaggaggccgccatcgtggagccctag

SEQ ID NO: 18788 - DNA, 636 bp, Artificial Sequence
  Description of Artificial Sequence: Synthetic coding sequence
atgagcacagctgctgtgcctgagctgaagcagatcagccgggtggaggccatgaggctgggccctggctggagccacagctgccacgccatgctgtatgctgccaaccctggccagctgtttggccgcatccccatgaggttctctgtgctgatgcagatgagatttgatggcctgctgggcttccctgggggctttgtggaccggcgcttctggagcctggaggatggcctgaacagagtgctgggcctgggcctgggctgcctgcggctgacagaggccgactacctgagcagccacctgacagagggcccccaccgggtggtggcccacctgtatgcccggcagctgaccctggagcagctgcatgctgtggagatctctgctgtgcacagccgggaccacggcctggaggtgctgggcctggtgcgggtgcccctgtacacccagaaggacagagtgggcggcttccccaacttcctgagcaatgcctttgtgtccacagccaagtgccagctgctgtttgccctgaaggtgctgaacatgatgcctgaggagaagctggtggaggccctggccgccgccacagagaagcagaagaaggccctggagaagctgctgcctgccagcagctag

SEQ ID NO: 18789 - DNA, 2622 bp, Artificial Sequence
  Description of Artificial Sequence: Synthetic coding sequence
atgcaccccccacctcctgctgctgccatggacttcagccagaacagcctgtttggctacatggaggacctgcaggagctgaccatcatcgagaggcctgtgagaagaagcctgaagaccccagaggagattgaaaggctgactgtggatgaggacctgagtgacatcgagagagctgtgtacctgctgtctgctggccaggatgtgcagggcacctctgtgattgccaacctgcccttcctgatgaggcagaaccccacagagaccctgcggcgggtgctgcccaaggtgcgggaggccctgcacgtggccggcgtggagatgcagctgacagctgccatgtccttcctgaccatcctgcaggatgagagcgtgtccatccacgcctacacccacagcttcctgcaggtgatcctgctgcacctggagcaccgggacacaggagtgtccaatgcctggctggagaccctgctgtctgtgattgaggtgctgcccaaggagaccctgcggcatgagatcctgaaccccctggtgtccaaggcccagctgagccagacagtgcagagccggctggtgtcctgcaagatcctgggcaagctgaccaacaagtttgatgcccacaccatcaagcgggagatcctgcccctggtgaagagcctgtgccaggatgtggagtatgaggtgcgcagctgcatgtgccggcagctggagaacatcgcccagggcattggaacagagctgaccaagtctgtggtgctgcctgagctgattgagctgagcagagatgagggcagctctgtgcggctggccgcctttgagaccctggtgaacctgctggacatctttgacacagatgacaggagccagaccatcctgcccctggtgaagagcttctgtgagaagagcttcaaggcagatgagagcatcctgatcagcctgtccttccacctgggcaagctgtgccacggcctgtatggcatcttcaccccagaccagcacctgcgcttcctggagttctacaagaagctgtgcaccctgggcctgcagcaggagaatggccacaatgaaaaccagatccccccccagatcctggagcaggagaagaagtacatctctgtgaggaagaactgtgcctacaacttccctgccatgattgtgtttgtggaccccaagaacttccacatggagctgtacagcaccttcttctgcctgtgccacgaccctgaggtgcctgtgcgctacaccatcgccatctgcttctatgaggtgtccaagctgctgaacagcggcgtgtacctgatccacaaggagctgatcaccctgctgcaggatgagagcctggaggtgctggatgccctgattgaccacctgcctgagatcctggagctgatgagcactggaggagagagctctgtgcaggagaacaagctgagcagcctgcctgacctgatcccagccctgacagctgctgagcagagagctgctgccagcctgaagtggaggacccatgagaagctgctgcagaagtatgcctgcctgccccacgtgatcagcagtgaccagatctactaccgcttcctgcagaggatgttcaccatcatgatgaccaacaacgtgctgcctgtgcagaaggccgccagcaggaccctgtgcatcttcctgcgctacaacaggaagcaggagcagagacatgaggtgatccagaagctgattgagcagctgggccagggcaagagctactggaaccggctgcgcttcctggacacctgtgagttcatcatcgagatcttcagcaagagcttcttctgcaagtacttcttcctgcctgccatcgagctgacccatgaccctgtggccaacgtgaggatgaagctgtgctacctgctgcccaaggtgaagagcaccctgaagatcccagctgacaagcacctgctgcagcagctggagatgtgtgtgaggaagctgctgtgccaggagaaggacaaggatgtgctggccatcgtgaagaggacagtgctggagctggacaggatggagatgtccatggatgccttccagaagaagttctatgagaaggacctgctggaccaggagaaggagcgggaggagctgctgctgctggagatggagcagctggagaaggagaagcagcagaatgatggccggcccatgtctgacaagatgtttgagaagaagagaagagacaccaagacccccacccagagcctgcccaagaacatccccatctctgtgcccggccccagctctgtgacccccagcaccagcaaggagatcaagaagagcaagctgatccgcagccagagcttcaacaaccaggccttccacgccaagtatggcaacctggagaagtgtgccagcaagagcagcaccaccggctacaccacctctgtgtctggcctgggcaagacctctgtgctgagcctggctgatgacagcttccgcaccagaaatgccagctctgtgcccagcagcttcagccccaacacccccctgcccagcaccagccggggcactggaaacagcgtggaccccaagagcagcggcagcaaggacacccagcccaggaaggccaccctgaagagcaggaagagcaacccctag

SEQ ID NO: 18790 - DNA, 951 bp, Artificial Sequence
  Description of Artificial Sequence: Synthetic coding sequence
atgaggcagcccctgtcctggggccgctggagggccatgctggcccggacctacggccctggccccagcgctggctaccgctgggccagcggggcccagggctacgtgagaaatcctcctgtgggcgcctgtgacctgcagggcgagctggacagatttggaggcatctctgtgcggctggcccggctggatgccctggaccggctggatgctgctgccttccagaagggcctgcaggccgctgtgcagcagtggaggtctgagggccgcacagctgtgtggctgcacatccccatcctgcagagccgcttcatcgccccagctgccagcctgggcttctgcttccaccacgccgagagtgacagcagcaccctgaccctgtggctgcgggagggccccagccggctgcccggctacgccagccaccaggtgggcgtggccggggctgtgtttgatgagagcaccaggaagatcctggtggtgcaggacaggaacaagctgaagaacatgtggaagtttcctgggggcctgtctgagcctgaggaggacatcggggacacagctgtgcgggaggtgtttgaggagaccggcatcaagtctgagttccgctctgtgctgagcatccggcagcagcacaccaaccctggggccttcggcaagagtgacatgtacatcatctgccgcctgaagccctacagcttcaccatcaacttctgccaggaggagtgcctgcgctgtgagtggatggacctgaatgacctggccaagacagagaacaccacccccatcaccagccgggtggcccggctgctgctgtatggctaccgggagggctttgacaagattgacctgactgtggaggagctgcctgctgtgtacacaggcctcttctacaagctgtaccacaaggagctgcctgagaactacaagaccatgaagggcattgattag

SEQ ID NO: 18791 - DNA, 537 bp, Artificial Sequence
  Description of Artificial Sequence: Synthetic coding sequence
atgggagagacctggaagaacatctgcagcacagtgcgccacggctggtggctgcgggaccacaggatggccggcctgcccatccccccagagatcgtgaaggaggccgaggtgccccaggccgccctgggcgtgcctgcccagggcaccggggacaatggccacacccctgtggaggaggaggtgggcggcatccctgtgcctgcccctggcctgctgcaggtgacagagcggcggcagcccctgagctctgtgagcagcctggaggtgcactttgacctgctggacctgacagagctgacagacatgtctgaccaggagctggccgaggtgtttgctgacagtgatgatgagaacctgaacacagagagccctgctggcctgcaccccctgccccgggccggctacctgcggagccccagctggaccaggaccagggctgagcagagccatgagaagcagcccctgggggaccctgagcggcaggccaccgtgctggacaccttcctgactgtggagcggccccaggaggactag

SEQ ID NO: 18792 - DNA, 741 bp, Artificial Sequence
  Description of Artificial Sequence: Synthetic coding sequence
atggccgagcaggagcagaggaagatccccctggtgcctgagaacctgctgaagaagaggaaggcctaccaggccctgaaggccacccaggccaagcaggccctgctggccaagaaggagcagaagaagggcaagggcctgcgcttcaagaggctggagagcttcctgcatgacagctggaggcagaagagggacaaggtgcggctgcggcggctggaggtgaagccccacgccctggagctgcctgacaagcacagcctggcctttgtggtgagaattgaaagaattgatggagtgtccctgctggtgcagaggaccatcgcccggctgcggctgaagaagatcttctctggagtgtttgtgaaggtgaccccccagaacctgaagatgctgagaattgtggagccctacgtgacctggggcttccccaacctgaagtctgtgcgggagctgatcctgaagaggggccaggccaaggtgaagaacaagaccatccccctgacagacaacacagtgattgaggagcacctgggcaagtttggagtcatctgcctggaggacctgatccacgagatcgccttccctgggaagcacttccaggagatctcctggttcctgtgccccttccacctgtctgtggcccggcatgccaccaagaacagagtgggcttcctgaaggagatgggcaccccaggctacagaggagagcgcatcaaccagctgatccggcagctgaactag

SEQ ID NO: 18793 - DNA, 2442 bp, Artificial Sequence
  Description of Artificial Sequence: Synthetic coding sequence
atggcctggccctgcatcacccgggcctgctgcatcgcccgcttctggaaccagctggacaaggctgacattgctgtgcccctggtgttcaccaagtacagcgaggccacagagcaccctggggccccaccccagcccccaccaccccagcagcaggcccagcctgccctggcccctccttctgcccgggctgtggccatcgagacccagcctgcccagggcgagctggatgctgtggcccgggccactggacctgcccctggccccaccggggagcgggagcctgctgctggccctggccgcagcggccctggccctggcctgggcagcggcagcaccagcggccctgctgacagcgtgatgaggcaggactaccgggcctggaaggtgcagaggcctgagcccagctgccggcccaggtctgagtaccagcccagtgatgccccctttgagcgggagacccagtaccagaaggacttccgggcctggcccctgcccaggagaggagaccacccctggatccccaagcctgtgcagatctctgctgccagccaggccagcgcccccatcctgggcgcccccaagaggcggccccagagccaggagcgctggcctgtgcaggccgctgctgaggcccgggagcaggaggccgcccctggaggagctgggggcctggccgccggcaaggccagcggggctgatgagcgggacaccaggaggaaggccggccctgcctggatcgtgagaagagctgagggcctgggccacgagcagacccccctgcctgctgcccaggcccaggtgcaggccactggacctgaggccggccggggccgggctgctgctgatgccctgaaccggcagatccgggaggaggtggccagcgctgtgagcagcagctacagaaatgagttccgggcctggacagacatcaagcctgtgaagcccatcaaggccaagccccagtacaagcccccagatgacaagatggtgcatgagaccagctacagcgcccagttcaagggggaggccagcaagcccaccacagctgacaacaaggtgattgacagaagacgcatccgcagcctgtacagcgagcccttcaaggagccccccaaggtggagaagcccagcgtgcagagcagcaagcccaagaagaccagcgccagccacaagcccaccaggaaggccaaggacaagcaggccgtgtctggccaggccgccaagaagaagtctgctgagggccccagcaccaccaagccagatgacaaggagcagagcaaggagatgaacaacaagctggccgaggccaaggagagcctggcccagcctgtgtctgacagcagcaagacccagggccctgtggccacagagccagacaaggaccagggctctgtggtgcccggcctgctgaagggccagggccccatggtgcaggagcccctgaagaagcagggctctgtggtgcccggcccccccaaggacctgggccccatgatccccctgcctgtgaaggaccaggaccacacagtgcctgagcccctgaagaatgaaagccctgtgatcagcgcccctgtgaaggaccagggccccagcgtgcctgtgccccccaagaaccagagccccatggtgcctgccaaggtgaaggaccagggctctgtggtgcctgagagcctgaaggaccagggcccccgcatccctgagcctgtgaagaaccaggcccccatggtgcctgcccctgtgaaggatgagggccccatggtgtctgcctctgtgaaggaccagggccccatggtgtctgcccctgtgaaggaccagggccccatcgtgcctgcccctgtgaagggggagggccccatcgtgcctgcccctgtgaaggatgagggccccatggtgtctgcccccatcaaggaccaggaccccatggtgcctgagcaccccaaggatgaaagtgccatggccacagcccccatcaagaaccagggctccatggtgtctgagcctgtgaagaaccagggcctggtggtgtctggccctgtgaaggaccaggatgtggtggtgcctgagcacgccaaggtgcatgacagcgctgtggtggcccctgtgaagaaccagggccctgtggtgcctgagagcgtgaagaaccaggaccccatcctgcctgtgctggtgaaggaccagggccccaccgtgctgcagccccccaagaaccagggcagaattgtgcctgagcccctgaagaaccaggtgcccatcgtgcctgtgcccctgaaggaccaggaccccctggtgcctgtgcctgccaaggaccagggccctgctgtgcctgagcccctgaagacccagggcccccgggacccccagctgcccaccgtgagccccctgccccgggtgatgatccccacagccccccacacagagtacatcgagagcagcccctag

SEQ ID NO: 18794 - DNA, 261 bp, Artificial Sequence
  Description of Artificial Sequence: Synthetic coding sequence
atgccccagtaccagacctgggaggagttcagcagagctgctgagaagctgtacctggccgaccccatgaaggcccgggtggtgctgaagtaccgccacagtgatggcaacctgtgtgtgaaggtgacagatgacctggtgtgcctggtgtacaagacagaccaggcccaggatgtgaagaagattgagaagttccacagccagctgatgaggctgatggtggccaaggaggccagaaatgtgaccatggagacagaatag

SEQ ID NO: 18795 - DNA, 1206 bp, Artificial Sequence
  Description of Artificial Sequence: Synthetic coding sequence
atggcccacgtgagcagcgagacccaggatgtgagccccaaggatgagctgacagccagcgaggccagcaccaggagccccctgtgtgagcacaccttccctggggacagcgacctgcgctccatgattgaggagcacgccttccaggtgctgagccagggcagcctgctggagagccccagctacacagtgtgtgtgtctgagccagacaaggatgatgacttcctgagcctgaacttccccaggaagctgtggaagatcgtggagagtgaccagttcaagagcatctcctgggatgaaaatggcacctgcatcgtcatcaatgaggagctgttcaagaaggagatcctggagaccaaggccccctaccgcatcttccagacagatgccatcaagagctttgtgcggcagctgaacctgtatggcttcagcaagatccagcagaacttccagaggtctgccttcctggccaccttcctgtctgaggagaaggagagctctgtgctgagcaagctgaagttctactacaaccccaacttcaagaggggctacccccagctgctggtgcgggtgaagagaagaattggagtgaagaatgccagccccatcagcaccctcttcaatgaagacttcaacaagaagcacttccgggccggggccaacatggagaaccacaacagcgccctggccgctgaggccagcgaggagagcctcttcagcgccagcaagaacctgaacatgcccctgacccgggagagctctgtgcggcagatcatcgccaacagctctgtgcccatccgcagcggcttccccccacccagccccagcacctctgtgggccccagcgagcagatcgccacagaccagcacgccatcctgaaccagctgaccaccatccacatgcacagccacagcacctacatgcaggcccggggccacatcgtgaacttcatcaccaccaccaccagccagtaccacatcatcagccccctgcagaatggctacttcggcctgactgtggagcccagcgctgtgcccacccgctaccccctggtgtctgtgaatgaggccccctacagaaacatgctgcctgctggcaacccctggctgcagatgcccaccatcgctgacagatctgctgccccccacagccggctggccctgcagcccagccccctggacaagtaccaccccaactacaactag

SEQ ID NO: 18796 - DNA, 4302 bp, Artificial Sequence
  Description of Artificial Sequence: Synthetic coding sequence
atgtggagcctgacagccagcgagggggagagcaccacagcccacttcttcctgggcgctggagatgagggcctgggcacccggggcatcggcatgaggcctgaggagagtgacagcgagctgctggaggatgaggaggatgaggtgcccccagagccccagatcatcgtgggcatctgtgccatgaccaagaagagcaagagcaagcccatgacccagatcctggagcggctgtgccgctttgactacctgactgtggtgatcctgggagaagatgtgatcctgaatgaacctgtggagaactggcccagctgccactgcctgatctccttccacagcaagggcttccccctggacaaggctgtggcctacagcaagctgaggaaccccttcctgatcaatgacctggccatgcagtactacatccaggacagaagagaggtgtaccgcatcctgcaggaggagggcatcgacctgcccaggtatgctgtgctgaacagagatcctgcccggcctgaggagtgcaacctgattgaaggagaggaccaggtggaggtgaatggagctgtgttccccaagccctttgtggagaagcctgtgtctgctgaggaccacaacgtgtacatctactaccccagcagcgctgggggcggcagccagaggctcttcaggaagattggcagccgcagctctgtgtacagccctgagagctctgtgaggaagacaggcagctacatctatgaggagttcatgcccacagatggaacagatgtgaaggtgtacacagtgggccctgactatgcccacgccgaggccaggaagagccctgccctggatggcaaggtggagcgggacagcgagggcaaggagatccgctaccctgtgatgctgacagccatggagaagctggtggccaggaaggtgtgtgtggccttcaagcagacagtgtgtggctttgacctgctgcgggccaacggccacagctttgtgtgtgatgtgaatggcttctcctttgtgaagaacagcatgaagtactatgatgactgtgccaagatcctgggcaacaccatcatgagggagctggccccccagttccagatcccctggagcatccccacagaagctgaggacatccccatcgtgcccaccaccagcggcaccatgatggagctgcgctgtgtgattgccatcatccgccacggggacaggacccccaagcagaagatgaagatggaggtgaagcacccccgcttctttgccctgtttgagaagcatggaggctacaagacaggcaagctgaagctgaagaggcctgagcagctgcaggaggtgctggacatcacccggctgctgctggccgagctggagaaggagcctggaggagaaattgaggagaagacaggcaagctggagcagctgaagtctgtgctggagatgtatggccacttcagcggcatcaacaggaaggtgcagctgacctactacccccatggagtgaaggccagcaatgaaggccaggacccccagcgggagaccctggcccccagcctgctgctggtgctgaagtggggcggggagctgaccccagctggccgggtgcaggccgaggagctgggccgggccttccgctgcatgtacccaggcggccagggcgactatgccggcttccctggctgcggcctgctgcggctgcacagcaccttcagacatgacctgaagatctatgccagtgatgagggccgggtgcagatgacagctgctgcctttgccaagggcctgctggccctggagggggagctgacccccatcctggtgcagatggtgaagagcgccaacatgaatggcctgctggacagtgatggagacagcctgagcagctgccagcaccgggtgaaggcccggctgcaccacatcctgcagcaggatgccccctttggacctgaggactatgaccagctggcccccaccaggagcaccagcctgctgaacagcatgaccatcatccagaaccctgtgaaggtgtgtgaccaggtgtttgccctgattgagaacctgacccaccagatccgggagaggatgcaggaccccaggtctgtggacctgcagctgtaccacagcgagaccctggagctgatgctgcagcgctggagcaagctggagcgggacttccggcagaagagcggccgctatgacatcagcaagatcccagacatctatgactgtgtgaagtatgatgtgcagcacaacggcagcctgggcctgcagggcacagctgagctgctgcggctgagcaaggccctggctgatgtggtgatcccccaggagtatggcatcagccgggaggagaagctggagattgctgtgggcttctgcctgcccctgctgaggaagatcctgctggacctgcagaggacccatgaagatgagagcgtgaacaagctgcaccccctgtgctacctgcgctacagcagaggagtgctgagccctggccgccacgtgaggacccggctgtacttcaccagcgagagccacgtgcacagcctgctgagcgtcttccgctatggaggcctgctggatgagacccaggatgcccagtggcagagggccctggactacctgagcgccatcagcgagctgaactacatgacccagatcgtcatcatgctgtatgaggacaacacccaggaccccctgtctgaggagcgcttccacgtggagctgcacttcagccctggggtgaagggcgtggaggaggagggcagcgccccagctggctgcggcttccggcctgccagcagtgaaaatgaggagatgaagaccaaccagggctccatggagaacctgtgccctgggaaggccagtgatgagccagaccgggccctgcagaccagcccccagcccccagagggccctggcctgcccaggaggagccccctcatccggaacaggaaggccggctccatggaggtgctgtctgagaccagcagcagcaggcctgggggctaccgcctcttcagcagcagccggcccccaacagagatgaagcagagcggcctgggcagccagtgcaccggcctcttcagcaccaccgtgctgggcggcagcagcagcgcccccaacctgcaggactatgcccggagccacggcaagaagctgcccccagccagcctgaagcacagagatgagctgctgtttgtgcctgctgtgaagcgcttctctgtgtcctttgccaagcaccccaccaacggctttgagggctgcagcatggtgcccaccatctaccccctggagaccctgcacaatgccctgagcctgcggcaggtgtctgagttcctgagccgggtgtgccagaggcacacagatgcccaggcccaggccagcgctgccctgtttgacagcatgcacagcagccaggccagtgacaaccccttcagcccccccaggaccctgcacagcccccccctgcagctgcagcagaggtctgagaagccaccctggtacagcagcggccccagcagcacagtgtcctctgctggccccagcagccccaccaccgtggatggcaacagccagtttggcttcagtgaccagcccagcctgaacagccacgtggccgaggagcaccagggcctgggcctgctgcaggagaccccaggcagcggggcccaggagctgagcattgaaggagagcaggagctgtttgagcccaaccagagcccccaggtgccccccatggagaccagccagccctatgaggaggtgtcccagccctgccaggaggtgcctgacatcagccagccctgccaggacatcagcgaggccctgagccagccctgccagaaggtgcctgacatcagccagcagtgccaggagaaccacgacaatggaaaccacacctgccaggaggtgccccacatcagccagccctgccagaagagcagccagctgtgccagaaggtgtctgaggaggtgtgccagctgtgcctggagaacagcgaggaggtgtcccagccctgccagggcgtgtctgtggaggtgggcaagctggtgcacaagttccacgtgggcgtgggcagcctggtgcaggagaccctggtggaggtgggcagccctgctgaggagatccctgaggaggtgatccagccctaccaggagttctctgtggaggtgggccgcctggcccaggagaccagcgccatcaacctgctgagccagggcatccctgagattgacaagcccagccaggagttccctgaggagattgacctgcaggcccaggaggtgcctgaggagatcaactag

SEQ ID NO: 18797 - DNA, 1137 bp, Artificial Sequence
  Description of Artificial Sequence: Synthetic coding sequence
atggattctgtgcgcagcggggccttcggccacctgttccggccagacaacttcatcttcggccagagcggggccggcaacaactgggccaagggccactacacagaaggagctgagctggtggacagcgtgctggatgtggtgaggaaagaatgtgagaactgtgactgcctgcagggcttccagctgacccacagcctgggcggcggcactggaagtggcatgggcaccctgctgatcagcaaggtgcgggaggagtacccagaccgcatcatgaacaccttctctgtggtgcccagccccaaggtgtctgacacagtggtggagccctacaatgccaccctgagcatccaccagctggtggagaacacagatgagacctactgcatcgacaatgaggccctgtatgacatctgcttccgcaccctgaagctggccacccccacctacggggacctgaaccacctggtgtctgccaccatgtctggagtgaccaccagcctgcgcttccctggccagctgaatgctgacctgaggaagctggccgtgaacatggtgcccttcccccggctgcacttcttcatgcctggctttgcccccctgacagcccggggcagccagcagtaccgggccctgactgtgcctgagctgacccagcagatgtttgatgccaagaacatgatggccgcctgtgaccccaggcatggccgctacctgactgtggccaccgtcttccggggccgcatgtccatgaaggaggtggatgagcagatgctggccatccagagcaagaacagcagctactttgtggagtggatccccaacaacgtgaaggtggccgtgtgtgacatccccccccggggcctgaagatgagcagcaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggagggggagatgtatgaagatgatgaggaggagagcgaggcccagggccccaagtag

SEQ ID NO: 18798 - DNA, 1161 bp, Artificial Sequence
  Description of Artificial Sequence: Synthetic coding sequence
atgtgtgaaagagctgcccggctgtgcagagctggggcccaccggctgctgcgggagcccccccagcagggccgggccctgggcggcctgctgcgctgggtgggcgccaggatgggagagccccgggagagcctggccccagctgccccagctgaccccggccctgccagcccccggggcggcacagctgtgatcctggacatcttccggcgggctgacaagaatgatgatggcaagctgagcctggaggagttccagctgttctttgctgatggagtgctgaatgagaaggagctggaggacctcttccacaccatcgacagcgacaacaccaaccacgtggacaccaaggagctgtgtgactactttgtggaccacatgggagactatgaagatgtgctggccagcctggagaccctgaaccacagcgtgctgaaggccatgggctacaccaagaaggtgtatgaaggaggcagcaatgtggaccagtttgtgacccgcttcctgctgaaggagacagccaaccagatccagagcctgctgagctctgtggagagcgctgtggaggccatcgaggagcagaccagccagctgcggcagaaccacatcaagcccagccacagcgctgcccagacctggtgtggcagccccaccccagccagcgcccccaaccacaagctgatggccatggagcagggcaagaccctgcccagcgccacagaagatgccaaggaggagggcctggaggcccagatcagccggctggccgagctgattggccgcctggagagcaaggccctgtggtttgacctgcagcagaggctgagtgatgaagatggcaccaacatgcacctgcagctggtgcggcaggagatggctgtgtgcccagagcagctgtctgagttcctggacagcctgcggcagtacctgcggggcaccaccggggtgaggaactgcttccacatcacagctgtgcggctgagtgatggcttcacctttgtgatctatgagttctgggagacagaggaggcctggaagaggcacctgcagagccccctgtgcaaggccttcagacatgtgaaggtggacaccctgagccagcctgaggccctgagccgcatcctggtgcctgctgcctggtgcaccgtgggccgggactag

SEQ ID NO: 18799 - DNA, 1482 bp, Artificial Sequence
  Description of Artificial Sequence: Synthetic coding sequence
atggagaggagcccagatgtgtccccaggccccagccgctccttcaaggaggagctgctgtgtgctgtgtgctatgaccccttcagagatgctgtgaccctgcgctgtggccacaacttctgccggggctgtgtgagccgctgctgggaggtgcaggtgagccccacctgccctgtgtgcaaggaccgggccagccctgctgacctgcggaccaaccacaccctgaacaacctggtggagaagctgctgcgggaggaggccgagggcgcccgctggaccagctaccgcttcagccgggtgtgccgcctgcaccggggccagctgagcctcttctgcctggaggacaaggagctgctgtgctgcagctgccaggccgaccccaggcaccagggccaccgggtgcagcctgtgaaggacacagcccatgacttccgggccaagtgcaggaacatggagcacgccctgcgggagaaggccaaggccttctgggccatgaggaggagctatgaggccatcgccaagcacaaccaggtggaggccgcctggctggagggccgcatccggcaggagtttgacaagctgcgggagttcctgcgggtggaggagcaggccatcctggatgccatggccgaggagacccggcagaagcagctgctggctgatgagaagatgaagcagctgacagaggagacagaggtgctggcccacgagattgaaaggctgcagatggagatgaaggaggatgatgtgtccttcctgatgaagcacaagagcaggaagagaagactcttctgcaccatggagcctgagcctgtgcagcccggcatgctgattgatgtgtgcaagtacctgggcagcctgcagtacagagtgtggaagaagatgctggcctctgtggagagcgtgcccttctcctttgaccccaacacagctgctggctggctgtctgtgtctgatgacctgacctctgtgaccaaccacggctacagagtgcaggtggagaaccctgagcgcttcagcagcgccccctgcctgctgggcagcagggtcttcagccagggcagccacgcctgggaggtggccctgggcggcctgcagagctggagggtgggcgtggtgcgggtgcggcaggacagcggggctgagggccacagccacagctgctaccatgacaccaggagcggcttctggtacgtgtgcaggacccagggcgtggagggggaccactgtgtgaccagtgaccctgccaccagccccctggtgctggccatcccccggcggctgcgggtggagctggagtgtgaggagggggagctgtccttctatgatgctgagcggcactgccacctgtacaccttccacgccaggtttggagaggtgcggccctacttctacctgggcggggcccggggggccggccccccagagcccctgcgcatctgccccctgcacatctctgtgaaggaggagctggatggatag

SEQ ID NO: 18800 - DNA, 2262 bp, Artificial Sequence
  Description of Artificial Sequence: Synthetic coding sequence
atggccccagacagcgaccccttccctgagggccccctgctgaagctgctgcccctggatgcccgggaccggggcacccagcgctgccgcctgggccctgctgccctgcacgccctgggcgcccggctgggcagcgctgtgaagatcagcctgcctgatggcggcagctgcctgtgcacagcctggcccaggagagatggagcagatggctttgtgcagctggaccccctgtgtgccagccctggagctgctgtgggcgccagccgcagcagaagaagcctgagcctgaaccggctgctgctggtgccctgcccccccctgcggcgggtggccgtgtggcctgtgctgcgggagcgggccggggcccctggggccaggaacacagctgctgtgctggaggccgcccaggagctgctgaggaaccggcccatcagcctgggccacgtggtggtggcccctcctggggcccctggcctggtggccgccctgcacatcgtgggcggcacccccagcccagaccctgctggcctggtgacccccaggaccagggtgtccctgggcggggagccccccagcgaggcccagccccagcctgaggtgcccctgggcggcctgtctgaggccgctgacagcctgcgggagctgctgcggctgcccctgcgctacccccgggccctgacagccctgggcctggccgtgccccggggcgtgctgctggccggccccccaggagtgggcaagacccagctggtgcgggctgtggcccgggaggccggggctgagctgctggccgtgtctgccccagccctgcagggcagcaggcctggagaaacagaggagaatgtgagaagagtcttccagagggcccgggagctggccagccggggccccagcctgctcttcctggatgagatggatgccctgtgcccccagaggggcagccgggcccctgagagccgggtggtggcccaggtgctgaccctgctggatggagccagcggggaccgggaggtggtggtggtgggcgccaccaacagaccagatgccctggaccctgccctgcggcggcccggccgctttgaccgggaggtggtgattggcacccccaccctgaagcagaggaaggagatcctgcaggtgatcaccagcaagatgcccatcagcagccacgtggacctgggcctgctggccgagatgacagtgggctacgtgggcgctgacctgacagccctgtgccgggaggccgccatgcacgccctgctgcacagcgagaagaaccaggacaaccctgtgattgatgaaattgacttcctggaggccttcaagaacatccagcccagcagcttccgctctgtgattggcctgatggacatcaagcctgtggactgggaggagatcggcggcctggaggatgtgaagctgaagctgaagcagagcattgagtggcccctgaagttcccctgggagtttgtgaggatgggcctgacccagcccaagggcgtgctgctgtatggccccccaggctgtgccaagaccaccctggtgcgggccctggccaccagctgccactgcagctttgtgtctgtgtctggagctgacctcttcagcccctttgtgggggacagcgagaaggtgctgagccagatcttccggcaggcccgggccagcaccccagccatcctcttcctggatgaaattgacagcatcctgggcgcccggagcgccagcaagacaggctgtgatgtgcaggagcgggtgctgtctgtgctgctgaatgagctggatggagtgggcctgaagaccatcgagcggcggggcagcaagagcagccagcaggagttccaggaggtgttcaacagatctgtgatgatcatcgccgccaccaacagaccagatgtgctggacacagccctgctgcggcccggccgcctggacaagatcatctacatccccccaccagaccacaagggccgcctgagcatcctgaaggtgtgcaccaagaccatgcccatcggcccagatgtgtccctggagaacctggccgctgagacctgcttcttcagcggggctgacctgaggaacctgtgcacagaagctgccctgctggccctgcaggagaatggcctggatgccaccaccgtgaagcaggagcacttcctgaagagcctgaagacagtgaagcccagcctgagctgcaaggacctggccctgtatgaaaatctcttcaagaaggagggcttcagcaatgtggagggcatctag

SEQ ID NO: 18801 - DNA, 1026 bp, Artificial Sequence
  Description of Artificial Sequence: Synthetic coding sequence
atgcccaagaggaaggtgaccttccagggcgtgggagatgaagaagatgaagatgagatcatcgtgcccaagaagaagctggtggaccctgtggccggcagcggcggccctggcagccgcttcaagggcaagcacagcctggacagtgatgaggaggaggatgatgatgatggcggcagcagcaaatatgacatcctggcctctgaagatgtggagggccaggaggccgccaccctgcccagcgagggcggcgtgcgcatcacccccttcaacctgcaggaggagatggaggagggccactttgatgctgatggcaactacttcctgaacagagatgcccagatccgggacagctggctggacaacatcgactgggtgaagatccgggagcggcccccaggccagaggcaggccagtgacagcgaggaggaggacagcctgggccagacctccatgtctgcccaggccctgctggagggcctgctggagctgctgctgccccgggagaccgtggccggggccctgcggcggctgggcgcccggggcggcggcaaaggaaggaagggccctggccagcccagcagcccccagaggctggaccggctgagcggcctggccgaccagatggtggcccggggcaacctgggcgtgtaccaggagacccgggagcggctggccatgaggctgaagggcctgggctgccagaccctgggcccccacaaccccaccccaccacccagcctggacatgtttgctgaggagctggccgaggaggagctggagacccccacccccacccagagaggagaggccgagagcagaggagatggcctggtggatgtgatgtgggagtacaagtgggagaacacaggagatgctgagctgtatggccccttcaccagcgcccagatgcagacctgggtgtctgagggctacttcccagatggagtgtactgcaggaagctggaccccccaggcggccagttctacaacagcaagagaattgactttgacctgtacacctag

SEQ ID NO: 18802 - DNA, 690 bp, Artificial Sequence
  Description of Artificial Sequence: Synthetic coding sequence
atggccgaggagatggagagcagcctggaggccagcttcagcagcagcggggctgtgtctggggccagcggcttcctgcccccagcccggagccgcatcttcaagatcatcgtgattggagacagcaatgtgggcaagacctgcctgacctaccgcttctgtgccggccgcttcccagacagaacagaggccaccatcggcgtggacttccgggagagagctgtggagattgatggagagcgcatcaagatccagctgtgggacacagctggccaggagcgcttcaggaagtccatggtgcagcactactacagaaatgtgcatgctgtggtgtttgtgtatgacatgaccaacatggccagcttccacagcctgcccagctggattgaggagtgcaagcagcacctgctggccaatgacatcccccgcatcctggtgggcaacaagtgtgacctgcggagcgccatccaggtgcccacagacctggcccagaagtttgctgacacccacagcatgcccctgtttgagaccagcgccaagaaccccaatgacaatgaccacgtggaggccatcttcatgaccctggcccacaagctgaagagccacaagcccctgatgctgagccagcccccagacaatggcatcatcctgaagccagagcccaagccagccatgacctgctggtgctag

SEQ ID NO: 18803 - DNA, 2352 bp, Artificial Sequence
  Description of Artificial Sequence: Synthetic coding sequence
atgctgctgggcttccggcggggcagaagaagccacttcaagcacatcatccacggcctgctgcctgctgcctctgtggcccccaaggctgctgtgcccaggaccccaccacccaggagccccaaccccagccctgagcggcccaggtctgccctggccgccgccatcctggccaccaccctgaccggccgcacagtggccatcccccagccccggcagaggagccgctctgagagtgatgtgtcctctgtggagcaggacagcttcatcgagccctatgccaccaccagccagctgcggccccggcccaactggcagagcgagatgggcagaagaagcagcctgcccagctttgagaccctggactatggagatgaagaagatattgagacccagctgagcagcagcggcaaggagctgggagatgtgtctgccagagaagatcggggcggccacagtgatgacctgtatgctgtgccccacaggaaccaggtgcccctgctgcacgaggtgaacagtgaagatgatgagaacatcagccaccaggacggcttccctggcagccccccagccccccagaggacccagcagaaggatggcaagcaccctgtgctgaacctgaaggatgagaagccacccctgtgtgagaagcccccacccagcccagacatcaccggccgggcccggcagcgctacacagagatcacccgggagaagtttgaggccctgaaggaggagaacatggacctgaacaacatgaaccagagcctgaccctggagctgaacaccatgaagcaggccatgaaggagctgcagctgaagctgaagggcatggagaaggagaagaggaagctgaaggaggccgagaaggccagcagccaggaggtggccgcccctgagctgctgtacctgaggaagcaggcccaggagctggtggatgaaaatgatggcctgaagatgacagtgcaccggctgaatgtggagctgagccgctaccagaccaagttccgccacctgagcaaggaggagagcctgaacatcgagggcctgcccagcaagggccccatccccccctggctgctggacatcaagtacctgagccccctgctgctggcctatgaggacatgatgaaggagaaggatgagctgaatgccaccctgaaggaggagatgaggatgttcaggatgagggtgcaggaggtggtgaaggaaaatgaggagctgcaccaggagctgaacaagagcagcgctgtgaccagcgaggagtggaggcagctgcagacccaggccaagctggtgctggaggagaacaagctgctgctggagcagctggagatccagcagaggaaggccaaggacagccaccaggagcggctgcaggaggtgtccaagctgaccaagcagctgatgctgctggaggccaagacccacggccaggagaaggagctggctgaaaatcgggagcagctggagatcctgcgggccaagtgccaggagctgaagacccacagtgatggcaagattgctgtggaggtgcacaagagcatcgtgaatgagctgaagagccagctgcagaaggaggaggagaaggagagagctgagatggaggagctgatggagaagctgactgtgctgcaggcccagaagaagagcctgctgctggagaagaacagcctgacagagcagaacaaggccctggaggccgagctggagcgggcccagaagatcaacaggaagagccagaagaagattgaggtgctgaagaagcaggtggagaaggccatgggaaatgagatgtctgcccaccagtacctggccaacctggtgggcctggccgagaacatcacccaggagcgggacagcctgatgtgcctggccaagtgcctggagagcgagaaggatggagtgctgaacaaggtgatcaagagcaacatccggctgggcaagctggaggagaaggtgaagggctacaagaagcaggccgccctgaagctgggggacatcagccaccggctgctggagcagcaggaggactttgctgggaagacagcccagtaccggcaggagatgaggcacctgcaccaggtgctgaaggacaagcaggaggtgctggaccaggccctgcagcagaaccgggagatggagggggagctggaggtgatctgggagagcaccttccgggagaacagacgcatccgggagctgctgcaggacaccctgaccaggactggagtgcaggacaacccccgggccctggtggcccccagcctgaatggagtgtcccaggccgacctgctggatggctgtgatgtgtgcagctatgacctgaagagccacgcccccacctgctag

SEQ ID NO: 18804 - DNA, 639 bp, Artificial Sequence
  Description of Artificial Sequence: Synthetic coding sequence
atggccgcccggcggggggccctgattgtgctggagggcgtggacagagctgggaagagcacccagagcaggaagctggtggaggccctgtgtgccgccggccacagagctgagctgctgcgcttccctgagaggagcacagaaattggcaagctgctgagcagctacctgcagaagaagagtgatgtggaggaccacagcgtgcacctgctcttcagcgccaaccgctgggagcaggtgcccctcatcaaggagaagctgagccagggcgtgaccctggtggtggacagatatgccttctctggagtggccttcaccggggccaaggagaacttcagcctggactggtgcaagcagccagatgtgggcctgcccaagccagacctggtgctcttcctgcagctgcagctggctgatgctgccaagagaggagccttcggccacgagagatatgaaaatggagccttccaggagcgggccctgcgctgcttccaccagctgatgaaggacaccaccctgaactggaagatggtggatgccagcaagagcattgaggccgtgcatgaggacatccgggtgctgtctgaagatgccatcagaacagccacagagaagcccctgggggagctgtggaagtag

SEQ ID NO: 18805 - DNA, 504 bp, Artificial Sequence
  Description of Artificial Sequence: Synthetic coding sequence
atggaggagacctacacagacagcctggaccctgagaagctgctgcagtgcccctatgacaagaaccaccagatccgggcctgccgcttcccctaccacctgatcaagtgcaggaagaaccacccagatgtggccagcaagctggccacctgccccttcaatgcccggcaccaggtgcccagggctgagatcagccaccacatcagcagctgtgatgacaggagctgcatcgagcaggatgtggtgaaccagaccaggagcctgcggcaggagaccctggccgagagcacctggcagtgccccccctgtgatgaggactgggacaaggacctgtgggagcagaccagcaccccatttgtgtggggcaccacccactacagcgacaacaacagccctgccagcaacatcgtgacagagcacaagaacaacctggccagcggcatgagggtgcccaagagcctgccctacgtgctgccctggaagaacaatggaaatgcccagtag

SEQ ID NO: 18806 - DNA, 381 bp, Artificial Sequence
  Description of Artificial Sequence: Synthetic coding sequence
atggctgctggccctgagcccccagagtgggagccccgctggaggaaggccctgcggggcaaggagaacaagggctctgtggagatcatgaggaaggacctgaatgatgcccgggacctgcacggccaggccgagagcgctgctgctgtgtggaagggccacgtgatggacaggaggaagaaggccctgacagactacaagaagctgcgggccttctttgtggaggaggaggagcacttcctgcaggaggccgagaaggaggagggcctgcctgaagatgagctggccgaccccacagagcgcttccgcagcctgctgcaggccgtgtctgagctggagaagaagcacaggaacctgggcctgtccatgctgctgcagtag

SEQ ID NO: 18807 - DNA, 1668 bp, Artificial Sequence
  Description of Artificial Sequence: Synthetic coding sequence
atgcagagctgtgagagcagcggggacagcgcagatgaccccctgagccggggcctgcggcggcggggccagccccgggtggtggtgattggagctggcctggccggcctggccgccgccaaggccctgctggagcagggcttcacagatgtgacagtgctggaggccagcagccacatcggcggccgggtgcagagcgtgaagctgggccacgccacctttgagctgggcgccacctggatccacggcagccacggcaaccccatctaccacctggccgaggccaacggcctgctggaggagaccacagatggagagaggtctgtgggccgcatcagcctgtacagcaagaatggagtggcctgctacctgaccaaccacggccgccgcatccccaaggatgtggtggaggagttcagtgacctgtacaatgaggtgtacaacctgacccaggagttcttcagacatgacaagcctgtgaatgctgagagccagaacagcgtgggcgtcttcacccgggaggaggtgaggaaccgcatcagaaatgaccctgatgatcctgaggccaccaagaggctgaagctggccatgatccagcagtacctgaaggtggagagctgtgagagcagcagccacagcatggatgaggtgtccctgagcgccttcggggagtggacagagatccctggggcccaccacatcatccccagcggcttcatgagggtggtggagctgctggccgagggcatcccagcccacgtgatccagctgggcaagcctgtgcgctgcatccactgggaccaggccagcgcccggccccggggccctgagattgagcccagaggagagggggaccacaaccacgacaccggggagggcggccagggcggggaggagccccggggcggccgctgggatgaagatgagcagtggagcgtggtggtggagtgtgaggactgtgagctgatcccagctgaccacgtgattgtgacagtgtccctgggcgtgctgaagaggcagtacaccagcttcttccggcccggcctgcccacagagaaggtggccgccatccaccggctgggcatcggcaccacagacaagatcttcctggagtttgaggagcccttctggggccctgagtgcaacagcctgcagtttgtgtgggaggatgaggccgagagccacaccctgacctacccacctgagctgtggtacaggaagatctgtggctttgatgtgctgtacccacctgagagatatggccacgtgctgagcggctggatctgtggggaggaggccctggtgatggagaagtgtgatgatgaagctgtggccgagatctgcacagagatgctgcggcagttcaccggcaaccccaacatccccaagccccggcgcatcctgcggagcgcctggggcagcaacccctacttccggggcagctacagctacacccaggtgggcagcagcggggctgatgtggagaagctggccaagcccctgccctacacagagagcagcaagacagcccccatgcaggtgctcttctctggagaggccacccacaggaagtactacagcaccacccacggggccctgctgagcggccagcgggaggccgcccggctcatcgagatgtacagagacctcttccagcagggcacctag

SEQ ID NO: 18808 - DNA, 3153 bp, Artificial Sequence
  Description of Artificial Sequence: Synthetic coding sequence
atggccctgtatgatgaggacctgctgaagaaccccttctacctggccctgcagaagtgcaggccagacctgtgcagcaaggtggcccagatccacggcatcgtgctggtgccctgcaagggcagcctgagcagcagcatccagagcacctgccagtttgagagctacatcctgatccctgtggaggagcacttccagaccctgaatggcaaggatgtgttcatccagggcaaccgcatcaagctgggcgccggctttgcctgcctgctgtctgtgcccatcctgtttgaggagaccttctacaatgagaaggaggagagcttcagcatcctgtgcatcgcccaccccctggagaagcgggagagcagcgaggagcccctggcccccagcgaccccttcagcctgaagaccattgaagatgtgcgggagttcctgggccgccacagcgagagatttgacaggaacatcgccagcttccacaggaccttcagagaatgtgagaggaagagcctgcggcaccacattgattctgccaatgccctgtacaccaagtgcctgcagcagctgctgcgggacagccacctgaagatgctggccaagcaggaggcccagatgaacctgatgaagcaggccgtggagatctacgtgcaccacgagatctacaacctgatcttcaagtatgtgggcaccatggaggcctctgaagatgctgccttcaacaagatcaccaggagcctgcaggacctgcagcagaaggacatcggcgtgaagccagagttctccttcaacatcccccgggccaagcgggagctggcccagctgaacaagtgcaccagcccccagcagaagctggtgtgcctgaggaaggtggtgcagctgatcacccagagccccagccagagggtgaacctggagaccatgtgtgctgatgacctgctgtctgtgctgctgtacctgctggtgaagacagagatccccaactggatggccaacctgagctacatcaagaacttccgcttcagcagcctggccaaggatgagctgggctactgcctgaccagctttgaagctgccatcgagtacatccggcagggcagcctgagcgccaagcccccagagagcgagggctttggagacaggctcttcctgaagcagaggatgagcctgctgagccagatgaccagcagccccacagactgcctcttcaagcacatcgccagcggcaaccagaaggaggtggagcggctgctgagccaggaggaccatgacaaggacacagtgcagaagatgtgccaccccctgtgcttctgtgatgactgtgagaagctggtgtctggccgcctgaatgaccccagcgtggtgacccccttcagcagagatgaccggggccacacccccctgcacgtggccgctgtgtgtggccaggccagcctgattgacctgctggtgtccaaaggagccatggtgaatgccacagactaccatggagccacccccctgcacctggcctgccagaagggctaccagagcgtgaccctgctgctgctgcactacaaggccagcgctgaggtgcaggacaacaacggcaacacccccctgcacctggcctgcacctacggccacgaggactgtgtgaaggccctggtgtactatgatgtggagagctgccgcctggacattggaaatgagaagggggacacccccctgcacatcgccgcccgctggggctaccagggcgtgattgagaccctgctgcagaatggagccagcacagagatccagaaccggctgaaggagacccccctgaagtgtgccctgaacagcaagatcctgtctgtgatggaggcctaccacctgagctttgaaagacggcagaagagcagcgaggcccctgtgcagagcccccagaggtctgtggacagcatcagccaggagagcagcaccagcagcttcagctccatgtctgccagcagccggcaggaggagaccaagaaggactaccgggaggtggagaagctgctgcgggctgtggctgatggagacctggagatggtgcgctacctgctggagtggacagaggaggacctggaggatgctgaggacacagtgtctgctgctgaccctgagttctgccaccccctgtgccagtgccccaagtgtgccccagcccagaagaggctggccaaggtgcctgccagcggcctgggcgtgaatgtgaccagccaggacggcagcagccccctgcacgtggccgccctgcacggccgggctgacctgatccccctgctgctgaagcacggggccaatgctggggccagaaatgctgaccaggccgtgcccctgcacctggcctgccagcagggccacttccaggtggtgaagtgcctgctggacagcaatgccaagcccaacaagaaggacctgagcggcaacacccccctcatctatgcctgcagcggcggccaccacgagctggtggccctgctgctgcagcacggggccagcatcaatgccagcaacaacaagggcaacacagccctgcacgaggccgtcatcgagaagcacgtgtttgtggtggagctgctgctgctgcatggagcctctgtgcaggtgctgaacaagaggcagaggacagctgtggactgtgccgagcagaacagcaagatcatggagctgctgcaggtggtgcccagctgtgtggccagcctggatgatgtggccgagacagacaggaaggagtatgtgacagtgaagatcaggaagaagtggaacagcaagctgtatgacctgcctgatgagcccttcacccggcagttctactttgtgcacagcgctggccagttcaagggcaagaccagccgggagatcatggcccgggacagatctgtgcccaacctgacagagggcagcctgcacgagcccggccggcagagcgtgaccctgcggcagaacaacctgcctgcccagagcggcagccacgccgctgagaagggcaacagcgactggccagagcggcccggcctgacccagacaggccctggccacaggaggatgctgcggcggcacacagtggaggatgctgtggtgtcccagggccctgaggccgccggccccctgagcaccccccaggaggtgtctgccagccgctcctag

SEQ ID NO: 18809 - DNA, 1662 bp, Artificial Sequence
  Description of Artificial Sequence: Synthetic coding sequence
atggatgtggacaaggagctgggcatggagagcgtgaaggccggggccagcggcaagccagagatgaggctgggcacccaggaggagaccagtgaaggagatgccaatgaaagcagcctgctggtgctgagcagcaatgtgcccctgctggccctggagttcctggagatcgcccaggccaaggagaaggccttcctgcccatggtgagccacaccttccacatgaggacagaggagagtgatgccagccaggagggagatgacctgcccaagagcagcgccaacaccagccaccccaagcaggatgacagccccaagagcagcgaggagaccatccagcccaaggagggggacatccccaaggcccctgaggagaccatccagagcaagaaggaggacctgcccaagagcagcgagaaggccatccagcccaaggagagcaacatccccaagagcagcgccaagcccatccagcccaagctgggcaacatccccaaggcctctgtgaagcccagccagcccaaggagggggacatccccaaggcccctgaggagaccatccagagcaagaaggaggacctgcccaagagcagcgaggaggccatccagcccaaggagggggacatccccaagagcagcgccaagcccatccagcccaagctgggcaacatcgccaagacctctgtgaagcccagccagcccaaggagagtgacatccccaagagccctgaggagaccatccagcccaaggagggggacatccccaagagcagcgccaagcccatccagcccaagctgggcaacatccccaaggcctctgtgaagcccagccagcccaaggagggggacatcagcaagagccctgaggaggccatccagcccaaggagggggacctgcccaagagcctggaggaggccatccagcccaaggagggggacatccccaagagccctgaggaggccatccagcccaaggagggggacatccccaagagcctggaggaggccatccagcccaaggagggggacatccccaagagccctgaggagaccatccagcccaagaagggggacatccccaagagccctgaggaggccatccagcccaaggagggggacatccccaagagccccaagcaggccatccagcccaaggagggggacatccccaagagcctggaggaggccatcccccccaaggagattgacatccccaagagccctgaggagaccatccagcccaaggaggatgacagccccaagagcctggaggaggccacccccagcaaggagggggacatcctgaagccagaggaggagaccatggagttccctgagggggacaaggtgaaggtgatcctgagcaaagaagattttgaggccagcctgaaggaggccggggagcggctggtggccgtggacttcagcgccacctggtgtggcccctgcaggaccatccggcccttcttccacgccctgtctgtgaagcatgaagatgtggtgttcctggaggtggatgctgacaactgtgaggaggtggtgcgggagtgtgccatcatgtgtgtgcccaccttccagttctacaagaaggaggagaaggtggatgagctgtgtggggccctgaaggagaagctggaggccgtgattgctgagctgaagtag

SEQ ID NO: 18810 - DNA, 2268 bp, Artificial Sequence
  Description of Artificial Sequence: Synthetic coding sequence
atggtgagccacggcagcagccccagcctgctggaggccctgagcagtgacttcctggcctgcaagatctgcctggagcagctgcgggcccccaagaccctgccctgcctgcacacctactgccaggactgcctggcccagctggctgatggcggccgggtgcgctgcccagagtgccgggagaccgtgcctgtgcccccagagggcgtggccagcttcaagaccaacttctttgtgaatggcctgctggacctggtgaaggcccgggcctgtggggacctgcgggccggcaagccagcctgtgccctgtgccccctggtgggcggcaccagcactggaggccctgccacagcccgctgcctggactgtgctgatgacctgtgccaggcctgtgctgatggccaccgctgcacccggcagacccacacccaccgggtggtggacctggtgggctaccgggccggctggtatgatgaggaggcccgggagcggcaggccgcccagtgcccccagcaccctggagaggccctgcgcttcctgtgccagccctgcagccagctgctgtgcagagaatgtcggctggacccccacctggaccacccctgcctgcccctggccgaggccgtgcgggcccggcggcccggcctggagggcctgctggccggcgtggacaacaacctggtggagctggaggccgcccggcgggtggagaaggaggccctggcccggctgcgggagcaggccgcccgggtgggcacccaggtggaggaggccgctgagggcgtgctgcgggccctgctggcccagaagcaggaggtgctgggccagctgcgggcccacgtggaggccgctgaggaggccgcccgggagcggctggccgagctggagggccgggagcaggtggcccgggctgctgctgcctttgcccggcgggtgctgagcctgggccgggaggccgagatcctgagcctggagggcgccatcgcccagaggctgcggcagctgcagggctgcccctgggcccctggccctgccccctgcctgctgccccagctggagctgcaccctggcctgctggacaagaactgccacctgctgcggctgagctttgaggagcagcagccccagaaggatggcggcaaggatggagctggcacccagggcggggaggagagccagagcagaagagaagatgagcccaagacagagcggcagggcggcgtgcagccccaggccggagatggagcccagacccccaaggaggagaaggcccagaccacccgggaggagggcgcccagaccctggaggaggaccgggcccagacccctcatgaagatggcggcccccagccccaccggggcggccggcccaacaagaagaagaagttcaagggccgcctgaagagcatcagccgggagcccagccctgccctgggccccaacctggatggcagcggcctgctgccccggcccatcttctactgcagcttccccaccaggatgcctggggacaagaggagcccccgcatcaccggcctgtgccccttcggcccccgggagatcctggtggctgatgagcagaacagagccctgaagcgcttcagcctgaatggagactacaagggcaccgtgcctgtgcctgagggctgcagcccctgcagcgtggccgccctgcagagcgctgtggccttcagcgccagcgcccggctgtacctgatcaaccccaacggggaggtgcagtggaggcgggccctgagcctgagccaggccagccatgctgtggccgccctgcccagcggggacagagtggccgtgtctgtggccggccacgtggaggtgtacaacatggagggcagcctggccacccgcttcatccctgggggcaaggccagccggggcctgcgggccctggtgttcctgaccaccagcccccagggccactttgtgggcagtgactggcagcagaacagcgtggtgatctgtgatggcctgggccaggtggtgggggagtacaagggccctggcctgcacggctgccagcccggctctgtgtctgtggacaagaagggctacatcttcctgaccctgcgggaggtgaacaaggtggtgatcctggaccccaagggcagcctgctgggggacttcctgacagcctaccacggcctggagaagccccgggtgaccaccatggtggatggccgctacctggtggtgtccctgagcaatggcaccatccacatcttccgggtgcgcagcccagacagctag

SEQ ID NO: 18811 - DNA, 1467 bp, Artificial Sequence
  Description of Artificial Sequence: Synthetic coding sequence
atggctgctggcagcgaggccaccacccctgtgattgtggccgccggggccggcggggaggagggggagcacgtgaagcccttcaagccagagaaggccaaggagatcatcatgagcctgcagcagcctgccatcttctgcaacatggtgtttgactggccagcccggcactggaatgccaagtacctgagccaggtgctgcacggcaagcagatccgcttcaggatgggcatgaagtccatgagcacagtgccccagtttgagaccacctgcaactacgtggaggccaccctggaggagttcctgacctggaactgtgaccagagcagcatcagcggccccttccgggactatgaccacagcaagttctgggcctatgctgactacaagtactttgtgtccctgtttgaggacaagacagacctcttccaggatgtgaagtggagcgactttggcttccctggaagaaatggccaggagagcaccctgtggattggcagcctgggcgcccacaccccctgccacctggacagctatggctgcaacctggtgttccaggtgcagggcaggaagcgctggcacctgtttcctcctgaggacacccccttcctgtaccccacccgcatcccctatgaggagagctctgtgttcagcaagatcaacgtggtgaacccagacctgaagcgcttcccccagttcaggaaggcccagagacatgctgtgaccctgagccctggccaggtgctgtttgtgcccaggcactggtggcactacgtggagagcattgatcctgtgacagtgtccatcaacagctggattgagctggaggaggaccacctggcccgggtggaggaggccatcaccaggatgctggtgtgtgccctgaagacagctgagaacccccagaacacccgggcctggctgaaccccacagaggtggaggagaccagccatgctgtgaactgctgctacctgaatgctgctgtgtctgccttctttgaccgctgcaggaccagcgaggtggtggagatccaggccctgaggacagatggagagcacatgaagaaggaggagctgaatgtgtgcaaccacatggaggtgggccagacaggcagccagaacctgaccactggaacagacaagccagaggccgccagccccttcggccctgacctggtgcctgtggcccagaggtctgaggagccccccagcgagcggggcggcatcttcggcagtgatggcaaggactttgtggacaaggatggagagcactttgggaagctgcactgtgccaagaggcagcagatcatgagcaacagtgaaaatgccatcgaggagcagatcgccagcaacaccaccaccaccccccagaccttcatcagcacagatgacctgctggactgcctggtgaacccccaggtgaccagaattgtggcccagctgctgatccagggccgcagcctgtag

SEQ ID NO: 18812 - DNA, 579 bp, Artificial Sequence
  Description of Artificial Sequence: Synthetic coding sequence
atggcccccaagccaggagctgagtggagcacagccctgagccacctggtgctgggcgtggtgtccctgcatgctgctgtgtccacagctgaggccagcagaggagctgctgctggcttcctgctgcaggtgctggccgccaccaccaccctggcccctggcctgagcacccatgaggactgcctggccggggcctgggtggccaccgtgattggcctgcccctgctggcctttgacttccactgggtgaatggagacaggagcagcgccaacctgctgctgggcggcggcatggtgctggccgtggccggcggccacctgggccctgagggccgctctgtggccggccaggccatgctgctggtggtggccgtgaccatcctgattgtggccgtgttcaccgccaacacctacggcatgtggggcggggccatgctgggcgtggccggcctgctgagccggctggaggaggaccggctgctgctgctgcccaaggaggatgtgtgccgctgggccctggccgtgggctcctgggcctactgccgggccctgcacacccagaggctgcagtgggagtag

SEQ ID NO: 18813 - DNA, 462 bp, Artificial Sequence
  Description of Artificial Sequence: Synthetic coding sequence
atgaccagcgagagcaccagcccccctgtggtgccccccctgcacagccccaagagccctgtgtggcccaccttccccttccaccgggagggcagccgggtgtgggagcggggcggcgtgcccccccgggacctgcccagccccctgcccaccaagaggaccaggacctacagcgccacagcccgggccagcgctggccctgtgttcaagggcgtgtgcaagcagttcagccgcagccagggccacggcttcatcaccccagaaaatggaagtgaggacatctttgtgcacgtgtctgacattgaaggagaatatgtgcctgtggagggagatgaggtgacctacaagatgtgccccatcccccccaagaaccagaagttccaggccgtggaggtggtgctgacccagctggccccccacacccctcatgagacctggagcggccaggtggtgggcagctag

SEQ ID NO: 18814 - DNA, 537 bp, Artificial Sequence
  Description of Artificial Sequence: Synthetic coding sequence
atgagcagcttcagccgggccccccagcagtgggccacctttgcccgcatctggtacctgctggatggcaagatgcagcccccaggcaagctggccgccatggccagcatccggctgcagggcctgcacaagcctgtgtaccacgccctgagtgactgtggggaccacgtggtgatcatgaacaccaggcacatcgccttcagcggcaacaagtgggagcagaaggtgtacagcagccacacaggctacccaggcggcttccggcaggtgacagctgcccagctgcacctgcgggaccctgtggccatcgtgaagctggccatctacggcatgctgcccaagaacctgcacaggaggaccatgatggagcggctgcacctgttcccagatgagtacatccctgaggacatcctgaagaacctggtggaggagctgccccagcccaggaagatccccaagaggctggatgagtacacccaggaggagattgatgccttcccccggctgtggaccccacctgaggactaccgcctgtag

SEQ ID NO: 18815 - DNA, 8763 bp, Artificial Sequence
  Description of Artificial Sequence: Synthetic coding sequence
atgaggggccggcggggccggccccccaagcagcctgctgccccagctgctgagcgctgtgccccagcccctcctcctcctcctcctccacccaccagcggccccatcggcggcctgcggagccgccaccggggcagcagccggggccgctgggccgccgcccaggccgaggtggcccccaagacccggctgagcagcccccggggcggcagcagcagcaggaggaagcccccacctcctcctccagccccacccagcaccagcgcccctggccggggcggccggggcggcggcggcggccgcactggaggcggcggcggcggcggccacctggcccggaccacagctgcccggcgggctgtgaacaaggtggtgtatgatgaccatgaaagtgaggaggaggaggaggaggaggacatggtgtctgaggaggaggaggaggaggatggagatgctgaggagacccaggacagtgaagatgatgaagaagatgagatggaggaggatgatgatgacagcgactacccagaggagatggaggatgatgatgatgatgccagctactgcacagagagcagcttccgcagccacagcacctacagcagcaccccaggccgcaggaagccccgggtgcaccggcccaggagccccatcctggaggagaaggacatcccccccctggagttccccaagagcagcgaggacctgatggtgcccaatgagcacatcatgaatgtgattgccatctatgaggtgctgaggaactttggcaccgtgctgcggctgagccccttccgctttgaggacttctgtgccgccctggtgtcccaggagcagtgcaccctgatggccgagatgcacgtggtgctgctgaaggctgtgctgcgggaggaggacaccagcaacaccacctttggacctgctgacctgaaggacagcgtgaacagcaccctgtacttcattgatggcatgacctggccagaggtgctgcgggtgtactgtgagagtgacaaggagtaccaccacgtgctgccctaccaggaggccgaggactacccctacggccctgtggagaacaagatcaaggtgctgcagttcctggtggaccagttcctgaccaccaacatcgcccgggaggagctgatgtctgaaggagtcatccagtatgatgaccactgccgggtgtgccacaagctgggggacctgctgtgctgtgagacctgcagcgctgtgtaccacctggagtgtgtgaagccacccctggaggaggtgcctgaagatgagtggcagtgtgaggtgtgtgtggcccacaaggtgcctggggtgacagactgtgtggccgagatccagaagaacaagccctacatcagacatgagcccatcggctatgacaggagcaggaggaagtactggttcctgaacagaagactcatcatcgaggaggacacagaaaatgaaaatgagaagaagatctggtactacagcaccaaggtgcagctggccgagctgattgactgcctggacaaggactactgggaggccgagctgtgcaagatcctggaggagatgagggaggagatccaccgccacatggacatcacagaggacctgaccaacaaggcccggggcagcaacaagagcttcctggccgccgccaatgaggagatcctggagagcatccgggccaagaagggggacatcgacaacgtgaagagccctgaggagacagagaaggacaagaatgaaacagaaaatgacagcaaggatgctgagaagaaccgggaggagtttgaggaccagagcctggagaaggacagtgatgacaagaccccagatgatgatcctgagcagggcaagtctgaggtgggggacttcaagtctgagaagagcaatggagagctgtctgagagccctggggccggcaagggggccagcggcagcacccgcatcatcacccggctgagaaatccagacagcaagctgagccagctgaagagccagcaggtggccgccgccgcccacgaggccaacaagctgttcaaggagggcaaggaggtgctggtggtgaacagccagggcgagatcagccggctgagcaccaagaaggaggtgatcatgaagggcaacatcaacaactacttcaagctgggccaggagggcaagtacagagtgtaccacaaccagtacagcaccaacagctttgccctgaacaagcaccagcacagagaagatcatgacaagaggaggcacctggcccacaagttctgcctgaccccagctggggagttcaagtggaatggatctgtgcacggcagcaaggtgctgaccatcagcaccctgcggctgaccatcacccagctggagaacaacatccccagcagcttcctgcaccccaactgggccagccaccgggccaactggatcaaggctgtgcagatgtgcagcaagccccgggagtttgccctggccctggccatcctggagtgtgctgtgaagcctgtggtgatgctgcccatctggagggagagcctgggccacacccggctgcacaggatgaccagcattgagcgggaggagaaggagaaggtgaagaagaaggagaagaagcaggaggaggaggagaccatgcagcaggccacctgggtgaagtacaccttccctgtgaagcaccaggtgtggaagcagaagggggaggagtacagagtgacaggctatggaggctggagctggatcagcaagacccacgtgtacagatttgtgcccaagctgcccggcaacaccaacgtgaactacaggaagagcctggagggcaccaagaacaacatggatgagaacatggatgaaagtgacaagaggaagtgcagccgcagccccaagaagatcaagattgaaccagattctgagaaggatgaggtgaagggcagtgatgctgccaagggagctgaccagaatgagatggacatcagcaagatcacagagaagaaggaccaggatgtgaaggagctgctggacagcgacagcgacaagccctgcaaggaggagcccatggaggtggatgatgacatgaagacagagagccacgtgaactgccaggagagcagccaggtggatgtggtgaatgtgtctgagggcttccacctgcggaccagctacaagaagaagaccaagagcagcaagctggatggcctgctggagcggcgcatcaagcagttcaccctggaggagaagcagaggctggagaagatcaagctggagggcggcatcaagggcatcggcaagaccagcaccaacagcagcaagaacctgtctgagagccctgtgatcaccaaggccaaggagggctgccagagcgacagcatgaggcaggagcagagccccaatgccaacaatgaccagcctgaggacctgatccagggctgcagcgagagtgacagctctgtgctgaggatgtctgaccccagccacaccaccaacaagctgtaccccaaggacagagtgctggatgatgtgtccatccgcagccctgagaccaagtgccccaagcagaacagcattgaaaatgacatcgaggagaaggtgtctgacctggccagccggggccaggagcccagcaagagcaagaccaagggaaatgacttcttcattgatgacagcaagctggccagcgcagatgacatcggcaccctcatctgcaagaacaagaagcccctcatccaggaggagagtgacaccatcgtgagcagcagcaagagcgccctgcacagctctgtgcccaagagcaccaatgacagagatgccacccccctgagccgggccatggactttgagggcaagctgggctgtgacagcgagagcaacagcaccctggagaacagcagtgacacagtgtccatccaggacagcagcgaggaggacatgattgtgcagaacagcaatgaaagcatcagcgagcagttccgcacccgggagcaggatgtggaggtgctggagcccctgaagtgtgagctggtgtctggagagagcacaggcaactgtgaggaccggctgcctgtgaagggcacagaggccaacgggaagaagcccagccagcagaagaagctggaggagaggcctgtgaacaagtgcagcgaccagatcaagctgaagaacaccacagacaagaagaacaatgaaaatcgggagagcgagaagaagggccagaggaccagcaccttccagatcaacgggaaggacaacaagcccaagatctacctgaagggagaatgtctgaaggagatcagcgagagccgggtggtgtctggaaatgtggagcccaaggtgaacaacatcaacaagatcatcccagaaaatgacatcaagagcctgactgtgaaggagagcgccatccggcccttcatcaatggagatgtgatcatggaggacttcaatgaaagaaacagcagcgagaccaagagccacctgctgagcagcagtgatgctgagggcaactacagagacagcctggagaccctgcccagcaccaaggagagtgacagcacccagaccaccaccccatctgccagctgcccagagagcaacagcgtgaaccaggtggaggacatggagattgagaccagcgaggtgaagaaggtgaccagcagccccatcaccagcgaggaggagagcaacctgagcaatgacttcattgatgaaaatggcctgcccatcaacaagaatgaaaatgtgaatggagagagcaagaggaagacagtcatcacagaggtgaccaccatgaccagcacagtggccacagagagcaagacagtcatcaaggtggagaagggggacaagcagacagtggtgagcagcacagagaactgtgccaagagcacagtgaccaccaccaccaccaccgtgaccaagctgagcacccccagcactggaggctctgtggacatcatctctgtgaaggagcagagcaagacagtggtgaccaccaccgtgacagacagcctgaccaccaccggcggcaccctggtgacctccatgacagtgtccaaggagtacagcacccgggacaaggtgaagctgatgaagttcagccggcccaagaagaccaggtctggaacagccctgcccagctacaggaagtttgtgaccaagagcagcaagaagagcatctttgtgctgcccaatgatgacctgaagaagctggccaggaagggcggcatccgggaggtgccctacttcaactacaatgccaagccagccctggacatctggccctaccccagcccccggcccaccttcggcatcacctggagataccgcctgcagacagtgaagagcctggccggcgtgtccctgatgctgcggctgctgtgggccagcctgcgctgggatgacatggccgccaaggcccctcctgggggcggcaccaccaggacagagaccagcgagacagagatcaccaccacagagatcatcaagagaagagatgtgggcccctacggcatccgctctgagtactgcatcaggaagatcatctgccccatcggcgtgcctgagacccccaaggagacccccaccccccagaggaagggcctgcggagcagcgccctgcggcccaagaggcctgagacccccaagcagacaggccctgtgatcatcgagacctgggtggccgaggaggagctggagctgtgggagatccgggcctttgctgagcgggtggagaaggagaaggcccaggccgtggagcagcaggccaagaagaggctggagcagcagaagcccaccgtcatcgccaccagcaccaccagccccaccagcagcaccaccagcaccatcagccctgcccagaaggtgatggtggcccccatcagcggctctgtgaccaccggcaccaagatggtgctgaccaccaaggtgggcagccctgccaccgtgaccttccagcagaacaagaacttccaccagacctttgccacctgggtgaagcagggccagagcaacagcggcgtggtgcaggtgcagcagaaggtgctgggcatcatccccagcagcacaggcaccagccagcagaccttcaccagcttccagcccaggacagccaccgtgaccatccggcccaacaccagcggcagcggcggcaccaccagcaacagccaggtgatcaccggcccccagatccggcccggcatgaccgtcatccgcacccccctgcagcagagcaccctgggcaaggccatcatccgcacccctgtgatggtgcagcccggggccccccagcaggtgatgacccagatcatccggggccagcctgtgtccacagctgtgtctgcccccaacacagtgagcagcaccccaggccagaagagcctgaccagcgccaccagcaccagcaacatccagagcagcgccagccagcccccccggccccagcagggccaggtgaagctgaccatggcccagctgacccagctgacccagggccatggaggcaaccagggcctgactgtggtgatccagggccagggccagaccaccggccagctgcagctgatcccccagggcgtgacagtgctgcccggccctggccagcagctgatgcaggccgccatgcccaatggaacagtgcagcgcttcctgttcacccccctggccaccacagccaccacagccagcaccaccaccaccaccgtgtccaccacagctgctggcactggagagcagaggcagagcaagctgagcccccagatgcaggtgcaccaggacaagaccctgcccccagcccagagcagctctgtgggccctgctgaggcccagccccagacagcccagcccagcgcccagccccagccccagacccagccccagagccctgcccagcctgaggtgcagacccagcctgaggtgcagacccagaccaccgtgagcagccacgtgcccagcgaggcccagcccacccacgcccagagcagcaagccccaggtggccgcccagagccagccccagagcaatgtgcagggccagagccctgtgcgggtgcagagccccagccagacccgcatccggcccagcacccccagccagctgagccctggccagcagagccaggtgcagaccaccaccagccagcccatccccatccagccccacaccagcctgcagatccccagccagggccagccccagagccagccccaggtgcagagcagcacccagaccctgagcagcggccagaccctgaaccaggtgacagtgagcagccccagccggccccagctgcagatccagcagccccagccccaggtgattgctgtgccccagctgcagcagcaggtgcaggtgctgagccagatccagagccaggtggtggcccagatccaggcccagcagagcggcgtgccccagcagatcaagctgcagctgcccatccagatccagcagagcagcgctgtgcagacccaccagatccagaatgtggtgacagtgcaggccgcctctgtgcaggagcagctgcagagggtgcagcagctgcgggaccagcagcagaagaagaagcagcagcagatcgagatcaagcgggagcacaccctgcaggccagcaaccagagcgagatcatccagaagcaggtggtgatgaagcacaatgctgtgattgagcacctgaagcagaagaagtccatgaccccagctgagcgggaggagaaccagaggatgattgtgtgcaaccaggtgatgaagtacatcctggacaagattgacaaggaggagaagcaggccgccaagaagaggaagcgggaggagagcgtggagcagaagaggagcaagcagaatgccaccaagctgagcgccctgctcttcaagcacaaggagcagctgcgggcagagatcctgaagaagagggccctgctggacaaggacctgcagatcgaggtgcaggaggagctgaagagggacctgaagatcaagaaggagaaggacctgatgcagctggcccaggccacagctgtggccgccccctgcccccctgtgaccccagcccccccagcccccccagcccccccacccagccccccacctcctcctgctgtgcagcacacaggcctgctgagcacccccaccctgcctgctgccagccagaagaggaagcgggaggaggagaaggacagcagcagcaagagcaagaagaagaagatgatcagcaccaccagcaaggagaccaagaaggacaccaagctgtactgcatctgcaagaccccctatgatgagagcaagttctacatcggctgtgaccgctgccagaactggtaccacggccgctgtgtgggcatcctgcagagcgaggccgagctgattgatgaatatgtgtgcccccagtgccagagcacagaagatgccatgacagtgctgacccccctgacagagaaggactatgagggcctgaagagggtgctgcggagcctgcaggcccacaagatggcctggcccttcctggagcctgtggaccccaatgatgccccagactactatggagtcatcaaggagcccatggacctggccaccatggaggagcgggtgcagaggcgctactatgagaagctgacagaatttgtggccgacatgaccaagatctttgacaactgccgctactacaaccccagcgacagccccttctaccagtgtgccgaggtgctggagagcttctttgtgcagaagctgaagggcttcaaggccagccgcagccacaacaacaagctgcagagcacagccagctag

SEQ ID NO: 18816 - DNA, 390 bp, Artificial Sequence
  Description of Artificial Sequence: Synthetic coding sequence
atggctgacccccgggtgcggcagatcaagatcaagacaggagtggtgaagaggctggtgaaggagaaggtgatgtatgagaaggaggccaagcagcaggaggagaagattgagaagatgagagcagaagatggagagaactatgacatcaagaagcaggccgagatcctgcaggagagcaggatgatgatcccagactgccagaggcggctggaggccgcctacctggacctgcagaggatcctggtgtccaaggacttctgtgtgatgttcaagttcttcttcagcatccagtacatggagagccagaagttcaagtacctgaccctgcggacctcctggcagtacttcctgttcacctgccccctgtaccgctacatcctgaagtag

SEQ ID NO: 18817 - DNA, 582 bp, Artificial Sequence
  Description of Artificial Sequence: Synthetic coding sequence
atgtctgatgatgacagccgggccagcaccagcagcagcagcagcagcagcagcaaccagcagacagagaaggagaccaacacccccaagaagaaggagagcaaggtgtccatgagcaagaacagcaagctgctgagcaccagcgccaagaggatccagaaggagctggccgacatcaccctggaccccccacccaactgcagcgctggccccaagggggacaacatctatgagtggaggagcaccatcctgggccccccaggctctgtgtatgaaggaggagtcttcttcctggacatcaccttcaccccagagtaccccttcaagccacccaaggtgaccttccgcacccgcatctaccactgcaacatcaacagccagggcgtcatctgcctggacatcctgaaggacaactggagccctgccctgaccatcagcaaggtgctgctgagcatctgcagcctgctgacagactgcaacccagctgaccccctggtgggcagcatcgccacccagtacatgaccaacagagctgagcatgacaggatggcccggcagtggaccaagagatatgccacctag

SEQ ID NO: 18818 - DNA, 1395 bp, Artificial Sequence
  Description of Artificial Sequence: Synthetic coding sequence
atgagcctgcagttcagcaatggcagcagacatgtgtgcctgcggagcggggccggctctgtgcggcccctgaatggaggagctggctttgctggcagcagcgcctgtggcggctctgtggccggcagcgagttcagctgtgccctgggcggcggcctgggctctgtgcctgggggcagccacgccggcggggccctgggcaatgctgcctgcatcggctttgctggcagcgagggcggcctgctgtctggaaatgagaaggtgaccatgcagaacctgaatgaccggctggccagctacctggacaacgtgcgggccctggaggaggccaatgctgagctggagaggaagatcaagggctggtatgagaagtatggccctggcagctgccggggcctggaccatgactacagccgctaccacctgaccatcgaggacctgaagaacaagatcatcagcagcaccaccaccaatgccaacgtcatcctgcagattgacaatgcccggctggccgcagatgacttccggctgaagtatgaaaatgagctgaccctgcaccagaatgtggaggccgacatcaatggcctgcggcgggtgctggatgagctgaccctgtgcaggacagaccaggagctgcagtatgagagcctgtctgaggagatgacctacctgaagaagaaccacgaggaggagatgaaggccctgcagtgtgccgccggcggcaatgtgaatgtggagatgaatgctgcccctggggtggacctggccgtgctgctgaacaacatgagagcagaatatgaggccctggccgagcagaacaggaaggatgctgaggcctggttcaatgagaagagcgccagcctgcagcagcagatcagccatgacagcggggccgccacctttgcccggagccagctgacagagatgaggaggaccctgcagaccctggagatccagctgcagagcctgatggccaccaagcacagcctggagtgcagcctgacagaaacagagagcaactactgcacccagctggcccagatccaggcccagatcggggccctggaggagcagctgcaccaggtgaggacagaaacagagggccagaagctggagtatgagcacctgctggatgtgaaggtgcacctggagaaggagattgagacctactgccgcctgattgatggagatggcaacagctgcagcaagagcaaaggatttggaagtggcagccctggcaacagcagcaaggacctgagcaagaccaccctggtgaagacagtggtggaggagctggaccagaggggcaaggtgctgagcagccgcatccacagcattgaggagaagaccagcaagatgaccaacgggaagacagagcagagggtgcccttctag

SEQ ID NO: 18819 - DNA, 2013 bp, Artificial Sequence
  Description of Artificial Sequence: Synthetic coding sequence
atggaggagttcagaagaagctacagccggctgtgccgggagagcggggctgagccccaggaggccgtgctgcagcagctgcaccagctgccccggggccgcctggacctggccacccagagcctgactgtggagacctgccgggccctgggcaagctgctgccccgggagaccctgtgcacagagctggtgctgagtgactgcatgctgtctgaggagggcgccaccctgctgctgcggggcctgtgtgccaacacagtgctgcgcttcctggacctgaagggcaacaacctgcgggctgctggagctgaggccctgggcaagctgctgcagcagaacaagagcatccagagcctgaccctggagtggaacagcctgggcacctgggatgatgcctttgccaccttctgtggcggcctggccgccaatggagccctgcagaggctggacctgaggaacaaccagatcagccacaagggagctgaggagctggccctggccctgaagggcaacaccaccctgcagcagctggacctgcgctggaacaacgtgggcctgctgggcggccgggccctgatgaactgcctgcccagcaacagaaccctgtggaggctggacctggccggcaacaacatccctggagatgtgctgcgggctgtggagcaggccatgggccacagccaggaccggctgaccaccttccaggagaaccaggcccggacccacgtgctgagcaaggaggtgcagcacctgcgggaggagaagagcaagcagttcctggacctgatggagaccatcgacaagcagcgggaggagatggccaagagcagccgggccagcgctgcccgggtgggccagctgcaggaggccctgaatgaaagacacagcatcatcaatgccctgaaggccaagctgcagatgacagaggccgccctggccctgtctgagcagaaggcccaggacctgggggagctgctggccacagctgagcaggagcagctgagcctgagccagaggcaggccaaggagctgaagctggagcagcaggaggccgctgagcgggagagcaagctgctgcgggacctgtctgctgccaatgagaagaacctgctgctgcagaaccaggtggatgagctggagaggaagttccgctgccagcaggagcagctgttccagacccggcaggagatgacctccatgtctgctgagctgaagatgagggccatccaggccgaggagcggctggacatggagaagaggcgctgccggcagagcctggaggacagcgagagcctgcgcatcaaggaggtggagcacatgaccaggcacctggaggagagcgagaaggccatgcaggagcgggtgcagaggctggaggccgcccggctgagcctggaggaggagctgagccgggtgaaggctgctgccctgtctgagcggggccaggccgaggaggagctgatcaaggccaagagccaggcccggctggaggagcagcagaggctggcccacctggaggacaagctgcggctgctggcccaggccagagatgaggcccagggcgcctgcctgcagcagaagcaggtggtggccgaggcccagaccagggtgtcccagctgggcctgcaggtggagggcctgcggcggcggctggaggagctgcagcaggagctgagcctgaaggaccaggagcgggtggccgaggtgtcccgggtgcgggtggagctgcaggagcagaatggccgcctgcaggccgagctggccgcccaggaggccctgcgggagaaggccgccgccctggagcggcagctgaaggtgatggccagtgaccaccgggaggccctgctggaccgggagagtgaaaatgccagcctgcgggagaagctgcggctgcgggaggccgagatcgcccgcatcagagatgaggaggcccagagggccagcttcctgcagaatgctgtgctggcctacgtgcaggccagccctgtgaggaccctgagcccccccaagtag

SEQ ID NO: 18820 - DNA, 1782 bp, Artificial Sequence
  Description of Artificial Sequence: Synthetic coding sequence
atggagcccgccacagcccccaggccagacatggcccctgagctgaccccagaggaggagcaggccaccaagcagttcctggaggagatcaacaagtggacagtgcagtacaacgtgagccccctgtcctggaatgtggccgtgaagttcctgatggccaggaagtttgatgtgctgcgggccatcgagctgttccacagctaccgggagaccaggaggaaggagggcatcgtgaagctgaagccccatgaggagcccctgcggtctgagatcctgagcggcaagttcaccatcctgaatgtgcgggaccccactggagccagcatcgccctcttcaccgcccggctgcaccacccccacaagtctgtgcagcacgtggtgctgcaggccctcttctacctgctggacagagctgtggacagctttgagacccagagaaatggcctggtgttcatctatgacatgtgtggcagcaactatgccaactttgagctggacctgggcaagaaggtgctgaacctgctgaagggggccttccctgcccggctgaagaaggtgctgattgtgggcgcccccatctggttccgggtgccctacagcatcatcagcctgctgctgaaggacaaggtgcgggagcgcatccagatcctgaagaccagcgaggtgacccagcacctgcccagagaatgtctgcctgagaacctgggcggctacgtgaagattgacctggccacctggaacttccagttcctgccccaggtgaatggccacccagacccctttgatgagatcatcctcttcagcctgcccccagccctggactgggacagcgtgcacgtgcccggcccccacgccatgaccatccaggagctggtggactatgtgaatgcccggcagaagcagggcatctatgaggagtatgaggacatcagaagagaaaatcctgtgggcaccttccactgcagcatgagccctggcaacctggagaagaacagatatggagatgtgccctgcctggaccagaccagggtgaagctgaccaagaggagcggccacacccagacagactacatcaatgccagcttcatggatggctacaagcagaagaatgcctacatcggcacccagggccccctggagaacacctacagagacttctggctgatggtgtgggagcagaaggtgctggtgattgtgatgaccaccaggtttgaggagggcggcagaagaaaatgtggccagtactggcccctggagaaggacagccgcatccgcttcggcttcctgactgtgaccaacctgggcgtggagaacatgaaccactacaagaagaccaccctggagatccacaacacagaggagcggcagaagaggcaggtgacccacttccagttcctgtcctggccagactatggagtgcccagcagcgctgccagcctgattgacttcctgcgggtggtgaggaaccagcagagcctggccgtgagcaacatgggcgcccggagcaagggccagtgcccagagccccccatcgtggtgcactgcagcgctggcattggaagaacaggcaccttctgcagcctggacatctgcctggcccagctggaggagctgggcaccctgaatgtgttccagacagtgtccaggatgaggacccagagggccttcagcatccagaccccagagcagtactacttctgctacaaggccatcctggagtttgctgagaaggagggcatggtgagcagcggccagaacctgctggccgtggagagccagtag

SEQ ID NO: 18821 - DNA, 1884 bp, Artificial Sequence
  Description of Artificial Sequence: Synthetic coding sequence
atggagggcctggccggctacgtgtacaaggccgccagcgagggcaaggtgctgaccctggccgccctgctgctgaacagaagtgaaagtgacatccgctacctgctgggctacgtgtcccagcagggcggccagaggagcacccccctcatcatcgccgccagaaatggccacgccaaggtggtgcggctgctgctggagcactacagagtgcagacccagcagacaggcaccgtgcgctttgatggctacgtgattgatggagccacagccctgtggtgtgccgccggggccggccactttgaggtggtgaagctgctggtgagccacggggccaacgtgaaccacaccaccgtgaccaacagcacccccctgcgggccgcctgctttgatggccgcctggacatcgtgaagtacctggtggagaacaatgccaacatcagcatcgccaacaagtatgacaacacctgcctgatgattgctgcctacaagggccacacagatgtggtgcgctacctgctggagcagagagctgaccccaatgccaaggcccactgtggggccacagccctgcactttgctgctgaggccggccacatcgacatcgtgaaggagctgatcaagtggagggctgccatcgtggtgaatggccacggcatgacccccctgaaggtggccgctgagagctgcaaggcagatgtggtggagctgctgctgagccacgccgactgtgaccggcgcagccgcatcgaggccctggagctgctgggcgccagctttgccaatgacagagaaaattatgacatcatcaagacctaccactacctgtacctggccatgctggagcgcttccaggatggagacaacatcctggagaaggaggtgctgccccccatccacgcctacggcaacagaacagaatgtagaaacccccaggagctggagagcatccggcaggacagagatgccctgcacatggagggcctcatcgtgcgggagcgcatcctgggcgctgacaacattgatgtgagccaccccatcatctacagaggagctgtgtatgctgacaacatggagtttgagcagtgcatcaagctgtggctgcacgccctgcacctgcggcagaagggcaacagaaacacccacaaggacctgctgcgctttgcccaggtgttcagccagatgatccacctgaatgaaacagtgaaggccccagacattgaatgtgtgctgcgctgcagcgtgctggagattgagcagagcatgaacagagtgaagaacatcagtgatgctgatgtgcacaatgccatggacaactatgagtgcaacctgtacaccttcctgtacctggtgtgcatcagcaccaagacccagtgcagcgaggaggaccagtgcaagatcaacaagcagatctacaacctgatccacctggaccccaggacccgggagggcttcaccctgctgcacctggccgtgaacagcaacacccctgtggatgacttccacaccaatgatgtgtgcagcttccccaatgccctggtgaccaagctgctgctggactgtggggctgaggtgaatgctgtggacaatgaaggcaacagcgccctgcacatcatcgtgcagtacaaccggcccatcagtgacttcctgaccctgcacagcatcatcatcagcctggtggaggccggggcccacacagacatgaccaacaagcagaacaagacccccctggacaagagcaccaccggggtgtctgagatcctgctgaagacccagatgaagatgagcctgaagtgcctggccgcccgggctgtgcgggccaatgacatcaactaccaggaccagatccccaggaccctggaggagtttgtgggcttccactag

SEQ ID NO: 18822 - DNA, 378 bp, Artificial Sequence
  Description of Artificial Sequence: Synthetic coding sequence
atgcccagcgagaagaccttcaagcagaggaggacctttgagcagagggtggaggatgtgcggctcatccgggagcagcaccccaccaagatccctgtgatcatcgagcgctacaagggggagaagcagctgcctgtgctggacaagaccaagttcctggtgcctgaccacgtgaacatgtctgagctgatcaagatcatcagaagaaggctgcagctgaatgccaaccaggccttcttcctgctggtgaatggccacagcatggtgtctgtgtccacccccatcagcgaggtgtatgaaagtgagaaggatgaagatggcttcctgtacatggtgtgtgccagccaggagaccttcggcatgaagctgtctgtgtag

SEQ ID NO: 18823 - DNA, 3786 bp, Artificial Sequence
  Description of Artificial Sequence: Synthetic coding sequence
atgggcactggagacttcatctgcatctccatgactggaggagccccctggggcttccggctgcagggcggcaaggagcagaagcagcccctgcaggtggccaagatccggaaccagagcaaggccagcggcagcggcctgtgtgaaggagatgaggtggtgtccatcaatggaaacccctgtgccgacctgacctacccagaggtgatcaagctgatggagagcatcacagacagcctgcagatgctgatcaagaggcccagcagcggcatcagcgaggccctgatcagtgaaaatgaaaacaagaacctggagcacctgacccatggaggctacgtggagagcaccaccctgcagatccggcctgccaccaagacccagtgcacagagttcttcctggcccctgtgaagacagaggtgcccctggccgagaaccagaggagcggccctgactgtgccggcagcctgaaggaggagaccggccccagctaccagagggccccccagatgccagacagccagaggggccgggtggccgaggagctgatcctgcgggagaaggtggaggccgtgcagcccggccctgtggtggagctgcagctgagcctgagccaggagcggcacaagggggccagcggccccctggtggccctgcctggagctgagaagagcaagagcccagaccctgaccccaacctgagccatgaccgcatcgtgcacatcaacagcatccccaccaatgagaaggctgaccccttcctgcggagcagcaagatcatccagatcagcagcggccgggagctgcgggtcatccaggagagcgaggccggagatgctggcctgccccgggtggaggtgatcctggactgcagcgaccggcagaagacagagggctgccgcctgcaggccggcaaggaatgtgtggacagccctgtggagggcggccagagcgaggccccacccagcctggtgtcctttgctgtgagcagcgagggcacagagcagggcgaggaccccaggtctgagaaggaccacagccggccccacaagcaccgggcccggcatgcccggctgcggcgctctgagagcctgtctgagaagcaggtgaaggaggccaagagcaagtgcaagagcatcgccctgctgctgacagatgcccccaaccccaacagcaagggcgtgctgatgttcaagaagagaagaagaagagccaggaagtacaccctggtgtcctatggcaccggggagctggagcgggaggctgatgaggaggaggagggggacaaggaggacacctgtgaggtggccttcctgggcgccagcgagagcgaggtggatgaggagctgctgagtgatgtggatgacaacacccaggtggtgaactttgactgggacagcggcctggtggacatcgagaagaagctgaacagaggagacaagatggagatgctgcctgacaccaccgggaagggggccctgatgtttgccaagaggcgggagaggatggaccagatcacagcccagaaggaggaggacaaggtgggcggcacccccagccgggagcaggatgctgcccagacagatggcctgcggaccaccaccagctaccagaggaaggaggaggagagcgtgaggacccagagctctgtgtccaagagctacatcgaggtgagccacggcctgggccacgtgccccagcagaatggcttcagcggcaccagcgagacagccaacatccagaggatggtgcccatgaacagaacagccaagcccttccctggctctgtgaaccagcctgccacccccttcagccccaccaggaacatgaccagccccatcgctgacttccctgcccccccaccctacagcgctgtgaccccacctccagatgccttcagcagaggagtgagcagccccatcgccggccctgcccagcccccaccctggccccagcctgccccctggagccagcctgccttctatgacagcagcgagagaattgccagcagagatgagcgcatctctgtgcctgccaagaggacaggcatcctgcaggaggccaagagaagaagcaccaccaagcccatgttcaccttcaaggagcccaaggtgagccccaaccctgagctgctgagcctgctgcagaacagcgagggcaagaggggcactggagctggaggagacagcggccctgaggaggactacctgagcctgggcgctgaggcctgcaacttcatgcagagcagcagcgccaagcagaagaccccacctcctgtggcccccaagccagctgtgaagagcagcagcagccagcctgtgacccctgtgtcccctgtgtggagccctggggtggcccccacccagcccccagccttccccaccagcaaccccagcaaaggaacagtggtgagcagcatcaagatcgcccagcccagctaccccccagcccggcctgccagcaccctgaatgtggccggccccttcaagggcccccaggccgctgtggccagccagaactacacccccaagcccaccgtgtccacccccaccgtgaatgctgtgcagcccggggctgtgggccccagcaatgagctgcccggcatgagcggccgcggggcccagctgtttgccaagaggcagagcaggatggagaagtatgtggtggacagcgacacagtgcaggcccatgctgcccgggcccagagccccacccccagcctgcctgcctcctggaagtacagcagcaatgtgcgggcccctcctcctgtggcctacaaccccatccacagccccagctaccccctggccgccctgaagagccagcccagcgctgcccagcccagcaagatgggcaagaagaagggcaagaagcccctgaatgccctggatgtgatgaagcaccagccctaccagctgaatgccagcctcttcaccttccagcccccagatgccaaggatggcctgccccagaagagctctgtgaaggtgaacagcgccctggccatgaagcaggccctgccccccaggcctgtgaatgctgccagccccaccaacgtgcaggccagctctgtgtacagcgtgcctgcctacaccagccccccatccttctttgctgaggccagcagccctgtgtctgccagccctgtgcctgtgggcatccccaccagccccaagcaggagagcgccagcagcagctactttgtggccccccggcccaagttcagcgccaagaagtctggagtgaccatccaggagagcggccgcagcctgagcctgcccggccgctctgtgcccccacccatcagcaccagcccctgggtgtaccagcccacctacagctacagcagcaagcccacagatggcctggagaaggccaacaagaggcccaccccctgggaggccgccgccaagagccccctgggcctggtggatgatgccttccagcccaggaacatccaggagagcatcgtggccaacgtggtgtctgctgcccggaggaaggtgctgcccggccccccagaggactggaatgaaaggctgagctacatcccccagacccagaaggcctacatgggcagctgtggccggcaggagtacaacgtgacagccaacaacaacatgagcaccaccagccagtatggcagccagctgccctatgcctactaccggcaggccagcagaaatgacagcgccatcatgtccatggagaccaggagtgactactgcctgcctgtggccgactacaactacaacccccacccccggggctggaggcggcagacctag

SEQ ID NO: 18824 - DNA, 1146 bp, Artificial Sequence
  Description of Artificial Sequence: Synthetic coding sequence
atgtcctggacagtgcctgtggtgcgggccagccagagggtgtcctctgtgggcgccaacttcctgtgcctgggcatggccctgtgcccccggcaggccacccgcatccccctgaatggcacctggctgttcacccctgtgtccaagatggccaccgtgaagtctgagctgattgagcgcttcaccagcgagaagcctgtgcaccacagcaaggtgtccatcattggaactggatctgtgggcatggcctgtgccatcagcatcctgctgaagggcctgagtgatgagctggccctggtggacctggatgaggacaagctgaagggggagaccatggacctgcagcacggcagccccttcaccaagatgcccaacatcgtgtgcagcaaggactactttgtgacagccaacagcaacctggtgatcatcacagctggggcccggcaggagaagggggagacccggctgaacctggtgcagagaaatgtggccatcttcaagctgatgatcagcagcatcgtgcagtacagcccccactgcaagctgatcatcgtgagcaaccctgtggacatcctgacctacgtggcctggaagctgagcgccttccccaagaaccgcatcatcggcagcggctgcaacctggacacagcccgcttccgcttcctgattggccagaagctgggcatccacagcgagagctgccacggctggatcctgggggagcacggggacagctctgtgcctgtgtggagcggcgtgaacattgctggggtgcccctgaaggacctgaacagcgacattggaacagacaaggaccctgagcagtggaagaatgtgcacaaggaggtgacagccacagcctatgagatcatcaagatgaagggctacacctcctgggccatcggcctgtctgtggccgacctgacagagagcatcctgaagaacctgcggcgcatccaccctgtgtccaccatcatcaagggcctgtatggaattgatgaggaggtgttcctgagcatcccctgcatcctgggggagaatggcatcaccaacctgatcaagatcaagctgaccccagaggaggaggcccacctgaagaagagcgccaagaccctgtgggagatccagaacaagctgaagctgtag

SEQ ID NO: 18825 - DNA, 861 bp, Artificial Sequence
  Description of Artificial Sequence: Synthetic coding sequence
atgatggccacccccaaccagacagcctgcaatgctgagagccctgtggccctggaggaggccaagaccagcggggcccctggcagcccccagaccccacctgagagacatgattctgggggcagcctgcccctgacccccaggatggagagccacagtgaagatgaggacctggccggggctgtgggcggcctgggctggaacagccgcagccccaggacccagagccctgggggctgcagcgctgaggccgtgctggccaggaagaagcacagaagaagacccagcaagaggaagaggcactggaggccctacctggagctgtcctgggccgagaagcagcagagagatgagcggcagagccagagggccagccgggtgcgggaggagatgtttgccaagggccagcctgtggccccctacaacaccacccagttcctgatgaatgaccgggaccctgaggagcccaacctggatgtgccccacggcatcagccaccctggcagcagcggggagagcgaggccggggacagtgatggccggggccgggcccatggagagttccagaggaaggacttcagcgagacctatgagcgcttccacacagagagcctgcagggccgcagcaagcaggagctggtgcgggactacctggagctggagaagaggctgagccaggccgaggaggagacccggcggctgcagcagctgcaggcctgcaccggccagcagagctgccggcaggtggaggagctggccgctgaggtgcagaggctgaggacagagaaccagaggctgcggcaggagaaccagatgtggaaccgggagggctgccgctgtgatgaggagcccggcacctag

SEQ ID NO: 18826 - DNA, 1206 bp, Artificial Sequence; identical to SEQ ID NO: 18795
  Description of Artificial Sequence: Synthetic coding sequence

SEQ ID NO: 18827 - DNA, 1728 bp, Artificial Sequence
  Description of Artificial Sequence: Synthetic coding sequence
atggccatggcccccagccccagcctggtgcaggtgtacaccagccctgctgctgtggccgtgtgggagtggcaggacggcctgggcacctggcacccctacagcgccaccgtgtgcagcttcatcgagcagcagtttgtgcagcagaagggccagcgcttcggcctgggcagcctggcccacagcatccccctgggccaggccgaccccagcctggccccctacatcatcgacctgcccagctggacccagttccggcaggacaccggcaccatgagagctgtgcggcggcacctgttcccccagcacagcgcccctggccggggcgtggtgtgggagtggctgagtgatgatggctcctggacagcctatgaggcctctgtgtgtgactacctggagcagcaggtggcccggggcaaccagctggtggacctggcccccctgggctacaactacacagtgaactacaccacccacacccagaccaacaagaccagcagcttctgccgctctgtgcggcggcaggccggccccccctaccctgtgaccaccatcatcgcccctcctggccacactggagtggcctgcagctgccaccagtgcctgagcggcagcaggactggacctgtgtctggccgctaccgccacagcatgaccaacctgcctgcctaccctgtgccccagcaccccccccacaggacagcctctgtgtttggcacccaccaggcctttgccccctacaacaagcccagcctgagcggggcccggagcgccccccggctgaacaccaccaatgcctggggcgccgccccacccagcctgggcagccagcccctgtaccgcagcagcctgagccacctgggcccccagcacctgcccccaggcagcagcaccagcggggctgtgtctgccagcctgcccagcggccccagcagcagccctggctctgtgcctgccaccgtgcccatgcagatgcccaagcccagccgggtgcagcaggccctggccggggccacccccaagccagagcctgagcctgagcaggtgatcaagaactacacagaggagctgaaggtgcccccagatgaggactgcatcatctgcatggagaagctgagcacagccagcggctacagtgatgtgacagacagcaaggccatcggcagcctggccgtgggccacctgaccaagtgcagccacgccttccacctgctgtgcctgctggccatgtactgcaatggaaacaaggatggcagcctgcagtgccccagctgcaagaccatctatggagagaagacaggcacccagccccagggcaagatggaggtgctgcgcttccagatgagcctgcccggccacgaggactgtggcaccatcctgattgtgtacagcatcccccacggcatccagggccctgagcaccccaaccctgggaagcccttcaccgcccggggcttcccccggcagtgctacctgcctgacaatgcccagggcaggaaggtgctggagctgctgaaggtggcctggaagagaagactcatcttcaccgtgggcaccagcagcaccactggagaaacagacacagtggtgtggaatgagatccaccacaagacagagatggacaggaacatcactggacatggctacccagaccccaactacctgcagaatgtgctggccgagctggccgcccagggcgtgacagaggactgcctggagcagcagtag

SEQ ID NO: 18828 - DNA, 1095 bp, Artificial Sequence
  Description of Artificial Sequence: Synthetic coding sequence
atggagcacaacggcagcgccagcaatgctgacaagatccaccagaaccggctgagctctgtgacagaagatgaggaccaggatgctgccctgaccatcgtgacagtgctggacaaggtggccagcatcgtggacagcgtgcaggccagccagaagagaattgaggagcggcaccgggagatggagaatgccatcaagtctgtgcagattgacctgctgaagctgagccagagccacagcaacacaggccacatcatcaacaagctgtttgagaagaccaggaaggtgtctgcccacatcaaggatgtgaaggcccgggtggagaagcagcagatccacgtgaagaaggtggaggtgaagcaggaggagatcatgaagaagaacaagttccgggtggtgatcttccaggagaagttccgctgccccaccagcctgtctgtggtgaaggacaggaacctgacagagaaccaggaggaggatgatgatgacatctttgatcctcctgtggacctgagcagtgatgaggagtactacgtggaggagagccgcagcgcccggctgaggaagagcggcaaggagcacatcgacaacatcaagaaggccttcagcaaagaaaacatgcagaagacccggcagaacctggacaagaaggtgaaccgcatccgcaccagaattgtgaccccagagcggcgggagcggctgcggcagagcggggagcggctgcggcagagcggggagcggctgcggcagagcggggagcgcttcaagaagagcatcagcaatgctgcccccagcaaggaggccttcaagatgaggagcctgaggaagggcaaggacagaacagtggccgagggggaggagtgtgcccgggagatgggcgtggacatcatcgcccggtctgagagcctgggccccatcagcgagctgtacagtgatgagctgtctgagcctgagcatgaagctgcccggcctgtgtacccacctcatgagggccgggagatccccaccccagagcccctgaaggtgaccttcaagagccaggtgaaggtggaggatgatgagagcctgctgctggacctgaagcacagcagctag

SEQ ID NO: 18829 - DNA, 1266 bp, Artificial Sequence
  Description of Artificial Sequence: Synthetic coding sequence
atgcccaccctgtctgtgttcatggatgtgcccctggcccacaagctggagggcagcctgctgaagacctacaagcaggatgactaccccaacaagatcttcctggcctacagagtgtgcatgaccaatgaaggccacccctgggtgtccctggtggtgcagaagacccggctgcagatcagccaggaccccagcctgaactatgagtacctgcccaccatgggcctgaagagcttcatccaggccagcctggccctgctgtttgggaagcacagccaggccatcgtggagaacagagtgggcggcgtgcacacagtgggggacagcggggccttccagctgggcgtgcagttcctgcgggcctggcacaaggatgcccgcatcgtgtacatcatcagcagccagaaggagctgcacggcctggtgttccaggacatgggcttcaccgtgtatgagtacagcgtgtgggaccccaagaagctgtgcatggaccctgacatcctgctgaatgtggtggagcagatcccccacggctgtgtgctggtgatgggcaacatcatcgactgcaagctgacccccagcggctgggccaagctgatgtccatgatcaagagcaagcagatcttccccttctttgacatcccctgccagggcctgtacaccagtgacctggaggaggacacccgcatcctgcagtactttgtgtcccagggctttgagttcttctgcagccagagcctgagcaagaactttggcatctatgatgaaggagtgggcatgctggtggtggtggccgtgaacaaccagcagctgctgtgtgtgctgagccagctggagggcctggcccaggccctgtggctgaacccccccaacacaggagcccgggtcatcaccagcatcctgtgcaacccagccctgctgggggagtggaagcagagcctgaaggaggtggtggagaacatcatgctgaccaaggagaaggtgaaggagaagctgcagctgctgggcaccccaggctcctggggccacatcacagagcagagcggcacccacggctacctgggcctgaacagccagcaggtggagtacctggtgaggaagaagcacatctacatccccaagaatggccagatcaacttcagctgcatcaatgccaacaacatcaactacatcacagagggcatcaatgaggccgtgctgctgacagagagcagcgagatgtgcctgcccaaggagaagaagaccctgattggcatcaagctgtag

SEQ ID NO: 18830 - DNA, 576 bp, Artificial Sequence
  Description of Artificial Sequence: Synthetic coding sequence
atgggcaagagctgcaaggtggtggtgtgtggccaggcctctgtgggcaagaccagcatcctggagcagctgctgtatggcaaccacgtggtgggcagcgagatgattgagacccaggaggacatctacgtgggcagcattgaaacagaccggggcgtgcgggagcaggtgcgcttctatgacacccggggcctgagagatggagctgagctgcccaggcactgcttcagctgcacagatggctacgtgctggtgtacagcacagacagccgggagagcttccagagggtggagctgctgaagaaggagattgacaagagcaaggacaagaaggaggtgaccatcgtggtgctgggcaacaagtgtgacctgcaggagcagaggagagtggaccctgatgtggcccagcactgggccaagtctgagaaggtgaagctgtgggaggtgtctgtggccgaccggcgcagcctgctggagccctttgtgtacctggccagcaagatgacccagccccagagcaagagcgccttccccctgagcaggaagaacaagggcagcggcagcctggatggatag

SEQ ID NO: 18831 - DNA, 3207 bp, Artificial Sequence
  Description of Artificial Sequence: Synthetic coding sequence
atggtgtccagtgacaggcctgtgtccctggaggatgaggtgagccacagcatgaaggagatgattggaggctgctgcgtgtgcagtgatgagcggggctgggccgagaaccccctggtgtactgtgatggccacggctgcagcgtggccgtgcaccaggcctgctacggcatcgtgcaggtgcccaccggcccctggttctgcaggaaatgtgagagccaggagagagctgcccgggtgcgctgtgagctgtgcccccacaaggatggagccctgaagaggacagacaatggaggctgggcccacgtggtgtgtgccctgtacatccctgaggtgcagtttgccaacgtgtccaccatggagcccatcgtgctgcagagcgtgccccatgaccgctacaacaagacctgctacatctgtgatgagcagggccgggagagcaaggccgccactggagcctgcatgacctgcaacaagcacggctgccggcaggccttccacgtgacctgtgcccagtttgctggcctgctgtgtgaggaggagggcaatggagctgacaacgtgcagtactgcggctactgcaagtaccacttcagcaagctgaagaagagcaagaggggcagcaacagaagctatgaccagagcctgagtgacagcagcagccacagccaggacaagcaccacgagaaggagaagaagaagtacaaggagaaggacaagcacaagcagaagcacaagaagcagcctgagcccagccctgccctggtgcccagcctgactgtgaccacagagaagacctacaccagcaccagcaacaacagcatcagcggcagcctgaagaggctggaggacaccacagcccgcttcaccaatgccaacttccaggaggtgtctgcccacaccagcagcggcaaggatgtgtctgagacccggggcagcgagggcaagggcaagaagagcagcgcccacagcagcggccagaggggcaggaagccaggcggcggcaggaaccctggcaccaccgtgtctgctgccagccccttcccccagggcagcttcagcggcaccccaggctctgtgaagagcagcagcggcagctctgtgcagagcccccaggacttcctgtccttcacagacagcgacctgagaaatgacagctacagccacagccagcagagcagcgccaccaaggatgtgcacaagggggagagcggcagccaggagggcggcgtgaacagcttcagcaccctcatcggcctgcccagcaccagcgctgtgaccagccagcccaagagctttgagaacagccctggggacctgggcaacagcagcctgcccacagctggctacaagagggcccagaccagcggcatcgaggaggagaccgtgaaggagaagaagaggaaaggaaacaagcagagcaagcacggccctggccggcccaagggcaacaagaaccaggagaatgtgagccacctgtctgtgtcctctgccagccccaccagctctgtggccagcgctgctggcagcatcaccagcagcagcctgcagaagagccccaccctgctgagaaatggcagcctgcagagcctgtctgtgggcagcagccctgtgggcagcgagatctccatgcagtacagacatgatggagcctgccccaccaccaccttcagcgagctgctgaatgccatccacaacggcatctacaacagcaatgatgtggccgtgtccttccccaacgtggtgtctggcagcggcagcagcacccctgtgagcagcagccacctgccccagcagagcagcggccacctgcagcaggtgggcgccctgagccccagcgctgtgtcctctgctgccccagctgtggccaccacccaggccaacaccctgagcggcagcagcctgagccaggcccccagccacatgtatggcaacagaagcaacagctccatggccgccctgattgcccagagcgagaacaaccagacagaccaggacctgggggacaacagcaggaacctggtgggccggggcagcagcccccggggcagcctgagccccaggagccctgtgagcagcctgcagatccgctatgaccagcccggcaacagcagcctggagaacctgccccctgtggccgccagcattgagcagctgctggagcggcagtggagcgagggccagcagttcctgctggagcagggcacccccagcgacatcctgggcatgctgaagagcctgcaccagctgcaggtggagaacagaaggctggaggagcagatcaagaacctgacagccaagaaggagcggctgcagctgctgaatgcccagctgtctgtgcccttccccaccatcacagccaaccccagccccagccaccagatccacaccttcagcgcccagacagcccccaccacagacagcctgaacagcagcaagagcccccacatcggcaacagcttcctgcctgacaacagcctgcctgtgctgaaccaggacctgaccagcagcggccagagcaccagcagcagcagcgccctgagcaccccacctcctgctggccagagccctgcccagcagggcagcggcgtgtctggagtgcagcaggtgaatggagtgacagtgggcgccctggccagcggcatgcagcctgtgaccagcaccatcccagctgtgtctgctgtgggcggcatcattggagccctgcccggcaaccagctggccatcaatggcatcgtgggcgccctgaatggagtgatgcagacccctgtgaccatgagccagaaccccacccccctgacccacaccaccgtgcccccaaatgccacccaccccatgcctgccaccctgaccaacagcgccagcggcctgggcctgctgagtgaccagcagaggcagatcctgatccaccagcagcagttccagcagctgctgaacagccagcagctgaccccagagcagcaccaggccttcctgtaccagctgatgcagcaccaccaccagcagcaccaccagcctgagctgcagcagctgcagatccctggccccacccagatccccatcaacaacctgctggccggcacccaggccccacccctgcacacagccaccaccaaccccttcctgaccatccatggagacaatgccagccagaaggtggcccggctgagtgacaagacaggccctgtggcccaggagaagagctag

SEQ ID NO: 18832 - DNA, 1353 bp, Artificial Sequence
  Description of Artificial Sequence: Synthetic coding sequence
atgagctgcctgatggtggagcgctgtggggagatcctgtttgaaaatccagaccagaatgccaagtgtgtgtgcatgctgggggacatccggctgcggggccagacaggagtgcgggcagagcggcggggcagctaccccttcatcgacttccggctgctgaacagcaccacctacagcggggagatcggcaccaagaagaaggtgaagaggctgctgtccttccagcgctacttccacgccagccggctgctgcggggcatcatcccccaggcccccctgcacctgctggatgaggactacctgggccaggcccggcacatgctgagcaaggtgggcatgtgggactttgacatcttcctgtttgaccggctgaccaatggaaacagcctggtgaccctgctgtgccacctgttcaacacccacggcctcatccaccacttcaagctggacatggtgaccctgcaccgcttcctggtgatggtgcaggaggactaccacagccagaacccctaccacaatgctgtgcacgccgcagatgtgacccaggccatgcactgctacctgaaggagcccaagctggccagcttcctgacccccctggacatcatgctgggcctgctggccgctgctgcccatgatgtggaccaccctggggtgaaccagcccttcctgatcaagaccaaccaccacctggccaacctgtaccagaacatgtctgtgctggagaaccaccactggaggagcaccatcggcatgctgcgggagagccggctgctggcccacctgcccaaggagatgacccaggacatcgagcagcagctgggcagcctcatcctggccacagacatcaaccggcagaatgagttcctgacccggctgaaggcccacctgcacaacaaggacctgcggctggaggatgcccaggacagacacttcatgctgcagatcgccctgaagtgtgccgacatctgcaacccctgccgcatctgggagatgagcaagcagtggagcgagcgggtgtgtgaggagttctaccggcagggcgagctggagcagaagtttgagctggagatcagccccctgtgcaaccagcagaaggacagcatccccagcatccagatcggcttcatgagctacatcgtggagcccctcttccgggagtgggcccacttcaccggcaacagcaccctgtctgagaacatgctgggccacctggcccacaacaaggcccagtggaagagcctgctgccccggcagcacaggagccggggcagcagcggcagcggccctgaccatgaccacgccggccagggcacagagagcgaggagcaggagggggacagcccctag

SEQ ID NO: 18833 - DNA, 2268 bp, Artificial Sequence
  Description of Artificial Sequence: Synthetic coding sequence
atggccggctgcatccctgaggagaagacctaccgccgcttcctggagctgttcctgggggagttccggggcccctgtggcggcggggagcctgagcctgagcctgagcctgagcctgagcctgagcctgagagcgagcctgagcctgagcctgagctggtggaggccgaggccgctgaggcctctgtggaggagcccggggaggaggccgccaccgtggccgccacagaggagggggaccaggagcaggaccctgagcctgaggaggaggccgctgtggagggggaggaggaggaggagggcgccgccacagctgctgctgcccctggccacagcgctgtgcccccacctccaccccagctgccccccctgccccccctgccccggcccctgtctgagcgcatcacccgggaggaggtggagggggagagcctggacctgtgcctgcagcagctgtacaagtacaactgccccagcttcctggccgccgccctggcccgggccaccagtgatgaggtgctgcagagcgacctgagcgcccactacatccccaaggagacagatggaacagagggcaccgtggagattgagaccgtgaagctggcccggagcgtcttcagcaagctgcacgagatctgctgctcctgggtgaaggacttccccctgcggcggcggccccagctgtactatgagaccagcatccacgccatcaagaacatgaggaggaagatggaggacaagcacgtgtgcatcccagacttcaacatgctgttcaacctggaggaccaggaggagcaggcctactttgctgtgtttgatggccatggaggagtggatgctgccatctatgccagcatccacctgcacgtgaacctggtgcggcaggagatgttcccccatgaccctgctgaggccctgtgccgggccttccgggtgacagatgaaagatttgtgcagaaggccgcccgggagagcctgcgctgtggcaccactggagtggtgaccttcatccggggcaacatgctgcacgtggcctgggtgggggacagccaggtgatgctggtgaggaagggccaggccgtggagctgatgaagccccacaagccagaccgggaggatgagaagcagagaattgaggccctgggcggctgtgtggtgtggtttggagcctggagggtgaatggcagcctgtctgtgtcccgggccatcggagatgctgagcacaagccctacatctgtggagatgctgacagcgccagcacagtgctggatggaacagaggactacctgatcctggcctgtgatggcttctatgacacagtgaacccagatgaggccgtgaaggtggtgtctgaccacctgaaggagaacaacggggacagctccatggtggcccacaagctggtggccagcgccagagatgctggcagcagtgacaacatcaccgtcatcgtggtgttcctgcgggacatgaacaaggctgtgaatgtgtctgaggagagtgactggacagaaaattccttccagggcggccaggaggatggaggagatgacaaggagaaccacggggagtgcaagaggccctggccccagcaccagtgcagcgccccagctgacctgggctatgatggccgggtggacagcttcacagacaggaccagcctgagccctggcagccagatcaacgtgctggaggaccccggctacctggacctgacccagatcgaggccagcaagccccacagcgcccagttcctgctgcctgtggagatgtttggacctggggcccccaagaaggccaacctgatcaatgagctgatgatggagaagaagtctgtgcagagcagcctgcctgagtggagcggggccggggagttccccacagccttcaacctgggcagcactggagagcagatctacaggatgcagagcctgagccctgtgtgcagcggcctggagaatgagcagttcaagagccctggcaacagagtgtcccggctgagccacctgcggcaccactacagcaagaagtggcaccgcttccgcttcaaccccaagttctacagcttcctgagcgcccaggagcccagccacaagattggcaccagcctgagcagcctgaccggcagcggcaagaggaaccgcatccgcagcagcctgccctggaggcagaacagctggaagggctacagcgagaacatgaggaagctgaggaagacccatgacatcccctgcccagacctgccctggagctacaagattgaatag

SEQ ID NO: 18834 - DNA, 771 bp, Artificial Sequence
  Description of Artificial Sequence: Synthetic coding sequence
atggccagccgctatgaccgggccatcaccgtcttctccccagatggccacctgttccaggtggagtatgcccaggaggccgtgaagaagggcagcacagctgtgggcatccggggcaccaacatcgtggtgctgggcgtggagaagaagtctgtggccaagctgcaggatgagaggacagtgaggaagatctgtgccctggatgaccacgtgtgcatggcctttgctgtgctgaccatcttcatcggcctgacagcagatgcccgggtggtgatcaacagagcccgggtggagtgccagagccacaagctgactgtggaggaccctgtgacagtggagtacatcacccgcttcatcgccaccctgaagcagaagtacacccagagcaatggccggcggcccttcggcatcagcgccctgattgtgggctttgatgatgatggcatcagccggctgtaccagacagaccccagcggcacctaccacgcctggaaggccaatgccatcggccgcagcgccaagacagtgcgggagttcctggagaagaactacacagaagatgccatcgccagtgacagcgaggccatcaagctggccatcaaggccctgctggaggtggtgcagagcggcggcaagaacatcgagctggccatcatcagaagaaaccagcccctgaagatgttttctgccaaggaggtggagctgtatgtgacagaaattgagaaggagaaggaggaggccgagaagaagaagagcaagaagtctgtgtag

SEQ ID NO: 18835 - DNA, 3108 bp, Artificial Sequence
  Description of Artificial Sequence: Synthetic coding sequence
atggccccccggctgcagctggagaaggccgcctggcgctgggccgagaccgtgcggcctgaggaggtgtcccaggagcacatcgagacagcctaccgcatctggctggagccctgcatccggggcgtgtgcagaagaaactgcaagggcaaccccaactgcctggtgggcatcggggagcacatctggctgggggagattgatgaaaattccttccacaacattgatgaccccaactgtgagaggaggaagaagaacagctttgtgggcctgaccaacctgggcgccacctgctacgtgaacaccttcctgcaggtgtggttcctgaacctggagctgcggcaggccctgtacctgtgccccagcacctgcagcgactacatgctgggagatggcatccaggaggagaaggactatgagccccagaccatctgtgagcacctgcagtacctgtttgccctgctgcagaacagcaacagacgctacatcgaccccagcggctttgtgaaggccctgggcctggacaccggccagcagcaggatgcccaggagttcagcaagctgttcatgagcctgctggaggacaccctgagcaagcagaagaacccagatgtgaggaacatcgtgcagcagcagttctgtggggagtatgcctacgtgacagtgtgcaaccagtgtggccgggagagcaagctgctgagcaagttctatgagctggagctgaacatccagggccacaagcagctgacagactgcatcagcgagttcctgaaggaggagaagctggagggggacaaccgctacttctgtgagaactgccagagcaagcagaatgccaccaggaagatccggctgctgagcctgccctgcaccctgaacctgcagctgatgagatttgtgtttgaccggcagacaggccacaagaagaagctgaacacctacatcggcttcagcgagatcctggacatggagccctacgtggagcacaagggcggcagctatgtgtatgagctgtctgctgtgctgatccaccggggcgtgtctgcctacagcggccactacatcgcccacgtgaaggacccccagagcggggagtggtacaagttcaatgatgaggacatcgagaagatggagggcaagaagctgcagctgggcatcgaggaggacctggccgagcccagcaagagccagaccaggaagcccaagtgtgggaagggcacccactgcagcagaaatgcctacatgctggtgtaccgcctgcagacccaggagaagcccaacaccaccgtgcaggtgcctgccttcctgcaggagctggtggaccgggacaacagcaagtttgaggagtggtgcatcgagatggccgagatgaggaagcagagcgtggacaagggcaaggccaagcatgaggaggtgaaggagctgtaccagaggctgcctgctggagctgagccctatgaatttgtgtccctggagtggctgcagaagtggctggatgagagcacccccaccaagcccatcgacaaccacgcctgcctgtgcagccatgacaagctgcacccagacaagatcagcatcatgaagaggatcagtgaatatgctgctgacatcttctacagccgctatggaggcggcccccggctgactgtgaaggccctgtgcaaggaatgtgtggtggagcgctgccgcatcctgcggctgaagaaccagctgaatgaagactacaagacagtgaacaacctgctgaaggctgctgtgaagggcagtgatggcttctgggtgggcaagagcagcctgcgctcctggaggcagctggccctggagcagctggatgagcaggatggagatgctgagcagagcaatggcaagatgaatggcagcaccctgaacaaggatgagagcaaggaggagaggaaggaggaggaggagctgaacttcaatgaagacatcctgtgcccccacggggagctgtgcatcagtgaaaatgaaagaaggctggtgtccaaggaggcctggagcaagctgcagcagtacttccccaaggcccctgagttccccagctacaaggagtgctgcagccagtgcaagatcctggagcgggagggggaggagaatgaggccctgcacaagatgattgccaatgagcagaagaccagcctgcccaacctcttccaggacaagaaccggccctgcctgagcaactggccagaggacacagatgtgctgtacatcgtgtcccagttctttgtggaggagtggaggaagtttgtgaggaagcccacccgctgcagccctgtgtcctctgtgggcaacagcgccctgctgtgcccccacggcggcctgatgttcacctttgcctccatgaccaaggaggacagcaagctgattgccctgatctggcccagcgagtggcagatgatccagaagctgtttgtggtggaccacgtgatcaagatcacccgcatcgaggtgggagatgtgaaccccagcgagacccagtacatcagcgagcccaagctgtgcccagaatgtcgggagggcctgctgtgccagcagcagagggacctgcgggagtacacccaggccaccatctacgtgcacaaggtggtggacaacaagaaggtgatgaaggacagcgcccctgagctgaatgtgagcagcagcgagacagaggaggacaaggaggaggccaagccagatggagagaaggaccctgacttcaaccagagcaatggaggcaccaagaggcagaagatcagccaccagaactacatcgcctaccagaagcaggtgatcagaagatccatgaggcacaggaaggtgcggggggagaaggccctgctggtgtctgccaaccagaccctgaaggagctgaagatccagatcatgcacgccttctctgtggccccctttgaccagaacctgagcattgatggcaagatcctgagtgatgactgtgccaccctgggcaccctgggcgtcatccctgagagcgtcatcctgctgaaggcagatgagcccatcgctgactatgctgccatggatgatgtgatgcaggtgtgcatgcctgaggagggcttcaagggcaccggcctgctgggccactag

SEQ ID NO: 18836 - DNA, 2382 bp, Artificial Sequence
  Description of Artificial Sequence: Synthetic coding sequence
atgctgatccagagcgagaagaagacccagctgagcaagacagagagcgtgaaggagagcgagagcctgatggagtttgcccagcctgagatccagccccaggagttcctgaacagacgctacatgacagaggtggactacagcaacaagcagggcgaggagcagccctgggaggccgactatgccaggaagcccaacctgcccaagcgctgggacatgctgacagagccagatggccaggagaagaagcaggagagcttcaagtcctgggaggccagcggcaagcaccaggaggtgtccaagccagctgtgtccctggagcagaggaagcaggacaccagcaagctgcggagcaccctgcctgaggagcagaagaagcaggagatcagcaagagcaagcccagccccagccagtggaagcaggacacccccaagagcaaggccggctacgtgcaggaggagcagaagaagcaggagacccccaagctgtggcctgtgcagctgcagaaggagcaggaccccaagaagcagacccccaagtcctggacccccagcatgcagagcgagcagaacaccaccaagtcctggaccacccccatgtgtgaggagcaggacagcaagcagcctgagacccccaagtcctgggagaacaacgtggagagccagaagcacagcctgaccagccagagccagatcagccccaagtcctggggcgtggccacagccagcctcatccccaatgaccagctgctgcccaggaagctgaacacagagcccaaggatgtgcccaagcctgtgcaccagcctgtgggcagcagcagcaccctgcccaaggaccctgtgctgaggaaggagaagctgcaggacctgatgacccagatccagggcacctgcaacttcatgcaggagagcgtgctggactttgacaagcccagcagcgccatccccaccagccagccccccagcgccaccccaggcagccctgtggccagcaaggagcagaacctgagcagccagagcgacttcctgcaggagcccctgcaggccaccagcagccctgtgacctgcagcagcaatgcctgcctggtgaccacagaccaggccagcagcggcagcgagacagagttcatgaccagcgagaccccagaggccgccatccccccaggcaagcagcccagcagcctggccagccccaacccccccatggccaagggcagcgagcagggcttccagagccccccagccagcagcagctctgtgaccatcaacacagcccccttccaggccatgcagaccgtcttcaacgtgaatgcccccctgccccccaggaaggagcaggagatcaaggagagcccctacagccctggctacaaccagagcttcaccacagccagcacccagaccccaccccagtgccagctgcccagcatccacgtggagcagacagtgcacagccaggagacagccaactaccacccagatggcaccatccaggtgtccaatggcagcctggccttctacccagcccagaccaacgtgttcccccggcccacccagccctttgtgaacagccggggctctgtgcggggctgcacccggggcggccgcctcatcaccaacagctaccgcagccctgggggctacaagggctttgacacctaccggggcctgcccagcatcagcaatggaaactacagccagctgcagttccaggcccgggagtacagcggggccccctacagccagagggacaacttccagcagtgctacaagagaggaggcaccagcggcggcccccgggccaacagcagagctggctggagcgacagcagccaggtgagcagccctgagcgggacaatgagaccttcaacagcggggacagcggccagggcgacagccgctccatgacccctgtggatgtgcctgtgaccaacccagctgccaccatcctgcctgtgcacgtgtaccccctgccccagcagatgagggtggccttctctgctgcccggaccagcaacctggcccctggcaccctggaccagcccatcgtgtttgacctgctgctgaacaacctgggggagacctttgacctgcagctgggccgcttcaactgccctgtgaatggcacctacgtgttcatcttccacatgctgaagctggccgtgaatgtgcccctgtatgtgaacctgatgaagaatgaggaggtgctggtgtctgcctatgccaatgatggagccccagaccatgaaacagccagcaaccacgccatcctgcagctgttccagggcgaccagatctggctgcggctgcacagaggagccatctacggcagctcctggaagtacagcaccttcagcggctacctgctgtaccaggactag

SEQ ID NO: 18837 - DNA, 1083 bp, Artificial Sequence
  Description of Artificial Sequence: Synthetic coding sequence
atggaggagctgagccaggccctggccagcagcttctctgtgtcccaggacctgaacagcacagctgccccccacccccggctgagccagtacaagagcaagtacagcagcctggagcagagcgagaggagaagaaggctgctggagctgcagaagagcaagaggctggactatgtgaaccacgcccggcggctggctgaagatgactggacaggcatggagagcgaggaggagaacaagaaggatgatgaggagatggacatcgacacagtgaagaagctgcccaagcactacgccaaccagctgatgctgtctgagtggctgattgatgtgcccagcgacctgggccaggagtggatcgtggtggtgtgccctgtgggcaagagggccctgattgtggccagccggggcagcaccagcgcctacaccaagagcggctactgtgtgaaccgcttcagcagcctgctgcccggcggcaacagaagaaacagcacagccaaggactacaccatcctggactgcatctacaatgaggtgaaccagacctactacgtgctggatgtgatgtgctggaggggccaccccttctatgactgccagacagacttccgcttctactggatgcacagcaagctgcctgaggaggagggcctgggggagaagaccaagctgaaccccttcaagtttgtgggcctgaagaacttcccctgcaccccagagagcctgtgtgatgtgctgtccatggacttcccctttgaggtggatggcctgctcttctaccacaagcagacccactacagccctggcagcacccccctggtgggctggctgcggccctacatggtgtctgatgtgctgggcgtggccgtgcctgctggccccctgaccaccaagccagactatgccggccaccagctgcagcagatcatggagcacaagaagagccagaaggagggcatgaaggagaagctgacccacaaggcctctgaaaatggccactatgagctggagcacctgagcacccccaagctgaagggcagcagccacagcccagaccaccctggctgcctgatggagaactag

SEQ ID NO: 18838 - DNA, 525 bp, Artificial Sequence
  Description of Artificial Sequence: Synthetic coding sequence
ctcatccacaagcccctgaagagggccatcaccaccctgatggccggcatcctgcggctggtggtgcagtggcccccaggccgcctgcagacagtgaccaagggcgtggagagcctcatctgcacagactggatccgccacaagttcaccaggagccgcatccctgagaaggtgttccaggccagccctgaggaccacgagaagtatggaggagacccccagaacccccacaagctgcacatcgtgacccgcatcaagagcacccggcggcggccctactgggagaaggacatcatcaagatgctgggcctggagaaggcccacaccccccaggtgcacaagaacatccccagcgtgaatgccaagctgaaggtggtgaagcacctgatccgcatcaagcccctgaagctgccccagggcctgcctgctgaggagaacatgagcaacacctgcctgaagagcactggagagctggtggtgcagtggcacctgaagcctgtggagcagaaggcccacgagagctag

SEQ ID NO: 18839 - DNA, 1434 bp, Artificial Sequence
  Description of Artificial Sequence: Synthetic coding sequence
atggccacctacacctgcatcacctgccgggtggccttcagagatgctgacatgcagagggcccactacaagacagactggcaccgctacaacctgcggaggaaggtggcctccatggcccctgtgacagctgagggcttccaggagcgggtgcgggcccagagagctgtggccgaggaggagagcaaaggaagtgccacctactgcaccgtgtgcagcaagaagtttgccagcttcaatgcctatgagaaccacctgaagagcagaagacatgtggagctggagaagaaggctgtgcaggccgtgaacaggaaggtggagatgatgaatgagaagaacctggagaagggcctgggcgtggacagcgtggacaaggatgccatgaatgctgccatccagcaggccatcaaggcccagcccagcatgagccccaagaaggcccccccagccccagccaaggaggccagaaatgtggtggccgtgggcactggaggccggggcacccatgaccgggaccccagcgagaagccaccccggctgcagtggtttgagcagcaggccaagaagctggccaagcagcaggaggaggacagcgaggaggaggaggaggacctggatggagatgactgggaggacatcgacagtgatgaggagctggagtgtgaggacacagaggccatggatgatgtggtggagcaggatgctgaggaggaggaggccgaggagggcccccccctgggcgccatccccatcacagactgcctcttctgcagccaccacagcagcagcctgatgaagaatgtggcccacatgaccaaggaccacagcttcttcatcccagacatcgagtacctgagtgacatcaagggcctcatcaagtacctgggggagaaggtgggcgtgggcaagatctgcctgtggtgcaatgagaagggcaagagcttctacagcacagaggccgtgcaggcccacatgaatgacaagagccactgcaagctgttcacagatggagatgctgccctggagtttgctgacttctatgacttccgcagcagctacccagaccacaaggagggggaggaccccaacaaggccgaggagctgcccagcgagaagaacctggagtatgatgatgagaccatggagctgatcctgcccagcggggcccgggtgggccacaggagcctgatgagatactacaagcagcgcttcggcctgagcagagctgtggccgtggccaagaacaggaaggctgtgggccgggtgctgcagcagtaccgggccctgggctggacaggcagcactggagctgccctgatgagggagcgggacatgcagtatgtgcagaggatgaagagcaagtggatgctgaagacaggcatgaagaacaatgccaccaagcagatgcacttccgggtgcaggtgcgcttctag

SEQ ID NO: 18840 - DNA, 2862 bp, Artificial Sequence
  Description of Artificial Sequence: Synthetic coding sequence
atgatcaccagcgctgctggcatcatcagcctgctggatgaagatgagccccagctgaaggagtttgccctgcacaagctgaatgctgtggtgaatgacttctgggccgagatcagcgagagcgtggacaagattgaggtgctgtatgaagatgagggcttccgcagccggcagtttgctgccctggtggccagcaaggtgttctaccacctgggcgcctttgaggagagcctgaactatgccctgggcgctggggacctcttcaacgtgaatgacaacagtgaatatgtggagaccatcatcgccaagtgcatcgaccactacaccaagcagtgtgtggagaatgctgacctgcctgagggggagaagaagcccatcgaccagaggctggagggcatcgtgaacaagatgttccagcgctgcctggatgaccacaagtacaagcaggccatcggcatcgccctggagacccggcggctggatgtgtttgagaagaccatcctggagagcaatgatgtgcccggcatgctggcctacagcctgaagctgtgcatgagcctgatgcagaacaagcagttcaggaacaaggtgctgcgggtgctggtgaagatctacatgaacctggagaagccagacttcatcaacgtgtgccagtgcctgatcttcctggatgacccccaggccgtgtctgacatcctggagaagctggtgaaggaggacaacctgctgatggcctaccagatctgctttgacctgtatgaaagtgccagccagcagttcctgagcagcgtcatccagaacctgaggacagtgggcacccccatcgcctctgtgcccggcagcaccaacacaggcaccgtgcccggcagcgagaaggacagcgacagcatggagacagaggagaagaccagcagcgcctttgtgggcaagaccccagaggccagccctgagcccaaggaccagaccctgaagatgatcaagatcctgagcggggagatggccatcgagctgcacctgcagttcctgatccggaacaacaacacagacctgatgatcctgaagaacaccaaggatgctgtgagaaattctgtgtgccacacagccaccgtgattgccaacagcttcatgcactgcggcaccaccagtgaccagttcctgcgggacaacctggagtggctggcccgggccaccaactgggccaagttcaccgccacagccagcctgggcgtcatccacaagggccacgagaaggaggccctgcagctgatggccacctacctgcccaaggacaccagccctggcagcgcctaccaggagggcggcggcctgtatgccctgggcctcatccacgccaaccacggcggggacatcatcgactacctgctgaaccagctgaagaatgccagcaatgacatcgtgagacatggaggcagcctgggcctgggcctggccgccatgggcacagcccggcaggatgtgtatgacctgctgaagaccaacctgtaccaggatgatgctgtgactggagaggccgccggcctggccctgggcctggtgatgctgggcagcaagaatgcccaggccatcgaggacatggtgggctacgcccaggagacccagcacgagaagatcctgcggggcctggccgtgggcatcgccctggtgatgtatggccgcatggaggaggctgatgccctgattgagagcctgtgccgggacaaggaccccatcctgcggcgcagcggcatgtacacagtggccatggcctactgcggcagcggcaacaacaaggccatccggcggctgctgcacgtggccgtgtctgatgtgaatgatgatgtgagaagagctgctgtggagagcctgggcttcatcctcttccgcaccccagagcagtgccccagcgtggtgtccctgctgtctgagagctacaacccccacgtgcgctacggggccgccatggccctgggcatctgctgtgccggcactggaaacaaggaggccatcaacctgctggagcccatgaccaatgaccctgtgaactacgtgcggcagggcgccctgattgccagcgccctgatcatgatccagcagacagagatcacctgccccaaggtgaaccagttccggcagctgtacagcaaggtgatcaatgacaagcatgatgatgtgatggccaagtttggagccatcctggcccagggcatcctggatgctgggggccacaacgtgaccatcagcctgcagagcaggacaggccacacccacatgcccagcgtggtgggcgtgctggtgttcacccagttctggttctggttccccctgagccacttcctgagcctggcctacacccccacctgtgtgattggcctgaacaaggacctgaagatgcccaaggtgcagtacaagagcaactgcaagcccagcacctttgcctacccagcccccctggaggtgcccaaggagaaggagaaggagaaggtgtccacagctgtgctgagcatcacagccaaggccaagaagaaggagaaggagaaggagaagaaggaggaggagaagatggaggtggatgaagctgagaagaaggaggagaaggagaagaagaaggagcctgagcccaacttccagctgctggacaacccagcccgggtgatgcctgcccagctgaaggtgctgaccatgcctgagacctgccgctaccagcccttcaagcccctgagcatcggcggcatcatcatcctgaaggacaccagtgaagatattgaggagctggtggagcctgtggccgcccacggccccaagattgaggaggaggagcaggagcctgagcccccagagccctttgagtacattgatgactag

SEQ ID NO: 18841 - DNA, 984 bp, Artificial Sequence
  Description of Artificial Sequence: Synthetic coding sequence
atgtgcagcaccagcggctgtgacctggaggagatccccctggatgatgatgacctgaacaccatcgagttcaagatcctggcctactacaccaggcaccacgtgttcaagagcaccccagccctcttcagccccaagctgctgcggaccaggagcctgagccagaggggcctgggcaactgcagcgccaatgaatcctggacagaggtgtcctggccctgcaggaacagccagagcagcgagaaggccatcaacctgggcaagaagaagagctcctggaaggccttctttggagtggtggagaaggaggacagccagagcaccccagccaaggtgtctgcccagggccagaggaccctggagtaccaggacagccacagccagcagtggagccgctgcctgagcaatgtggagcagtgcctggagcatgaagctgtggaccccaaggtgatcagcatcgccaacagagtggccgagatcgtgtacagctggcccccaccccaggccacccaggccggcggcttcaagagcaaggagatctttgtgacagagggcctgtccttccagctgcagggccacgtgcctgtggccagcagcagcaagaaggatgaggaggagcagatcctggccaagatcgtggagctgctgaagtacagcggggaccagctggagaggaagctgaagaaggacaaggccctgatgggccacttccaggacggcctgagctacagcgtcttcaagaccatcacagaccaggtgctgatgggcgtggaccccagaggagagagcgaggtgaaggcccagggcttcaaggccgccctggtgattgatgtgacagccaagctgacagccatcgacaaccaccccatgaacagagtgctgggcttcggcaccaagtacctgaaggagaacttcagcccctggatccagcagcacggcggctgggagaagatcctgggcatcagccatgaggaggtggactag

SEQ ID NO: 18842 - DNA, 1086 bp, Artificial Sequence
  Description of Artificial Sequence: Synthetic coding sequence
atgggcggcgctgtgtctgctggagaagataatgatgagctgattgacaacctgaaggaggcccagtacatcagaacagagctggtggagcaggccttccgggccatcgacagagctgactactacctggaggagttcaaggaaaatgcctacaaggacctggcctggaagcacggcaacatccacctgagcgccccctgcatctacagcgaggtgatggaggccctggacctgcagcccggcctgtccttcctgaacctgggcagcggcaccggctacctgagctccatggtgggcctcatcctgggcccctttggagtgaaccacggcgtggagctgcacagtgatgtgattgaatatgccaagcagaagctggacttcttcatccgcaccagtgacagctttgacaagtttgacttctgtgagcccagctttgtgactggaaactgcctggagatcagcccagactgcagccagtatgacagagtgtactgtggggccggcgtgcagaaggagcacgaggagtacatgaagaacctgctgaaggtgggcggcatcctggtgatgcccctggaggagaagctgaccaagatcaccaggacaggccccagcgcctgggagaccaagaagatcctggccgtgtcctttgcccccctcatccagccctgccacagcgagagcggcaagagccggctggtgcagctgccccctgtggccgtgcgcagcctgcaggacctggccagaattgccatccggggcaccatcaagaagatcatccaccaggagaccgtgtccaagaatggaaatggcctgaagaacaccccccgcttcaagagaagaagagtgagaagaagaaggatggagaccatcgtgttcctggacaaggaggtgtttgccagccgcatcagcaaccccagtgatgacaacagctgtgaggacctggaggaggagcggcgggaggaggaggagaagaccccacctgagaccaagccagacccccctgtgaacttcctgcggcagaaggtgctgagcctgcccctgcctgaccccctgaagtactacctgctgtactaccgggagaagtag

SEQ ID NO: 18843 - DNA, 780 bp, Artificial Sequence
  Description of Artificial Sequence: Synthetic coding sequence
atgaaggatgtggacaacctgaagagcatcaaggaggagtgggtgtgtgagaccggcagtgacaaccagcccctgggcaacaaccagcagagcaactgtgagtactttgtggacagcctgtttgaggaggcccagaaggtgagcagcaaatgtgtgtccccagctgagcagaagaagcaggtggatgtgaacatcaagctgtggaagaatggcttcaccgtgaatgatgacttccgcagctacagtgatggagccagccagcagttcctgaacagcatcaagaagggggagctgcccagcgagctgcagggcatctttgacaaggaggaggtggatgtgaaggtggaggacaagaagaatgagatctgcctgagcaccaagcctgtgttccagcccttcagcggccagggccaccggctgggcagcgccacccccaagatcgtgtccaaggccaagaacatcgaggtggagaacaagaacaacctgtctgctgtgcccctgaacaacctggagcccatcaccaacatccagatctggctggccaacgggaagagaattgtgcagaagttcaacatcacccaccgggtgagccacatcaaggacttcatcgagaagtaccagggcagccagaggagcccccccttcagcctggccacagccctgcctgtgctgcggctgctggatgagaccctgaccctggaggaggccgacctgcagaatgctgtgatcatccagaggctgcagaagacagccagcttccgggagctgtctgagcactag

SEQ ID NO: 18844 - DNA, 990 bp, Artificial Sequence
  Description of Artificial Sequence: Synthetic coding sequence
atggtgaggaccaagacctggaccctgaagaagcactttgtgggctaccccaccaacagcgactttgagctgaagacagctgagctgccccccctgaagaatggagaggtgctgctggaggccctcttcctgactgtggacccctacatgagggtggccgccaagaggctgaaggagggggacaccatgatgggccagcaggtggccaaggtggtggagagcaagaatgtggccctgcccaagggcaccatcgtgctggccagccctggctggaccacccacagcatcagtgatggcaaggacctggagaagctgctgacagagtggccagacaccatccccctgagcctggccctgggcaccgtgggcatgcctggcctgacagcctacttcggcctgctggagatctgtggggtgaagggcggggagaccgtgatggtgaatgctgctgctggagctgtgggctctgtggtgggccagatcgccaagctgaagggctgcaaggtggtgggcgctgtgggcagtgatgagaaggtggcctacctgcagaagctgggctttgatgtggtgttcaactacaagacagtggagagcctggaggagaccctgaagaaggccagcccagatggctatgactgctactttgacaacgtgggcggggagttcagcaacacagtgattggccagatgaagaagtttggccgcatcgccatctgtggggccatcagcacctacaacagaacaggccccctgcccccaggccccccacctgagatcgtcatctaccaggagctgaggatggaggcctttgtggtgtaccgctggcagggagatgcccggcagaaggccctgaaggacctgctgaagtgggtgctggagggcaagatccagtacaaggagtacatcatcgagggctttgagaacatgcctgctgccttcatgggcatgctgaagggggacaacctgggcaagaccatcgtgaaggcctag

SEQ ID NO: 18845 - DNA, 3006 bp, Artificial Sequence
  Description of Artificial Sequence: Synthetic coding sequence
atgcagagcacagacctgggcaacaaggagagcggcaagatctggcacaggaagcccagccctgccaccagagatggcatcatcgtgaacatcatccacaacaccagtgactaccaccccaaggtgctgcgcttcctgaatgtggcctttgatggcactggagactgcctgattgctggggaccaccagggcaacatctacgtgtttgacctgcacggcaaccgcttcaacctggtgcagaggacagcccaggcctgcacagccctggccttcaacctgcggaggaagtctgagttcctggtggccctggccgactacagcatcaagtgctttgacacagtgaccaaggagctggtgtcctggatgaggggccacgagagcagcgtcttcagcatctctgtgcacgccagcggcaagtatgccatcaccaccagcagtgacacagcccagctgtgggacctggacaccttccagaggaagaggaagctgaacatccggcagagcgtgggcatccagaaggtgttcttcctgcccctgagcaacaccatcctgagctgcttcaaggacaacagcatctttgcctgggagtgtgacaccctcttctgcaagtaccagctgcctgcccctcctgagagcagcagcatcctgtacaaggtgtttgctgtgaccagagatggccgcatcctggccgccggcggcaagagcaaccacctgcacctgtggtgcctggaggcccggcagctgttccgcatcatccagatgcccaccaaggtgcgggccatccgccacctggagttcctgcctgacagctttgatgctggcagcaaccaggtgctgggcgtgctgagccaggacggcatcatgaggttcatcaacatgcagacctgcaagctgctgtttgagatcggcagcctggatgagggcatcagcagcagcgccatcagcccccacggccgctacatcgccagcatcatggagaatggcagcctgaacatctacagcgtgcaggccctgacccaggagatcaacaagcccccaccacccctggtgaaggtgattgaggacctgcccaagaacaagctgagcagcagtgacctgaagatgaaggtgaccagcggccgggtgcagcagcctgccaagagccgggagagcaagatgcagacccgcatcctgaagcaggacctgaccggggactttgagagcaagaagaatgagctgcctgatggcctgaacaagaagaggctgcagatcctgctgaagggctacggggagtaccccaccaagtacaggatgttcatctggaggagcctgctgcagctgcctgagaaccacacagccttcagcaccctgattgacaagggcacccacgtggccttcctgaacctgcagaagaagtaccccatcaagagcaggaagctgctgcgggtgctgcagaggaccctgagcgccctggcccactggagcgtcatcttcagtgacaccccctacctgcccctgctggccttcccctttgtgaagctgttccagaacaaccagctgatctgctttgaggtgattgccaccctcatcatcaactggtgccagcactggtttgagtacttccccaacccccccatcaacatcctgtccatgattgaaaatgtgctggccttccatgacaaggagctgctgcagcacttcatcgaccatgacatcaccagccagctgtatgcctggcccctgctggagaccgtcttcagcgaggtgctgacccgggaggagtggctgaagctgtttgacaacatcttcagcaaccaccccagcttcctgctgatgacagtggtggcctacaacatctgcagcaggacccccctgctgagctgcaacctgaaggatgactttgagttcttcttccaccacaggaacaacctggacatcaacgtggtgatccggcaggtgtaccacctgatggagaccacccccacagacatccacccagacagcatgctgaatgtgtttgtggccctgaccaagggccagtaccctgtgttcaaccagtaccccaagttcatcgtggactaccagacccaggagcgggagcgcatcagaaatgatgagctggactacctgcgggagcggcagacagtggaggacatgcaggccaaggtggaccagcagagggtggaggatgaggcctggtaccagaagcaggagctgctgaggaaggccgaggagacccggcgggagatgctgctgcaggaggaggagaagatgatccagcagaggcagaggctggccgctgtgaagcgggagctgaaggtgaaggagatgcacctgcaggatgctgcccggcggcgcttcctgaagctgcagcaggaccagcaggagatggagctgcggcggctggatgatgaaattggaaggaaggtgtacatgagggaccgggagattgctgccacagcccgggacctggagatgaggcagctggagctggagagccagaagaggctgtatgagaagaacctgacagagaaccaggaggccctggccaaggagatgagagcagatgctgatgcctacagaaggaaggtggacctggaggagcacatgttccacaagctgattgaggccggggagacccagagccagaagacccagaagtggaaggaggccgagggcaaggagttccggctgcggagcgccaagaaggccagcgccctgagtgatgccagcaggaagtggttcctgaagcaggagatcaatgctgctgtggagcacgccgagaacccctgccacaaggaggagccccgcttccagaatgagcaggacagcagctgcctgcccaggaccagccagctgaatgacagcagcgagatggaccccagcacccagatcagcctgaacagaagagctgtggagtgggacaccaccggccagaacctgatcaagaaggtgaggaacctgcggcagaggctgacagcccgggcccggcaccgctgccagaccccccacctgctggccgcctag

SEQ ID NO: 18846 - DNA, 651 bp, Artificial Sequence
  Description of Artificial Sequence: Synthetic coding sequence
atgtccttcctgtttggcagccgcagcagcaagaccttcaagcccaagaagaacatccctgagggcagccaccagtatgagctgctgaagcacgccgaggccaccctgggcagcggcaacctgaggatggctgtgatgctgcctgaaggagaggacctgaatgagtgggtggccgtgaacacagtggacttcttcaaccagatcaacatgctgtatggcaccatcacagacttctgcacagaggagagctgccctgtgatgtctgctggccccaagtatgagtaccactgggcagatggcaccaacatcaagaagcccatcaagtgcagcgcccccaagtacatcgactacctgatgacctgggtgcaggaccagctggatgatgagaccctcttccccagcaagattggagtgcccttccccaagaacttcatgtctgtggccaagaccatcctgaagaggctcttccgggtgtatgcccacatctaccaccagcactttgatcctgtgatccagctgcaggaggaggcccacctgaacaccagcttcaagcacttcatcttctttgtgcaggagttcaacctgattgaccggcgggagctggcccccctgcaggagctgattgagaagctgaccagcaaggacagatag

SEQ ID NO: 18847 - DNA, 477 bp, Artificial Sequence
  Description of Artificial Sequence: Synthetic coding sequence
atggccgcccagggcgtgggccctggccctggcagcgctgcccctcctggcctggaggccgcccggcagaagctggccctgcggaggaagaaggtgctgagcacagaggagatggagctgtatgagctggcccaggccgccggcggcggcattgatcctgatgtgttcaagatcctggtggacctgctgaagctgaatgtggcccccctggccgtgttccagatgctgaagtccatgtgtgccggccagaggctggccagcgagccccaggaccctgctgctgtgtccctgcccaccagctctgtgcctgagacccggggccgggacaagggcagcgctgccctgggcggcgtgctggccctggccgagaggagcaaccacgagggcagcagccagaggatgccccggcagcccagcgccacccggctgcccaagggcggcggccctgggaagagccccacccagggcagcacctag

SEQ ID NO: 18848 - DNA, 1425 bp, Artificial Sequence
  Description of Artificial Sequence: Synthetic coding sequence
atgaacagcgtgtccccagctgctgcccagtaccgcagcagcagcccagaagatgccaggagaagacctgaggcccggcggccccggggcccccggggccctgaccccaacggcctgggccccagcggggccagcggccctgccctgggcagccctggggccggccccagcgagccagatgaggtggacaagttcaaggccaagttcctgacagcctggaacaacgtgaagtatggctgggtggtgaagagcaggaccagcttcagcaagatcagcagcatccacctgtgtggccgccgctacagatttgaaggagagggggacatccagcgcttccagagggactttgtgtcccggctgtggctgacctacagaagagacttcccccccctgcccggcggctgcctgaccagtgactgtggctggggctgcatgctgcggagcggccagatgatgctggcccagggcctgctgctgcacttcctgccccgggactggacctgggccgagggcatgggcctgggccccccagagctgagcggcagcgccagccccagccgctaccacggccctgcccgctggatgccaccccgctgggcccagggcgcccctgagctggagcaggagcggcggcaccggcagatcgtgtcctggtttgctgaccacccccgggcccccttcggcctgcaccggctggtggagctgggccagagcagcggcaagaaggccggggactggtacggccccagcctggtggcccacatcctgaggaaggctgtggagagctgcagtgatgtgacccggctggtggtgtatgtgtcccaggactgcaccgtgtacaaggcagatgtggcccggctggtggcccggccagaccccacagctgagtggaagtctgtggtgatcctggtgcctgtgcggctgggcggggagaccctgaaccctgtgtatgtgccctgtgtgaaggagctgctgcgctgtgagctgtgcctgggcatcatgggcggcaagcccaggcacagcctgtacttcatcggctaccaggatgacttcctgctgtacctggacccccactactgccagcccaccgtggatgtgtcccaggccgacttccccctggagagcttccactgcaccagccccaggaagatggcctttgccaagatggaccccagctgcaccgtgggcttctacgccggggacaggaaggagtttgagaccctgtgcagcgagctgaccagggtgctgagcagcagcagcgccacagagcgctaccccatgttcaccctggccgagggccacgcccaggaccacagcctggatgacctgtgcagccagctggcccagcccaccctgcggctgcccaggacaggccgcctgctgcgggccaagaggcccagcagtgaagattttgtgttcctgtag

SEQ ID NO: 18849 - DNA, 945 bp, Artificial Sequence
  Description of Artificial Sequence: Synthetic coding sequence
atggcctttgtgacccggcagttcatgaggtctgtgagcagcagcagcacagccagcgccagcgccaagaagatcatcgtgaagcacgtgacagtgattggaggcggcctgatgggcgccggcatcgcccaggtggccgccgccaccggccacacagtggtgctggtggaccagacagaggacatcctggccaagagcaagaagggcatcgaggagagcctgaggaaggtggccaagaagaagtttgctgagaacctgaaggctggagatgaatttgtggagaagaccctgagcaccatcgccaccagcacagatgctgcctctgtggtgcacagcacagacctggtggtggaggccatcgtggagaacctgaaggtgaagaatgagctgttcaagaggctggacaagtttgctgctgagcacaccatctttgccagcaacaccagcagcctgcagatcaccagcatcgccaatgccaccacccggcaggacagatttgctggcctgcacttcttcaaccctgtgcctgtgatgaagctggtggaggtgatcaagacccccatgaccagccagaagacctttgagagcctggtggacttcagcaaggccctgggcaagcaccctgtgtcctgcaaggacaccccaggcttcatcgtgaaccggctgctggtgccctacctgatggaggccatccggctgtatgaaagaggagatgccagcaaggaggacatcgacacagccatgaagctgggcgccggctaccccatgggcccctttgagctgctggactatgtgggcctggacaccaccaagttcatcgtggatggctggcatgagatggatgctgagaaccccctgcaccagcccagccccagcctgaacaagctggtggccgagaacaagtttgggaagaagacaggagagggcttctacaagtacaagtag

SEQ ID NO: 18850 - DNA, 810 bp, Artificial Sequence
  Description of Artificial Sequence: Synthetic coding sequence
atgggcaactgctgctggacccagtgcttcggcctgctgaggaaggaggccggccgcctgcagagggtgggcggcggcggcggcagcaagtacttccgcacctgcagcagaggagagcacctgaccattgaatttgagaacctggtggagagtgatgaaggagagagccctggcagcagccaccggcccctgacagaggaggagatcgtggacctgcgggagcggcactatgacagcattgctgagaagcagaaggacctggacaagaagatccagaaggagcaggagcggcagagaattgtgcagcagtaccaccccagcaacaatggagagtaccagagcagcggcccagaagatgactttgagagctgcctgaggaacatgaagagccagtatgaggtgttccgcagcagccggctgagcagtgatgccaccgtgctgacccccaacacagagagcagctgtgacctgatgaccaagaccaagagcaccagcggaaatgatgacagcaccagcctggacctggagtgggaggatgaggagggcatgaacaggatgctgcccatgagggagaggagcaagacagaggaggacatcctgcgggccgccctgaagtacagcaacaagaagacaggcagcaaccccaccagcgccagtgatgacagcaatggcctggagtgggagaatgactttgtgtctgctgagatggatgacaatggaaacagcgagtacagcggctttgtgaaccctgtgctggagctgagtgacagcggcatccgccacagcgacacagaccagcagaccaggtag

SEQ ID NO: 18851 - DNA, 1371 bp, Artificial Sequence
  Description of Artificial Sequence: Synthetic coding sequence
atgaagtgtgagcactgcaccaggaaggagtgcagcaagaagaccaagacagatgaccaggagaatgtgtctgcagatgcccccagccctgcccaggagaatggagagaagggggagttccacaagctggctgatgccaagatcttcctgagtgactgcctggcctgtgacagctgcatgacagctgaggagggcgtgcagctgagccagcagaatgccaaggacttcttccgggtgctgaacctgaacaagaagtgtgacaccagcaagcacaaggtgctggtggtgtctgtgtgcccccagagcctgccctactttgctgccaagttcaacctgtctgtgacagatgccagccggcggctgtgtggcttcctgaagagcctgggcgtgcactacgtgtttgacaccaccatcgctgctgacttcagcatcctggagagccagaaggagtttgtgcggcgctaccggcagcacagcgaggaggagaggaccctgcccatgctgaccagcgcctgccccggctgggtgcgctatgcagagcgggtgctgggccggcccatcacagcccacctgtgcacagccaagagcccccagcaggtgatgggcagcctggtgaaggactactttgcccggcagcagaacctgagccctgagaagatcttccacgtgattgtggccccctgctatgacaagaagctggaggccctgcaggagagcctgcccccagccctgcacggcagcagaggagctgactgtgtgctgaccagcggggagatcgcccagatcatggagcagggcgacctgtctgtgagagatgctgctgtggacaccctgtttggagacctgaaggaggacaaggtgaccaggcatgatggagccagcagtgatggccacctggcccacatcttcagacatgctgccaaggagctgttcaatgaagatgtggaggaggtgacctaccgggccctgaggaacaaggacttccaggaggtgaccctggagaagaatggagaggtggtgctgcgctttgctgctgcctacggcttcaggaacatccagaacatgatcctgaagctgaagaagggcaagttccccttccactttgtggaggtgctggcctgtgccggcggctgcctgaatggccggggccaggcccagaccccagatggccacgccgacaaggccctgctgcggcagatggagggcatctatgctgacatccctgtgcggcggcctgagagcagcgcccacgtgcaggagctgtaccaggagtggctggagggcatcaacagccccaaggcccgggaggtgctgcacaccacctaccagagccaggagcggggcacccacagcctggacatcaagtggtag

SEQ ID NO: 18852 - DNA, 612 bp, Artificial Sequence
  Description of Artificial Sequence: Synthetic coding sequence
atggcccacgtgagcagcgagacccaggatgtgagccccaaggatgagctgacagccagcgaggccagcaccaggagccccctgtgtgagcacaccttccctggggacagcgacctgcgctccatgattgaggagcacgccttccaggtgctgagccagggcagcctgctggagagccccagctacacagtgtgtgtgtctgagccagacaaggatgatgacttcctgagcctgaacttccccaggaagctgtggaagatcgtggagagtgaccagttcaagagcatctcctgggatgaaaatggcacctgcatcgtcatcaatgaggagctgttcaagaaggagatcctggagaccaaggccccctaccgcatcttccagacagatgccatcaagagctttgtgcggcagctgaacctgtatggcttcagcaagatccagcagaacttccagaggtctgccttcctggccaccttcctgtctgaggagaaggagagctctgtgctgagcaagatccgcttcaccaagatgaagctgagccgcagcagcacctatgagaaccgctacctgtgctgcaacctgcacctgaaggatgagagcaactacagctag

SEQ ID NO: 18853 - DNA, 2052 bp, Artificial Sequence
  Description of Artificial Sequence: Synthetic coding sequence
atgaacaccagcatcccctaccagcagaacccctacaacccccggggcagcagcaatgtcatccagtgctaccgctgtggggacacctgcaagggggaggtggtgcgggtgcacaacaaccacttccacatccgctgcttcacctgccaggtgtgtggctgcggcctggcccagagcggcttcttcttcaagaaccaggagtacatctgcacccaggactaccagcagctgtatggcacccgctgtgacagctgccgggacttcatcaccggggaggtgatcagcgccctgggccgcacctaccaccccaagtgctttgtgtgcagcctgtgcaggaagcccttccccatcggggacaaggtgaccttcagcggcaaggaatgtgtgtgccagacctgcagccagagcatggccagcagcaagcccatcaagatccggggccccagccactgtgccggctgcaaggaggagatcaagcacggccagagcctgctggccctggacaagcagtggcacgtgtcctgcttcaagtgccagacctgcagcgtcatcctgaccggggagtacatcagcaaggatggagtgccctactgtgagagtgactaccacgcccagtttggcatcaagtgtgagacctgtgaccgctacatcagcggccgggtgctggaggccggcggcaagcactaccaccccacctgtgcccgctgtgtgcgctgccaccagatgttcacagaaggagaggagatgtacctgaccggcagcgaggtgtggcaccccatctgcaagcaggccgcccgggcagagaagaagctgaagcacaggaggaccagcgagaccagcatcagccccccaggcagcagcatcggcagccccaacagagtcatctgtgccaaggtggacaatgagatcctgaactacaaggacctggccgccctgcccaaggtgaagagcatctatgaggtgcagaggccagacctgatctcctatgagccccacagccgctacatgtctgatgagatgctggagcgctgtggctacggggagagcctgggcaccctgagcccctacagccaggacatctatgagaacctggacctgcggcagaggcgggccagcagccctggctacatcgacagccccacctacagccggcagggcatgagccccaccttcagccgcagcccccaccactactacagaagtggccctgagagcggccgcagcagcccctaccacagccagctggatgtgcgcagcagcacccccaccagctaccaggcccccaagcacttccacatcccagctggggacagcaacatctacaggaagccacccatctacaagagacatggagacctgagcacagccaccaagagcaagaccagcgaggacatcagccagaccagcaagtacagccccatctacagcccagacccctactatgccagcgagagcgagtactggacctaccacggcagccccaaggtgccccgggcccggcgcttcagcagcggcggggaggaggatgactttgaccgctccatgcacaagctgcagagcggcatcggccgcctcatcctgaaggaggagatgaaggcccggagcagcagctatgctgacccctggaccccacccaggagcagcaccagcagccgggaggccctgcacacagctggctatgagatgagcctgaatggcagccccaggagccactacctggccgacagcgaccccctcatcagcaagagcgccagcctgcctgcctacagaagaaatggcctgcacaggaccccatctgctgacctcttccactatgacagcatgaatgctgtgaactggggcatgagggagtacaagatctacccctatgagctgctgctggtgaccacccggggcaggaaccggctgcccaaggatgtggacaggacccggctggagcggcacctgagccaggaggagttctaccaggtgtttggcatgaccatcagcgagtttgaccggctggccctgtggaagagaaatgagctgaagaagcaggcccggctcttctag

SEQ ID NO: 18854 - DNA, 2541 bp, Artificial Sequence
  Description of Artificial Sequence: Synthetic coding sequence
atgctgttcaccgtgtcctgcagcaagatgagcagcatcgtggacagagatgacagcagcatctttgatggcctggtggaggaggatgacaaggacaaggccaagagggtgtccaggaacaagtctgagaagaagaggcgggaccagttcaacgtgctgatcaaggagctgggctccatgctgcctggaaatgccaggaagatggacaagagcacagtgctgcagaagagcattgacttcctgaggaagcacaaggagatcacagcccagagtgatgccagcgagatccggcaggactggaagcccaccttcctgagcaatgaggagttcacccagctgatgctggaggccctggatggcttcttcctggccatcatgacagatggcagcatcatctacgtgtctgagagcgtgaccagcctgctggagcacctgcccagcgacctggtggaccagagcatcttcaacttcatccctgagggggagcacagcgaggtgtacaagatcctgagcacccacctgctggagagtgacagcctgaccccagagtacctgaagagcaagaaccagctggagttctgctgccacatgctgcggggcaccatcgaccccaaggagcccagcacctatgaatatgtgaagttcatcggcaacttcaagagcctgaacagcgtgagcagcagcgcccacaatggatttgagggcaccatccagaggacccaccggcccagctatgaggacagagtgtgctttgtggccaccgtgcggctggccaccccccagttcatcaaggagatgtgcaccgtggaggagcccaatgaggagttcaccagccgccacagcctggagtggaagttcctgttcctggaccaccgggccccacccatcatcggctacctgccctttgaggtgctgggcaccagcggctatgactactaccacgtggatgacctggagaacctggccaagtgccacgagcacctgatgcagtatggcaagggcaagagctgctactaccgcttcctgaccaagggccagcagtggatctggctgcagacccactactacatcacctaccaccagtggaacagcaggcctgagttcatcgtgtgcacccacacagtggtgtcctatgcagaggtgcgggcagagcggcggcgggagctgggcatcgaggagagcctgcctgagacagctgctgacaagagccaggacagcggcagtgacaaccgcatcaacacagtgtccctgaaggaggccctggagagatttgaccacagccccaccccatctgccagcagccgcagcagcaggaagagcagccacacagctgtgtctgaccccagcagcacccccaccaagatccccacagacaccagcaccccaccccggcagcacctgcctgcccacgagaagatggtgcagaggaggagcagcttcagcagccagagcatcaacagccagagcgtgggcagcagcctgacccagcctgtgatgagccaggccaccaacctgcccatcccccagggcatgagccagttccagttcagcgcccagctgggcgccatgcagcacctgaaggaccagctggagcagaggaccaggatgattgaggccaacatccaccggcagcaggaggagctgaggaagatccaggagcagctgcagatggtgcacggccagggcctgcagatgttcctgcagcagagcaaccctggcctgaactttggatctgtgcagctgagcagcggcaacagcagcaacatccagcagctggcccccatcaacatgcagggccaggtggtgcccaccaaccagatccagagcggcatgaacacaggccacatcggcaccacccagcacatgatccagcagcagaccctgcagagcaccagcacccagagccagcagaatgtgctgagcggccacagccagcagaccagcctgcccagccagacccagagcaccctgacagcccccctgtacaacaccatggtgatcagccagcctgctgctggctccatggtgcagatccccagctccatgccccagaacagcacccagagcgctgctgtgaccaccttcacccaggaccggcagatccgcttcagccagggccagcagctggtgaccaagctggtgacagcccctgtggcctgtggggctgtgatggtgcccagcaccatgctgatgggccaggtggtgacagcctaccccacctttgccacccagcagcagcagagccagaccctgtctgtgacccagcagcagcagcagcagagcagccaggagcagcagctgacctctgtgcagcagcccagccaggcccagctgacccagcccccccagcagttcctgcagaccagccggctgctgcacggcaaccccagcacccagctgatcctgtctgctgccttccccctgcagcagagcaccttcccccagagccaccaccagcagcaccagagccagcagcagcagcagctgagccgccacaggacagacagcctgcctgaccccagcaaggtgcagccccagtag

SEQ ID NO: 18855 - DNA, 1656 bp, Artificial Sequence
  Description of Artificial Sequence: Synthetic coding sequence
atgggcaggaaggccatcgtgctggccatcgccaacaccagcctggccttccccctgtgccagcacctggtgaccttctgcctgggggaggatgatggagtgcacacagtggaggatgccagcaggaagctggccgtgatggacagccagggccgggtgtgggcccaggagatgctgctgcgggtgtccccagaccacgtgaccctgctggaccctgccagcaaggaggagctggagagctaccccctgggcgccatcgtgcgctgtgatgctgtgatgcctcctggccgcagccgcagcctgctgctgctggtgtgccaggagcctgagcgggcccagccagatgtgcacttcttccagggcctgcggctgggcgctgagctgatccgggaggacatccagggcgccctgcacaactaccgcagcggccgcggggagaggagagctgctgccctgcgggccacccaggaggagctgcagagggacaggagccctgctgctgagaccccacccctgcagaggcggcccagcgtgcgggccgtcatcagcacagtggagagaggagctggccggggccggccccaggccaagcccatccctgaggccgaggaggcccagaggcctgagcctgtgggcaccagcagcaatgctgacagcgccagcccagacctgggcccccggggccctgacctggccgtgctgcaggccgagcgggaggtggacatcctgaaccacgtgtttgatgatgtggagagctttgtgtcccggctgcagaagtctgctgaggccgcccgggtgctggagcaccgggagcggggccgccgcagcagaagaagagctgctggggagggcctgctgaccctgcgggccaagccacccagcgaggccgagtacacagatgtgctgcagaagatcaagtatgccttcagcctgctggcccggctgcggggcaacattgctgaccccagcagccctgagctgctgcacttcctgtttggccccctgcagatgattgtgaacaccagcggcggccctgagtttgccagctctgtgcggcggccccacctgaccagtgatgctgtggccctgctgcgggacaacgtgaccccccgggagaatgagctgtggaccagcctgggggacagctggacccggcccggcctggagctgagccctgaggagggccccccctacagacctgagttcttcagcggctgggagccccctgtgacagacccccagagccgggcctgggaggaccctgtggagaagcagctgcagcacgagaggagaagacggcaggtgacccaggccacccagcagggccggggctgggaggtgcggggccggggccgcagcgcctggccccggctgacccggctgagctacttcctgcagcagagcgccccccaggtggccgtgaatggccaccgggacctggagcctgagagcgagccccagctggagagcgagacagctgggaagtgggtgctgtgcaactatgacttccaggccaggaacagcagcgagctgtctgtgaagcagagagatgtgctggaggccctgcaggacaaggagaaggtgtctgagctggaggccgtgatggagaagcagaagaagaaggtggagggggaggtggagatggaggtgatctag

SEQ ID NO: 18856 - DNA, 1689 bp, Artificial Sequence
  Description of Artificial Sequence: Synthetic coding sequence
atggccgccagcgccaagaggaagcaggaggagaagcacctgaagatgctgcgggacatgacaggcctgccccacaacaggaagtgctttgactgtgaccagaggggccccacctacgtgaacatgacagtgggcagctttgtgtgcaccagctgcagcggcagcctgcggggcctgaaccccccccaccgggtgaagagcatctccatgaccaccttcacccagcaggagattgagttcctgcagaagcacggcaatgaggtgtgcaagcagatctggctgggcctgtttgatgacaggagcagcgccatcccagacttccgggacccccagaaggtgaaggagttcctgcaggagaagtatgagaagaagcgctggtacgtgcccccagagcaggccaaggtggtggcctctgtgcacgccagcatcagcggcagcagcgccagcagcaccagcagcaccccagaggtgaagcccctgaagagcctgctgggggacagcgcccccaccctgcacctgaacaagggcacccccagccagagccctgtggtgggccgcagccagggccagcagcaggagaagaagcagtttgacctgctgagtgacctgggcagtgacatctttgctgccccagccccccagagcacagccacagccaactttgccaactttgcccacttcaacagccatgctgcccagaacagcgccaatgctgactttgccaactttgatgccttcggccagagcagcggcagcagcaactttggaggcttccccacagccagccacagccccttccagccccagaccactggaggcagcgctgcctctgtgaatgccaactttgcccactttgacaacttccccaagagcagcagcgctgactttggcaccttcaacaccagccagagccaccagacagccagcgctgtgtccaaggtgtccaccaacaaggccggcctgcagacagctgacaagtatgctgccctggccaacctggacaacatcttctctgctggccagggcggggaccagggcagcggcttcggcaccaccgggaaggcccctgtgggctctgtggtgtctgtgcccagccagagcagcgccagcagtgacaagtatgctgccctggccgagctggacagcgtcttcagcagcgctgccaccagcagcaatgcctacaccagcaccagcaatgccagcagcaatgtgtttggaacagtgcctgtggtggccagcgcccagacccagcctgccagcagctctgtgcctgccccctttggagccacccccagcaccaacccctttgtggccgccgccggccccagcgtggccagcagcaccaaccccttccagaccaatgcccggggggccacagctgccacctttggaacagcctccatgtccatgcccaccggcttcggcaccccagccccctacagcctgcccaccagcttcagcggcagcttccagcagcctgccttccctgcccaggccgccttcccccagcagacagccttcagccagcagcccaacggggccggctttgctgccttcggccagaccaagcctgtggtgaccccatttggccaggtggccgctgctggggtgagcagcaaccccttcatgaccggggcccccaccggccagttccccaccggcagcagcagcaccaaccccttcctgtag

SEQ ID NO: 18857 - DNA, 2052 bp, Artificial Sequence
  Description of Artificial Sequence: Synthetic coding sequence
atggctgctgctgtggccgcccccctggccgccggcggggaggaggccgccgccaccacctctgtgcccggcagccctggcctgcctggaagaagatctgctgagcgggccctggaggaggccgtggccaccggcaccctgaacctgagcaacagaaggctgaagcacttccccagaggagctgcccggagctatgacctgagtgacatcacccaggccgacctgagcaggaaccgcttccctgaggtgcctgaggccgcctgccagctggtgtccctggagggcctgagcctgtaccacaactgcctgcgctgcctgaacccagccctgggcaacctgacagccctgacctacctgaacctgagcaggaaccagctgagcctgctgcccccctacatctgccagctgcccctgcgggtgctgattgtgagcaacaacaagctgggcgccctgcccccagacatcggcaccctgggcagcctgcggcagctggatgtgagcagcaatgagctgcagagcctgcccagcgagctgtgtggcctgagcagcctgcgggacctgaatgtgagaagaaaccagctgagcaccctgcctgaggagctgggggacctgcccctggtgcggctggacttcagctgcaacagagtgagccgcatccctgtgtccttctgccgcctgcggcacctgcaggtgatcctgctggacagcaaccccctgcagagccccccagcccaggtgtgcctgaagggcaagctgcacatcttcaagtacctgagcacagaggccggccagaggggcagcgccctgggggacctggcccccagcaggcctccttccttcagcccctgcccagctgaggacctcttccctggccacagatatgatggcggcctggacagcggcttccacagcgtggacagcggcagcaagcgctggagcggaaatgaaagcacagatgagttcagcgagctgtccttccgcatcagcgagctggcccgggagccccggggcccccgggagaggaaagaagatggcagcgcagatggagaccctgtgcagattgacttcatcgacagccacgtgcctggagaagatgaggagcggggcaccgtggaggagcagaggcctcctgagctgagccctggagctggggaccgggagcgggcccccagcagcagaagagaggagcctgctggggaggagaggagaagaccagacaccctgcagctgtggcaggagcgggagcggcggcagcagcagcagagcggggcctggggcgcccccaggaaggacagcctgctgaagccaggcctgcgggctgtggtgggcggcgctgctgctgtgtccacccaggccatgcacaacggcagccccaagagcagcgccagccaggccggggctgctgctggccagggcgccccagccccagccccagccagccaggagcccctgcccatcgccggccctgccacagccccagccccccggcccctgggcagcatccagaggcccaacagcttcctgttccgcagcagcagccagagcggcagcggccccagcagcccagacagcgtgctgcggccccggcgctacccccaggtgcctgatgagaaggacctgatgacccagctgcggcaggtgctggagagccggctgcagaggcccctgcctgaggacctggccgaggccctggccagcggggtcatcctgtgccagctggccaaccagctgcggcccaggtctgtgcccttcatccacgtgcccagccctgctgtgcccaagctgagcgccctgaaggccaggaagaatgtggagagcttcctggaggcctgcaggaagatgggcgtgcctgaggccgacctgtgcagccccagcgacctgctgcagggcacagcccggggcctgaggacagccctggaggccgtgaagagggtgggcggcaaggccctgccccccctgtggcccccatctggcctgggcggctttgtggtgttctacgtggtgctgatgctgctgctgtatgtgacctacacccggctgctgggcagctag

SEQ ID NO: 18858 - DNA, 303 bp, Artificial Sequence
  Description of Artificial Sequence: Synthetic coding sequence
atgagcaccagcaccagctgccccatccctgggggccgggaccagctgcctgactgctacagcaccacccctgggggcaccctgtatgccaccaccccaggcggcacccgcatcatctatgacaggaagttcctgctggagtgcaagaacagccccatcgcccggaccccaccctgctgcctgccccagatccctggggtgaccaccccacccacagcccccctgagcaagctggaggagctgaaggagcaggagacagaggaggagatcccagatgatgcccagtttgagatggacatctag

SEQ ID NO: 18859 - DNA, 2382 bp, Artificial Sequence
  Description of Artificial Sequence: Synthetic coding sequence
atgcccatggagagcgccagcagtgacaacaagaagcagatccccaatgaggccagcgcccggtctgagcgggacaccagtgacctggagcagaactggagcctgcaggaccactacaggatgtacagccccatcatctaccaggccctgtgtgaacatgtgcagacccagatgagcctgatgaatgacctgaccagcaagaacatccccaacggcatcccagctgtgccctgccacgcccccagccacagcgagagccaggccaccccccacagcagctatggcctgtgcaccagcacccctgtgtggagcctgcagaggcctccctgcccccccaaggtgcacagcgaggtgcagacagatggcaacagccagtttgccagccagggcaagacagtgtctgccacctgcacagatgtgctgaggaacagcttcaacaccagccctggggtgccctgcagcctgcccaagacagacatcagcgccatccccaccctgcagcagctgggcctggtgaatggcatcctgccccagcagggcatccacaaggagacagacctgctgaagtgcatccagacctacctgagcctcttccgcagccacggcaaggagacccacctggacagccagacccacaggagccccacccagagccagcctgccttcctggccaccaatgaggagaagtgtgcccgggagcagatccgggaggccaccagcgagaggaaggacctgaacatccacgtgcgggacaccaagacagtgaaggatgtgcagaaggccaagaatgtgaacaagacagctgagaaggtgcgcatcatcaagtacctgctgggggagctgaaggccctggtggccgagcaggaggacagcgagatccagaggctcatcacagagatggaggcctgcatctctgtgctgcccaccgtgtctggcaacacagacatccaggtggagatcgccctggccatgcagcccctgcggagtgaaaatgcccagctgcggcggcagctgcgcatcctgaaccagcagctgcgggagcagcagaagacccagaagcccagcggggctgtggactgcaacctggagctgttcagcctgcagagcctgaacatgagcctgcagaaccagctggaggagagcctgaagagccaggagctgctgcagagcaagaatgaggagctgctgaaggtgattgagaaccagaaggatgagaacaagaagttcagcagcatcttcaaggacaaggaccagaccatcctggagaacaagcagcagtatgacatcgagatcacccgcatcaagattgagctggaggaggccctggtgaatgtgaagagcagccagttcaagctggagacagctgagaaggagaaccagatcctgggcatcaccctgcggcagagagatgctgaggtgacccggctgcgggagctgaccaggaccctgcagacctccatggccaagctgctgagtgacctgtctgtggacagcgcccgctgcaagccaggcaacaacctgaccaagagcctgctgaacatccatgacaagcagctgcagcacgaccctgccccagcccacaccagcatcatgagctacctgaacaagctggagaccaactacagcttcacccacagcgagcccctgagcaccatcaagaatgaggagaccatcgagccagacaagacctatgaaaatgtgctgagcagccggggcccccagaacagcaacacccggggcatggaggaggccagcgcccctggcatcatcagcgccctgagcaagcaggacagtgatgagggcagcgagaccatggccctgattgaagatgagcacaacctggacaacaccatctacatcccctttgcccggagcaccccagagaagaagagccccctgagcaagaggctgagcccccagccccagatccgggccgccaccacccagctggtgagcaacagcggcctggccgtgtctgggaaggagaacaagctgtgcacccctgtgatctgcagcagcagcaccaaggaggctgaagatgcccctgagaagctgagccgggccagtgacatgaaggacacccagctgctgaagaagatcaaggaggccatcggcaagatcccagctgccaccaaggagcctgaggagcagacagcctgccacggccccagcggctgcctgagcaacagcctgcaggtgaagggcaacacagtgtgtgatggcagcgtcttcaccagtgacctgatgtctgactggagcatcagcagcttcagcaccttcaccagcagagatgagcaggacttcagaaatggcctggccgccctggatgccaacatcgcccggctgcagaagagcctgaggacaggcctgctggagaagtag

SEQ ID NO: 18860 - DNA, 1119 bp, Artificial Sequence; identical to SEQ ID NO: 18778
  Description of Artificial Sequence: Synthetic coding sequence

SEQ ID NO: 18861 - DNA, 336 bp, Artificial Sequence
  Description of Artificial Sequence: Synthetic coding sequence
atgaccaccctgcgggccttcacctgtgatgacctcttccgcttcaacaacatcaacctggaccccctgacagagacctacggcatccccttctacctgcagtacctggcccactggccagagtacttcatcgtggccgaggcccctggaggagagctgatgggctacatcatgggcaaggccgagggctctgtggcccgggaggagtggcacggccacgtgacagccctgtctgtggcccctgagttccggcggctgggcctggccgccaagctgatggagctgctggaggagatcagcgagagatatgaggagagcaccttccagggctactag

SEQ ID NO: 18862 - DNA, 1449 bp, Artificial Sequence
  Description of Artificial Sequence: Synthetic coding sequence
atgaatggcaccctggaccacccagaccagcctgacctggatgccatcaagatgtttgtgggccaggtgcccaggacctggagcgagaaggacctgcgggagctgtttgagcagtatggagctgtgtatgagatcaacgtgctgcgggacaggagccagaaccccccccagagcaagggctgctgctttgtgaccttctacaccaggaaggccgccctggaggcccagaatgccctgcacaacatgaaggtgctgcccggcatgcaccaccccatccagatgaagccagctgacagcgagaagaacaatgctgtggaggacaggaagctgttcatcggcatgatcagcaagaagtgcacagaaaatgacatccgggtgatgttcagcagctttggccagatcgaggagtgccgcatcctgcggggcccagatggcctgagccggggctgtgcctttgtgaccttcaccacccgggccatggcccagacagccatcaaggccatgcaccaggcccagaccatggagggctgcagcagccccatggtggtgaagtttgctgacacccagaaggacaaggagcagaagaggatggcccagcagctgcagcagcagatgcagcagatctctgctgcctctgtgtggggcaacctggccggcctgaacaccctgggcccccagtacctggccctgctgcagcagacagccagcagcggcaacctgaacaccctgagcagcctgcaccccatgggcggcctgaatgccatgcagctgcagaacctggccgccctggccgccgccgccagcgctgcccagaacaccccatctggcaccaatgccctgaccaccagcagcagccccctgtctgtgctgaccagcagcggcagcagccccagcagcagcagcagcaacagcgtgaaccccatcgccagcctgggcgccctgcagaccctggccggggccacagctggcctgaatgtgggcagcctggccggcatggccgccctgaatggaggcctgggcagcagcggcctgagcaatggcaccggcagcaccatggaggccctgacccaggcctacagcggcatccagcagtatgctgctgctgccctgcccaccctgtacaaccagaacctgctgacccagcagagcatcggggctgctggcagccagaaggagggccctgagggcgccaacctcttcatctaccacctgccccaggagtttggagaccaggacctgctgcagatgttcatgccctttggaaatgtggtgtctgccaaggtgttcatcgacaagcagaccaacctgagcaagtgcttcggctttgtgtcctatgacaaccctgtgtctgcccaggccgccatccagagcatgaatggcttccagatcggcatgaagaggctgaaggtgcagctgaagaggagcaagaatgacagcaagccctactag

SEQ ID NO: 18863 - DNA, 1347 bp, Artificial Sequence
  Description of Artificial Sequence: Synthetic coding sequence
atgagccccctggagtgcagcgagtgcttcggggaccagctgctgcacaggacctacacctggcagctgaccctgcacagccggcccaactacaccaggaagagggacaccaggtctgagagcctggagatccccatctctgtggtgctgccccagaggggcacagctgagcccttcccccggctgcacaacctgtacagcaccccccgctgtgcccagcaggccgccctgccccggctgagcaggaggatggccagccagcacagctaccccctgaaccgcttcagctctgtgcccctggaccccatggagcggcccatgagccaggccgacctggagctggactacaaccccccccgggtgcagctgagtgatgagatgtttgtgttccaggacggccgctgggtgaatgaaaactgccgcctgcagagcccctacttcagccccagcgccagcttccaccacaagctgcaccacaagaggctggccaaggagtgcatgctgcaggaggagaacaagagcctgcgggaggagaacaaggccctgcgggaggagaacaggatgctgagcaaggagaacaagatcctgcaggtgttctgggaggagcacaaggccagcctgggccgggaggagagccgggcccccagccccctgctgcacaaggacagcgccagcctggaggtggtgaagaaggaccacgtggccctgcaggtgccccggggcaaggaggacagcaccctgcagctgctgcgggaggagaacagagccctgcagcagctgctggagcagaagcaggcctactgggcccaggccgaggacacagctgccccagctgaggagagcaagccagcccccagcccccatgaggagccctgcagccctggcctgctgcaggaccagggcagcggcctgagcagcagatttgaggagcccaagggccccccagcccggcaggaggacagcaaggagctgcgggccctgaggaagatggtgagcaacatgagcggccccagcggggaggaggaggccaaggtgggccctggcctgcctgatggctgccagcccctgcagctgctgcgggagatgaggcaggccctgcaggccctgctgaaggagaaccggctgctgcaggaggagaacagaaccctgcaggtgctgcgggcagagcaccggggcttccaggaggagaacaaggccctgtgggagaacaacaagctgaagctgcagcagaagctggtgattgacacagtgacagaggtgacagccaggatggagatgctgattgaggagctgtatgccttcatgcctgcccggagccaggaccccaagaagcccagccgggtgtag

SEQ ID NO: 18864 - DNA, 1002 bp, Artificial Sequence
  Description of Artificial Sequence: Synthetic coding sequence
atggctgctgctgctgctggaacagccaccagccagcgcttcttccagagcttcagtgatgccctgattgatgaggacccccaggccgccctggaggagctgaccaaggccctggagcagaagccagatgatgcccagtactactgccagagggcctactgccacatcctgctgggcaactactgtgtggccgtggctgatgccaagaagagcctggagctgaaccccaacaacagcacagccatgctgaggaagggcatctgtgagtaccacgagaagaactatgctgctgccctggagaccttcacagagggccagaagctggacagcgcagatgccaacttctctgtgtggatcaagcgctgccaggaggcccagaatggaagtgaaagtgaggtgtggacccaccagagcaagatcaagtatgactggtaccagacagagagccaggtggtgatcaccctgatgatcaagaatgtgcagaagaatgatgtgaatgtggagttcagcgagaaggagctgagcgccctggtgaagctgcccagcggggaggactacaacctgaagctggagctgctgcaccccatcatccctgagcagagcaccttcaaggtgctgagcaccaagattgagatcaagctgaagaagccagaggccgtgcgctgggagaagctggagggccagggagatgtgcccacccccaagcagtttgtggctgatgtgaagaacctgtaccccagcagcagcccctacaccaggaactgggacaagctggtgggggagatcaaggaggaggagaagaatgagaagctggagggagatgctgccctgaacagactcttccagcagatctacagtgatggcagtgatgaggtgaagagggccatgaacaagagcttcatggagagcggcggcaccgtgctgagcaccaactggagcgatgtgggcaagaggaaggtggagatcaaccccccagatgacatggagtggaagaagtactag

SEQ ID NO: 18865 - DNA, 1029 bp, Artificial Sequence
  Description of Artificial Sequence: Synthetic coding sequence
atgagcctgcacggcaagaggaaggagatctacaagtatgaggccccctggacagtgtatgccatgaactggagcgtgcggccagacaagcgcttccggctggccctgggcagctttgtggaggagtacaacaacaaggtgcagctggtgggcctggatgaggagagcagcgagttcatctgcaggaacacctttgaccacccctaccccaccaccaagctgatgtggatcccagacaccaagggcgtgtacccagacctgctggccaccagcggggactacctgcgggtgtggagggtgggggagacagagacccggctggagtgcctgctgaacaacaacaagaacagcgacttctgtgcccccctgaccagctttgactggaatgaggtggacccctacctgctgggcaccagcagcattgacaccacctgcaccatctggggcctggagaccggccaggtgctgggccgggtgaacctggtgtctggccacgtgaagacccagctgattgcccatgacaaggaggtgtatgacatcgccttcagcagagctgggggcggccgggacatgtttgcctctgtgggcgcagatggctctgtgaggatgtttgacctgcggcacctggagcacagcaccatcatctatgaggacccccagcaccaccccctgctgcggctgtgctggaacaagcaggaccccaactacctggccaccatggccatggatggcatggaggtggtgatcctggatgtgcgggtgccctgcacccctgtggcccggctgaacaaccaccgggcctgtgtgaatggcatcgcctgggccccccacagcagctgccacatctgcacagctgctgatgaccaccaggccctgatctgggacatccagcagatgccccgggccatcgaggaccccatcctggcctacacagctgagggggagatcaacaacgtgcagtgggccagcacccagcctgactggatcgccatctgctacaacaactgcctggagatcctgcgggtgtag

SEQ ID NO: 18866 - DNA, 507 bp, Artificial Sequence
  Description of Artificial Sequence: Synthetic coding sequence
atggccgagggcagccgcatcccccaggcccgggccctgctgcagcagtgcctgcacgcccggctgcagatccggccagcagatggagatgtggccgcccagtgggtggaggtgcagaggggcctggtgatctacgtgtgcttcttcaagggagctgacaaggagctgctgcccaagatggtgaacaccctgctgaatgtgaagctgtctgaaacagaaaatggcaagcacgtgtccatcctggacctgcccggcaacatcctgatcatcccccaggccaccctgggcggccgcctgaagggcaggaacatgcagtaccacagcaacagcggcaaggaggagggctttgagctgtacagccagtttgtgaccctgtgtgagaaggaggtggccgccaacagcaaatgtgccgaggcccgggtggtggtggagcacggcacctacggcaaccggcaggtgctgaagctggacaccaacggccccttcacccacctgattgagttctag

SEQ ID NO: 18867 - DNA, 3069 bp, Artificial Sequence
  Description of Artificial Sequence: Synthetic coding sequence
atggagggcgccctgacagcccgggacaaggtgggcgtgcaggactttgtgctgctggatgcctacaccagcgagagcgcctttgtggacaacctgaggaagcgcttcagcgagaacctgatctacacctacatcggcaccctgctggtgtctgtgaacccctaccaggagctgggcatctacacagtgtcccagatggagctgtaccagggcgtgaacttctttgagctgcccccccacgtgtatgccatcgctgacaatgcctacaggatgatgtgtgccgagctgaacaaccacttcatcctgatcagcggggagagcggggccggcaagacagaggccagcaagaagatcctggagtactttgctgtgacctgccccatgacccagagcctgcagatcgcccgggaccggctgctcttcagcaaccctgtgctggaggcctttggaaatgcccggaccctgagaaatgacaacagcagcagatttgggaagtacatggacatccagtttgacttccagggcatccctgtgggcggccacatcatctcctacctgattgagaagagccgggtggtgtaccagaatgaaggagagaggaacttccacatcttctaccagctgctggccggcggggaggaggagcggctgagctacctgggcctggagcgggacccccagctgtacaagtacctgagccagggccactgtgccaaggagagcagcatcagtgacaagaatgactggaagacagtgtccaatgccttctctgtgattgacttcacagaggccgacctggagaacctgtttggcatcatcgcctctgtgctgcacctgggcaacatcggctttgaggaggatgaccagggctgtgccaccatcccagacacccatgagatcaagtggatcgccaagctgctgggcgtgcaccccagcgtgctgctggaggccctgacccacaggaagattgaggccaagacagaggaggtgatctgccccctgaccctggagctgtctgtgtatgccagagatgccatggccaaggctgtgtatggccgcaccttcacctggctggtgaacaagatcaacagcagcctggtgaacaaggacttcaccaggaagacagtgattggcctgctggacatctacggctttgaggtgtttgacaagaatggatttgagcagttctgcatcaactactgcaatgagaagctgcagcagctgctgattgaaagaaccctgaaggccgagcaggccgagtatgagatggagggcatcgagtgggagcccatcaagtacttcaacaacaagatcatctgtgacctggtggaggagcggcacaagggcatcatcagcatcctggatgaggagtgcatccggcccggccctgccacagacctgtccttcctggagaagctggaggagaaggtgggcaagcacgcccactttgagaccaggaagctggccggccccaagggcaggaagagaattggctggatggagttccggctgctgcactacgccggggaggtgacctactgcaccaagggcttcctggagaagaacaatgacctgctgtaccgccacctgaaggaggtgctgtgcaagagcaagaacatcatcctgcgggagtgcttcctgctggccgagctggagaacagaagaagaccacccaccgtgggcacccagttcaagaacagcctgagcagcctgctggagaccctcatcagcaaggagcccagctacatccgctgcatcaagcccaatgacaggaaggagcccagcaagtttgatgacttcctgatccgccaccagatcaagtacctgggcctgatggagcacctgcgggtgcggcgggccggctttgcctacagaagaaaatatgagcacttcctgcagcgctacaagagcctgtgcccagacacctggccccactggcacggccccccagctgagggcgtggagcggctcatcaagtacatcggctacaagccagaggagtacaagctgggcaagaccaagatcttcatccgcttccccaggaccctgtttgccacagaagatgcctttgagttcagcaagcaccagctggtggcccgcatccaggccacctacaagcgctgcctgggcagaagagaatatgtgaagaagaggcaggccgccatcaagctggaggcccactggaggggggccctggccaggaaggccatccagaggaggaagtgggccgtgcgcatcatcaggaagttcatcaagggcttcatcagcaggaacaagcccctgtgcccagacaatgaggagttcatcgtgtttgtgaggaagaactacatcctgaacctgcgctaccacctgcccaagacagtgctggacaagtcctggctgcggcccccaggcatcctggagaatgccagtgacctgctgaggaagatgtgtgtgaggaacctggtgcagaagtactgccggggcatcacagctgagaggaaggccatgatgcagcagaaggtggtgaccagcgagatcttccggggcaggaaggatggctacacagagagcctgaaccagccctttgtgaacagcagaattgatgaaggagacatcaaccccaaggtgctgcagctgatcagccatgagaagatccagtatggagtgcctgtgatcaagtatgacaggaagggcttcaaggcccggcagaggcagctgatcctgacccagaaggccgcctacgtggtggagctggccaagatcaagcagaagattgagtacagcgccctgaagggcgtgtccaccagcaacctgagtgatggcatcctggtgatccacgtgtccccagaggacagcaagcagaagggagatgctgtgctgcagtgtggccacgtgtttgaggccgtgaccaagctggtgatgctggtgaagaaggaaaatattgtgaatgtggtgcagggcagcctgcagttcttcatcagccctgggaaggagggcaccatcgtgtttgacaccggcctggaggagcaggtgtacaagaacaagaatggccagctgactgtggtgtctgtgcggaggaagagctag

SEQ ID NO: 18868 - DNA, 1044 bp, Artificial Sequence
  Description of Artificial Sequence: Synthetic coding sequence
atgaacaccctgatggatgtgctgcggcaccggcccggctgggtggaggtgaaggatgaaggagagtgggacttctactggtgtgatgtgtcctggctgagagaaaattttgaccacacctacatggatgaacatgtgcgcatcagccacttcaggaaccactatgagctgaccaggaagaactacatggtgaagaacctgaagcgcttcaggaagcagctggagcgggaggccggcaagctggaggccgccaagtgtgacttcttccccaagacctttgagatgccctgtgagtaccacctgtttgtggaggagttcaggaagaaccctggcatcacctggatcatgaagcctgtggcccggagccagggcaagggcatcttcctgttccggcggctgaaggacatcgtggactggaggaaggacaccaggagcagtgatgaccagaaggatgacatccctgtggagaactacgtggcccagcgctacatcgagaacccctacctgattggaggcaggaagtttgacctgcgggtgtatgtgctggtgatgagctacatccccctgcgggcctggctgtacagagatggctttgcccgcttcagcaacacccgcttcaccctgaacagcattgatgaccagtatgtgcacctgaccaacgtggccgtgcagaagaccagcccagactaccaccccaagaagggctgcaagtggaccctgcagcgcttccggcagtacctggccagcaagcacggccctgaggccgtggagaccctcttccgggacatcgacaacatctttgtgaagagcctgcagagcgtgcagaaggtgatcatcagtgacaagcactgctttgagctgtatggctatgacatcctgattgaccaggacctgaagccctggctgctggaggtgaatgccagccccagcctgacagccagcagccaggaggactatgagctgaagacctgcctgctggaggacaccctgcacgtggtggacatggaggcccggagcctgcgggctgacagcccctgctggtag

SEQ ID NO: 18869 - DNA, 444 bp, Artificial Sequence
  Description of Artificial Sequence: Synthetic coding sequence
atgagcagcgagcccccacctccaccccagccccccacccaccaggcctctgtgggcctgctggacacccccaggagccgggagaggagccccagccccctgcggggaaatgtggtgcccagccccctgcccaccaggaggaccaggaccttcagcgccaccgtgcgggccagccagggccctgtgtacaagggcgtgtgcaagtgcttctgccgcagcaagggccacggcttcatcaccccagcagatggcggccctgacatcttcctgcacatcagtgatgtggagggggagtatgtgcctgtggagggagatgaggtgacctacaagatgtgcagcatcccccccaagaatgagaagctgcaggccgtggaggtggtgatcacccacctggcccctggcaccaagcatgagacctggagcggccacgtgatcagcagctag

SEQ ID NO: 18870 - DNA, 558 bp, Artificial Sequence
  Description of Artificial Sequence: Synthetic coding sequence
atggctgatggcggcggcggcggcggcaccggggctgtgggcggcggcggcaccagccaggccagcgctggagctgccactggagccaccggggccagcggcggcggcggccccatcaacccagccagcctgcccccaggggacccccagctgattgccctgattgtggagcagctgaagagccggggcctgtttgacagcttcagaagagactgcctggctgatgtggacaccaagccagcctaccagaacctgcggcagaaggtggacaactttgtgtccacccacctggacaagcaggagtggaaccccaccatgaacaagaaccagctgagaaatggcctgcggcagagcgtggtgcagagcggcatgctggaggccggcgtggaccgcatcatcagccaggtggtggaccccaagctgaaccacatcttccggccccagatcgagcgggccatccacgagttcctggccgcccagaagaaggctgctgtgcctgcccctcctcctgagcctgagggccaggaccccccagcccccagccaggacaccagctag

SEQ ID NO: 18871 - DNA, 6351 bp, Artificial Sequence
  Description of Artificial Sequence: Synthetic coding sequence
atggatgaggtggagcaggaccagcacgaggcccggctgaaggagctgtttgacagctttgacaccactggaacaggcagcctgggccaggaggagctgacagacctgtgccacatgctgagcctggaggaggtggcccctgtgctgcagcagaccctgctgcaggacaacctgctgggccgggtgcactttgaccagttcaaggaggccctgatcctgatcctgagcaggaccctgagcaatgaggagcacttccaggagccagactgcagcctggaggcccagcccaagtatgtgcggggcggcaagagatatggaagaagaagcctgcctgagttccaggagagcgtggaggagttccctgaggtgaccgtcatcgagcccctggatgaggaggcccggcccagccacatcccagctggggactgcagcgagcactggaagacccagaggtctgaggagtatgaagctgagggccagctgcgcttctggaacccagatgacctgaatgccagccagagcggcagcagccccccccaggactggattgaggagaagctgcaggaggtgtgtgaggacctgggcatcaccagagatggccacctgaacaggaagaagctggtgtccatctgtgagcagtatggcctgcagaatgtggatggagagatgctggaggaggtgttccacaacctggaccctgatggcaccatgtctgtggaggacttcttctacggcctcttcaagaatggcaagagcctgacccccagcgccagcaccccctaccggcagctgaagaggcacctgtccatgcagagctttgatgagagcggccgccgcaccaccaccagcagcgccatgaccagcaccatcggcttccgggtcttcagctgcctggatgatggcatgggccacgcctctgtggagcgcatcctggacacctggcaggaggagggcatcgagaacagccaggagatcctgaaggccctggacttcagcctggatggcaacatcaacctgacagagctgaccctggccctggagaatgagctgctggtgaccaagaacagcatccaccaggccgccctggccagcttcaaggccgagatccgccacctgctggagcgggtggaccaggtggtgcgggagaaggagaagctgcggagtgacctggacaaggccgagaagctgaagagcctgatggccagcgaggtggatgaccaccacgccgccattgaaagaagaaatgagtacaacctgaggaagctggatgaggagtacaaggagagaattgctgccctgaagaatgagctgaggaaggagcgggagcagatcctgcagcaggccggcaagcagaggctggagctggagcaggagattgagaaggccaagacagaggagaactacatccgggaccggctggccctgagcctgaaggagaacagccggctggagaatgagctgctggagaatgcagaaaatgtgctggccgagaagtttggagacctggaccccagcagcgctgagttcttcctgcaggaggagcggctgacccagatgagaaatgaatatgagcggcagtgccgggtgctgcaggaccaggtggatgagctgcagagcgagctggaggagtaccgggcccagggccgggtgctgcggctgcccctgaagaacagccccagcgaggaggtggaggccaacagcggcggcatcgagcctgagcacggcctgggcagcgaggagtgcaaccccctgaacatgagcattgaggccgagctggtgattgagcagatgaaggagcagcaccaccgggacatctgctgcctgcggctggagctggaggacaaggtgcgccactatgagaagcagctggatgagaccgtggtgtcctgcaagaaggcccaggagaacatgaagcagagacatgaaaatgagacccacaccctggagaagcagatcagtgacctgaagaatgaaattgctgagctgcagggccaggccgctgtgctgaaggaggcccaccacgaggccacctgcagacatgaggaggagaagaagcagctgcaggtgaagctggaggaggagaagacccacctgcaggagaagctgcggctgcagcacgagatggagctgaaggcccggctgacccaggcccaggccagctttgagcgggagcgggagggcctgcagagcagcgcctggacagaggagaaggtgcggggcctgacccaggagctggagcagttccaccaggagcagctgaccagcctggtggagaagcacaccctggagaaggaggagctgaggaaggagctgctggagaagcaccagcgggagctgcaggagggccgggagaagatggagacagagtgcaacagaaggaccagccagatcgaggcccagttccagagcgactgccagaaggtgacagagcgctgtgagagcgccctgcagagcctggagggccgctaccggcaggagctgaaggacctgcaggagcagcagcgggaggagaagagccagtgggagtttgagaaggatgagctgacccaggagtgtgccgaggcccaggagctgctgaaggagaccctgaagcgggagaagaccaccagcctggtgctgacccaggagcgggagatgctggagaagacctacaaggagcacctgaacagcatggtggtggagcggcagcagctgctgcaggacctggaggacctgagaaatgtgtctgagacccagcagagcctgctgagtgaccagatcctggagctgaagagcagccacaagcgggagctgcgggagcgggaggaggtgctgtgccaggccggggccagcgagcagctggccagccagaggctggagcggctggagatggagcatgaccaggagcggcaggagatgatgagcaagctgctggccatggagaacatccacaaggccacctgtgaaacagctgaccgggagagagctgagatgagcacagagatcagccggctgcagagcaagatcaaggagatgcagcaggccaccagccccctgtccatgctgcagagcggctgccaggtgattggagaggaggaggtggagggagatggagccctgagcctgctgcagcagggcgagcagctgctggaggagaatggagatgtgctgctgagcctgcagagggcccacgagcaggccgtgaaggaaaatgtgaagatggccacagagatcagccggctgcagcagaggctgcagaagctggagcccggcctggtgatgagcagctgcctggatgagcccgccacagagttctttggaaacacagctgagcagacagagcagttcctgcagcagaacagaaccaagcaggtggagggcgtgaccaggagacatgtgctgagtgacctggaggatgatgaggtgcgggacctgggcagcacaggcaccagctctgtgcagaggcaggaggtgaagattgaggagagcgaggcctctgtggagggcttcagcgagctggagaacagcgaggagaccaggacagagagctgggagctgaagaaccagatcagccagctgcaggagcagctgatgatgctgtgtgccgactgtgaccgggccagcgagaagaagcaggacctgctgtttgatgtgtctgtgctgaagaagaagctgaagatgctggagcgcatccctgaggccagccccaagtacaagctgctgtatgaagatgtgtccagagaaaatgactgcctgcaggaggagctgaggatgatggagaccaggtatgatgaggccctggagaacaacaaggagctgacagctgaggtgttccggctgcaggatgagctgaagaagatggaggaggtgacagagaccttcctgagcctggagaagagctatgatgaggtgaagattgaaaatgaaggcctgaatgtgctggtgctgcggctgcagggcaagattgagaagctgcaggagagcgtggtgcagagatgtgactgctgcctgtgggaggccagcctggagaacctggagattgaaccagatggcaacatcctgcagctgaaccagaccctggaggagtgtgtgccccgggtgcgctctgtgcaccacgtgattgaggagtgcaagcaggagaaccagtacctggagggcaacacccagctgctggagaaggtgaaggcccacgagatcgcctggctgcacggcaccatccagacccaccaggagcggccccgggtgcagaaccaggtgatcctggaggagaacaccaccctgctgggcttccaggacaagcacttccagcaccaggccaccatcgccgagctggagctggagaagaccaagctgcaggagctgaccaggaagctgaaggagcgggtgaccatcctggtgaagcagaaggatgtgctgagccatggagagaaggaggaggagctgaaggccatgatgcatgacctgcagatcacctgcagcgagatgcagcagaaggtggagctgctgcgctatgaaagtgagaagctgcagcaggagaacagcatcctgagaaatgagatcaccaccctgaatgaagaagattccatcagcaacctgaagctgggcaccctgaatggcagccaggaggagatgtggcagaagacagaaacagtgaagcaggagaatgctgctgtgcagaagatggtggagaacctgaagaagcagatcagcgagctgaagatcaagaaccagcagctggacctggagaacacagagctgagccagaagaacagccagaaccaggagaagctgcaggagctgaaccagaggctgacagagatgctgtgccagaaggagaaggagcccggcaacagcgccctggaggagcgggagcaggagaagttcaacctgaaggaggagctggagcgctgcaaggtgcagagcagcaccctggtgagcagcctggaggccgagctgtctgaggtgaagatccagacccacatcgtgcagcaggagaaccacctgctgaaggatgagctggagaagatgaagcagctgcaccgctgcccagacctgagtgacttccagcagaagatcagctctgtgctgagctacaatgagaagctgctgaaggagaaggaggccctgtctgaggagctgaacagctgtgtggacaagctggccaagagcagcctgctggagcacagaattgccaccatgaagcaggagcagaagtcctgggagcaccagagcgccagcctgaagagccagctggtggccagccaggagaaggtgcagaacctggaggacacagtgcagaatgtgaacctgcagatgagcaggatgaagagtgacctgcgggtgacccagcaggagaaggaggccctgaagcaggaggtgatgagcctgcacaagcagctgcagaatgctgggggcaagtcctgggcccctgagatcgccacccaccccagcggcctgcacaaccagcagaagaggctgtcctgggacaagctggaccacctgatgaatgaggagcagcagctgctgtggcaggagaatgaaaggctgcagaccatggtgcagaacaccaaggccgagctgacccacagccgggagaaggtgcggcagctggagagcaacctgctgcccaagcaccagaagcacctgaaccccagcggcaccatgaaccccacagagcaggagaagctgagcctgaagcgggagtgtgaccagttccagaaggagcagagccctgccaacaggaaggtgtcccagatgaacagcctggagcaggagctggagaccatccacctggagaatgaaggcctgaagaagaagcaggtgaagctggatgagcagctgatggagatgcagcacctgcggagcacagccacccccagccccagcccccacgcctgggacctgcagctgctgcagcagcaggcctgccccatggtgccccgggagcagttcctgcagctgcagaggcagctgctgcaggccgagcgcatcaaccagcacctgcaggaggagctggagaacagaacatctgagaccaacaccccccagggcaaccaggagcagctggtgacagtgatggaggagaggatgattgaggtggagcagaagctgaagctggtgaagaggctgctgcaggagaaggtgaaccagctgaaggagcagctgtgcaagaacaccaaggcagatgccatggtgaaggacctgtatgtggagaatgcccagctgctgaaggccctggaggtgacagagcagaggcagaagacagctgagaagaagaactacctgctggaggagaagatcgccagcctgagcaacatcgtgaggaacctgaccccagcccccctgaccagcaccccacccctgcggagctag

SEQ ID NO: 18872 - DNA, 2664 bp, Artificial Sequence
  Description of Artificial Sequence: Synthetic coding sequence
atgcccatcctgctcttcctgattgacaccagcgcctccatgaaccagaggagccacctgggcaccacctacctggacacagccaagggagctgtggagaccttcatgaagctgcgggcccgggaccctgccagcagaggagaccgctacatgctggtgacctttgaggagcccccctatgccatcaaggccggctggaaggagaaccacgccaccttcatgaatgagctgaagaacctgcaggccgagggcctgaccaccctgggccagagcctgaggacagcctttgacctgctgaacctgaaccggctggtgacaggcatcgacaactacggccagggcaggaaccccttcttcctggagcccgccatcatcatcaccatcacagatggcagcaagctgaccaccaccagcggcgtgcaggatgagctgcacctgcccctgaacagccccctgcccggcagcgagctgaccaaggagcccttccgctgggaccagaggctgtttgccctggtgctgcggctgcccggcaccatgtctgtggagagcgagcagctgactggagtgcccctggatgacagcgccatcacccccatgtgtgaggtgactggaggccgcagctacagcgtgtgcagccccaggatgctgaaccagtgcctggagagcctggtgcagaaggtgcagagcggcgtggtgatcaactttgagaaggccggccctgaccccagccctgtggaggatggccagcctgacatcagccggcccttcggcagccagccctggcacagctgccacaagctgatctacgtgcggcccaaccccaagacaggagtgcccatcggccactggcctgtgcctgagagcttctggccagaccagaacagccccaccctgccccccaggaccagccaccctgtggtgaagttcagctgcacagactgtgagcccatggtgattgacaagctgccctttgacaagtatgagctggagcccagccccctgacccagttcatcctggagaggaagagcccccagacctgctggcaggtgtatgtgagcaacagcgccaagtacagcgagctgggccaccccttcggctacctgaaggccagcacagccctgaactgtgtgaacctgtttgtgatgccctacaactaccctgtgctgctgcccctgctggatgacctcttcaaggtgcacaaggccaagcccaccctgaagtggaggcagagctttgagagctacctgaagaccatgccaccctactacctgggccccctgaagaaggctgtgaggatgatgggcgcccccaacctgattgctgacagcatggagtatggcctgagctacagcgtcatctcctacctgaagaagctgagccagcaggccaagattgaaagtgacagagtgattggctctgtgggcaagaaggtggtgcaggagaccggcatcaaggtgcgcagccgcagccacggcctgtccatggcctacaggaaggacttccagcagctgctgcagggcatcagtgaagatgtgccccaccggctgctggacctgaacatgaaggagtacacaggcttccaggtggccctgctgaacaaggacctgaagccccagaccttcagaaatgcctatgacatccccaggaggaacctgctggaccacctgaccaggatgaggagcaacctgctgaagagcacccggcgcttcctgaagggccaggatgaggaccaggtgcacagcgtgcccatcgcccagatgggcaactaccaggagtacctgaagcaggtgcccagccccctgcgggagctggaccctgaccagccccggcggctgcacacctttggaaaccccttcaagctggacaagaagggcatgatgattgatgaagcagatgaatttgtggccggcccccagaacaagcacaagaggcctggagagcccaacatgcagggcatccccaagagaagacgctgcatgagccccctgctgcggggccggcagcagaaccctgtggtgaacaaccacatcggcggcaagggccccccagcccccaccacccaggcccagcctgacctgatcaagcccctgcccctgcacaagatcagcgagaccaccaatgacagcatcatccatgatgtggtggagaaccacgtggccgaccagctgagcagtgacatcaccccaaatgccatggacacagagttcagcgccagcagccctgccagcctgctggagcggcccaccaaccacatggaggccctgggccatgaccacctgggcaccaatgacctgactgtgggcggcttcctggagaaccacgaggagccccgggacaaggagcagtgtgccgaggagaacatcccagccagcagcctgaacaagggcaagaagctgatgcactgccgcagccatgaggaggtgaacacagagctgaaggcccagatcatgaaggagatcaggaagccaggcaggaaatatgagcgcatcttcaccctgctgaagcacgtgcagggcagcctgcagaccaggctcatcttcctgcagaatgtcatcaaggaggccagccgcttcaagaagaggatgctgattgagcagctggagaacttcctggatgagatccaccggcgggccaaccagatcaaccacatcaacagcaactag

SEQ ID NO: 18873 - DNA, 1944 bp, Artificial Sequence
  Description of Artificial Sequence: Synthetic coding sequence
atgtctgatgaggtgttcagcaccaccctggcctacaccaagagccccaaggtgaccaagaggaccaccttccaggatgagctgatccgggccatcacagcccggagcgcccggcagaggagcagcgagtacagtgatgactttgacagtgatgaaattgtgtccctgggggacttcagtgacaccagcgcagatgagaacagcgtgaacaagaagatgaatgacttccacatcagtgatgatgaggagaagaaccccagcaagctgctcttcctgaagaccaacaagagcaatggaaacatcaccaaggatgagcctgtgtgtgccatcaagaatgaggaggagatggccccagatggctgtgaggacatcgtggtgaagagcttcagcgagagccagaacaaggatgaggagtttgagaaggacaagatcaagatgaagcccaagccccgcatcctgagcatcaagagcaccagcagcgctgagaacaacagcctggacacagatgaccacttcaagcccagcccccggcccaggtccatgctgaagaagaagagccacatggaggagaaggatggcctggaggacaaggagacagccctgtctgaggagctggagctgcacagcgcccccagcagcctgcccacccccaacggcatccagctggaggccgagaagaaggccttcagcgagaacctggaccctgaggacagctgcctgaccagcctggccagcagcagcctgaagcagatcctgggggacagcttcagccctggcagcgagggcaatgccagcggcaaggaccccaatgaggagatcacagagaaccacaacagcctgaagagtgatgagaacaaggaaaattccttctctgctgaccacgtgaccacagctgtggagaagagcaaggagagccaggtgacagcagatgacctggaggaggagaaggccaaggccgagctgatcatggatgatgacagaacagtggaccccctgctgagcaagagccagagcatcctgatcagcaccagcgccacagccagcagcaagaagaccatcgaggacaggaacatcaagaacaagaagagcaccaacaacagagccagcagcgccagcgcccggctgatgaccagcgagttcctgaagaagagcagcagcaagaggaggacccccagcaccaccaccagcagccactacctgggcaccctgaaggtgctggaccagaagcccagccagaagcagagcattgaaccagacagagctgacaacatccgggctgctgtgtaccaggagtggctggagaagaagaatgtgtacctgcacgagatgcaccgcatcaagagaattgaaagtgagaacctgcgcatccagaatgagcagaagaaggccgccaagcgggaggaggccctggccagctttgaggcctggaaggccatgaaggagaaggaggccaagaagattgctgccaagaagaggctggaggagaagaacaagaagaagacagaggaggagaatgctgccaggaaaggagaggccctgcaggcctttgagaagtggaaggagaagaagatggagtacctgaaggagaagaacaggaaggagcgggagtatgagcgggccaagaagcagaaggaggaggagaccgtggccgagaagaagaaggacaacctgacagctgtggagaagtggaatgagaagaaggaggccttcttcaagcagaaggagaaggagaagatcaatgagaagaggaaggaggagctgaagagagctgagaagaaggacaaggacaagcaggccatcaatgaatatgagaagtggctggagaacaaggagaagcaggagcgcatcgagaggaagcagaagaagaggcacagcttcctggagagcgaggccctgcccccctggagcccccccagcaggacagtgtttgccaaggtgttctag

SEQ ID NO: 18874 - DNA, 1074 bp, Artificial Sequence
  Description of Artificial Sequence: Synthetic coding sequence
atgcagaccttcctgaagggcaagagggtgggctactggctgtctgagaagaagatcaagaagctgaacttccaggcctttgctgagctgtgcaggaagaggggcatggaggtggtgcagctgaacctgagccggcccatcgaggagcagggccccctggatgtgatcatccacaagctgacagatgtgatcctggaggccgaccagaatgacagccagagcctggagctggtgcaccgcttccaggagtacattgatgcccaccctgagaccatcgtgctggaccccctgcctgccatccgcaccctgctggacaggagcaagagctatgagctgatcaggaagattgaggcctacatggaggatgaccgcatctgcagcccccccttcatggagctgaccagcctgtgtggagatgacaccatgaggctgctggagaagaatggcctgaccttccccttcatctgcaagaccagggtggcccacggcaccaacagccatgagatggccatcgtgttcaaccaggagggcctgaatgccatccagcccccctgtgtggtgcagaacttcatcaaccacaatgctgtgctgtacaaggtgtttgtggtgggggagagctacacagtggtgcagaggcccagcctgaagaacttctctgctggcaccagtgaccgggagagcatcttcttcaacagccacaacgtgtccaagccagagagcagctctgtgctgacagagctggacaagattgagggcgtgtttgagcggcccagtgatgaagtcatccgggagctgagccgggccctgcggcaggccctgggcgtgtccctgtttggcatcgacatcatcatcaacaaccagacaggccagcacgccgtcatcgacatcaatgccttccctggctatgagggcgtgtctgagttcttcacagacctgctgaaccacatcgccaccgtgctgcagggccagagcacagccatggccgcccccagcggggagttccgggccggggacctgtgctgtgacctgggcaagagcttccaggtgtttggccccccaccaccctgcctgtag

SEQ ID NO: 18875 - DNA, 852 bp, Artificial Sequence
  Description of Artificial Sequence: Synthetic coding sequence
atgctgcgctgtggccagatgatctttgcccaggccctggtgtgccgccacctgggccgggactggcgctggacccagaggaagaggcagcctgacagctacttctctgtgctgaatgccttcatcgacaggaaggacagctactacagcatccaccagatcgcccagatgggcgtgggggagggcaagagcatcggccagtggtacggccccaacacagtggcccaggtgctgaagaagctggccgtgtttgacacctggagcagcctggccgtgcacatcgccatggacaacacagtggtgatggaggagatccggcggctgtgcaggacctctgtgccctgtgccggggccacagccttccctgctgacagcgacagacactgcaatggcttccctgctggagctgaggtgaccaaccggcccagcccctggaggcccctggtgctgctgatccccctgcggctgggcctgacagacatcaatgaggcctacgtggagaccctgaagcactgcttcatgatgccccagagcctgggcgtcatcggcggcaagcccaacagcgcccactacttcatcggctacgtgggggaggagctgatctacctggacccccacaccacccagcctgctgtggagcccacagatggctgcttcatcccagatgagagcttccactgccagcaccccccctgcaggatgagcattgctgagctggaccccagcattgctgtggtgctgggcgtgggcaagcagggccgcctggtgcgcagcatcccctgggccccccggcccagctcctggtgtgccgctgtgctgggcgctgctgtggtgatgtgtggcaccccctag

SEQ ID NO: 18876 - DNA, 2160 bp, Artificial Sequence
  Description of Artificial Sequence: Synthetic coding sequence
atgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcctcttcaccaaggccgaggacaacaagtacctgctgacctgcaagacagcccggcagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgaccagggcctggagaaggacaacagcgagctgggcagcgagacccgctaccccctgctgctgcccaagggcgtggtgctgaagctgaagcctgtggccgaccgcttccccaagaaggcctggaggcagaagaggagctctgtgctgaagcccctgctgatccagcccagccccagcctgcagcccagcttcaaccctgggaagaccccagcccagagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgccatgcctcctgaggcccggaccagcttccccctgtctgagagccagaccctgctgagcagcgcccctgtgcccaaggtgatgatgcccagccctgccagctccatgttcaggaagccctacgtgagaagaagacccagcaagagaagaggagcccgggccttccgctgcatcaagccagcccctgtgatccacccagccagcgtcatcttcaccgtgcctgccaccaccgtgaagatcgtgtccctgggcggcggctgcaacatgatccagcctgtgaatgctgctgtggcccagagcccccagaccatccccatcgccaccctgctggtgaaccccaccagcttcccctgccccctgaaccagcccctggtggccagctctgtgagccccctcatcgtgtctggcaacagcgtgaacctgcccatccccagcaccccagaggacaaggcccacatgaatgtggacatcgcctgtgctgtggctgatggagaaaatgccttccagggcctggagcccaagctggagccccaggagctgagccccctgagcgccaccgtcttccccaaggtggagcacagccctggccccccacctgtggacaagcagtgccaggagggcctgtctgaaaattctgcctaccgctggacagtggtgaagacagaggagggccggcaggccctggagcccctgccccagggcatccaggagagcctgaacaacagcagccctggggacctggaggaggtggtgaagatggagccagaagatgccacagaggagatcagcggcttcctgtag

SEQ ID NO: 18877 - DNA, 1134 bp, Artificial Sequence
  Description of Artificial Sequence: Synthetic coding sequence
atggaggccgctgctgtgacagtgaccaggtctgccaccaggagaagaagacggcagctgcagggcctggccgcccctgaggccggcacccaggaggagcaggaggaccaggagccccggcccaggagaagaagacctggccgcagcatcaaggatgaggaggaggagaccgtcttccgggaggtggtgtccttctccccagaccccctgcctgtgcgctactatgacaaggacaccaccaagcccatctccttctacctgagcagcctggaggagctgctggcctggaagccccggctggaggatggcttcaacgtggccctggagcccctggcctgccggcagccccccctgagcagccagaggcccaggaccctgctgtgccacgacatgatgggcggctacctggatgaccgcttcatccagggctctgtggtgcagaccccctatgccttctaccactggcagtgcattgatgtgtttgtgtacttcagccaccacacagtgaccatcccccctgtgggctggaccaacacagcccacagacatggagtgtgtgtgctgggcaccttcatcacagagtggaatgaaggaggccgcctgtgtgaggccttcctggccggagatgagaggagctaccaggccgtggccgaccggctggtgcagatcacccagttcttccgctttgatggctggctgatcaacatcgagaacagcctgagcctggccgctgtgggcaacatgccacccttcctgcgctacctgaccacccagctgcaccggcaggtgcctgggggcctggtgctgtggtatgattctgtggtgcagagcggccagctgaagtggcaggatgagctgaaccagcacaacagagtcttctttgacagctgtgatggcttcttcaccaactacaactggagggaggagcacctggagaggatgctgggccaggccggggagaggagagcagatgtgtatgtgggcgtggatgtgtttgcccggggaaatgtggtgggcggccgctttgacacagacaagagcctggagctgatcaggaagcacggcttctctgtggccctgtttgcccctggctgcagcgtcttccctggggtgggcaacctgctgtgctgctag

SEQ ID NO: 18878 - DNA, 927 bp, Artificial Sequence
  Description of Artificial Sequence: Synthetic coding sequence
atgaggggcaagagaagaccccagaccagggctgcccggcggctggccgcccaggagagcagcgaggccgaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaccagcccctttgccaagagcctgggccacagcagaggagaggccgacctgtttgattctggggacatcttcagcactggaacaggcagccagagcgtggagaggaccaagcccaaggccaagattgctgaaaatcctgccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcagcagccagcaggatgtgatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcacaggcatccaggccaagaccaccaagcccaagagccgcagcgcccaggccgcccctgagcccaggtttgagcacaaggtgagcaacatctttgatgaccccctgaatgcctttggaggccagtag

SEQ ID NO: 18879 - DNA, 933 bp, Artificial Sequence
  Description of Artificial Sequence: Synthetic coding sequence
atgctgaagaacaagggccacagcagcaagaaggacaacctggccgtgaatgctgtggccctgcaggaccacatcctgcatgacctgcagctgaggaacctgtctgtggccgaccacagcaagacccaggtgcagaagaaggagaacaagagcctgaagagggacaccaaggccatcatcgacaccggcctgaagaagaccacccagtgccccaagctggaggacagcgagaaggagtatgtgctggaccccaagcccccacccctgaccctggcccagaagctgggcctcatcggccccccacctccacccctgagcagtgatgagtgggagaaggtgaagcagaggagcctgctgcagggcgacagcgtgcagccctgccccatctgcaaggaggagtttgagctgcggccccaggtgctgctgagctgcagccacgtgttccacaaggcctgcctgcaggcctttgagaagttcaccaacaagaagacctgccccctgtgcaggaagaaccagtaccagaccagggtcatccatgatggagcccggctcttccgcatcaagtgtgtgacccgcatccaggcctactggaggggctgtgtggtgaggaagtggtacagaaacctgaggaagacagtgcccccaacagatgccaagctgaggaagaagttctttgagaagaagttcacagagatcagccaccgcatcctgtgcagctacaacaccaacatcgaggagctgtttgctgagattgaccagtgcctggccatcaacagatctgtgctgcagcagctggaggagaagtgtggccacgagatcacagaggaggagtgggagaagatccaggtgcagaatgagaccagcgcctgctttgaggacccctgcctgggcgcccacggcagccacttcagcctgagcaacttcctgctgtag

SEQ ID NO: 18880 - DNA, 1119 bp, Artificial Sequence
  Description of Artificial Sequence: Synthetic coding sequence
atgagggtgggccctgtgcgcagcgccatgtctggggccagccagccccggggccctgccctgctcttccctgccacccggggcgtgcctgccaagaggctgctggatgctgatgatgctgctgctgtggccgccaagtgcccccggctgtctgagtgcagcagccccccagactacctgagccccccaggcagcccctgcagcccccagcccccacctgctgcccctggggccggcggcggcagcggcagcgcccctggccccagcagaattgctgactacctgctgctgcccctggccgagcgggagcacgtgtcccgggccctgtgcatccacacaggccgggagctgcgctgcaaggtgttccccatcaagcactaccaggacaagatccggccctacatccagctgcccagccacagcaacatcaccggcatcgtggaggtgatcctgggggagaccaaggcctacgtgttctttgagaaggactttggagacatgcacagctatgtgcgcagcaggaagaggctgcgggaggaggaggccgcccggctcttcaagcagatcgtgtctgctgtggcccactgccaccagagcgccatcgtgctgggggacctgaagctgaggaagtttgtgttcagcacagaggagaggacccagctgcggctggagagcctggaggacacccacatcatgaagggagaagatgatgccctgagtgacaagcacggctgcccagcctacgtgtccccagagatcctgaacaccaccggcacctacagcggcaaggctgctgatgtgtggagcctgggcgtgatgctgtacaccctgctggtgggccgctaccccttccatgacagcgaccccagcgccctcttcagcaagatcagaagaggccagttctgcatccctgagcacatcagccccaaggcccgctgcctgatccgcagcctgctgcggcgggagcccagcgagcggctgacagcccctgagatcctgctgcacccctggtttgagagcgtgctggagcccggctacattgattctgaaattggcaccagtgaccagatcgtgcctgagtaccaggaggacagcgacatcagcagcttcttctgctag

SEQ ID NO: 18881 - DNA, 1554 bp, Artificial Sequence
  Description of Artificial Sequence: Synthetic coding sequence
atggagacagacctgaacagccaggacaggaaggacctggacaagttcatcaagttctttgccctgaagacagtgcaggtgattgtgcaggcccggctgggggagaagatctgcaccaggagcagcagcagccccaccggcagtgactggttcaacctggccatcaaggacatccctgaggtgacccatgaggccaagaaggccctggccggccagctgcctgctgtgggccgctccatgtgtgtggagatcagcctgaagaccagcgagggggacagcatggagctggagatctggtgcctggagatgaatgagaagtgtgacaaggagatcaaggtgtcctacacagtgtacaaccggctgagcctgctgctgaagagcctgctggccatcaccagggtgaccccagcctaccgcctgagcaggaagcagggccacgagtatgtgatcctgtaccgcatctactttggagaggtgcagctgagcggcctgggggagggcttccagacagtgcgggtgggcaccgtgggcacccctgtgggcaccatcaccctgagctgtgcctaccgcatcaacctggccttcatgagcacccggcagtttgagaggaccccacccatcatgggcatcatcatcgaccactttgtggaccggccctaccccagcagcagccccatgcacccctgcaactacagaacagctggggaggacaccggggtcatctaccccagcgtggaggacagccaggaggtgtgcaccaccagcttcagcaccagcccccccagccagctgagcagcagccggctgagctaccagcctgctgccctgggcgtgggcagcgctgacctggcctaccctgtggtgtttgctgctggcctgaatgccacccacccccaccagctgatggtgcctgggaaggagggcggcgtgcccctggcccccaaccagcctgtgcacggcacccaggccgaccaggagcggctggccacctgcacccccagcgacaggacccactgtgccgccacccccagcagcagcgaggacacagaaacagtgagcaacagcagcgagggccgggccagcccccatgatgtgctggagaccatctttgtgaggaaggtgggcgcctttgtgaacaagcccatcaaccaggtgaccctgaccagcctggacatcccctttgccatgtttgcccccaagaacctggagctggaggacacagaccccatggtgaaccccccagacagccctgagacagagagccccctgcagggcagcctgcacagtgatggcagcagcggcggcagcagcggcaacacccatgatgactttgtgatgattgacttcaagccagccttcagcaaggatgacatcctgcccatggacctgggcaccttctaccgggagttccagaaccccccccagctgagcagcctgagcattgatattggagcccagagcatggccgaggacctggacagcctgcctgagaagctggccgtgcatgagaagaatgtgcgggagtttgatgcctttgtggagaccctgcagtag

SEQ ID NO: 18882 - DNA, 1488 bp, Artificial Sequence
  Description of Artificial Sequence: Synthetic coding sequence
atgtggaggggctgtgcccggagcaggaagaggaagaaggtggacaatgactacaatgccctgcgggagcggctgagcaccctgcctgacaagctgagctacaacatcatggtgcccttcggcccctttgccttcatgcctgggaagctggtgcacaccaatgaggtgacagtgctgctgggggacaactggtttgccaagtgcagcgccaagcaggccgtgggcctggtggagcacaggaaggagcacgtgaggaagaccattgatgacctgaagaaggtgatgaagaactttgagagccgggtggagttcacagaggacctgcagaagatgtctgatgctgctggggacatcgtggacatccgggaggagatcaagtgtgactttgagttcaaggccaagcacagaattgcccacaagccccacagcaagcccaagaccagtgacatctttgaagctgacatcgccaatgatgtgaagagcaaggacctgctggccgacaaggagctgtgggcccggctggaggagctggagcggcaggaggagctgctgggggagctggacagcaagccagacacagtgattgccaatggagaggacaccaccagcagcgaggaggagaaggaggacaggaacaccaacgtgaatgccatgcaccaggtgacagacagccacaccccctgccacaaggatgtggccagcagcgagcccttcagcggccaggtgaacagccagctgaactgcagcgtgaatggcagcagcagctaccacagtgatgatgatgatgatgatgatgatgatgatgatgatgacaacattgatgatgatgatggagacaatgaccacgaggccctgggcgtgggggacaacagcatccccaccatctacttcagccacacagtggagcccaagagggtgcgcatcaacacaggcaagaacaccaccctgaagttcagcgagaagaaggaggaggccaagaggaagaggaagaacagcactggaagtggccacagcgcccaggagctgcccaccatccgcaccccagctgacatctaccgggcctttgtggatgtggtgaatggagaatatgtgcccaggaagagcatcctgaagagccgcagccgggagaacagcgtgtgcagcgacaccagcgagagcagcgctgctgagtttgatgaccggcggggcgtgctgcggagcatcagctgtgaggaggccacctgcagcgacaccagcgagagcatcctggaggaggagccccaggagaaccagaagaagctgctgcccctgtctgtgaccccagaggccttcagcggcaccgtcatcgagaaggagtttgtgagccccagcctgaccccacctccagccatcgcccacccagccctgcccaccatccctgagaggaaggaggtgctgctggaggccagcgaggagaccgggaagagggtgtccaagttcaaggccgcccggctgcagcagaaggactag

SEQ ID NO: 18883 - DNA, 1458 bp, Artificial Sequence
  Description of Artificial Sequence: Synthetic coding sequence
atgtgccaggtgggggaggactatggagagcccgcccctgaggagcccccaccagccccccggcccagccgggagcagaagtgtgtgaagtgcaaggaggcccagcctgtggtggtgatccgggctggagatgccttctgccgggactgcttcaaggccttctacgtgcacaagttccgggccatgctgggcaagaacagactcatcttccctggagagaaggtgctgctggcctggagcggcggccccagcagcagctccatggtgtggcaggtgctggagggcctgagccaggacagcgccaagaggctgcgctttgtggccggggtcatctttgtggatgagggcgccgcctgtggccagagcctggaggagaggagcaagaccctggccgaggtgaagcccatcctgcaggccaccggcttcccctggcacgtggtggccctggaggaggtgttcagcctgccccccagcgtgctgtggtgcagcgcccaggagctggtgggcagcgagggcgcctacaaggctgctgtggacagcttcctgcagcagcagcacgtgctgggcgctgggggcggccctggccccacccagggcgaggagcagcccccccagccccccctggacccccagaacctggcccggcccccagccccagcccagacagaggccctgagccagctgttctgcagcgtgaggaccctgacagccaaggaggagctgctgcagaccctgcggacccacctgatcctgcacatggcccgggcccacggctacagcaaggtgatgaccggggacagctgcacccggctggccatcaagctgatgaccaacctggccctgggccgcggggccttcctggcctgggacaccggcttcagtgatgaaagacatggagatgtggtggtggtgcggcccatgagggaccacaccctgaaggaggtggccttctacaacagactcttctctgtgcccagcgtcttcaccccagctgtggacaccaaggcccctgagaaggccagcatccaccggctgatggaggccttcatcctgcggctgcagacccagttccccagcacagtgtccacagtgtaccgcaccagcgagaagctggtgaagggccccagagatggccctgctgctggggacagcggcccccgctgcctgctgtgcatgtgtgccctggatgtggatgctgctgacagcgccacagccttcggggcccagaccagcagccggctgagccagatgcagagccccatccccctgacagagaccaggaccccacctggcccctgctgcagccctggggtgggctgggcccagagatgtggccagggcgcctgccggcgggaggacccccaggcctgcatcgaggagcagctgtgctacagctgccgggtgaacatgaaggacctgggcctgggcctggccggggaccccggcctgagtgactag

SEQ ID NO: 18884 - DNA, 1353 bp, Artificial Sequence
  Description of Artificial Sequence: Synthetic coding sequence
atgagcctgcggctgagcagcgccagccgccgcagctgcccccggcccaccaccggcagcctgcggctgtatggaggcggcaccagctttggcaccggcaacagctgtggcatctctggaattggcagcggcttcagcagcgcctttggaggcagcagcagcggcggcaacacaggaggcggcaacccctgtgccggcttcaccgtgaatgaaagaggcctgctgtctggaaatgagaaggtgaccatgcagaacctgaatgaccggctggccagctacctggacagcgtgcacgccctggaggaggccaatgctgacctggagcagaagatcaagggctggtatgagaagtttggacctggcagctgccggggcctggaccatgactacagccgctacttccccatcattgatgacctgaagaaccagatcatcgccagcaccaccagcaatgccaatgctgtgctgcagattgacaatgcccggctgacagcagatgacttccggctgaagtatgaaaatgagctggccctgcaccagagcgtggaggctgatgtgaatggcctgcggcgggtgctggatgagatcaccctgtgcaggacagacctggagatccagtatgagaccctgtctgaggagatgacctacctgaagaagaaccacaaggaggagatgcaggtgctgcagtgtgccgccggcggcaatgtgaatgtggagatgaatgctgcccctggggtggacctgactgtgctgctgaacaacatgagagcagaatatgaggccctggccgagcagaacagaagagatgctgaggcctggttcaatgagaagagcgccagcctgcagcagcagatcagtgaagatgtgggcgccaccaccagcgccagaaatgagctgacagagatgaagaggaccctgcagaccctggagattgagctgcagagcctgctggccaccaagcacagcctggagtgcagcctgacagaaacagagagcaactactgtgcccagctggcccagatccaggcccagattggagccctggaggagcagctgcaccaggtgaggacagaaacagagggccagaagctggagtatgagcagctgctggacatcaagctgcacctggagaaggagattgagacctactgcctgctgattggaggagatgatggagcctgcaagagcggcggctacaagagcaaggactatggcagcggaaatgtgggcagccaggtgaaggaccctgccaaggccatcgtggtgaagaaggtgctggaggaggtggaccagaggagcaagatcctgaccacccggctgcacagcctggaggagaagagccagagcaactag

SEQ ID NO: 18885 - DNA, 2679 bp, Artificial Sequence
  Description of Artificial Sequence: Synthetic coding sequence
atggaccagcctgaggccccctgcagcagcacaggcccccggctggccgtggcccgggagctgctgctggccgccctggaggagctgagccaggagcagctgaagcgcttccgccacaagctgagagatgtgggcccagatggccgcagcatcccctggggccgcctggagcgggcagatgctgtggacctggccgagcagctggcccagttctacggccctgagcccgccctggaggtggccaggaagaccctgaagagagcagatgccagagatgtggccgcccagctgcaggagcggcggctgcagaggctgggcctgggcagcggcaccctgctgtctgtgtctgagtacaagaagaagtaccgggagcacgtgctgcagctgcacgcccgggtgaaggagagaaatgcccggtctgtgaagatcaccaagcgcttcaccaagctgctgattgcccctgagagcgctgcccctgaggaggccatgggccctgctgaggagcctgagcccggccgggccaggagaagtgacacccacaccttcaacagactcttcagaagagatgaggagggcagaagacccctgactgtggtgctgcagggccctgctggcatcggcaagaccatggccgccaagaagatcctgtatgactgggccgccggcaagctgtaccagggccaggtggactttgccttcttcatgccctgtggggagctgctggagcggcccggcaccaggagcctggccgacctgatcctggaccagtgcccagacagaggagcccctgtgccccagatgctggcccagccccagaggctgctcttcatcctggatggagcagatgagctgcctgccctgggcggccctgaggccgccccctgcacagacccctttgaagctgccagcggggcccgggtgctgggcggcctgctgagcaaggccctgctgcccacagccctgctgctggtgaccaccagggctgctgcccctggccgcctgcagggccgcctgtgcagcccccagtgtgccgaggtgcggggcttcagtgacaaggacaagaagaagtacttctacaagtacttcagagatgagcggcgggcagagcgggcctacagatttgtgaaggaaaatgagaccctgtttgccctgtgctttgtgccctttgtgtgctggatcgtgtgcaccgtgctgcggcagcagctggagctgggccgggacctgagcaggaccagcaagaccaccacctctgtgtacctgctcttcatcacctctgtgctgagcagcgcccctgtggctgatggcccccggctgcagggcgacctgaggaacctgtgccgcctggcccgggagggcgtgctgggccggcgggcccagtttgctgagaaggagctggagcagctggagctgcggggcagcaaggtgcagaccctcttcctgagcaagaaggagctgcccggggtgctggagacagaggtgacctaccagttcatcgaccagagcttccaggagttcctggccgccctgagctacctgctggaggatggaggagtgcccaggacagctgctggaggagtgggcaccctgctgcggggagatgcccagccccacagccacctggtgctgaccacccgcttcctgtttggcctgctgtctgctgagaggatgagggacatcgagcggcacttcggctgcatggtgtctgagcgggtgaagcaggaggccctgcgctgggtgcagggccagggccagggctgccctggggtggcccctgaggtgacagagggcgccaagggcctggaggacacagaggagcctgaggaggaggaggagggggaggagcccaactaccccctggagctgctgtactgcctgtatgagacccaggaggatgcctttgtgcggcaggccctgtgccgcttccctgagctggccctgcagagggtgcgcttctgcaggatggatgtggccgtgctgagctactgtgtgcgctgctgcccagctggccaggccctgcggctcatcagctgccgcctggtggccgcccaggagaagaagaagaagagcctgggcaagaggctgcaggccagcctgggcggcggcagcagcagccagggcaccaccaagcagctgcctgccagcctgctgcaccccctcttccaggccatgacagaccccctgtgccacctgagcagcctgaccctgagccactgcaagctgcctgatgctgtgtgccgggacctgtctgaggccctgcgggccgccccagccctgacagagctgggcctgctgcacaaccggctgtctgaggccggcctgaggatgctgtctgagggcctggcctggccccagtgccgggtgcagacagtgcgggtgcagctgcctgacccccagaggggcctgcagtacctggtgggcatgctgcggcagagccctgccctgaccaccctggacctgagcggctgccagctgcctgcccccatggtgacctacctgtgtgctgtgctgcagcaccagggctgcggcctgcagaccctgagcctggcctctgtggagctgtctgagcagagcctgcaggagctgcaggccgtgaagagggccaagccagacctggtgatcacccacccagccctggatggccacccccagccccccaaggagctgatcagcaccttctag

SEQ ID NO: 18886 - DNA, 1047 bp, Artificial Sequence
  Description of Artificial Sequence: Synthetic coding sequence
atgggcaaggactactacaagatcctgggcatccccagcggggccaatgaagatgagatcaagaaggcctacaggaagatggccctgaagtaccacccagacaagaacaaggagcccaatgctgaggagaagttcaaggagattgctgaggcctatgatgtgctgagtgaccccaagaagaggggcctgtatgaccagtatggagaggagggcctgaagacaggaggcggcaccagcggcggcagcagcggcagcttccactacaccttccatggagacccccacgccacctttgccagcttcttcggcggcagcaacccctttgacatcttctttgccagcagccgcagcacccggcccttcagcggctttgatcctgatgacatggatgtggatgaagatgaggacccctttggagccttcggccgcttcggcttcaacggcctgagccggggcccccggcgggcccctgagcccctgtaccccaggaggaaggtgcaggacccccctgtggtgcatgagctgcgggtgtccctggaggagatctaccacggcagcaccaagaggatgaagatcacccggcggcggctgaacccagatggccgcacagtgaggacagaggacaagatcctgcacatcgtcatcaagaggggctggaaggagggcaccaagatcaccttccccaaggagggagatgccaccccagacaacatcccagctgacatcgtgtttgtgctgaaggacaagccccacgcccacttcagaagagatggcaccaacgtgctgtacagcgccctgatcagcctgaaggaggccctgtgtggctgcaccgtgaacatccccaccattgatggccgggtcatccccctgccctgcaatgatgtgatcaagccaggcaccgtgaagaggctgcggggggagggcctgcccttccccaaggtgcccacccagagaggagacctgattgtggagttcaaggtgcgcttcccagaccggctgaccccccagacccggcagatcctgaagcagcacctgccctgcagctag

SEQ ID NO: 18887 - DNA, 1899 bp, Artificial Sequence
  Description of Artificial Sequence: Synthetic coding sequence
atggacaccatgatgctgaatgtgaggaacctgtttgagcagctggtgagaagagtggagatcctgtctgagggcaatgaggtgcagttcatccagctggccaaggactttgaggacttcaggaagaagtggcagaggacagaccacgagctgggcaagtacaaggacctgctgatgaaggccgagacagagaggtctgccctggatgtgaagctgaagcacgccaggaaccaggtggatgtggagatcaagaggcggcagagagctgaggccgactgtgagaagctggagcggcagatccagctgatccgggagatgctgatgtgtgacaccagcggcagcatccagctgtctgaggagcagaagagcgccctggccttcctgaacagaggccagcccagcagcagcaatgccggcaacaagaggctgagcaccattgatgaaagtggcagcatcctgagtgacatcagctttgacaagacagatgagagcctggactgggacagcagcctggtgaagaccttcaagctgaagaagcgggagaagagaagaagcaccagccggcagtttgtggatggccccccaggccctgtgaagaagaccaggagcatcggcagcgctgtggaccagggcaatgaaagcatcgtggccaagaccaccgtgacagtgcccaatgatggcggccccatcgaggccgtgtccaccatcgagaccgtgccctactggaccaggagcaggaggaagacaggcaccctgcagccctggaacagcgacagcaccctgaacagccggcagctggagcccaggacagaaacagacagcgtgggcaccccccagagcaatggaggcatgaggctgcatgactttgtgtccaagacagtcatcaagccagagagctgtgtgccctgtgggaagaggatcaagtttgggaagctgagcctgaagtgccgggactgccgggtggtgagccaccctgagtgccgggaccgctgccccctgccctgcatccccaccctcatcggcacccctgtgaagatcggggagggcatgctggccgactttgtgtcccagaccagccccatgatccccagcatcgtggtgcactgtgtgaatgaaattgagcagaggggcctgacagaaacaggcctgtaccgcatcagcggctgtgacagaacagtgaaggagctgaaggagaagttcctgcgggtgaagacagtgcccctgctgagcaaggtggatgacatccacgccatctgcagcctgctgaaggacttcctgaggaacctgaaggagcccctgctgaccttccggctgaacagagccttcatggaggccgctgagatcacagatgaggacaacagcattgctgccatgtaccaggccgtgggggagctgccccaggccaacagagacaccctggccttcctgatgatccacctgcagagggtggcccagagcccccacaccaagatggatgtggccaacctggccaaggtgtttggccccaccatcgtggcccatgctgtgcccaacccagaccctgtgaccatgctgcaggacatcaagaggcagcccaaggtggtggagcggctgctgagcctgcccctggagtactggagccagttcatgatggtggagcaggagaacatcgaccccctgcacgtgattgagaacagcaatgccttcagcaccccccagaccccagacatcaaggtgtccctgctgggccctgtgaccaccccagagcaccagctgctgaagacccccagcagcagcagcctgagccagagggtgcgcagcaccctgaccaagaacacccccaggtttggcagcaagagcaagagcgccaccaacctgggccggcagggcaacttctttgccagccccatgctgaagtag

SEQ ID NO: 18888 - DNA, 12075 bp, Artificial Sequence
  Description of Artificial Sequence: Synthetic coding sequence
atgagcagcgagcaggacaagagcgccagcaaggagaagagcaagaagcctgtgcgcttcctgccccagctgtccatggagaagctggccagcaaggagaagttcaaggccccagcccgggccctgccccagctgtccatggtgtccaccaagccccactggcagcaggccgcccccagcttccacctgtctgtgaagcaggatgatgagagccctgagcccttctctgtgaagaatgagcagagccacgccgagtacatggagagatttgggaagaagggcaagctgccccaccaggtggatgacagctatgtgggccccagcaccagcaagagcaagggcaagagcccccacaaggagcgggagaacttccgcagcaccctggtgaatgtcatcatgcagcaggatgctgacctggacagcgctgtgcctgatggcagcaccatccccaagcccacagccagcgccatcgagaaggacatcctgcgctactactactacatccaccacggcatcgacacagaccacgtggcccccatggaggacagctggctggagcacgtgctggacctggtgccccagcacctgaaggtgttcacagacagcatcgtgaccctgagtgatgagatgagggaggactacctgctgtctgtgaggaagagcatcgtggactttgtgctgaaggacccccgggagaagggagatgacaagaagacagatgagctgcctgcccacagagctgagatggagatcctgcccaagccctggaggaagagcttcctggccgccagcagctacatccgggaccacctgaatgccatgaaccccaccatgctggccgtgctggacctgtggcacaccaacttcaagaagctgcggctggtggacatcaaggagttccacaactgccaggatgccctggagctgagcagcttccagaacatcatcatgaggcacatggacagcgccaaggagaccctgctgaagatgtggttccctgaggtgcagaacatctactaccagggcaacaagaagaagcagctgcccaccggggacagcagcgccaagctggagagcttcttcaactgtgccgccgccctgatgaccctgcagctgcaggacctgaccctggtgtccatgcaggacttcacagacctgattgcccagcccccagattctgtgcgggcctttgagcaccctggcttcatcatgaggctcatcctggacaatgacaccatcaagtttgagcctgagctgagtgactacatcgacatcttcctgaatgtgtatgatgtgatgatcaaggctgtgtcctttgtgccccgggtggagaccaagctgtacagcaagtgggagagcaagagcaagcccaccaccctgaagcccatcatcctgaatgagatcgtggatgcccacaaggagaagatcaaggaggtgatcatgaaggagagcgtggcccccacagagcacctgcggctgtatgacaagtatgacttcctgatcaccaggaaggccgagagagatgtggacaacttcctggccgagaaccacagctatgagaagatcattgatgagatctgcaagtaccagaagctgattgaggagatccagtacaccagcatcaagaccatccggctgggcatgtttgagatgcactgtgaggagctgatccgggccctggtgaagagagctgacatcatctgtgggaagctgctggccaagatgttccgggaccaccaggaggtgaacacccggctgtgtgatgaatttgaaagaattgctgagaaggccctgagcaccccacccaacacagctgagctgatggagatgaaggcctacatccagaaggtggaggtgacagacatgattgagctggagcagaggctggtggacagcaagaactgcctggccttcctgattgaatatgtgaacttctccccagctgacatgaggctgaacaacagcgtcttccagtggtacggccgcatgggagagatctttgaggagcacaggaagatcatcaaggagaagattgagcagtaccaggagggcctgaagctgcgctgtgaaagatttgtggaggagctggagagctatgccaagcagagcgaggagttctacagctttggagacctgcaggatgtgcagcgctacctgaagaaggcccagatcctgaatggcaagctggacctggccgctgacaagattgagcagttcaatgctgaggaggaggccttcggctggctgcccagcgtgtacccccagaggaagaagatccaggacggcctgaacccctacctgcggctgtatgaaacagctgtggagttcagcagcaactaccgggcctggacagagggcccctaccacaaggtgaacccagaccaggtggaggccgacatcggcaactactggaggggcctgtacaagctggagaagaccttccatgacagcccctatgccctggccatgaccaagaaggtgcgcagcaaggtggaggacttcaagcagcacatccccctcatccaggtgatctgcaaccctggcctgcggcccaggcactgggaggccatgtctgccatcgtgggctaccccctgcagcccagtgatgacagcacagtgtcctccttcctggacatgaacctggagccctacatcgacagatttgagggcatcagcgaggccgccagcaaggagtacagcctggagaaggccatggagaagatgatcacagagtgggatgctgtggagtttgtgatccacagctaccgggagaccggcaccttcatcctggcctctgtggatgagatccagatgctgctggatgaccacatcatcaagacccagaccatgaggggcagccccttcatcaagccctatgagaagcagatgagggagtgggagggcaagctgctgctgctgcaggagatcctggatgagtggctgaaggtgcaggccacctggctgtacctggagcccatcttcagcagcccagacatcatgagccagatgcctgaggagggccgccgcttcaccgctgtggacaagacctggagggacatcatgaggtctgtgatgcaggacaagcacgtgctgactgtggtgaccatcgacaggatgctggagcggctgaagaagagcaatgagctgctggagctgatcctgaagggcctgaatgagtacctggagaagaagaggctcttcttcccccgcttcttcttcctgagcaatgatgagctgctggagatcctgtctgagaccaaggaccccaccagggtgcagccccacctgaagaagtgctttgagggcatcgccaaggtggagttcacagagaccctggacatcacccacatgaagagcagcgagggggaggtggtggagctgattgagatcatcagcacagccaaggcccggggccaggtggagaagtggctggtggagctggagcgggtgatgatcaacagcatccacaaggtgactggagatgccacctttgcctacaccaagtatgagcgcatcaactgggtgcgggactggccaggccagacagtgctgtgtgtgtcccagatcttctggaccaaggaggtgcagacagccatccccatgggcatcaaggccctggagcagtacctgaagacctgcaaccggcagattgatgacatcgtgaccctggtgcggggcaagctgtccatgcagaacagagtgaccctgggcgccctggtggtgctggatgtgcacgccagagatgtgctgagcagcctggtgaagaagaacatcagtgatgacagcgactttgagtggctgagccagctgcgctactactggcaggagaaccacctggagaccaagatgatcaatgccggcctgcgctatggctatgagtacctgggcaacagcccccggctggtgatcacccccctgacagaccgctgctaccgcaccctgtttggagccctgcacctgcacctgggcggggcccctgagggccctgctggcaccgggaagacagagaccaccaaggacctggccaaggctgtggccaagcagtgtgtggtgttcaactgcagtgatggcctggactacctggccctgggcaagttcttcaagggcctgctgagctgtggggcctgggcctgctttgatgagttcaacagaattgacctggaggtgctgtctgtggtggcccagcagatcctgaccatccagaggggcatcaatgctggagctgacatcctgatgtttgagggcacagagctgaagctggaccccacctgtgctgtgttcatcaccatgaaccctggctacgccggccgctctgagctgcctgacaacctgaaggccctcttcagaacagtggccatgatggtgcctgactatgccatgattgctgagatcgtgctgtacagctgtggctttgtgacagcccggcccctgtctgtgaagatcgtggccacctaccgcctgtgcagcgagcagctgagcagccagcaccactatgactatggcatgagagctgtgaagtctgtgctgacagctgctggcaacctgaagctgaagtacccaaatgaaaatgaggagatcctgctgctgcggagcatcattgatgtgaacctgcccaagttcctgagccatgacctgcccctgtttgagggcatcaccagtgacctcttccctggggtgaagctgcccaagccagactacaatgacctgctggccgccatcaaggacaactgtgcctccatgaacctgcagatgacagccttcttcagcgagaagatcctgcaggtgtatgagatgatgattgtgagacatggcttcatgattgtgggggagccctttggaggcaagaccagcgcctacagagtgctggccggggccctgaatgacatctgtgagaagggcctgatggaggagaacaaggtgcagatcaccgtgctgaaccccaagtctgtgaccatgggccagctgtatggccagtttgattctgtgtcccatgagtggagcgatggagtgctggccgtgtccttccgggcctttgccagctctgtgaccccagacaggaagtggctgatctttgatggccctgtggatgctgtgtggattgagaacatgaacacagtgctggatgacaacaagaagctgtgcctgatgtctggagagatcatccagatgagcccccagatgaacctgatctttgagcccatggacctggaggtggccagccctgccaccgtgagccgctgtggcatgatctacatggagccccacatgctgggctggaggcccctgatgctgtcctgggtgaacctgctgcctgcctctgtgtctgtcatccagaaggagttcatcatgggcctgtttgacaggatggtgcctgtgtctgtggagttcatcaggaagcacaccaaggagctgagccccaccagtgacaccaacctggtgcgcagcctgatgaacctgattgactgcttcatggatgactttgctgatgaggtgaagctgaaggagagaaatgaccgggagacctacagcctgctggagggcatcttcctgttcagcctcatctggagcgtgggcgccagctgcacagatgatgaccggctgaagttcaacaagatcctgcgggagctgatggagagccccatcagtgacaggaccaggaacaccttcaagctgcagagcggcacagagcagaccagcagcaaggccctgactgtgcccttccctgagaagggcaccatctatgactaccagtttgtgacagagggcatcggcaagtgggagccctggatcaagaagctgaaggaggccccacccatccccaaggatgtgatgtttaatgagatcatcgtgcccaccctggacaccatccgctacagcgccctgatggagctgctgaccacccaccagaagcccagcatctttgtgggccccaccggcaccgggaagtctgtgtacatcaccaacttcctgctgaaccagctgaacaaggagatctacaagcccctgctgatcaacttcagcgcccagaccacagctgcccagacccagaacatcgtgatgagcaagctggacaagaggaggaagggcgtgtttggaccacccctgggcaagaggatggtggtgtttgtggatgatgtgaacatgcctgcccgggaggtgtatggagcccagccccccatcgagctgctgcggcagtggctggaccactggaactggtatgacctgaaggactgcagcatgatcaagctggtggacatccagatcatgtgtgccatgggccccccaggcggcggcagaaatcctgtgaccccccgctacatgaggcacttcaacatcatcaccatcaatgagttcagtgacaagtccatgtacaccatcttcagccgcatcctgacctggcacctggagatctgctacaagttcccagatgagttcctggacctgaccacccagatcgtgaatggcaccatgaccctgtacaaggaggccatgaagaacctgctgcccaccccagccaagagccactacctgttcaacctgcgggacttcagcagggtcatccagggcgtgtgcctgagcaggcctgagaccacagagaccacagaggtgatcaagaggctgtgggtgcatgaggtgctgcgggtgtactatgaccggctgctggacaacacagaccgctcctggctgatcaactacatccaggagatcctgaggaactacatgtatgaggacttccacgagctgttccagaggctggactttgacaatgatggcatggtggaggctgatgacctgcggagcctgatgttctgtgacttccatgaccccaagcgggaggacaccaactaccgggagattgctgatgtggacaacctgaggatgattgtggagatccacctggaggagtacaacaacatcagcaagaagcccatgaacctggtgctcttccgctttgccatcgagcacatcagccgcatcagccgcatcctgaagcagcccaggagccacgccctgctggtgggcgtgggcggcagcggccggcagagcgtgacccggctggccgcccacatggctgactacagcgtcttccaggtggagatcagcaagggctatgacaccacagagtggcatgaggacctgaaggtgatcctgaggaaatgtgccgagggggagatgcagggcgtcttcctgttcacagacacccagatcaaggaggagagcttcctggaggatgtgagcaacctgctgaatgctggggagatccccaacctgtttgccctggatgagaagcaggagatctgtgacaagatgaggcagctggaccggcagagggacaagaccaagcagacagatggcagccccatcgccctcttcaacatgttcatcgaccactgccgcagccagctgcacgtggtgctggccatgagccccatcggagatgccttcaggaaccggctgaggaagtttcctgccctggtgaactgctgcaccatcgactggttccagagctggccagaagatgccctgcaggccgtggccagccgcttcctggaggagattgagatgtctgaggagatcagagatggctgcatcgacatgtgcaagagcttccacaccagcaccatcgacctgagcaagagcttctttgtggagctgcagcgctacaactacgtgacccccaccagctacctggagctgatcagcaccttcaagctgctgctggagaagaagaggtctgaggtgatgaagatgaagaagagatatgaggtgggcctggagaagctggacagcgccagcagccaggtggccaccatgcagatggagctggaggccctgcacccccagctgaaggtggccagcaaggaggtggatgagatgatgatcatgattgagaaggagagcgtggaggtggccaagacagagaagatcgtgaaggcagatgagaccatcgccaatgagcaggccatggccagcaaggccatcaaggatgaatgtgatgctgacctggccggggccctgcccatcctggagagcgccctggccgccctggacaccctgacagcccaggacatcaccgtggtgaagtccatgaagagccccccagctggggtgaagctggtgatggaggccatctgcatcctgaagggcatcaaggctgacaagatcccagaccccaccggcagcggcaagaagattgaggacttctggggccctgccaagaggctgctgggggacatgaggttcctgcagagcctgcatgaatatgacaaggacaacatccccccagcctacatgaacatcatcaggaagaactacatccccaacccagactttgtgcctgagaagatcagaaatgccagcacagctgctgagggcctgtgcaagtgggtgattgccatggacagctatgacaaggtggccaagatcgtggcccccaagaagatcaagctggccgctgctgagggggagctgaagatcgccatggatggcctgaggaagaagcaggccgccctgaaggaggtgcaggacaagctggcccggctgcaggacaccctggagctgaacaagcagaagaaggctgacctggagaaccaggtggacctgtgcagcaagaagctggagcgggcagagcagctgattggaggcctgggcggggagaagacccgctggagccacacagccctggagctgggccagctgtacatcaacctgactggagacatcctgatcagcagcggcgtggtggcctacctgggcgccttcaccagcacctaccggcagaaccagaccaaggagtggaccaccctgtgcaagggccgggacatcccctgcagtgatgactgcagcctgatgggcaccctgggggaggccgtgaccatccgcacctggaacattgctggcctgcccagcgacagcttcagcattgacaatggcatcatcatcatgaatgcccggcgctggcccctgatgattgacccccagagccaggccaacaagtggatcaagaacatggagaaggccaacagcctgtatgtgatcaagctgtctgagccagactatgtgaggaccctggagaactgcatccagtttggcacccctgtgctgctggagaatgtgggggaggagctggaccccatcctggagcccctgctgctgaagcagaccttcaagcagggcggcagcacctgcatccggctgggggacagcaccattgaatatgccccagacttccgcttctacatcaccaccaagctgaggaacccccactacctgcctgagacctctgtgaaggtgaccctgctgaacttcatgatcaccccagagggcatgcaggaccagctgctgggcatcgtggtggcccaggagaggccagacctggaggaggagaagcaggccctgatcctgcagggcgctgagaacaagaggcagctgaaggagattgaggacaagatcctggaggtgctgagcagcagcgagggcaacatcctggaggatgaaacagccatcaagatcctgagcagcagcaaggccctggccaatgagatcagccagaagcaggaggtggccgaggagacagagaagaagattgacaccaccaggatgggctaccggcccatcgccatccacagcagcatcctcttcttcagcctggccgacctggccaacatcgagcccatgtaccagtacagcctgacctggttcatcaacctcttcatcctgagcattgaaaattctgagaagtctgagatcctggccaagaggctgcagatcctgaaggaccacttcacctacagcctgtatgtgaatgtgtgccgcagcctgtttgagaaggacaagctgctcttctccttctgcctgaccatcaacctgctgctgcacgagcgggccatcaacaaggccgagtggaggttcctgctgactggaggcatcggcctggacaacccctatgccaacctgtgcacctggctgccccagaagtcctgggatgagatctgccgcctggatgacctgcctgccttcaagaccatccggcgggagttcatgaggctgaaggatggctggaagaaggtgtatgacagcctggagccccaccacgaggtgtttcctgaggagtgggaggacaaggccaatgagttccagaggatgctgatcatccgctgcctgcggccagacaaggtgatccccatgctgcaggagttcatcatcaaccggctgggccgggccttcatcgagcccccaccatttgacctggccaaggcctttggagacagcaactgctgtgcccccctcatctttgtgctgagccctggagctgaccccatggccgccctgctgaagtttgctgatgaccagggctatggaggcagcaagctgagcagcctgagcctgggccagggccagggccccatcgccatgaagatgctggagaaggctgtgaaggagggcacctgggtggtgctgcagaactgccacctggccacctcctggatgcccaccctggagaaggtgtgtgaggagctgagccctgagagcacccacccagacttcaggatgtggctgaccagctaccccagccccaacttccctgtgtctgtgctgcagaatggagtgaagatgaccaatgaggcccccaagggcctgcgggccaacatcatccgcagctacctgatggaccccatcagtgaccctgagttcttcggcagctgcaagaagccagaggagttcaagaagctgctgtatggcctgtgcttcttccacgccctggtgcaggagaggaggaagtttggccccctgggctggaacatcccctatgagttcaatgaaacagacctgcgcatctctgtgcagcagctgcacatgttcctgaaccagtatgaggagctgccctatgaggccctgcgctacatgactggagagtgcaactacggcggccgggtgacagatgactgggacaggaggaccctgcggagcatcctgaacaagttcttcaaccctgagctggtggagaacagcgactacaagtttgacagcagcggcatctactttgtgccccccagcggggaccacaagagctacatcgagtacaccaagaccctgcccctgaccccagcccctgagatcttcggcatgaatgccaatgctgacatcaccaaggaccagagcgagacccagctgctgtttgacaacatcctgctgacccagagccgctctgctggggccggggccaagagcagtgatgaggtggtgaatgaggtggccagtgacatcctgggcaagctgcccaacaactttgacatcgaggccgccatgaggcgctaccccaccacctacacccagagcatgaacacagtgctggtgcaggagatgggccgcttcaacaagctgctgaagaccatccgggacagctgtgtgaacatccagaaggccatcaagggcctggccgtgatgagcacagacctggaggaggtggtgagcagcatcctgaatgtgaagatccctgagatgtggatgggcaagagctaccccagcctgaagcccctgggcagctatgtgaatgacttcctggcccggctgaagttcctgcagcagtggtatgaggtgggccccccacctgtgttctggctgagcggcttcttcttcacccaggccttcctgaccggggcccagcagaactatgccaggaagtacaccatccccatcgacctgctgggctttgattatgaggtgatggaggacaaggagtacaagcaccccccagaagatggagtcttcatccacggcctcttcctggatggagcctcctggaacaggaagatcaagaagctggccgagagccaccccaagatcctgtatgacacagtgcctgtgatgtggctgaagccctgcaagagagctgacatccccaagaggcccagctatgtggcccccctgtacaagaccagcgagaggagaggagtgctgagcaccaccggccacagcaccaacttcgtcatcgccatgaccctgcccagcgaccagcccaaggagcactggattggccggggcgtggccctgctgtgccagctgaacagctag

SEQ ID NO: 18889 - DNA, 1506 bp, Artificial Sequence
  Description of Artificial Sequence: Synthetic coding sequence
atgagcagccggcaggacaagagcgccagcaaggagaagagcaagaagcctgtgcgcttcctgccccagctgtccatggagaagctggccagcaaggagaagttcaaggccccagcccgggccctgccccagctgtccatggtgtccaccaagccccactggcagcaggccgcccccagcttccacctgtctgtgaagcaggatgatgagagccctgagcccttctctgtgaagaatgagcagagccacgccgagtacatggagagatttgggaagaagggcaagctgccccaccaggtggatgacagctatgtgggccccagcaccagcaagagcaagggcaagagcccccacaaggagcgggagaacttccgcagcaccctggtgaatgtcatcatgcagcaggatgctgacctggacagcgctgtgcctgatggcagcaccatccccaagcccacagccagcgccatcgagaaggacatcctgcgctactactactacatccaccacggcatcgacacagaccacgtggcccccatggaggacagctggctggagcacgtgctggacctggtgccccagcacctgaaggtgttcacagacagcatcgtgaccctgagtgatgagatgagggaggactacctgctgtctgtgaggaagagcatcgtggactttgtgctgaaggacccccgggagaagggagatgacaagaagacagatgagctgcctgcccacagagctgagatggagatcctgcccaagccctggaggaagagcttcctggccgccagcagctacatccgggaccacctgaatgccatgaaccccaccatgctggccgtgctggacctgtggcacaccaacttcaagaagctgcggctggtggacatcaaggagttccacaactgccaggatgccctggagctgagcagcttccagaacatcatcatgaggcacatggacagcgccaaggagaccctgctgaagatgtggttccctgaggtgcagaacatctactaccagggcaacaagaagaagcagctgcccaccggggacagcagcgccaagctggagagcttcttcaactgtgccgccgccctgatgaccctgcagctgcaggacctgaccctggtgtccatgcaggacttcacagacctgattgcccagcccccagattctgtgcgggcctttgagcaccctggcttcatcatgaggctcatcctggacaatgacaccatcaagtttgagcctgagctgagtgactacatcgacatcttcctgaatgtgtatgatgtgatgatcaaggctgtgtcctttgtgccccgggtggagaccaagctgtacagcaagtggaggaacaaggccaagccaggccacttctacttcagccacatccagaggtctgtgaccttccagcacagcgaggtgagcagcccccagaacagccacttcaagatcgtgagccccttctctgtgctgggcttcacctggcgctgccagctgtag

SEQ ID NO: 18890 - DNA, 840 bp, Artificial Sequence
  Description of Artificial Sequence: Synthetic coding sequence
atggccgcccctgtgcggaggaccctgctgggcgtggccggcggctggaggagatttgagcggctgtgggccggcagcctgagcagccgcagcctggccctggccgccgcccccagcagcaatggcagcccctggaggctgctgggcgccctgtgcctgcagaggcctcctgtggtgtccaagcccctgacccccctgcaggaggagatggccagcctgctgcagcagattgaaattgaaagaagcctgtacagcgaccacgagctgcgggccctggatgagaaccagaggctggccaagaagaaggctgacctgcatgatgaagaagatgagcaggacatcctgctggcccaggacctggaggacatgtgggagcagaagttcctgcagttcaagctgggcgcccgcatcacagaagcagatgagaagaatgacaggaccagcctgaacaggaagctggacaggaacctggtgctgctggtgcgggagaagtttggagaccaggatgtgtggatcctgccccaggccgagtggcagcccggggagaccctgcggggcacagctgagaggaccctggccaccctgtctgagaacaacatggaggccaagttcctgggcaatgccccctgtggccactacaccttcaagttcccccaggccatgaggacagagagcaacctgggcgccaaggtgttcttcttcaaggccctgctgctgaccggggacttcagccaggccggcaacaagggccaccacgtgtgggtgaccaaggatgagctgggggactacctgaagcccaagtacctggcccaggtgagaagatttgtgtctgacctgtag

SEQ ID NO: 18891 - DNA, 609 bp, Artificial Sequence
  Description of Artificial Sequence: Synthetic coding sequence
atggaggccgaggccggcggcctggaggagctgacagatgaggagatggccgccctgggcaaggaggagctggtgcggcggctgcggcgggaggaggccgcccggctggccgccctggtgcagaggggccgcctgatgcaggaggtgaaccggcagctgcagggccacctgggggagatccgggagctgaagcagctgaacagaaggctgcaggctgaaaatcgggagctgcgggacctgtgctgcttcctggacagcgagcggcagaggggccggcgggccgcccggcagtggcagctgtttggcacccaggccagcagagctgtgcgggaggacctgggcggctgctggcagaagctggccgagctggagggccggcaggaggagctgctgcgggagaacctggccctgaaggagctgtgcctggccctgggggaggagtggggcccccggggcggccccagcggggccggcggcagcggggccggccctgcccctgagctggccctgcccccctgtggcccccgggacctgggagatggcagcagcagcactggatctgtgggcagcccagaccagctgcccctggcctgcagcccagatgactag

SEQ ID NO: 18892 - DNA, 1353 bp, Artificial Sequence
  Description of Artificial Sequence: Synthetic coding sequence
atgagggagtgcatcagcatccacgtgggccaggccggcgtgcagattggaaatgcctgctgggagctgtactgcctggagcacggcatccagccagatggccagatgcccagcgacaagaccatcggcggcggagatgacagcttcaacaccttcttcagcgagaccggggccggcaagcacgtgcccagggctgtgtttgtggacctggagcccaccgtggtggatgaggtgaggacaggcacctaccggcagctgttccaccctgagcagctgatcaccgggaaggaggatgctgccagcaactatgcccggggccactacaccatcggcaaggagatcgtggacctggtgctggaccgcatcaggaagctggccgacctgtgcaccggcctgcagggcttcctgatcttccacagctttggaggcggcactggaagtggctttgccagcctgctgatggagcggctgtctgtggactacagcaagaagagcaagctggagtttgccatctacccagccccccaggtgtccacagctgtggtggagccctacaacagcatcctgaccacccacaccaccctggagcacagcgactgtgccttcatggtggacaatgaggccatctatgacatctgcagaagaaacctggacatcgagcggcccacctacaccaacctgaaccggctgattggccagatcgtgagcagcatcacagccagcctgcgctttgatggagccctgaatgtggacctgacagagttccagaccaacctggtgccctacccccgcatccacttccccctggccacctacgcccctgtgatctctgctgagaaggcctaccacgagcagctgtctgtggccgagatcaccaatgcctgctttgagcccgccaaccagatggtgaagtgtgaccccaggcatggcaagtacatggcctgctgcatgctgtacagaggagatgtggtgcccaaggatgtgaatgctgccatcgccaccatcaagaccaagaggaccatccagtttgtggactggtgccccaccggcttcaaggtgggcatcaactaccagcccccaacagtggtgcctggaggagacctggccaaggtgcagagagctgtgtgcatgctgagcaacaccacagccatcgccgaggcctgggcccggctggtgcacaagtttgacctgatgtatgccaagtgggcctttgtgcactggtacgtgggggagggcatggaggagggggagttcagcgaggcccgggaggacctggccgccctggagaaggactgtgaggaggtgggcgtggacagcgtggaggccgaggccgaggagggggaggcctactag

SEQ ID NO: 18893 - DNA, 3078 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgcggcctgccccaccccgggccccagcccggctgctgctgcagggcctgcccccaggcaccaccccccagaggctggagcagcacgtgcaggccctgctgcgggccagcggcctgcctgtgcagccctgctgtgccctggccagccccaggccagaccgggccctggtgcagctgcccaagcccctgtctgaggctgatgtgcgggtgctggaggagcaggcccagaacctgggcctggagggcaccctggtgtccctggcccgggtgccccaggcccgggctgtgcgggtggtgggagatggagcctctgtggacctgctgctgctggagctgtacctggagaatgaaagaagaagtggcggcggccccctggaggacctgcagaggctgcccggccccctgggcaccgtggccagcttccagcagtggcaggtggccgagcgggtgctgcagcaggagcaccggctgcagggcagcgagctgagcctggtgccccactatgacatcctggagcctgaggagctggccgagaacaccagcggcggggaccaccccagcacccagggcccccgggccaccaagcacgccctgctgaggactggaggcctggtgacagccctgcagggcgccggcaccgtgaccatgggcagcggggaggagcccggccagagcggggccagcctgaggacaggccccatggtgcagggccggggcatcatgaccaccggcagcggccaggagcccggccagagcggcaccagcctgaggacaggccccatgggcagcctgggccaggccgagcaggtgtcctccatgcccatgggcagcctggagcacgagggcctggtgtccctgcggcctgtgggcctgcaggagcaggagggccccatgagcctgggccctgtgggcagcgctggccctgtggagaccagcaagggcctgctgggccaggagggcctggtggagatcgccatggacagccctgagcaggagggcctggtgggccccatggagatcaccatgggcagcctggagaaggccggccctgtgtccccaggctgtgtgaagctggccggccaggagggcctggtggagatggtgctgctgatggagcccggggccatgaggttcctgcagctgtaccacgaggacctgctggccggcctgggagatgtggccctgctgcccctggagggccctgacatgacaggcttccggctgtgtggggcccaggccagctgccaggccgctgaggagttcctgcggagcctgctgggcagcatcagctgccacgtgctgtgcctggagcaccctggcagcgcccgcttcctgctgggccctgagggccagcacctgctgcagggcctggaggcccagttccagtgtgtgtttggaacagagcggctggccacagccaccctggacaccggcctggaggaggtggaccccacagaggccctgcctgtgctgcctggaaatgcccacaccctgtggaccccagacagcactggaggagaccaggaggatgtgtccctggaggaggtgcgggagctgctggccaccctggagggcctggacctggatggagaggactggctgccccgggagctggaggaggagggcccccaggagcagcctgaggaggaggtgaccccaggccacgaggaggaggagcctgtggcccccagcacagtggccccccgctggctggaggaggaggccgccctgcagctggccctgcacaggagcctggagccccagggccaggtggccgagcaggaggaggccgccgccctgcggcaggccctgaccctgagcctgctggagcagccccccctggaggccgaggagcccccagatggcggcacagatggcaaggcccagctggtggtgcacagcgcctttgagcaggatgtggaggagctggaccgggccctgcgggccgccctggaggtgcacgtgcaggaggagaccgtgggcccctggaggaggaccctgcctgctgagctgcgggcccggctggagcgctgccacggcgtgtctgtggccctgcggggggactgcaccatcctgcggggctttggagcccacccagcccgggccgcccggcacctggtggccctgctggccggcccctgggaccagagcctggccttccccctggccgccagcggccccaccctggccggccagaccctgaagggcccctggaacaacctggagcggctggctgaaaatactggagagttccaggaggtggtgcgggccttctatgacaccctggatgctgcccggagcagcatccgggtggtgcgggtggagcgggtgagccaccccctgctgcagcagcagtatgagctgtaccgggagcggctgctgcagagatgtgagcggcggcctgtggagcaggtgctgtaccacggcaccacagccccagctgtgcctgacatctgtgcccacggcttcaacagaagcttctgtggcagaaatgccaccgtgtatggcaagggcgtgtactttgcccggcgggccagcctgtctgtgcaggaccgctacagccccccaaatgctgatggccacaaggctgtgtttgtggcccgggtgctgaccggggactatggccagggcagaagaggcctgcgggccccacccctgcggggccctggccacgtgctgctgcgctatgattctgctgtggactgcatctgccagcccagcatcttcgtcatcttccatgacacccaggccctgcccacccacctgatcacctgtgagcacgtgccccgggccagcccagatgaccccagcggcctgcccggccgcagcccagacacctag

SEQ ID NO: 18894 - DNA, 390 bp, Artificial Sequence
  Description of Artificial Sequence: Synthetic coding sequence
atgagccacctgcagagcctgctgctggacaccctgctgggcaccaagcacgtggacagcgctgccctgatcaagatccaggagaggagcctgtgtgtggccagccctggcttcaacgtgacccccagtgatgtgaggaccctggtgaatggatttgccaagaaccccctgcaggcccggcgggagggcctgtacttcaagggcaaggactaccgctgtgtgcgggcagatgagtacagcctgtatgccaagaatgaaaatactggagtggtggtggtgaagacccacctgtacctgctggtggccacctacacagagggcatgtaccccagcatctgtgtggaggccacagagagcctgggggactacctgaggaagaagggcagctag

SEQ ID NO: 18895 - DNA, 945 bp, Artificial Sequence
  Description of Artificial Sequence: Synthetic coding sequence
atgctgggcaagggcggcaagaggaagtttgatgaacatgaagatggcctggagggcaagatcgtgagcccctgtgatggccccagcaaggtgtcctacaccctgcagaggcagaccatcttcaacatcagcctgatgaagctgtacaaccaccggcccctgacagagcccagcctgcagaagacagtgctgatcaacaacatgctgcggcgcatccaggaggagctgaagcaggagggcagcctgcggcccatgttcacccccagcagccagcccaccacagagcccagcgacagctaccgggaggcccccccagccttcagccacctggccagccccagcagccacccctgtgacctgggcagcaccacccccctggaggcctgcctgaccccagccagcctgctggaggatgatgatgacaccttctgcaccagccaggccatgcagcccacagcccccaccaagctgagccccccagccctgctgcctgagaaggacagcttcagcagcgccctggatgaaattgaggagctgtgccccaccagcaccagcacagaggccgccacagctgccacagattctgtgaagggcaccagcagcgaggccggcacccagaagctggatggcccccaggagagcagagcagatgacagcaagctgatggacagcctgcccggcaactttgagatcaccaccagcacaggcttcctgacagacctgaccctggatgacatcctgtttgctgacatcgacacctccatgtatgactttgacccctgcaccagcagcagcggcacagccagcaagatggcccctgtgtctgcagatgacctgctgaagaccctggccccctacagcagccagcctgtgacccccagccagcccttcaagatggacctgacagagctggaccacatcatggaggtgctggtgggcagctag

SEQ ID NO: 18896 - DNA, 246 bp, Artificial Sequence
  Description of Artificial Sequence: Synthetic coding sequence
atgaagggcagccgcatcgagctgggagatgtgaccccccacaacatcaagcagctgaagaggctgaaccaggtgatcttccctgtgtcctacaatgacaagttctacaagaagtttggatttgagatcatcgagaccaagaagaactactacaagagaattgaaccagcagatgcccacgtgctgcagaagaacctgaaggtgcccagcggccagaatgctgatgtgcagaagacagacaactag

SEQ ID NO: 18897 - DNA, 1437 bp, Artificial Sequence
  Description of Artificial Sequence: Synthetic coding sequence
atggccagcgccacagaggaccctgtgctggagcgctacttcaagggccacaaggccgccatcaccagcctggacctgagccccaacgggaagcagctggccacagcctcctgggacaccttcctgatgctgtggaacttcaagccccacgcccgggcctaccgctacgtgggccacaaggatgtggtgacctctgtgcagttcagcccccacggcaacctgctggccagcgccagccgggacagaacagtgcggctgtggatcccagacaagaggggcaagttcagcgagttcaaggcccacacagcccctgtgcgctctgtggacttcagcgcagatggccagttcctggccacagccagcgaggacaagagcatcaaggtgtggagcatgtaccggcagcgcttcctgtacagcctgtaccgccacacccactgggtgcgctgtgccaagttctccccagatggccgcctgattgtgtcctgcagcgaggacaagaccatcaagatctgggacaccaccaacaagcagtgtgtgaacaacttcagtgacagcgtgggctttgccaactttgtggacttcaaccccagcggcacctgcatcgccagcgctggcagtgaccagacagtgaaggtgtgggatgtgcgggtgaacaagctgctgcagcactaccaggtgcacagcggcggcgtgaactgcatctccttccaccccagcggcaactacctgatcacagccagcagtgatggcaccctgaagatcctggacctgctggagggccgcctcatctacaccctgcagggccacacaggccctgtgttcaccgtgtccttcagcaagggcggggagctgtttgccagcggcggcgctgacacccaggtgctgctgtggaggaccaactttgatgagctgcactgcaagggcctgaccaagaggaacctgaagaggctgcactttgacagccccccccacctgctggacatctaccccaggaccccccacccccatgaggagaaggtggagaccgtggagatcaaccccaagctggaggtgattgacctgcagatcagcaccccacctgtgatggacatcctgagctttgacagcaccaccaccacagagaccagcggccgcaccctgcctgacaagggggaggaggcctgtggctacttcctgaaccccagcctgatgagccctgagtgcctgcccaccaccaccaagaagaagacagaggacatgtctgacctgccctgtgagagccagaggagcatccccctggccgtgacagatgccctggagcacatcatggagcagctgaatgtgctgacccagacagtgtccatcctggagcagaggctgaccctgacagaggacaagctgaaggactgcctggagaaccagcagaagctgttctctgctgtgcagcagaagagctag

SEQ ID NO: 18898 - DNA, 1263 bp, Artificial Sequence
  Description of Artificial Sequence: Synthetic coding sequence
atgctgaaggccgtcatcctgattggaggcccccagaagggcacccgcttccggcccctgagctttgaggtgcccaagcccctcttccctgtggccggcgtgcccatgatccagcaccacatcgaggcctgtgcccaggtgcccggcatgcaggagatcctgctgattggcttctaccagccagatgagcccctgacccagttcctggaggccgcccagcaggagttcaacctgcctgtgcgctacctgcaggagtttgcccccctgggcactggaggcggcctgtaccacttccgggaccagatcctggccggcagccctgaggccttctttgtgctgaatgctgatgtgtgcagcgacttccccctgagcgccatgctggaggcccaccggcggcagaggcaccccttcctgctgctgggcaccacagccaacagaacccagagcctgaactacggctgcatcgtggagaacccccagacccatgaggtgctgcactacgtggagaagcccagcaccttcatcagtgacatcatcaactgtggcatctacctgttcagccctgaggccctgaagcccctgagagatgtgttccagaggaaccagcaggacggccagctggaggacagccctggcctgtggccaggagctggcaccatccggctggagcaggatgtgttcagcgccctggccggccagggccagatctacgtgcacctgacagatggcatctggagccagatcaagtctgctggcagcgccctgtatgccagccggctgtacctgagccgctaccaggacacccaccctgagcggctggccaagcacacccctgggggcccctggatcagaggaaatgtgtacatccaccccacagccaaggtggcccccagcgctgtgctgggccccaacgtgtccattggaaaaggagtgacagtgggggagggcgtgcggctgcgggagagcatcgtgctgcacggggccaccctgcaggagcacacctgtgtgctgcacagcatcgtgggctggggcagcacagtgggccgctgggcccgggtggagggcacccccagcgaccccaaccccaatgacccccgggccaggatggattctgagagcctcttcaaggatggcaagctgctgcctgccatcaccatcctgggctgccgggtgcgcatcccagctgaggtgctgatcctgaacagcatcgtgctgccccacaaggagctgagccgctccttcaccaaccagatcatcctgtag

SEQ ID NO: 18899 - DNA, 1215 bp, Artificial Sequence
  Description of Artificial Sequence: Synthetic coding sequence
atggaccaggactatgaaagaaggctgctgcggcagatcgtcatccagaatgaaaacaccatgccccgggtgacagagatgaggaggaccctgaccccagccagcagccctgtgagcagccccagcaagcacggggaccgcttcatccccagcagagctggggccaactggagcgtgaacttccaccgcatcaatgaaaatgagaagagccccagccagaacaggaaggccaaggatgccaccagtgacaacgggaaggatggcctggcctacagcgccctgctgaagaatgagctgctgggcgccggcatcgagaaggtgcaggacccccagacagaagatagaaggctgcagcccagcaccccagagaagaagggcctcttcaccgtgacccggctgtgtgacctgtctgtggagggggacagcgtgacctctgtgggctggagcgagcggggcaacctggtggccgtgggcacccacaagggctttgtgcagatctgggatgctgctgctgggaagaagctgtccatgctggagggccacacagcccgggtgggcgccctggcctggaatgctgagcagctgagcagcggcagccgggacaggatgatcctgcagagggacatccgcaccccacccctgcagagcgagcggcggctgcagggccaccggcaggaggtgtgtggcctgaagtggagcacagaccaccagctgctggccagcggcggcaatgacaacaagctgctggtgtggaaccacagcagcctgagccctgtgcagcagtacacagagcacctggccgctgtgaaggccatcgcctggagcccccaccagcacggcctgctggccagcggcggcggcacagctgaccgctgcatccgcttctggaacaccctgaccggccagcccctgcagtgcatcgacaccggcagccaggtgtgcaacctggcctggagcaagcacgccaatgagctggtgtccacccacggctacagccagaaccagatcctggtgtggaagtaccccagcctgacccaggtggccaagctgaccggccacagctacagagtgctgtacctggccatgagcccagatggagaggccatcgtgactggagctggagatgagaccctgcgcttctggaatgtgttcagcaagaccaggagcaccaaggagagcgtgtctgtgctgaacctcttcacccgcatcagatag

SEQ ID NO: 18900 - DNA, 5892 bp, Artificial Sequence
  Description of Artificial Sequence: Synthetic coding sequence
atgaagcagaggaagggccagggcagcggcggcagccggggcaggaagaagaggggcctgagtgacatcagccccagcaccagcctgccccccctggtggagggccagctgcgctgcttcctgaagctgactgtgaacagagtcatctggaagatcgccaagccacccacctgtgtgctggtgcgggtgcgctggtggggcgagaccagtgatggcaccctcttctgccccagagatgccctgcagacagagcccaaggctgtgaggaccaccaccaggtatgccatccgctgtggccccaagcagttcaccagctacctgacagacatggctgtgctggtgctggaggtgatcaccaagctggatggcctgcccatcggccgggtgcagatcaatggcctggcccagctgagccccacccaccagatcaatggcttcttcaccatcgtgagcagcaccagcaagaagctgggggagctgcaggtgtccctggccctggagcccctgtctgagacctatgacagctaccaccccctgcccaccacagacatgacagaaaatgtgctgctgagcaagcagggcttcagagaaaatacagagcccagcagcacccagttccaggtgcccagccggccccgggacatccacaccatcaagattgatggcaaggagctggccgccaacagcagccgcagcaccaccccccggggcaaggaccacgtgtgctttgctgaaaatccagacaccatcaaggacagcagctttggcctgcagcacagcctgaacagcggccagagcctggagagcgtgaccctgaagggccgggcccccaggaagcagatgagcctgctgaacagcagcgagttccagccccagatcagaacagtggccaagagccacagcgacagctgcatcctgagcagcaacaacctgcccaccaaggacctgctgagcgccctgctggagcagggcaacaagctgagaaatgccatggtgatcagcgccatgaagagcagccctgagacctccatgctgctggaccaggtgcacccccccatcaatgaagacagcctgcgggccagcacccagatccgggccttcagcaggaaccgcttcaaggaccacatcgaggaccacctgctgcccagcacagagaacaccttctggaggcatgacaccaaggctgacacccgggccatccagctgctgctgggcagcgctgagctgagccagggcaacttctgggatggcctgggcagccccccagacagccccagccctggcagtgatgtgtactgcatcagcgagctgaatgacccccagtatgaccagagcctgctggagaacctcttctacacagcccccaagagtgacaccagcatcagtgacttcctgtctgaggaggatgacatcgtgcccagcaagaagatcagccagagcacagccctggcccggagcagcaaggtgctggagagcagtgaccacaagctgaagaagaggtctgctgggaagaggaacagaaacctggtggagcagcagatgctgtctgagaccccagaagatgcccagaccatgaccctgtctgtggaccggctggccctgctgggccgcacccacagcgtgcgcatcatcatcgagaccatgggcgtgcccccagacagcccccagatgaccccaggcaagaagagctatgccggccccccacccaaggtgaccacagccaagaagaggaccttctttgtggagtaccacttccctgtgggcttcagcgagagcggcctgggcaagacagccctgatcacagaggtggtgcggctggccagcagcaagatcacagatggcaaggtgaagttccagcagagatttgtgtttcctgtgcagtttggaggccccatgattgagcactggtggaacagcaacctgaccttccagatctacgtgaagaagaccccccagaagaagccagaggtgattggctctgtgtccctgagcctgcgggctgtgatccagagcgagctgctgtccttcagtgaccagctgcctgtgcagcaggagaatggccagagccccttcggccccctgaaggtgaccatggagctgatcacagacaacaaggacttcaccggcatcaacaccaagctgagcggcaacacccactacacccccctgtgtgcccccaccagccccaacaaggccctgcctgagctgaaccaggacatgacctgcaccaagaacccccagaacctgaaccagatccacgaggagacagccaagaaggcccagaacctggtgctgcccaacaggaagagccccagccctgtggccccccaccccagcacctttgtggccaccccagccagccacaacctggtgaaccagaccaacggcaccaccaaggagagcgccctgctgctgcacgtgctgctgatggtgcctgatggcaaggacttcatctctggagagagcgagaagcagagcccctgcaatgtgtacctgaactgcaagctgttcagcacagaggaggtgaccaggtctgtgattgcctggggcaccacccagcccgtcttcaacttcagccaggtgattcctgtgtccctgagcagcaagtacctggagcggctgaagaacaacgtgatggtgattgagacctggaacaaggtgcgcagccctggccaggacaagctgctgggcctggtgaagctgcccctgcaccagttctacatgtccttcaaggatgccaagatcagccggctgctgctggatgcccagtaccctgtggtggccgtggacagctacatgcctgtgattgatgtgttcagcggccaccagaatggcagcctgcgggtcttcctggccatgggcagcagcaaccagatcatggccctgcagaggctgaagaatgaggagggcaccctgccccccttcagccccaggcctgcccacttcctggaccagcccacagctgcctctgtggccatggctgaagatagaggaaatggcctgatggagcactgctttgagatccacatcgagatggtgaagggcctggcccccctgcaggccaccgtgtggggcgaggccgactgctacgtgcagtactacttccctgtgcagcacagccagagctctgtgctgaagggccctgagttcctggagaatggcatcaccctgaagcccttcagaacagccaccaccctgtgtgtgcctgaccccatcttcaacagcgagcaccaccacagcctgctgctgcctgctgaggtgcctgtgcagaggctgctgctgagcgccttcagcgcccagggcctggtgcctgggggcggcgtgcagtttgagatctggtgccgctactactaccccaacgtgcgggaccagaaggtggccaagggcaccctgcccctgagccgcatctgtgccatggtgaccacccagcaccgggaggatgtgggcatccagaccttcaacctgcccctgaccccaagaattgagaacaggaaggagctgaggaaccagagcagcggcctgctggatgtgggcctgcgctaccgccgcagccccaggacagctgagggcgtgctggccgccaggacagtgtccatctctgtgcagatcatccgggcctgtggcctgcaggccgccgccaaggccctggccgagcgggagcccgccctgcagttcagcgccaccgtgggcgtgaatgcctctgtgaccacccacctgtccttcctgccccagggcgagcagaggaggacccaccctgtggcctgcagcttctgcccagagttcagccaccacgtggagttcacctgcaacctggtgacccagcactgcagcggggaggcctgcttcctggccgagctgctggagtttgctgaggtgatctttgctgtgtaccacgagaacaccaagagcgccagtgacatcatcagcattgagagctgcaaggagtacctgctgggcgtggtgaaggtgcccaccaaggagctgctgatcaagaggagcggcatcaccggctggtaccccatcatcctgcctgaagatggcggcctgccccacggcctggagctgatgcagaagatcgtgggcggcctggagctgagcatctccttcacccacagaggagaccgggagcgggtgctggaggccgctgagcacctgggctggagctttgagaacagcctgaaggactttgtgaggatggatgaaggagagcccgccaccgtgaccatcagcaccccccggctgtggctgcccatccactgtgtgctgctggccggccacaaccacatccacaagaacacctactgctacctgcgctacaagttctatgaccacgaggccttctggacccccctgaagaagcccaaggagagcgtgaacaagaagcagatcatggtgaccttcaaggccagcaagagagctgaggtgacccggggccccagcctgctgtggtacttccgggaggagcggctggagatccaggtgtggagggcctatggaaatgacagcgtggagcggccccaccagacagacagctggattggcagcgcctacgtggacctggcccggctgggggagaggtctgcccggaccctgactgtgtctggagtgtaccccctgtttggaagaaatgccagcaacctgagcggggccgccctgcgggtgcacgtggtgctgagcagcctgagcagccacctggagcccacccatgagctggacagcatggactgcagcagccacagcgagagcgagcagctgcccaggagaaatgatgaggtgcagctgagccccccagaggtgatcagctgccaccagaagagccctgccagcacccaggtgccctgcagcagcaccacagctgaggtgcggctgacccaggagggccctgctgacctggatggcacctttgctgtgtccatcctggtggagcgggccatgcacctgagcctgaagggcagccccctgacagagaggaaggtgtccatccccagctgctgcgtgtcctttgccacagcagatgagagcagccctgtgtacacccaggtggtggagaacacagacagccccatctggaacttccagcagcagagccggctgagcaaggagctgctgctggacccccagcagaccctggtgttcaaggtgtggcacaagggagatgaggagagggtcatcggctttgcctctgtggacctgagccccctgctgagcggcttccagtttgtgtgtggctggtacaacatcacagacttctctggagagtgccagggccagatcaaggtggccgtgagccccctggagagcctcatccacttcaaggaggagcggcaggcccggcggggcgtggagaccagcaagagcctcatccccatctacagccccttctccttccctgccagtgacacctatgctgccttcagcagccacatggcccggcagaccctggaccagctggcccacgccagcagcaaggagctggacttcagcagccctggccgcagtgacaccaccaggagccaggccagcagacatgaggagcacgtgcagaacatccgccgcttccacgagagcctgcacctgcagggcgaggcccccctgccctgtgatgacaagctgaccaccagccccctgagcagccagaccagcatcctgaccagcctgaggaagaacctgtctgagctggaccagatccagcgctacttccggcagaagctgaccaagcccttcctgcccctgagcccccagacccagacagccatcagccagcaccaggagagctgccgggaccacctgggccctggggccagcagcctggaccccggcagccagtgcatcctggagaagagcagcaacctggtgctgcaggtgagcagcctcatcaccggcagctactag

SEQ ID NO: 18901 - DNA, 5586 bp, Artificial Sequence
  Description of Artificial Sequence: Synthetic coding sequence
atgaagcagaggaagggccagggcagcggcggcagccggggcaggaagaagaggggcctgagtgacatcagccccagcaccagcctgccccccctggtggagggccagctgcgctgcttcctgaagctgactgtgaacagagtcatctggaagatcgccaagccacccacctgtgtgctggtgcgggtgcgctggtggggcgagaccagtgatggcaccctcttctgccccagagatgccctgcagacagagcccaaggctgtgaggaccaccaccaggtatgccatccgctgtggccccaagcagttcaccagctacctgacagacatggctgtgctggtgctggaggtgatcaccaagctggatggcctgcccatcggccgggtgcagatcaatggcctggcccagctgagccccacccaccagatcaatggcttcttcaccatcgtgagcagcaccagcaagaagctgggggagctgcaggtgtccctggccctggagcccctgtctgagacctatgacagctaccaccccctgcccaccacagacatgacagaaaatgtgctgctgagcaagcagggcttcagagaaaatacagagcccagcagcacccagttccaggtgcccagccggccccgggacatccacaccatcaagattgatggcaaggagctggccgccaacagcagccgcagcaccaccccccggggcaaggaccacgtgtgctttgctgaaaatccagacaccatcaaggacagcagctttggcctgcagcacagcctgaacagcggccagagcctggagagcgtgaccctgaagggccgggcccccaggaagcagatgagcctgctgaacagcagcgagttccagccccagatcagaacagtggccaagagccacagcgacagctgcatcctgagcagcaacaacctgcccaccaaggacctgctgagcgccctgctggagcagggcaacaagctgagaaatgccatggtgatcagcgccatgaagagcagccctgagacctccatgctgctggaccaggtgcacccccccatcaatgaagacagcctgcgggccagcacccagatccgggccttcagcaggaaccgcttcaaggaccacatcgaggaccacctgctgcccagcacagagaacaccttctggaggcatgacaccaaggctgacacccgggccatccagctgctgctgggcagcgctgagctgagccagggcaacttctgggatggcctgggcagccccccagacagccccagccctggcagtgatgtgtactgcatcagcgagctgaatgacccccagtatgaccagagcctgctggagaacctcttctacacagcccccaagagtgacaccagcatcagtgacttcctgtctgaggaggatgacatcgtgcccagcaagaagatcagccagagcacagccctggcccggagcagcaaggtgctggagagcagtgaccacaagctgaagaagaggtctgctgggaagaggaacagaaacctggtggagcagcagatgctgtctgagaccccagaagatgcccagaccatgaccctgtctgtggaccggctggccctgctgggccgcacccacagcgtgcgcatcatcatcgagaccatgggcgtgcccccagacagcccccagatgaccccaggcaagaagagctatgccggccccccacccaaggtgaccacagccaagaagaggaccttctttgtggagtaccacttccctgtgggcttcagcgagagcggcctgggcaagacagccctgatcacagaggtggtgcggctggccagcagcaagatcacagatggcaaggtgaagttccagcagagatttgtgtttcctgtgcagtttggaggccccatgattgagcactggtggaacagcaacctgaccttccagatctacgtgaagaagaccccccagaagaagccagaggtgattggctctgtgtccctgagcctgcgggctgtgatccagagcgagctgctgtccttcagtgaccagctgcctgtgcagcaggagaatggccagagccccttcggccccctgaaggtgaccatggagctgatcacagacaacaaggacttcaccggcatcaacaccaagctgagcggcaacacccactacacccccctgtgtgcccccaccagccccaacaaggccctgcctgagctgaaccaggacatgacctgcaccaagaacccccagaacctgaaccagatccacgaggagacagccaagaaggcccagaacctggtgctgcccaacaggaagagccccagccctgtggccccccaccccagcacctttgtggccaccccagccagccacaacctggtgaaccagaccaacggcaccaccaaggagagcgccctgctgctgcacgtgctgctgatggtgcctgatggcaaggacttcatctctggagagagcgagaagcagagcccctgcaatgtgtacctgaactgcaagctgttcagcacagaggaggtgaccaggtctgtgattgcctggggcaccacccagcccgtcttcaacttcagccaggtgattcctgtgtccctgagcagcaagtacctggagcggctgaagaacaacgtgatggtgattgagacctggaacaaggtgcgcagccctggccaggacaagctgctgggcctggtgaagctgcccctgcaccagttctacatgtccttcaaggatgccaagatcagccggctgctgctggatgcccagtaccctgtggtggccgtggacagctacatgcctgtgattgatgtgttcagcggccaccagaatggcagcctgcgggtcttcctggccatgggcagcagcaaccagatcatggccctgcagaggctgaagaatgaggagggcaccctgccccccttcagccccaggcctgcccacttcctggaccagcccacagctgcctctgtggccatggctgaagatagaggaaatggcctgatggagcactgctttgagatccacatcgagatggtgaagggcctggcccccctgcaggccaccgtgtggggcgaggccgactgctacgtgcagtactacttccctgtgcagcacagccagagctctgtgctgaagggccctgagttcctggagaatggcatcaccctgaagcccttcagaacagccaccaccctgtgtgtgcctgaccccatcttcaacagcgagcaccaccacagcctgctgctgcctgctgaggtgcctgtgcagaggctgctgctgagcgccttcagcgcccagggcctggtgcctgggggcggcgtgcagtttgagatctggtgccgctactactaccccaacgtgcgggaccagaaggtggccaagggcaccctgcccctgagccgcatctgtgccatggtgaccacccagcaccgggaggatgtgggcatccagaccttcaacctgcccctgaccccaagaattgagaacaggaaggagctgaggaaccagagcagcggcctgctggatgtgggcctgcgctaccgccgcagccccaggacagctgagggcgtgctggccgccaggacagtgtccatctctgtgcagatcatccgggcctgtggcctgcaggccgccgccaaggccctggccgagcgggagcccgccctgcagttcagcgccaccgtgggcgtgaatgcctctgtgaccacccacctgtccttcctgccccagggcgagcagaggaggacccaccctgtggcctgcagcttctgcccagagttcagccaccacgtggagttcacctgcaacctggtgacccagcactgcagcggggaggcctgcttcctggccgagctgctggagtttgctgaggtgatctttgctgtgtaccacgagaacaccaagagcgccagtgacatcatcagcattgagagctgcaaggagtacctgctgggcgtggtgaaggtgcccaccaaggagctgctgatcaagaggagcggcatcaccggctggtaccccatcatcctgcctgaagatggcggcctgccccacggcctggagctgatgcagaagatcgtgggcggcctggagcacctgggctggagctttgagaacagcctgaaggactttgtgaggatggatgaaggagagcccgccaccgtgaccatcagcaccccccggctgtggctgcccatccactgtgtgctgctggccggccacaaccacatccacaagaacacctactgctacctgcgctacaagttctatgaccacgaggccttctggacccccctgaagaagcccaaggagagcgtgaacaagaagcagatcatggtgaccttcaaggccagcaagagagctgaggtgacccggggccccagcctgctgtggtacttccgggaggagcggctggagatccaggtgtggagggcctatggaaatgattctgtggagcggccccaccagacagacagctggattggcagcgcctacgtggacctggcccggctgggggagaggtctgcccggaccctgactgtgtctggagtgtaccccctgtttggaagaaatgccagcaacctgtctggagctgccctgcgggtgcacgtggtgctgagcagcctgagcagccacctggagcccacccatgagctggacagcatggactgcagcagccacagcgagagcgagcagctgcccaggagaaatgatgaggtgcagctgagccccccagaggtgatcagctgccaccagaagagccctgccagcacccaggtgccctgcagcagcaccacagctgaggtgcggctgacccaggagggccctgctgacctggatggcacctttgctgtgtccatcctggtggagcgggccatgcacctgagcctgaagggcagccccctgacagagaggaaggtgtccatccccagctgctgcgtgtcctttgccacagcagatgagagcagccctgtgtacacccaggtggtggagaacacagacagccccatctggaacttccagcagcagagccggctgagcaaggagctgctgctggacccccagcagaccctggtgttcaaggtgtggcacaagggagatgaggagcgggtgattggatttgcctctgtggacctgagccccctgctgagcggcttccagtttgtgtgtggctggtacaacatcacagacttcagcggggagtgccagggccagatcaaggtggccgtgagccccctggagagcctcatccacttcaaggaggagcggcaggccaggagaggagtggagaccagcaagagcctcatccccatctacagccccttctccttccctgccagtgacacctacgccgccttcagcagccacatggcccggcagaccctggaccagctggcccacgccagcagcaaggagctggacttcagcagccctggccgcagtgacaccaccaggagccaggccagcagacatgaggagcacgtgcagaacatccgccgcttccacgagagcctgcacctgcagggcgaggcccccctgccctgtgatgacaagctgaccaccagccccctgagcagccagacctag

SEQ ID NO: 18902 - DNA, 1131 bp, Artificial Sequence
  Description of Artificial Sequence: Synthetic coding sequence
atgctgaccttcctgcagcagctgcgggtggactggccagctgccagcgagcgggccagcagccacaccctgcggagccacgccctggaggagctgaccagcgccaatgatggccgcaccctgagccctggcatcctgggccgcctgtgcctgaaggagctggtggaggagcagggccgcacagctggctatgaccccaacctggacaactgcctggtgacagaggacctgctgtctgtgctggccgagctgcaggaggccctgtggcactggccagaggacagccaccctggcctggccggggccagtgacacaggaactggaggctgcctggtggtgcacgtggtgtcctgtgaggaggagttccagcagcagaagctggacctgctgtggcagaagctggtggacaaggcccccctgcggcagaagcacctgatctgtggccctgtgaaggtggccggggcccctggcaccctgatgacagcccctgagtactatgagttccgccacacccaggtgtgcaaggccagcgccctgaagcatggaggagacctggcccaggaccctgcctggacagagatctttggagtgctgtctgtggccaccatcaagtttgagatgctgagcacagccccccagagccagctgttcctggccctggccgacagcagcatcagcaccaagggcaccaagagcggcacctttgtgatgtacaactgtgcccggctggccaccctgtttgagagctacaagtgcagcatggagcagggcctgtaccccaccttcccccctgtgagcagcctggacttcagcctgctgcatgatgaaggagagtggctgctgctcttcaacagcatcctgcccttcccagacctgctgagcaggacagctgtgctggactgcacagcccctggcctgcacatcgctgtgaggacagagatgatctgcaagttcctggtgcagctgtccatggacttcagcagctactacaacagagtgcacatcctgggggagccccggccccacctgtttggccagatgtttgtgcggctgcagctgctgcgggctgtgcgggaggtgctgcacacaggcctggccatgctgggcctgccccccctgagccacatctag

SEQ ID NO: 18903 - DNA, 1572 bp, Artificial Sequence
  Description of Artificial Sequence: Synthetic coding sequence
atgaaccagccctgcaacagcatggagccccgggtgatggatgatgacatgctgaagctggccgtgggggaccagggcccccaggaggaggccggccagctggccaagcaggagggcatcctcttcaaggatgtgctgagcctgcagctggacttcaggaacatcctgagaattgacaacctgtggcagtttgagaacctgaggaagctgcagctggacaacaacatcatcgagaagattgagggcctggagaacctggcccacctggtgtggctggacctgtccttcaacaacatcgagaccatcgagggcctggacaccctggtgaacctggaggacctgagcctcttcaacaaccgcatcagcaagattgacagcctggatgccctggtgaagctgcaggtgctgagcctgggcaacaacagaattgacaacatgatgaacatcatctacctgcggcgcttcaagtgcctgcggaccctgagcctgagcaggaaccccatcagcgaggccgaggactacaagatgttcatctgtgcctacctgcctgacctgatgtacctggactacagaagaattgatgaccacaccaagaagctggccgaggccaagcaccagtacagcattgatgagctgaagcaccaggagaacctgatgcaggcccagctggaggatgagcaggcccagcgggaggagctggagaagcacaagacagcctttgtggagcacctgaatggcagcttcctgtttgacagcatgtatgcagaggacagcgagggcaacaacctgagctacctgcccggggtgggggagctgctggagacctacaaggacaagtttgtgatcatctgtgtgaacatctttgaatatggcctgaagcagcaggagaagaggaagacagagctggacaccttctctgaatgtgtgcgggaggccatccaggagaaccaggagcagggcaagaggaagatcgccaagtttgaggagaagcacctgagcagcctgagcgccatccgggaggagctggagctgcccaacatcgagaagatgatcctggagtgcagcgctgacatcagcgagctgtttgatgccctgatgaccctggagatgcagctggtggagcagctggaggagaccatcaacatgtttgaaagaaatattgtggacatggtgggcctcttcattgaaaatgtgcagagcctgatggcccagtgccgggacctggagaaccaccaccacgagaagctgctggagatcagcatcagcaccctggagaagatcgtggagggggacctggatgaggacctgcccaatgacctgcgggccctgtttgtggacaaggacaccatcgtgaatgctgtgggcgccagccatgacatccacctgctgaagattgacaacagagaagatgagctggtgacccgcatcaacagctggtgcacccggctgattgaccgcatccacaaggatgagatcatgaggaacaggaagagggtgaaggagatcaaccagtacatcgaccacatgcagagcgagctggacaacctggagtgtggggacatcctggactag

SEQ ID NO: 18904 - DNA, 1680 bp, Artificial Sequence
  Description of Artificial Sequence: Synthetic coding sequence
atgaaggtgatcacctgtgagatcgcctggcacaacaaggagcctgtgtacagcctggacttccagcacggcacagctggccgcatccaccggctggccagcgctggggtggacaccaacgtgcgcatctggaaggtggagaagggcccagatggcaaggccatcgtggagttcctgagcaacctggcccggcacaccaaggctgtgaatgtggtgcgcttcagccccactggagagatcctggccagcggaggagatgatgctgtgatcctgctgtggaaggtgaatgacaacaaggagcctgagcagatcgccttccaggatgaagatgaggcccagctgaacaaggagaactggacagtggtgaagaccctgcggggccacctggaggatgtgtatgacatctgctgggccacagatggcaacctgatggccagcgcctctgtggacaacacagccatcatctgggatgtgtccaagggccagaagatcagcatcttcaatgagcacaagagctatgtgcagggcgtgacctgggaccccctgggccagtatgtggccaccctgagctgtgacagagtgctgcgggtgtacagcatccagaagaagagggtggccttcaacgtgtccaagatgctgagcggcatcggggctgagggggaggcccggagctacaggatgtttcatgatgacagcatgaagagcttcttccggcggctgtccttcaccccagatggcagcctgctgctgaccccagctggctgtgtggagagcggggagaatgtgatgaacaccacctacgtgttcagcaggaagaacctgaagaggcccatcgcccacctgccctgccctgggaaggccaccctggccgtgcgctgctgccctgtgtactttgagctgcggcctgtggtggagaccggggtggagctgatgagcctgccctaccgcctggtgtttgctgtggccagcgaggacagcgtgctgctgtatgacacccagcagagcttccccttcggctacgtgagcaacatccactaccacaccctgagtgacatctcctggagcagtgatggagccttcctggccatcagcagcacagatggctactgcagctttgtgacctttgagaaggatgagctgggcatccccctgaaggagaagcctgtgctgaacatgaggaccccagacacagccaagaagaccaagagccagacccaccggggcagcagccctggccccaggcctgtggagggcaccccagccagcaggacccaggaccccagcagccctggcaccaccccaccccaggcccggcaggccccagcccccaccgtcatccgggaccccccatccatcaccccagctgtgaagagccccctgcccggccccagcgaggagaagaccctgcagcccagcagccagaacaccaaggcccaccccagccggcgggtgaccctgaacaccctgcaggcctggagcaagaccaccccccggcgcatcaacctgacccccctgaagacagacaccccacccagctctgtgcccaccagcgtcatcagcacccccagcacagaggagatccagagcgagaccccaggagatgcccagggcagccccccagagctgaagaggccccggctggatgaaaataaaggaggaacagagagcctggacccctag

SEQ ID NO: 18905 - DNA, 1527 bp, Artificial Sequence
  Description of Artificial Sequence: Synthetic coding sequence
atggctgatggccaggtggccgagctgctgctgcggcggctggaggccagtgatggcggcctggacagcgctgagctggccgctgagctgggcatggagcaccaggccgtggtgggcgctgtgaagagcctgcaggccctgggggaggtgattgaagctgagctgcggagcaccaagcactgggagctgacagctgagggggaggagatcgcccgggagggcagccatgaggcccgggtcttccgcagcatccccccagagggcctggcccagagcgagctgatgaggctgcccagcggcaaggtgggcttcagcaaggccatgagcaacaagtggatccgggtggacaagtctgctgctgatggccccagggtcttccgggtggtggacagcatggaggatgaggtgcagaggcggctgcagctggtgcggggcggccaggccgagaagctgggggagaaggagaggtctgagctgaggaagaggaagctgctggccgaggtgaccctgaagacctactgggtgtccaaaggaagtgccttcagcaccagcatcagcaagcaggagacagagctgagccctgagatgatcagcagcggctcctggagggaccggcccttcaagccctacaacttcctggcccatggagtgctgcctgattctggccacctgcaccccctgctgaaggtgcgcagccagttccggcagatcttcctggagatgggcttcacagagatgcccacagacaacttcatcgagagcagcttctggaactttgatgccctcttccagccccagcagcacccagcccgggaccagcacgacaccttcttcctgcgggaccctgctgaggccctgcagctgcccatggactatgtgcagagggtgaagaggacccacagccagggcggctacggcagccagggctacaagtacaactggaagctggatgaggccaggaagaacctgctgcggacccacaccaccagcgccagcgcccgggccctgtaccgcctggcccagaagaagcccttcacccctgtgaagtacttcagcattgacagagtcttcagaaatgagaccctggatgccacccacctggccgagttccaccagattgaaggagtggtggccgaccacggcctgaccctgggccacctgatgggcgtgctgcgggagttcttcaccaagctgggcatcacccagctgcgcttcaagccagcctacaacccctacacagagcccagcatggaggtgttctcctaccaccagggcctgaagaagtgggtggaggtgggcaacagcggggtcttccggcctgagatgctgctgcccatgggcctgcctgaaaatgtgtctgtgattgcctggggcctgagcctggagcggcccaccatgatcaagtatggcatcaacaacatccgggagctggtgggccacaaggtgaacctgcagatggtgtatgacagccccctgtgccgcctggatgctgagccccggcccccacccacccaggaggccgcctag

SEQ ID NO: 18906 - DNA, 1203 bp, Artificial Sequence
  Description of Artificial Sequence: Synthetic coding sequence
atgagcagccccctggccagcctgagcaagaccaggaaggtgcccctgcccagcgagcccatgaaccctggaagaagaggcatccgcatctatggagatgaagatgaggtggacatgctgagtgatggctgcggcagcgaggagaagatctctgtgcccagctgctacggcggcattggagcccctgtgtcccggcagggcgacagcctggcccctcctgaggtggactttgaccggctgctggccagcctgcaggacctgtctgagctggtggtggagggggacacccaggtgacccctgtgcctgggggcgcccggctgcggaccctggagcccatccccctgaagctgtacagaaatggcatcatgatgtttgatggccccttccagcccttctatgaccccagcacccagcgctgcctgcgggacatcctggatggcttcttccccagcgagctgcagaggctgtacccaaatggagtgcccttcaaggtgtctgacctgaggaaccaggtgtacctggaggatggcctggaccccttccctggagagggccgggtggtgggccggcagctgatgcacaaggccctggacagagtggaggagcaccctggcagcaggatgacagctgagaagttcctgaaccggctgcccaagtttgtgatccggcagggcgaggtgattgacatccggggccccatccgggacaccctgcagaactgctgccccctgcctgcccgcatccaggagatcgtggtggagacccccaccctggccgctgagcgggagaggagccaggagagccccaacaccccagccccacccctgtccatgctgcgcatcaagtcagaaaatggagagcaggccttcctgctgatgatgcagcctgacaacaccatcggagatgtgcgggccctgctggcccaggcccgggtgatggatgccagcgcctttgagatcttcagcaccttcccccccaccctgtaccaggatgacaccctgaccctgcaggccgccggcctggtgcccaaggccgccctgctgctgcgggcccggcgggcccccaagagcagcctgaagttcagccctggcccctgccccggccctggccctggccccagccctggccctggccctggccccagccctggccctggccctggccccagcccctgccccggccccagccccagcccccagtag

SEQ ID NO: 18907 - DNA, 1350 bp, Artificial Sequence
  Description of Artificial Sequence: Synthetic coding sequence
atggccagcgccctgcggcccccccgggtgcccaagcccaagggcgtgctgcccagccactactatgagagcttcctggagaagaagggcccctgtgaccgggactacaagaagttctgggccggcctgcagggcctgaccatctacttctacaacagcaacagagacttccagcacgtggagaagctgaacctgggcgcctttgagaagctgacagatgagatcccctggggcagcagccgggaccccggcacccacttcagcctcatcctgcgggaccaggagatcaagttcaaggtggagaccctggagtgccgggagatgtggaagggcttcatcctgactgtggtggagctgcgggtgcccacagacctgaccctgctgcccggccacctgtacatgatgtctgaggtgctggccaaggaggaggcccggcgggccctggagacccccagctgcttcctgaaggtgtcccggctggaggcccagctgctgctggagcgctacccagaatgtggcaacctgctgctgcggcccagcggagatggagcagatggagtgtctgtgaccacccggcagatgcacaacggcacccacgtggtgcgccactacaaggtgaagcgggagggccccaagtatgtgattgatgtggagcagcccttcagctgcaccagcctggatgctgtggtgaactactttgtgagccacaccaagaaggccctggtgcccttcctgctggatgaggactatgagaaggtgctgggctacgtggaggccgacaaggaaaatggagaaaatgtgtgggtggcccccagcgcccctggccctggccctgccccctgcaccggcggccccaagcccctgagccctgccagcagccaggacaagctgccccccctgccccccctgcccaaccaggaggagaactacgtgacccccatcggagatggccctgctgtggactatgagaaccaggatgtggccagcagctcctggcctgtgatcctgaagcccaagaagctgcccaagcccccagccaagctgcccaagccccctgtgggccccaagcctgtggagaagggcttccaccacgtggcccaggccggcctggagctgctgaccagcagtgacccccccaccagcgccagccagagcgctggcatcactggagtgagccaccacacctggccccacctgagcagcctgcctgagcccaaggtgttcaatggaggcctgggcaggaagctgcctgtgagcagcgcccagcccctcttccccacagctggcctggccgacatgacagctgagctgcagaagaagctggagaagaggcgggccctggagcactag

SEQ ID NO: 18908 - DNA, 1239 bp, Artificial Sequence
  Description of Artificial Sequence: Synthetic coding sequence
atggaccccatccgctccttctgtgggaagctgcggagcctggccagcaccctggactgtgaaacagcccggctgcagagggccctggatggagaggagagtgactttgaggactaccccatgaggatcctgtatgacctgcacagcgaggtgcagaccctgaaggatgatgtgaacatcctgctggacaaggcccggctggagaaccaggagggcatcgacttcatcaaggccaccaaggtgctgatggagaagaacagcatggacatcatgaagatccgggagtacttccagaagtatggctacagcccccgggtgaagaagaacagcgtgcatgagcaggaggccatcaacagcgaccctgagctgagcaactgtgagaacttccagaagacagatgtgaaggatgacctgagtgacccccctgtggccagcagctgcatcagcgagaagagccccaggagcccccagctgagtgactttggcctggagcgctacatcgtgtcccaggtgctgcccaaccccccccaggccgtgaacaactacaaggaggagcccgtcatcgtgaccccacccaccaagcagagcctggtgaaggtgctgaagacccccaagtgtgccctgaagatggatgactttgaatgtgtgacccccaagctggagcacttcggcatcagcgagtacaccatgtgcctgaatgaagactacaccatgggcctgaagaatgccaggaacaacaagtctgaggaggccatcgacacagagagccggctgaatgacaacgtgtttgccacccccagccccatcatccagcagctggagaagagtgatgctgagtacaccaacagccccctggtgcccaccttctgcaccccaggcctgaagatccccagcaccaagaacagcatcgccctggtgtccaccaactaccccctgagcaagaccaacagcagcagcaatgacctggaggtggaggacaggaccagcctggtgctgaacagcgacacctgctttgagaacctgacagaccccagcagccccaccatcagcagctatgagaacctgctgcggacccccaccccacctgaggtgaccaagatccctgaggacatcctgcagctgctgagcaagtacaacagcaacctggccacccccatcgccatcaaggctgtgccccccagcaagcgcttcctgaagcacggccagaacatcagagatgtgagcaacaaggaaaattag

SEQ ID NO: 18909 - DNA, 2583 bp, Artificial Sequence
  Description of Artificial Sequence: Synthetic coding sequence
atgacagagggcaccaagaagaccagcaagaagttcaagttcttcaagttcaagggcttcggcagcctgagcaacctgcccaggagcttcaccctgcggcgcagcagcgccagcatcagccggcagagccacctggagccagacacctttgaggccacccaggatgacatggtgacagtgcccaagagccccccagcctatgcccggagcagtgacatgtacagccacatgggcaccatgccccggcccagcatcaagaaggcccagaacagccaggccgcccggcaggcccaggaggccggccccaagcccaacctggtgcctgggggcgtgcctgaccccccaggcctggaggccgccaaggaggtgatggtgaaggccaccggccccctggaggacaccccagccatggagcccaaccccagcgctgtggaggtggaccccatcaggaagccagaggtgcccactggagatgtggaggaggagcggcccccaagagatgtgcacagcgagagagctgctggggagcctgaggccggcagtgactatgtgaagttcagcaaggagaagtacatcctggacagcagccctgagaagctgcacaaggagctggaggaggagctgaagctgagcagcacagacctgcggagccacgcctggtaccacggccgcatcccccgggaggtgtctgagaccctggtgcagagaaatggagacttcctgatccgggacagcctgaccagcctgggggactatgtgctgacctgccgctggaggaaccaggccctgcacttcaagatcaacaaggtggtggtgaaggccggggagagctacacccacatccagtacctgtttgagcaggagagctttgaccacgtgcctgccctggtgcgctaccacgtgggcagcaggaaggctgtgtctgagcagagcggggccatcatctactgccctgtgaacagaaccttccccctgcgctacctggaggccagctatggcctgggccagggcagcagcaagccagccagccctgtgagccccagcggccccaagggcagccacatgaagagaagatctgtgaccatgacagatggcctgacagctgacaaggtgaccaggagtgatggctgccccaccagcaccagcctgccccggccccgggacagcatccgcagctgtgccctgtccatggaccagatcccagacctgcacagccccatgagccccatcagcgagagccccagcagccctgcctacagcacagtgaccagggtgcatgctgccccagctgcccccagcgccacagccctgcctgccagccctgtggcccggcgcagcagcgagccccagctgtgccccggcagcgcccccaagacccacggggagagtgacaagggcccccacaccagccccagccacaccctgggcaaggccagccccagccccagcctgagcagctacagcgaccctgacagcggccactactgccagctgcagccccctgtgcggggcagccgggagtgggccgccacagagaccagcagccagcaggcccggagctatggagagcggctgaaggagctgtctgaaaatggagcccctgagggggactggggcaagaccttcaccgtgcccatcgtggaggtgaccagcagcttcaacccagccaccttccagagcctgctgatcccccgggacaaccggcccctggaggtgggcctgctgaggaaggtgaaggagctgctggccgaggtggatgcccggaccctggcccggcacgtgaccaaggtggactgcctggtggcccgcatcctgggcgtgaccaaggagatgcagaccctgatgggcgtgcgctggggcatggagctgctgaccctgccccacggccggcagctgcggctggacctgctggagcgcttccacaccatgagcatcatgctggccgtggacatcctgggctgcaccggcagcgctgaggagcgggccgccctgctgcacaagaccatccagctggccgctgagctgcggggcaccatgggcaacatgttctcctttgctgctgtgatgggcgccctggacatggcccagatcagccggctggagcagacctgggtgaccctgcggcagaggcacacagagggcgccatcctgtatgagaagaagctgaagcccttcctgaagagcctgaatgaaggcaaggagggcccccccctgagcaacaccaccttcccccacgtgctgcccctcatcaccctgctggagtgtgacagcgcccctcctgagggccctgagccctggggcagcacagaacatggagtggaggtggtgctggcccacctggaggccgccaggacagtggcccaccacggcggcctgtaccacaccaatgctgaggtgaagctgcagggcttccaggcccggcctgagctgctggaggtgttcagcacagagttccagatgaggctgctgtggggcagccagggcgccagcagcagccaggccaggagatatgagaagtttgacaaggtgctgacagccctgagccacaagctggagcctgctgtgcgcagcagcgagctgtag

SEQ ID NO: 18910 - DNA, 573 bp, Artificial Sequence
  Description of Artificial Sequence: Synthetic coding sequence
atgacagtgccctggaggcctgggaagaggcgcatcacctacaaggaggaggaggacctgaccctgcagcccaggcctgccagcagcgcccctgagagcctggtgggcctgcaggagggcaagagcacagagcagggcaaccacgaccagctgaaggagctgtacagcgctggcaacctgactgtgctggccacagaccccctgctgcaccaggaccctgtgcagctggacttccacttccggctgaccagccagaccagcgcccactggcacggcctgctgtgtgacagaagactcttcctggacatcccctaccaggccctggaccagggcaaccgggagagcctgacagccaccctggagtatgtggaggagaagaccaacgtggacagcgtgtttgtgaacttccagaatgacagaaatgacagaggagccctgctgcgggccttctcctacatgggctttgaggtggtgcggccagaccacccagccctgccccccctggacaacgtcatcttcatggtgtaccccctggagagagatgtgggccacctgcccagcgagcccccatag

SEQ ID NO: 18911 - DNA, 1527 bp, Artificial Sequence
  Description of Artificial Sequence: Synthetic coding sequence
atggccacagactggctgggcagcatcgtgtccatcaactgtggggacagcctgggcgtgtaccagggccgggtgtctgctgtggaccaggtgtcccagaccatcagcctgacccggcccttccacaatggagtgaagtgcctggtgcctgaggtgaccttccgggccggggacatcacagagctgaagatcctggagatccctggccctggggacaaccagcactttggagacctgcaccagacagagctgggccccagcggggccggctgccaggtgggcatcaaccagaatggcaccgggaagtttgtgaagaagccagccagcagcagcagcgccccccagaacatccccaagaggacagatgtgaagagccaggatgtggccgtgagcccccagcagcagcagtgcagcaagagctatgtggacagacacatggagagcctgagccagagcaagagcttcagaagaagacacaacagctggagcagcagcagccgccaccccaaccaggccacccccaagaagagcggcctgaagaatggccagatgaagaacaaggatgatgagtgctttggagatgacatcgaggagatcccagacacagactttgattttgagggcaacctggccctgtttgacaaggctgctgtgtttgaggagattgacacctatgaaagaagaagtggcaccaggagccggggcatccccaatgaaagacccacccgctacagacatgatgagaacatcctggagagcgagcccatcgtgtaccgccgcatcatcgtgccccacaacgtgtccaaggagttctgcacagattctggcctggtggtgcccagcatctcctatgagctgcacaagaagctgctgtctgtggccgagaagcacggcctgaccctggagcggcggctggagatgactggagtgtgtgccagccagatggccctgaccctgctgggcggccccaaccggctgaaccccaagaatgtgcaccagaggcccaccgtggccctgctgtgtggcccccacgtgaagggggcccagggcatcagctgtggccgccacctggccaaccatgatgtgcaggtgatcctcttcctgcccaactttgtgaagatgctggagagcatcaccaatgagctgagcctcttcagcaagacccagggccagcaggtgagcagcctgaaggacctgcccaccagccctgtggacctggtgatcaactgcctggactgcccagaaaatgtgttcctgcgggaccagccctggtacaaggctgctgtggcctgggccaaccagaacagagcccctgtgctgagcattgacccccctgtgcatgaggtggagcagggcattgatgccaagtggagcctggccctgggcctgcccctgcccctgggggagcacgccggccgcatctacctgtgtgacatcggcatcccccagcaggtgttccaggaggtgggcatcaactaccacagccccttcggctgcaagtttgtgatccccctgcacagcgcctag

SEQ ID NO: 18912 - DNA, 1158 bp, Artificial Sequence
  Description of Artificial Sequence: Synthetic coding sequence
atgggccgctggtgccagacagtggcccggggccagaggcccaggaccagcgcccccagccgggccggggccctgctgctgctgctgctgctgctgcggtctgctggctgctggggcgctggggaggcccctggggccctgagcacagctgaccctgctgaccagagcgtgcagtgtgtgcccaaggccacctgccccagcagccggccccggctgctgtggcagacccccaccacccagaccctgcccagcaccaccatggagacccagtttcctgtgtctgagggcaaggtggacccctaccgcagctgtggcttctcctatgagcaggaccccaccctgcgggaccctgaggccgtggcccggcgctggccctggatggtgtctgtgcgggccaacggcacccacatctgtgccggcaccatcatcgccagccagtgggtgctgactgtggcccactgcctgatctggagagatgtgatctacagcgtgcgggtgggcagcccctggattgaccagatgacccagacagccagtgatgtgcctgtgctgcaggtgatcatgcacagccgctaccgggcccagcgcttctggagctgggtgggccaggccaatgacatcggcctgctgaagctgaagcaggagctgaagtacagcaactacgtgcggcccatctgcctgcccggcacagattatgtgctgaaggaccacagccgctgcaccgtgacaggctggggcctgagcaaggcagatggcatgtggccccagttccgcaccatccaggagaaggaggtgatcatcctgaacaacaaggaatgtgacaacttctaccacaacttcaccaagatccccaccctggtgcagatcatcaagagccagatgatgtgtgccgaggacacccaccgggagaagttctgctatgagctgaccggggagcccctggtgtgcagcatggagggcacctggtacctggtgggcctggtgtcctggggcgccggctgccagaagtctgaggccccacccatctacctgcaggtgagcagctaccagcactggatctgggactgcctgaatggccaggccctggccctgcctgcccccagcaggaccctgctgctggccctgcccctgcccctgagcctgctggccgccctgtag

SEQ ID NO: 18913 - DNA, 750 bp, Artificial Sequence
  Description of Artificial Sequence: Synthetic coding sequence
atggtggaccggctggccaacagcgaggccaacacccggcgcatcagcatcgtggagaactgcttcggggctgctggccagcccctgaccatccctggccgggtgctgattggagagggcgtgctgaccaagctgtgcaggaagaagcccaaggcccggcagttcttcctgttcaatgacatcctggtgtatggcaacatcgtcatccagaagaagaagtacaacaagcagcacatcatccccctggagaatgtgaccatcgacagcatcaaggatgaaggagacctgagaaatggctggctgatcaagacccccaccaagagctttgctgtgtatgctgccacagccacagagaagtctgagtggatgaaccacatcaacaagtgtgtgacagacctgctgagcaagagcggcaagacccccagcaatgaacatgctgctgtgtgggtgcctgattctgaggccaccgtgtgcatgcgctgccagaaggccaagttcacccctgtgaacagaagacaccactgcaggaaatgtggctttgtggtgtgtggcccctgcagcgagaagcgcttcctgctgcccagccagagcagcaagcctgtgcgcatctgtgacttctgctatgacctgctgtctgctggggacatggccacctgccagcctgcccggagtgacagctacagccagagcctgaagagccccctgaatgacatgtctgatgatgatgatgatgatgacagcagtgactag

SEQ ID NO: 18914 - DNA, 2745 bp, Artificial Sequence
  Description of Artificial Sequence: Synthetic coding sequence
atgggagacagccgggacctgtgcccccacctggacagcatcggggaggtgaccaaggaggacctgctgctgaagagcaagggcacctgccagagctgtggggtgacaggccccaacctgtgggcctgcctgcaggtggcctgcccctacgtgggctgtggggagagctttgctgaccacagcaccatccacgcccaggccaagaagcacaacctgactgtgaacctgaccaccttccggctgtggtgctacgcctgtgagaaggaggtgttcctggagcagaggctggccgcccccctgctgggcagcagcagcaagttcagcgagcaggacagccccccacccagccaccccctgaaggctgtgcccatcgctgtggctgatgaaggagagagcgagagtgaagatgatgacctgaagccccggggcctgaccggcatgaagaacctgggcaacagctgctacatgaatgctgccctgcaggccctgagcaactgcccccccctgacccagttcttcctggagtgtggcggcctggtgaggacagacaagaagccagccctgtgcaagagctaccagaagctggtgtctgaggtgtggcacaagaagaggcccagctatgtggtgcccaccagcctgagccacggcatcaagctggtgaaccccatgttccggggctacgcccagcaggacacccaggagttcctgcgctgcctgatggaccagctgcacgaggagctgaaggagcctgtggtggccaccgtggccctgacagaggcccgggacagcgacagcagtgacacagatgagaagcgggagggggacaggagccccagtgaagatgagttcctgagctgtgacagcagcagtgacagaggagaaggagatggccagggccggggcggcggcagcagccaggccgagacagagctgctgatcccagatgaagctggccgggccatcagcgagaaggagaggatgaaggacaggaagttctcctggggccagcagaggaccaacagcgagcaggtggatgaagatgctgatgtggacacagccatggccgccctggatgaccagcctgctgaggcccagccccccagccccaggagcagcagcccctgcaggaccccagagccagacaatgatgcccacctgcggagcagcagccggccctgcagccctgtgcaccaccacgagggccacgccaagctgagcagcagccccccccgggccagccctgtgaggatggcccccagctatgtgctgaagaaggcccaggtgctgtctgctggcagcagaagaaggaaggagcagcgctacagaagtgtcatcagtgacatctttgatggcagcatcctgagcctggtgcagtgcctgacctgtgacagagtgtccaccaccgtggagaccttccaggacctgagcctgcccatccctgggaaggaggacctggccaagctgcacagcgccatctaccagaatgtgcctgccaagccaggggcctgtggggacagctatgctgcccagggctggctggccttcatcgtggagtacatcagaagatttgtggtgtcctgcacccccagctggttctggggccctgtggtgaccctggaggactgcctggccgccttctttgctgctgatgagctgaagggggacaacatgtacagctgtgagcgctgcaagaagctgagaaatggagtgaagtactgcaaggtgctgcggctgcctgagatcctgtgcatccacctgaagcgcttcagacatgaggtgatgtacagcttcaagatcaacagccacgtgtccttccccctggagggcctggacctgcggcccttcctggccaaggaatgtaccagccagatcaccacctatgacctgctgagcgtcatctgccaccacggcacagctggcagcggccactacatcgcctactgccagaatgtcatcaatggccagtggtatgaatttgatgaccagtatgtgacagaggtgcatgagaccgtggtgcagaatgctgagggctacgtgctcttctacaggaagagcagcgaggaggccatgagggagcggcagcaggtggtgtccctggccgccatgagggagcccagcctgctgcgcttctacgtgtcccgggagtggctgaacaagttcaacacctttgctgagcccggccccatcaccaaccagaccttcctgtgcagccacggcggcatccccccccacaagtaccactacattgatgacctggtggtgatcctgccccagaatgtgtgggagcacctgtacaacagatttggaggcggccctgctgtgaaccacctgtatgtgtgcagcatctgccaggtggagattgaggccctggccaagagaagacgcatcgagattgacaccttcatcaagctgaacaaggccttccaggccgaggagagccctggggtcatctactgcatctccatgcagtggttccgggagtgggaggcctttgtgaagggcaaggacaatgaacctcctggccccatcgacaacagccgcatcgcccaggtgaagggcagcggccacgtgcagctgaagcagggcgctgactatggccagatcagcgaggagacctggacctacctgaacagcctgtatggaggcggccctgagatcgccatccggcagagcgtggcccagcccctgggccctgagaacctgcacggggagcagaagattgaagctgagaccagggctgtgtag

SEQ ID NO: 18915 - DNA, 1341 bp, Artificial Sequence
  Description of Artificial Sequence: Synthetic coding sequence
atgagagctgcccggcggggcctgcactgtgccggggctgagcggccccggcggcggggccgcctgtgggacagcagcggcgtgccccagaggcagaagaggcctggcccctggaggacccagacccaggagcagatgagcagagatgtgtgcatccacacctggccctgcacctactacctggagcccaagaggcgctgggtgacaggccagctgagcctgaccagcctgagcctgcgcttcatgacagacagcactggagagatcctggtgtccttccccctgagcagcatcgtggagatcaagaaggaggccagccacttcatcttcagcagcatcaccatcctggagaagggccacgccaagcactggttcagcagcctgcggcccagcagaaatgtggtgttcagcatcatcgagcacttctggagggagctgctgctgagccagcctggagctgtggctgatgcctctgtgcccaggaccagaggagaggagctgaccggcctgatggccggcagccagaagaggctggaggacacagcccgggtgctgcaccaccagggccagcagctggacagcgtgatgaggggcctggacaagatggagagtgacctggaggtggccgaccggctgctgacagagctggagagccctgcctggtggcccttcagcagcaagctgtggaagaccccacctgagaccaagcccagagaagatgtgtccatgaccagctgtgagccctttgggaaggagggcatcctgatcaagatcccagctgtgatcagccacaggacagagagccacgtgaagccaggccgcctgactgtgctggtgtctggcctggagatccatgacagcagcagcctgctgatgcacagatttgagcgggaggatgtggatgacatcaaggtgcacagcccctatgagatcagcatccggcagcgcttcatcggcaagccagacatggcctaccgcctcatcagcgccaagatgcctgaggtgatccccatcctggaggtgcagttcagcaagaagatggagctgctggaggatgccctggtgctgcggagcgcccggaccagcagccctgctgagaagagctgcagcgtgtggcacgccgccagcggcctgatgggccgcaccctgcaccgggagcccccagctggggaccaggagggcacagccctgcacctgcagaccagcctgcctgccctgtctgaggccgacacccaggagctgacccagggcttccggcccatgagcctgagcacccagacagtgctggtgatgctgtgcagcgagagcgctggggccctgtggaggcagaggctgtcctag

SEQ ID NO: 18916 - DNA, 1896 bp, Artificial Sequence
  Description of Artificial Sequence: Synthetic coding sequence
atggccatcgtgcagaccctgcctgtgcccctggagcccgcccctgaggccgccacagccccccaggcccctgtgatgggctctgtgagcagcctcatcagcggccggccctgccctgggggccctgccccacccaggcaccacggccccccaggccccaccttcttccggcagcaggacggcctgctgcggggcggctatgaggcccaggagcccctgtgcccagctgtgccccccaggaaggctgtgcctgtgaccagcttcacctacatcaatgaagacttcagaacagagagcccccccagccccagcagtgatgtggaggatgcccgggagcagagggcccacaatgcccacctgcggggccccccacccaagctgatccctgtgtctgggaagctggagaagaacatggagaagatcctgatccggcccacagccttcaagcctgtgctgcccaagcccaggggggcccccagcctgcccagcttcatgggcccccgggccaccggcctgagcggcagccagggcagcctgacccagctgtttggaggccctgccagcagcagcagcagcagcagcagcagcagcgctgctgacaagcccctggccttcagcggctgggccagcggctgccccagcggcaccctgagtgacagcggcaggaacagcctgagcagcctgcccacctacagcactggaggagctgagcccaccaccagcagccctgggggccacctgcccagccacggcagcggccgcggggccctgcccggccctgcccggggcgtgcccaccggccccagccacagcgacagcggccgcagcagcagcagcaagagcacaggcagcctgggcggccgggtggccggcggcctgctgggcagcggcacccgggccagcccagacagcagcagctgtggggagaggagccccccacctcctcctcctccacccagtgatgaggccctgctgcactgtgtgctggagggcaagctgcgggaccgggaggccgagctgcagcagctgcgggacagcctggatgaaaatgaggccaccatgtgccaggcctatgaggagcggcagaggcactggcagcgggagcgggaggccctgcgggaggactgtgccgcccaggcccagagggcccagagggcccagcagctgctgcagctgcaggtgttccagctgcagcaggagaagaggcagctgcaggatgactttgcccagctgctgcaggagcgggagcagctggagcggcgctgtgccaccctggagcgggagcagcgggagctgggcccccggctggaggagaccaagtgggaggtgtgccagaagtctggagagatcagcctgctgaagcagcagctgaaggagagccaggccgagctggtgcagaagggcagcgagctggtggccctgcgggtggccctgcgggaggcccgggccaccctgcgggtgtctgagggccgggcccggggcctgcaggaggccgcccgggcccgggagctggagctggaggcctgcagccaggagctgcagaggcaccggcaggaggccgagcagctgcgggagaaggccggccagctggatgctgaggccgccggcctgcgggagccccctgtgcccccagccacagctgaccccttcctgctggccgagagtgatgaggccagcgccacagccaaccctgtgcaccggcgcttccagcccaccccagcccggggagctgggaagaagaagggcctgccccccctgcacatccccccagaccccaaggcccgggagagccagatggccccagctgccccagatgtgcctgcccacatcggcggccagggccgggcctgggcccgcttccctggcctgagcagcgctgccagcctgctggagtag

SEQ ID NO: 18917 - DNA, 1473 bp, Artificial Sequence
  Description of Artificial Sequence: Synthetic coding sequence
atgaatggagccctggaccacagcgaccagcctgaccctgatgccatcaagatgtttgtgggccagatccccaggtcctggagcgagaaggagctgaaggagctgtttgagccctatggagctgtgtaccagatcaacgtgctgcgggacaggagccagaaccccccccagagcaagggctgctgctttgtgaccttctacaccaggaaggccgccctggaggcccagaatgccctgcacaacatcaagaccctgcccggcatgcaccaccccatccagatgaagccagctgacagcgagaagagcaatgctgtggaggacaggaagctgttcatcggcatggtgtccaagaagtgcaatgaaaatgacatccgggtgatgttcagccccttcggccagatcgaggagtgccgcatcctgcggggcccagatggcctgagccggggctgtgcctttgtgaccttcagcacccgggccatggcccagaatgccatcaaggccatgcaccagagccagaccatggagggctgcagcagccccatcgtggtgaagtttgctgacacccagaaggacaaggagcagaggcggctgcagcagcagctggcccagcagatgcagcagctgaacacagccacctggggcaacctgaccggcctgggcggcctgaccccccagtacctggccctgctgcagcaggccaccagcagcagcaacctgggcgccttcagcggcatccagcagatggccggcatgaatgccctgcagctgcagaacctggccaccctggccgctgctgctgctgctgcccagaccagcgccaccagcaccaatgccaaccccctgagcaccaccagcagcgccctgggcgccctgaccagccctgtggccgccagcacccccaacagcacagctggggccgccatgaacagcctgaccagcctgggcaccctgcagggcctggccggggccaccgtgggcctgaacaacatcaatgccctggccgtggcccagatgctgagcggcatggccgccctgaatggaggcctgggcgccaccggcctgaccaacggcacagctggcaccatggatgccctgacccaggcctacagcggcatccagcagtatgctgctgctgccctgcccaccctgtacagccagagcctgctgcagcagcagagcgctgctggcagccagaaggagggccctgagggcgccaacctcttcatctaccacctgccccaggagtttggagaccaggacatcctgcagatgttcatgccctttggaaatgtcatcagcgccaaggtgttcatcgacaagcagaccaacctgagcaagtgcttcggctttgtgtcctatgacaaccctgtgtctgcccaggccgccatccaggccatgaatggcttccagatcggcatgaagaggctgaaggtgcagctgaagaggagcaagaatgacagcaagccctactag

SEQ ID NO: 18918 - DNA, 627 bp, Artificial Sequence
  Description of Artificial Sequence: Synthetic coding sequence
atggccgcctctgtggagcagcgggagggcaccatccaggtgcagggccaggccctcttcttccgggaggccctgcccggcagcggccaggcccgcttctctgtgctgctgctgcacggcatccgcttcagcagcgagacctggcagaacctgggcaccctgcaccggctggcccaggccggctacagagctgtggccatcgacctgcccggcctgaagggggagcccccagcccaggagcccctgctgagccagagccgggccagcttcctggccgctgtggtggatgccctggagctgggcccccctgtggtgatcagccccagcctgagcggcatgtacagcctgcccttcctgacagcccctggcagccagctgcccggctttgtgcctgtggcccccatctgcacagacaagatcaatgctgccaactatgcctctgtgaagaccccagccctgattgtgtatggagaccaggaccccatgggccagaccagctttgagcacctgaagcagctgcccaaccaccgggtgctgatcatgaagggggccggccacccctgctacctggacaagccagaggagtggcacacaggcctgctggacttcctgcagggcctgcagtag

SEQ ID NO: 18919 - DNA, 546 bp, Artificial Sequence
  Description of Artificial Sequence: Synthetic coding sequence
atggagagccgctctgtggcccaggccggcgtgcagtggtgtgacctgggcagcctgcagcccccacctcctggcttcaagcagttctcctacttcagcctgcagagctcctgggactaccgctacgtgcccccctgcccagccaactttgtgttcctggtggagatgggcttcctgcacgtggaccaggccggcctgaagctgctgaccagcggcatcgactttgccaccaggaagatcgccaagctgctgaagccccagaaggtgattgagcagaatggagacagcttcaccatccacaccaacagcagcctgaggaactactttgtgaagttcaaggtgggggaggagtttgatgaggacaacagaggcctggacaacaggaagtgcaagagcctggtgatctgggacaatgaccggctgacctgcatccagaagggggagaagaagaacagaggctggacccactggattgaaggagacaagctgcacctggagatgttctgtgagggccaggtgtgcaagcagaccttccagagggcctag

SEQ ID NO: 18920 - DNA, 1647 bp, Artificial Sequence
  Description of Artificial Sequence: Synthetic coding sequence
atgtctgccagcctgaactacaagagcttcagcaaggagcagcagaccatggacaacctggagaagcagctgatctgccccatctgcctggagatgttcaccaagcctgtggtgatcctgccctgccagcacaacctgtgcaggaaatgtgccagtgacatcttccaggccagcaacccctacctgcccacccggggcggcaccaccatggccagcggcggccgcttccgctgccccagctgcagacatgaggtggtgctggacagacatggagtgtatggcctgcagaggaacctgctggtggagaacatcatcgacatctacaagcaggagagcaccaggcctgagaagaagagtgaccagcccatgtgtgaggagcacgaggaggagcgcatcaacatctactgcctgaactgtgaggtgcccacctgcagcctgtgcaaggtgtttggagcccacaaggactgccaggtggcccccctgacccacgtgttccagaggcagaagtctgagctgagtgatggcatcgccatcctggtgggcagcaatgacagagtgcagggcgtcatcagccagctggaggacacctgcaagaccatcgaggagtgctgcaggaagcagaagcaggagctgtgtgagaagtttgactacctgtatggcatcctggaggagaggaagaatgagatgacccaggtgatcaccaggacccaggaggagaagctggagcacgtgcgggccctgatcaagaagtacagcgaccacctggagaatgtgtccaagctggtggagagcggcatccagttcatggatgagcctgagatggctgtgttcctgcagaatgccaagaccctgctgaagaagatcagcgaggccagcaaggccttccagatggagaagattgagcacggctatgagaacatgaaccacttcaccgtgaacctgaaccgggaggagaagatcatccgggagattgacttctacagagaagatgaagatgaggaggaggaggagggcggggagggggagaaggagggggagggggaggtgggcggggaggccgtggaggtggaggaggtggagaatgtgcagacagagttccctggagaagatgaaaatcctgagaaggccagcgagctgagccaggtggagctgcaggccgcccctggggccctgcctgtgagcagccctgagcccccaccagccctgcccccagctgctgatgcccctgtgacccagggcgaggtggtgcccaccggcagcgagcagaccacagagagcgagacccctgtgcctgctgctgctgagacagctgaccccctcttctaccccagctggtacaagggccagaccaggaaggccaccaccaaccccccctgcaccccaggcagcgagggcctgggccagatcggccccccaggcagcgaggacagcaatgtgaggaaggccgaggtggccgctgctgctgccagcgagagagctgctgtgtctgggaaggagaccagcgccccagctgccaccagccagattggatttgaggccccacccctgcagggccaggccgccgccccagccagcggcagcggggctgacagcgagcccgcccggcacatcttctccttctcctggctgaacagcctgaatgaatag

SEQ ID NO: 18921 - DNA, 1374 bp, Artificial Sequence
  Description of Artificial Sequence: Synthetic coding sequence
atgttccccaagttcagcctgcgctccatgttccacggggccggcggcggcaatgacatccagtggtgcttcagccaggtgaagggagctgtggatgatgatgtggccgaggccgacatcatcagcacagtggagttcaaccacagcggggagctgctggccactggagacaagggcggccgggtggtgatcttccagcaggagcaggagaacaagatccagagccacagcagaggagagtacaacgtgtacagcaccttccagagccatgagcctgagtttgactacctgaagagcctggagattgaggagaagatcaacaagatccgctggctgccccagaagaatgctgcccagttcctgctgagcaccaatgacaagaccatcaagctgtggaagatcagcgagcgggacaagaggcctgagggctacaacctgaaggaggaggatggccgctacagagaccccaccaccgtgaccaccctgcgggtgcctgtgttccggcccatggacctgatggtggaggccagcccccggcgcatctttgccaatgcccacacctaccacatcaacagcatcagcatcaacagcgactatgagacctacctgtctgcagatgacctgcgcatcaacctgtggcacctggagatcacagaccgctccttcaacatcgtggacatcaagccagccaacatggaggagctgacagaggtgatcacagctgctgagttccaccccaacagctgcaacacctttgtgtacagcagcagcaagggcaccatccggctgtgtgacatgagggccagcgccctgtgtgacagacacagcaagctgtttgaggagcctgaggaccccagcaacagaagcttcttcagcgagatcatcagcagcatcagtgatgtgaagttcagccacagcggccgctacatgatgacccgggactacctgtctgtgaagatctgggacctgaacatggagaacagacctgtggagacctaccaggtgcatgagtacctgcggagcaagctgtgcagcctgtatgaaaatgactgcatctttgacaagtttgagtgctgctggaatggaagtgacagcgtggtgatgacaggcagctacaacaacttcttcaggatgtttgacaggaacaccaagagggacatcaccctggaggccagccgggagaacaacaagcccaggacagtgctgaagcccaggaaggtgtgtgccagcggcaagaggaagaaggatgagatctctgtggacagcctggacttcaacaagaagatcctgcacacagcctggcaccccaaggagaacatcatcgctgtggccaccaccaacaacctgtacatcttccaggacaaggtgaactag

SEQ ID NO: 18922 - DNA, 738 bp, Artificial Sequence
  Description of Artificial Sequence: Synthetic coding sequence
atggccggcctggagctgctgagtgaccagggctacagagtggatggaagaagagctggggagctgaggaagatccaggccaggatgggcgtgtttgcccaggctgatggcagcgcctacatcgagcagggcaacaccaaggccctggccgtggtgtatggcccccatgagatccggggcagccgggcccgggccctgcctgaccgggccctggtgaactgccagtacagcagcgccaccttcagcactggagagaggaagaggcggccccatggagacaggaagagctgtgagatgggcctgcagctgcggcagacctttgaagctgccatcctgacccagctgcaccccaggagccagattgacatctacgtgcaggtgctgcaggctgatggcggcacctacgccgcctgtgtgaatgctgccaccctggccgtgctggatgctggcatccccatgagggactttgtgtgtgcctgcagcgctggctttgtggatggaacagccctggccgacctgagccacgtggaggaggccgccggcggcccccagctggccctggccctgctgcctgccagcggccagatcgccctgctggagatggatgcccggctgcacgaggaccacctggagcgggtgctggaggccgccgcccaggccgccagagatgtgcacaccctgctggacagagtggtgcggcagcacgtgcgggaggccagcatcctgctgggggactag

SEQ ID NO: 18923 - DNA, 2631 bp, Artificial Sequence
  Description of Artificial Sequence: Synthetic coding sequence
atgatggctgatggagctgctgctggggccggcggcagccccagcctgcgggagctgcgggccaggatggtggccgccgccaatgagatcgccaaggagaggaggaagcaggatgtggtgaacagagtggccacccacagcagcaacatccgcagcaccttcaagcctgtgattgatggctccatgctgaagaatgacatcaagcagaggctggcccgggagcggcgggaggagaagaggcggcagcaggatgccaacaaggagacccagctgctggagaaggagaggaagaccaagctgcagtatgagaagcagatggaggagcggcagaggaagctgaaggagaggaaggagaaggaggagcagaggagaattgctgctgaggagaagaggcaccagaaggatgaggcccagaaggagaagttcaccgccatcctgtaccgcaccctggagcggcggcggctggctgatgactaccagcagaagcgctggagctggggcggcagcgccatggccaacagcgagagcaagacagccaacaagaggtctgccagcacagagaagctggagcagggcaccagcgccctgatccggcagatgcccctgagcagcgctggcctgcagaacagcgtggccaagaggaagacagacaaggagaggagcagcagcctgaacagaagagacagcaacctgcacagcagcacagacaaggagcaggccgagaggaagccccgggtgactggagtgaccaactacgtgatgcagtatgtgacagtgcccctgaggaagtgcaccagtgatgagctgcgggctgtgatgttccccatgagcaccatgaagatccccccccagaccaaggtggaggagagccccctggagaaggtggagaccccacccaaggcctctgtggatgccccaccccaggtgaatgtggaggtgttctgcaacacctccatggaggccagccccaaggccggcgtgggcatggcccctgaggtgtccacagacagcttccctgtggtgtctgtggatgtgtcccctgtggtgtccacctatgacagcgagatgtccatggatgccagccctgagctgagcattgaggccctgcccaaggtggacctggagaccgtgcccaaggtgtccatcgtggccagccctgaggccagcctggaggcccctcctgaggtgtccctggaggccctgcctgaggtgtctgtggaggccgcccctgagggcagcctggaggccccacccaagggcagcgctgaggtggcccccaaggagagcgtgaagggcagccccaaggagagcatggaggccagccctgaggccatggtgaaggccagccccaagaccagcctggaggcctccatggaggccagccccaaggccaaggccagagatgcccccaagaagtctgagatggacaagcaggccctgatccccatcgccaagaagaggctgagcagctacacagagtgctacaagtggagcagcagcccagaaaatgcctgtggcctgcccagccccatcagcaccaaccggcagatccagaagaactgcccccccagccccctgcccctcatcagcaagcagagcccccagaccagcttcccctacaagatcatgcccatccagcacaccctgtctgtgcagagcgccagcagcacagtgaagaagaagaaggagaccgtgtccaagaccaccaacagatgtgaggccctgagccagaggcacatgatctatgaggagagcggcaacaagagcacagctggcatcatgaatgctgaggccgccaccaagatcctgacagagctgcggcggctggcccgggagcagcgggagaaggaggaggaggagcggcagcgggaggagatgcagcagagggtcatcaagaagagcaaggacatggccaaggaggccgtgggcggccaggccgaggaccacctgaagctgaaggatggccagcagcagaatgagaccaagaagaagaagggctggctggaccaggaggaccaggaggcccccctgcagaagggagatgccaagatcaaggcccaggaggaggccgacaagaggaagaaggagcacgagcgcatcatgctgcagaacctgcaggagcggctggagaggaagaagagaattgaggagatcatgaagaggaccaggaagacagatgtgaatgccagcaaggtgacagagaccagcagccatgacatctatgaggaggccgaggccgacaatgaggagagtgacaaggacagcctgaatgagatgttccccagcgccatcctgaatggcaccggcagccccaccaagttcaagatgcccttcaacaatgccaagaagatgacccacaagctggtgttcctggaggatggcaccagccaggtgaggaaggagcccaagacctacttcaatggagacctgaagaacttccggcagaagtccatgaaggacaccagcatccaggaggtggtgtcccggcccagcagcaagaggatgaccagccacaccaccaagaccaggaaggcagatgagaccaacaccaccagccgcagcagcgcccagaccaagtctgagggcttccatgacatcctgcccaagagcagtgacaccttccggcagtag

SEQ ID NO: 18924 - DNA, 6291 bp, Artificial Sequence
  Description of Artificial Sequence: Synthetic coding sequence
atgtgcagcaccccaggcatgcctgcccctggggccagcctggccctgcgggtgtcctttgtggatgtgcacccagatgtgattcctgtgcagctgtggggcctggtgggggagaggagaggagagtacctgcggctgagccgggagatccaggaggccgccgccacccggggccagtgggccctgggcagcgccagcgccagccctggagagctgtgcctggtgcaggtgggcctgctgtggcaccgctgccgggtggtgtcccggcaggcccaggagagcagggtcttcctgctggatgagggccgcaccatcacagctggagctggcagcctggcccctggccggcgggagttcttcaacctgcccagcgaggtgctgggctgtgtgctggccggcctggtgcctgctggctgtggggccggcagcggggagcccccccagcactggccagcagatgctgtggacttcctgagcaacctgcagggcaaggaggtgcacggctgtgtgctggatgtgctgctgctgcaccggctggtgctgctggaggtgcctgatgtgttccagcagatgagggagctgggcctggcccggcgggtgcctgacagcctcttccgcagcctgctggagcgctacctgacagctgccacagcctctgtgggcagcggcgtgcctgtgctgagccgggtgcccctgaagcagaagcagcccggcctggactacttctacccccagctgcagctgggcgtgacagaagctgtggtgatcacccaggtgtgccacccccaccgcatccactgccagctgcggtctgtgtcccaggagatccaccggctgtctgagagcatggcccaggtgtaccggggcagcactggaactggagatgagaacagcaccagcgccacctgggaggagcgggaggagagcccagacaagccaggcagcccctgtgccagctgtggcctggatggccactggtaccgggccctgctgctggagaccttccggccccagagatgtgcccaggtgctgcacgtggactatggcaggaaggagctggtgtcctgcagcagcctgcgctacctgctgcctgagtacttcaggatgcctgtggtgacctacccctgtgccctgtatggcctgtgggatggcggccggggctggagccgcagccaggtgggggacctgaagaccctcatcctgggcaaggctgtgaatgccaagattgagttctactgcagctttgaacatgtgtactacgtgtccctgtatggagaagatggcatcaacctgaacagagtgtttggagtgcagagctgctgcctggccgacagagtgctgcagagccaggccacagaggaggaggagcctgagaccagccagagccagagccctgctgaggaggtggatgaggagatcagcctgcctgccctgcggagcatccggctgaagatgaatgccttctatgatgcccaggtggagtttgtgaagaaccccagcgagttctggatccggctgaggaagcacaacgtgaccttcagcaagctgatgaggaggatgtgtggcttctacagcagcgccagcaagctggatggagtggtgctgaagccagagccagatgacctgtgctgcgtgaagtggaaggaaaatggctactaccgggccatcgtgaccaagctggatgacaagtctgtggatgtgttcctggtggaccggggcaacagtgaaaatgtggactggtatgatgtgaggatgctgctgccccagttccggcagctgcccatcctggccgtgaagtgcaccctggccgacatctggcccctgggcaagacctggagccaggaggccgtgtccttcttcaagaagacagtgctgcacaaggagctggtgatccacatcctggacaagcaggaccaccagtatgtgattgagatcctggatgagagcaggactggagaggagaacatcagcaaggtgattgcccaggccggctacgccaagtaccaggagtttgagaccaaggagaacatcctggtgaatgcccacagccctggccacgtgagcaaccacttcaccacagagagcaacaagatcccctttgccaagacaggagagggggagcagaaggccaagcgggagaacaagaccacctctgtgtccaaggccctgagtgacaccaccgtggtgaccaacggcagcacagagctggtggtgcaggagaaggtgaagagggcctctgtgtacttccccctgatgcagaactgcctggagatcaagccaggcagcagcagcaaaggagagctggaggtgggcagcacagtggaggtgcgggtgtcctatgtggagaaccctggctacttctggtgccagctgaccaggaacatccagggcctgaagaccctgatgtctgacatccagtactactgcaagaacacagctgccccccaccagaggaacaccctggcctgcctggccaagaggacagtgaaccggcagtggagccgggccctgatcagcggcatccagagcgtggagcacgtgaatgtgacctttgtggactatggagaccgggagatggtgtctgtgaagaacatctacagcatcagcgaggagttcctgaaggtgaaggcccaggccttccgctgcagcctgtacaacctgatccagcctgtgggccagaacccctttgtgtgggatgtgaaggccatccaggccttcaatgagttcatcgacaatgcctggcagaagaacctggagctgaagtgcaccatctttgccctggccagcatcaatgaggagctgttcaacatcgtggacctgctgacccccttccagagcgcctgccacttcctggtggagaagaggctggcccggcctgtgaagctgcagaagcccctggagagctctgtgcagctgcacagctacttctacagcacccatgacatgaagattggcagcgaggagctggtgtacatcacccacattgatgacccctggaccttctactgccagctggccagaaatgccaacatcctggagcagctgagctgcagcatcacccagctgagcaaggtgctgctgaacctgaagaccagccccctgaaccctggcaccctgtgcctggccaagtacacagatggcaactggtaccggggcatcgtgattgagaaggagcccaagaaggtgttctttgtggactttggaaacatctacgtggtgaccagtgatgacctgctgcccatccccagtgatgcctatgatgtgctgctgctgcccatgcaggccgtgcgctgcagcctgagtgacatcccagaccacatccctgaggaggtggtggtgtggttccaggagaccatcctggacaagagcctgaaggccctggtggtggccaaggaccctgatggcaccctcatcatcgagctgtatggagacaacatccagatcagcgccagcatcaacaagaagctgggcctgctgagctacaaggaccgcatcaggaagaaggagagcgaggtgctgtgcagcaccacagagaccctggaggagaagaatgaaaacatgaagctgccctgcacagagtacctgagcaagtctgtgggctacaagctgcccaacaaggagatcctggaggagagctacaagccccagatcaacagcagctacaaggagctgaagctgctgcagagcctgaccaagaccaacctggtgacccagtaccaggacagcgtgggcaacaagaacagccaggtgttccccctgaccacagagaagaaggaggagatctctgctgagacccccctgaagacagcccgggtggaggccaccctgtctgagaggaagattggagacagctgtgacaaggacctgcccctgaagttctgtgagttcccccagaagaccatcatgcctggcttcaagaccaccgtgtatgtgagccacatcaatgacctgagtgacttctacgtgcagctgattgaagatgaagctgagatcagccacctgtctgagcggctgaacagcgtgaagaccaggcctgagtactacgtgggcccccccctgcagagaggagacatgatctgtgctgtgtttcctgaggacaacctgtggtaccgggccgtcatcaaggagcagcagcccaatgacctgctgtctgtgcagttcatcgactatggaaatgtgtctgtggtgcacaccaacaagattggccgcctggacctggtgaatgccatcctgcccggcctgtgcatccactgcagcctgcagggctttgaggtgcctgacaacaagaacagcaagaagatgatgcactacttcagccagaggaccagcgaggccgccatccgctgtgaatttgtgaagttccaggaccgctgggaggtgatcctggctgatgagcacggcatcatcgcagatgacatgatcagccgctatgccctgtctgagaagagccaggtggagctgagcacccaggtgatcaagagcgccagcagcaagtctgtgaacaagagtgacatcgacaccagcgtcttcctgaactggtacaaccctgagaagaagatgatccgggcctatgccaccgtgattgatggccctgagtacttctggtgccagtttgctgacacagagaagctgcagtgcctggaggtggaggtgcagacagctggggagcaggtggccgacagaagaaactgcatcccctgcccctacatcggggacccctgcatcgtgcgctaccgggaggatggccactactaccgggccctgatcaccaacatctgtgaggactacctggtgtctgtgcggctggtggactttggaaatattgaggactgtgtggaccccaaggccctgtgggccatccccagcgagctgctgtctgtgcccatgcaggccttcccctgctgcctgagcggcttcaacatcagcgagggcctgtgcagccaggagggcaatgactacttctatgagatcatcacagaagatgtgctggagatcaccatcctggagatcagaagagatgtgtgtgacatccccctggccatcgtggacctgaagagcaagggcaagagcatcaatgagaagatggagaagtacagcaagacaggcatcaagagcgccctgccctatgagaacatcgacagcgagatcaagcagaccctgggcagctacaacctggatgtgggcctgaagaagctgagcaacaaggctgtgcagaacaagatctacatggagcagcagacagatgagctggccgagatcacagagaaggatgtgaacatcatcggcaccaagcccagcaacttccgggaccccaagacagacaacatctgtgagggctttgagaacccctgcaaggacaagattgacacagaggagctggagggggagctggagtgccacctggtggacaaggccgagtttgatgacaagtacctgatcaccggcttcaacaccctgctgccccacgccaatgagaccaaggagatcctggagctgaacagcctggaggtgcccctgagcccagatgatgagagcaaggagttcctggagctggagagcattgagctgcagaacagcctggtggtggatgaggagaagggggagctgagccctgtgcccccaaatgtgcccctgagccaggagtgtgtgaccaagggggccatggagctgttcaccctgcagctgcccctgagctgtgaggccgagaagcagcctgagctggagctgcccacagcccagctgcccctggatgacaagatggaccccctgagcctgggcgtgtcccagaaggcccaggagagcatgtgcacagaggacatgaggaagagcagctgtgtggagagctttgatgaccagaggaggatgagcctgcacctgcacggggctgactgtgaccccaagacccagaatgagatgaacatctgtgaggaggagtttgtggagtacaagaacagagatgccatcagcgccctgatgcccctcttcagcgaggaggagagcagtgatggcagcaagcacaacaacggcctgcctgaccacatcagcgcccagctgcagaacacctacaccctgaaggccttcaccgtgggcagcaaatgtgtggtgtggagcagcctgaggaacacctggagcaaatgtgagatcctggagacagctgaggagggcaccagggtgctgaacctgagcaatggcatggaggagatcgtgaacccagaaaatgtgtggaatggcatccccaagctggacaagagccccccagagaagaggggcctggaggtgatggagatctag

SEQ ID NO: 18925 - DNA, 690 bp, Artificial Sequence
  Description of Artificial Sequence: Synthetic coding sequence
atgggcaagagctgcaaggtggtggtgtgtggccaggcctctgtgggcaagaccagcatcctggagcagctgctgtatggcaaccacgtggtgggcagcgagatgattgagacccaggaggacatctacgtgggcagcattgaaacagaccggggcgtgcgggagcaggtgcgcttctatgacacccggggcctgagagatggagctgagctgcccaggcactgcttcagctgcacagatggctacgtgctggtgtacagcacagacagccgggagagcttccagagggtggagctgctgaagaaggagattgacaagagcaaggacaagaaggagggcctgaccctgcccccccggctggagtgcagcggcatgatcacagcccactgcagcctgaacctgccccggctgcgctggagcagctgcctgagccccctgctgcggctgcaggtgaccatcgtggtgctgggcaacaagtgtgacctgcaggagcagaggagagtggaccctgatgtggcccagcactgggccaagtctgagaaggtgaagctgtgggaggtgtctgtggccgaccggcgcagcctgctggagccctttgtgtacctggccagcaagatgacccagccccagagcaagagcgccttccccctgagcaggaagaacaagggcagcggcagcctggatggatag

SEQ ID NO: 18926 - DNA, 2412 bp, Artificial Sequence
  Description of Artificial Sequence: Synthetic coding sequence
atggagagcggccccagggctgagctgggcgctggggcccccccagctgtggtggcccggaccccacctgagccccggcccagccctgagggggaccccagccccccacctccacccatgtctgccctggtgcctgacaccccaccagacaccccaccagccatgaagaatgccaccagcagcaagcagctgcccctggagcctgagagccccagcggccaggtgggccccaggcctgccccaccccaggaggagagccccagcagcgaggccaagagccggggccccaccccaccagccatgggccccagagatgcccggcccccccggcgcagcagccagcccagccccacagctgtgcctgccagtgacagcccccccaccaagcaggaggtgaagaaggccggggagcggcacaagctggccaaggagcggcgggaggagcgggccaagtacctggccgccaagaaggctgtgtggctggagaaggaggagaaggccaaggccctgcgggagaagcagctgcaggagaggagaagaaggctggaggagcagaggctgaaggccgagcagaggcgggccgccctggaggagcggcagaggcagaagctggagaagaacaaggagagatatgaagctgccatccagaggtctgtgaagaagacctgggccgagatccggcagcagcgctggagctgggccggggccctgcaccacagcagccctggccacaagaccaacagaagcctgcagctgagcgcctgggagagcagcatcgtggaccggctgatgacccccaccctgtccttcctggcccggagccgctctgctgtgaccctgcccagaaatggccgggaccagggccggggctgtgaccccggccggggccccacctggggccgggccggggccagcctggcccggggcccccagcctgacaggacccaccccagcgctgctgtgcctgtgtgccccaggtctgccagcgccagccccctgaccccctgcagcgtgaccaggtctgtgcaccgctgtgccccagctggggagcggggggagaggaggaagcccaatgccggcggcagccctgcccctgtgagaagaagacctgaggccagccctgtgcagaagaaggagaagaaggacaaggagcgggagaatgagaaggagaagagcgccctggcccgggagaggagcctgaagaagaggcagagcctgcctgccagcccccgggcccggctgagcgccagcacagccagcgagctgagccccaagagcaaggcccggcccagcagccccagcacctcctggcacaggcctgccagcccctgccccagccctggccctggccacaccctgccccccaagccacccagcccccggggcaccacagccagccccaagggccgggtgcggaggaaggaggaggccaaggagagccccagcgctgctggccctgaggacaagagccagagcaagaggcgggccagcaatgagaaggagagcgctgccccagccagccctgcccccagccctgcccccagccccaccccagccccaccccagaaggagcagcccccagctgagacccccacagatgctgctgtgctgaccagccccccagccccagcccctcctgtgacccccagcaagcccatggccggcaccacagaccgggaggaggccacccggctgctggccgagaagaggcggcaggcccgggagcagcgggagcgggaggagcaggagcggcggctgcaggccgagcgggacaagaggatgagggaggagcagctggcccgggaggccgaggcccgggcagagcgggaggccgaggccaggagaagagaggagcaggaggcccgggagaaggcccaggccgagcaggaggagcaggagcggctgcagaagcagaaggaggaggccgaggcccggagccgggaggaggccgagcggcagaggctggagcgggagaagcacttccagcagcaggagcaggagcggcaggagaggaggaagaggctggaggagatcatgaagaggaccaggaagtctgaggtgtctgagaccaagaagcaggacagcaaggaggccaatgccaacggcagcagccctgagcctgtgaaggctgtggaggcccggagccctggcctgcagaaggaggccgtgcagaaggaggagcccatcccccaggagccccagtggagcctgcccagcaaggagctgcctgccagcctggtgaatggcctgcagcccctgcctgcccaccaggagaatggcttcagcaccaacggccccagcggggacaagagcctgagcaggaccccagagaccctgctgccctttgctgaggccgaggccttcctgaagaaggctgtggtgcagagcccccaggtgacagaggtgctgtag

SEQ ID NO: 18927 - DNA, 1125 bp, Artificial Sequence
  Description of Artificial Sequence: Synthetic coding sequence
atgagggcccccatgctgcagaagcagcaggcccccaggatggacaccccacctcctgaggagcggctggagaagcagaatgagaagctgaacaaccaggaggaggagacagagttcaaggagctggatggcctgcgggaggccctggccaacctgcggggcctgtctgaggaggagaggtctgagaaggccatgctgcggagccgcatcgaggagcagagccagctgatctgcatcctgaagagaagaagtgatgaggccctggagcgctgccagatcctggagctgctgaatgctgagctggaggagaagatgatgcaggaggccgagaagctgaaggcccagggcgagtacagcaggaagctggaggagcgcttcatgaccctggccgccaaccacgagctgatgctgcgcttcaaggatgagtacaagtctgagaacatcaagctgcgggaggagaatgagaagctgcggctggagaacagcagcctcttcagccaggccctgaaggatgaggaggccaaggtgctgcagctgactgtgcgctgtgaggccctgactggagagctggagaccctgaaggagcgctgtgcccaggatgcctgccaggcccaggcccgggagaaggagctgctggagctgcagagccagcaggcctgcacccacaccaaggagacagagcagctgcggagccagctgcagaccctgaagcagcagcaccagcaggccgtggagcagatcgccaaggccgaggagacccacagcagcctgagccaggagctgcaggcccggctgcagacagtgacccgggagaaggaggagctgctgcagctgagcattgaaagaggcaaggtgctgcagaacaagcaggccgagatctgccagctggaggagaagctggagatcgccaatgaagacaggaagcacgccctggagagatttgagcaggaggccgtggccgtggacagcaacctgcgggtgcgggagctgcagaggaaggtggatggcatccagaaggcctatgatgagctgcggctgcagagcgaggccttcaagaagcacagcctggacctgctgagcaaggagcgggagctgaatggcaagctgcggcacctgagcccctag

SEQ ID NO: 18928 - DNA, 585 bp, Artificial Sequence
  Description of Artificial Sequence: Synthetic coding sequence
atggaggatggcctgctggagatcatgaccaaggatggaggagacatgcctgcccccctggaggtgtccacagtgcctgctgtgggagatgtgatctctggagagtacaatggaggcatgaaggagctgatggagcacctgaaggcccagctgcaggccctgtttgaagatgtgcgggccatgagaggagccctggatgagcaggccagccacatccaggtgctgagtgatgatgtgtgtgccaaccagagggccatcgtgtccatgtgccagatcatgaccacagccccccggcagggcggcctgggcgtggtgggcggcaagggcagcttccagagcgacccccaggagcctgagacccccagccctggcattggagacagcggcctgctgggccgggaccctgaagatgaggaggaggaggaggaggagaaggagatgcccagccctgccacccccagcagccactgtgagaggcctgagagcccctgtgccggcctgctgggcggagatggccccctggtggagcccctggacatgccagacatcaccctgctgcagctggagggggaggccagcctgtag

SEQ ID NO: 18929 - DNA, 1281 bp, Artificial Sequence
  Description of Artificial Sequence: Synthetic coding sequence
atggcccacctgcggggctttgccaaccagcacagccgggtggaccctgaggagctgttcaccaagctggaccgcatcggcaagggcagctttggagaggtgtacaagggcatcgacaaccacaccaaggaggtggtggccatcaagatcatcgacctggaggaggctgaagatgaaattgaggacatccagcaggagatcaccgtgctgagccagtgtgacagcccctacatcacccgctacttcggcagctacctgaagagcaccaagctgtggatcatcatggagtacctgggcggcggcagcgccctggacctgctgaagccaggccccctggaggagacctacatcgccaccatcctgcgggagatcctgaagggcctggactacctgcacagcgagaggaagatccaccgggacatcaaggccgccaacgtgctgctgtctgagcagggagatgtgaagctggccgactttggagtggccggccagctgacagacacccagatcaagaggaacacctttgtgggcacccccttctggatggcccctgaggtgatcaagcagagcgcctatgacttcaaggctgacatctggagcctgggcatcacagccatcgagctggccaagggggagccccccaacagcgacctgcaccccatgagggtgctcttcctgatccccaagaacagcccccccaccctggagggccagcacagcaagcccttcaaggagtttgtggaggcctgcctgaacaaggacccccgcttccggcccacagccaaggagctgctgaagcacaagttcatcacccgctacaccaagaagaccagcttcctgacagagctgattgaccgctacaagcgctggaagtctgagggccatggagaggagagcagcagcgaggacagcgacattgatggagaggctgaagatggagagcagggccccatctggaccttcccccccaccatccggcccagcccccacagcaagctgcacaagggcacagccctgcacagcagccagaagccagctgagcctgtgaagaggcagcccaggagccagtgcctgagcaccctggtgcggcctgtgtttggagagctgaaggagaagcacaagcagagcggcggctctgtgggcgccctggaggagctggagaatgccttcagcctggccgaggagagctgccccggcatcagtgacaagctgatggtgcacctggtggagcgggtgcagcgcttcagccacaacagaaaccacctgaccagcaccaggtag

SEQ ID NO: 18930 - DNA, 1350 bp, Artificial Sequence
  Description of Artificial Sequence: Synthetic coding sequence
atgatgctgagcacagagggccgggagggctttgtggtgaaggtgcggggcctgccctggagctgcagcgcagatgaggtgatgaggttcttcagtgactgcaagatccagaatggcaccagcggcatccgcttcatctacacccgggagggccggcccagcggggaggcctttgtggagctggagagcgaggaggaggtgaagctggccctgaagaaggaccgggagaccatgggccaccgctacgtggaggtgttcaagagcaacagcgtggagatggactgggtgctgaagcacacaggccccaacagcccagacacagccaatgatggctttgtgcggctgcggggcctgcccttcggctgcagcaaggaggagatcgtgcagttcttcagcggcctggagatcgtgcccaacggcatgaccctgcctgtggacttccagggccgcagcactggagaggcctttgtgcagtttgccagccaggagattgctgagaaggccctgaagaagcacaaggagcgcatcggccaccgctacatcgagatcttcaagagcagcagagctgaggtgaggacccactatgacccccccaggaagctgatggccatgcagaggcctggcccctatgacaggcctggagctggccggggctacaacagcatcggccgcggggccggctttgagaggatgagaagaggagcctacggcggcggctacggcggctatgatgattatggaggctacaatgatggctacggctttggaagtgaccgcttcggccgggacctgaactactgcttcagcggcatgtctgaccacagatatggagatggcggcagcagcttccagagcaccaccggccactgtgtgcacatgaggggcctgccctaccgggccacagaaaatgacatctacaacttcttcagccccctgaaccccatgagggtgcacattgaaattggaccagatggccgggtgactggagaggctgatgtggagtttgccacccatgaagatgctgtggccgccatggccaaggacaaggccaacatgcagcaccgctacgtggagctgttcctgaacagcacagctggcaccagcggcggggcctatgaccacagctatgtggagctgttcctgaacagcacagctggggccagcggcggggcctacggcagccagatgatgggcggcatgggcctgagcaaccagagcagctatggaggccctgccagccagcagctgagcggcggctacggcggcggctacggcggccagagctccatgagcggctatgaccaggtgctgcaggagaacagcagtgactaccagagcaacctggcctag

SEQ ID NO: 18931 - DNA, 1317 bp, Artificial Sequence
  Description of Artificial Sequence: Synthetic coding sequence
atgtgccccaagaatgccagctactacggcaacagagctgccaccctgatgatgctgggccgcttccgggaggccctgggagatgcccagcagagcgtgcggctggatgacagctttgtgcggggccacctgcgggagggcaagtgccacctgagcctgggcaatgccatggccgcctgccgctccttccagagggccctggagctggaccacaagaatgcccaggcccagcaggagttcaagaatgccaatgctgtgatggagtatgagaagattgctgagacagactttgagaagagggacttcaggaaggtggtgttctgcatggaccgggccctggagtttgccccagcctgccaccgcttcaagatcctgaaggccgagtgcctggccatgctgggccgctacccagaggcccagagcgtggccagtgacatcctgaggatggacagcaccaatgctgatgccctgtatgtgcggggcctgtgcctgtactatgaggactgcatcgagaaggctgtgcagttctttgtgcaggccctgaggatggccccagaccacgagaaggcctgcatcgcctgcagaaatgccaaggccctgaaggccaagaaggaggatggcaacaaggccttcaaggagggcaactacaagctggcctatgagctgtacacagaggccctgggcatcgaccccaacaacatcaagaccaatgccaagctgtactgcaacagaggcaccgtgaacagcaagctgaggaagctggatgatgccatcgaggactgcaccaatgctgtgaagctggatgacacctacatcaaggcctacctgcggcgggcccagtgctacatggacacagagcagtatgaggaggccgtgcgggactatgagaaggtgtaccagacagagaagaccaaggagcacaagcagctgctgaagaatgcccagctggagctgaagaagagcaagaggaaggactactacaagatcctgggcgtggacaagaatgcctctgaagatgagatcaagaaggcctacaggaagagggccctgatgcaccacccagacagacacagcggggccagcgctgaggtgcagaaggaggaggagaagaagttcaaggaggtgggggaggccttcaccatcctgagtgaccccaagaagaagaccaggtatgattctggccaggacctggatgaggagggcatgaacatgggagactttgaccccaacaacatcttcaaggccttctttggaggccctgggggcttctcctttgaggccagcggccctggcaacttcttcttccagtttggatag

SEQ ID NO: 18932 - DNA, 165 bp, Artificial Sequence
  Description of Artificial Sequence: Synthetic coding sequence
atgcctgggaagaaggccaggaagaatgcccagcccagccctgcccgggccccagctgagctggaggtggagtgtgccacccagctgcggagatttggagacaagctgaacttccggcagaagctgctgaacctgatcagcaagctgttctgcagcggcacctag

SEQ ID NO: 18933 - DNA, 1404 bp, Artificial Sequence
  Description of Artificial Sequence: Synthetic coding sequence
atggcctctgtggccgccgcccgggctgtgcctgtgggcagcggcctgcggggcctgcagaggaccctgcccctggtggtgatcctgggcgccaccggcaccgggaagagcaccctggccctgcagctgggccagaggctgggcggggagatcgtgtctgctgacagcatgcaggtgtatgagggcctggacatcatcaccaacaaggtgtctgcccaggagcagaggatctgccgccaccacatgatcagctttgtggaccccctggtgaccaactacacagtggtggacttcaggaacagagccacagccctgattgaggacatctttgcccgggacaagatccccatcgtggtgggcggcaccaactactacatcgagagcctgctgtggaaggtgctggtgaacaccaagccccaggagatgggcacagagaaggtgattgacaggaaggtggagctggagaaggaggatggcctggtgctgcacaagaggctgagccaggtggaccctgagatggccgccaagctgcacccccatgacaagaggaaggtggcccggagcctgcaggtgtttgaggagaccggcatcagccacagcgagttcctgcaccggcagcacacagaggagggcggcggccccctgggcggccccctgaagttcagcaacccctgcatcctgtggctgcatgctgaccaggccgtgctggatgagcggctggacaagagggtggatgacatgctggccgccggcctgctggaggagctgcgggacttccaccggcgctacaaccagaagaatgtgtctgagaacagccaggactaccagcacggcatcttccagagcatcggcttcaaggagttccacgagtacctgatcacagagggcaagtgcaccctggagaccagcaaccagctgctgaagaagggcatcgaggccctgaagcaggtgaccaagagatatgccaggaagcagaaccgctgggtgaagaaccgcttcctgagcaggcctggccccatcgtgccccctgtgtatggcctggaggtgtctgatgtgtccaagtgggaggagagcgtgctggagcccgccctggagatcgtgcagagcttcatccagggccacaagcccacagccacccccatcaagatgccctacaatgaagctgagaacaagaggagctaccacctgtgtgacctgtgtgaccgcatcatcattggagaccgggagtgggccgcccacatcaagagcaagagccacctgaaccagctgaagaagagaagaaggctggacagtgatgctgtgaacaccatcgagagccagagcgtgtccccagaccacaacaaggagcccaaggagaagggcagccctggccagaatgaccaggagctgaagtgcagcgtgtag

SEQ ID NO: 18934 - DNA, 558 bp, Artificial Sequence
  Description of Artificial Sequence: Synthetic coding sequence
atgggcgtgaacctgaccaggagcaacaaggagaccgtgaagcacagtgatgtgctcttcctggccgtgaagccccacatcatccccttcatcctggatgaaattggagcagatgtgcaggcccggcacatcgtggtgtcctgtgccgccggcgtgaccatcagctctgtggagaagaagctgatggccttccagcctgcccccaaggtgatccgctgcatgaccaacacccctgtggtggtgcaggagggcgccaccgtgtatgccaccggcacccacgccctggtggaggatggccagctgctggagcagctgatgagctctgtgggcttctgcacagaggtggaggaggacctgattgatgctgtgacaggcctgagcggcagcggccctgcctaccagagcatggctgaccaggagaagatcagccctgctgccctgaagaagaccctgctggacagagtgaagctggagagccccaccgtgtccaccctgacccccagcagccctgggaagctgctgaccaggagcctggccctgggcggcaagaaggactag

SEQ ID NO: 18935 - DNA, 960 bp, Artificial Sequence
  Description of Artificial Sequence: Synthetic coding sequence
atgtctgtgggcttcatcggggccggccagctggccatgctgtggaggggggccagccggccccagcaccctgtgggcagccaggacaacagccagctgcccagaaatgagcccgcccacggcgtgcgggcccaggaggatggctgtgagccagacacccagcagcagggagatggagaggcccagaggaggcctgtgtctggctgtgaggcccacatcatccccttcatcctggatgaaattggagcagatgtgcaggcccggcacatcgtggtgtcctgtgccgccggcgtgaccatcagctctgtggagaagaagctgatggccttccagcctgcccccaaggtgatccgctgcatgaccaacacccctgtggtggtgcaggagggcgccaccgtgtatgccaccggcacccacgccctggtggaggatggccagctgctggagcagctgatgagctctgtgggcttctgcacagaggtggaggaggacctgattgatgctgtgacaggcctgagcggcagcggccctgcctatgccttcatggccctggatgccctggctgatggaggagtgaagatgggcctgccccggcggctggccatccagctgggcgcccaggccctgctgggcgccgccaagatgctgctggacagcgagcagcacccctgccagctgaaggacaacgtgtgcagccctggaggagccaccatccacgccctgcacttcctggagagcggcggcttccgcagcctgctgatcaatgctgtggaggccagctgcatccgcacccgggagctgcagagcatggctgaccaggagaagatcagccctgctgccctgaagaagaccctgctggacagagtgaagctggagagccccaccgtgtccaccctgacccccagcagccctgggaagctgctgaccaggagcctggccctgggcggcaagaaggactag

SEQ ID NO: 18936 - DNA, 708 bp, Artificial Sequence
  Description of Artificial Sequence: Synthetic coding sequence
atgctgagcgccacccggcgggcctgccagctgctgctgctgcacagcctcttccctgtgcccaggatgggcaacagcgccagcaacatcgtgagcccccaggaggccctgcccggcaggaaggagcagacccctgtggccgccaagcaccacgtgaatggaaacagaacagtggagcccttccctgagggcacccagatggctgtgtttggcatgggctgcttctggggcgctgagaggaagttctgggtgctgaagggcgtgtacagcacccaggtgggctttgctgggggctacaccagcaaccccacctacaaggaggtgtgcagcgagaagacaggccacgccgaggtggtgcgggtggtgtaccagcctgagcacatgagctttgaggagctgctgaaggtgttctgggagaaccacgaccccacccagggcatgaggcagggcaatgaccacggcacccagtacagaagtgccatctaccccaccagcgccaagcagatggaggccgccctgagcagcaaagaaaactaccagaaggtgctgtctgagcacggcttcggccccatcaccacagacatccgggagggccagaccttctactatgcagaggactaccaccagcagtacctgagcaagaaccccaacggctactgcggcctgggcggcactggagtgtcctgccctgtgggcatcaagaagtag

SEQ ID NO: 18937 - DNA, 3873 bp, Artificial Sequence
  Description of Artificial Sequence: Synthetic coding sequence
atgagcggccccctggagggcgcagatggcggcggggaccccaggcctggagagagcttctgccctgggggcgtgcccagccctggccccccccagcaccggccctgccccggccccagcctggctgatgacacagatgccaacagcaatggcagcagtggaaatgaaagcaatggccacgagagcagaggagccagccagaggagcagccacagcagcagcagtggaaatggcaaggacagcgccctgctggagaccacagagagcagcaagagcaccaacagccagagccccagcccccccagcagcagcatcgcctacagcctgctgagcgccagcagcgagcaggacaaccccagcaccagcggctgcagcagcgagcagagcgcccgggcccggacccagaaggagctgatgacagccctgcgggagctgaagctgcggctgcccccagagcggcggggcaagggccgcagcggcaccctggccaccctgcagtatgccctggcctgtgtgaagcaggtgcaggccaaccaggagtactaccagcagtggagcctggaggagggggagccctgcagcatggacatgagcacctacaccctggaggagctggagcacatcaccagcgagtacaccctgcagaaccaggacaccttctctgtggccgtgtccttcctgaccggcagaattgtgtacatcagcgagcaggccgctgtgctgctgcgctgcaagagagatgtgttccggggcacccgcttcagcgagctgctggccccccaggatgtgggcgtcttctacggcagcacagcccccagccggctgcccacctggggcaccggggccagcgctggcagcggcctgcgggacttcacccaggagaagagcgtcttctgccgcatccggggcggccctgaccgggaccccggcccccgctaccagcccttccggctgaccccctacgtgaccaagatccgggtgtctgatggagccccagcccagccctgctgcctgctgattgctgagcgcatccacagcggctatgaggccccccgcatccccccagacaagaggatcttcaccaccaggcacacccccagctgcctcttccaggatgtggatgaaagagctgcccccctgctgggctacctgccccaggacctgctgggcgcccctgtgctgctcttcctgcaccctgaggaccggcccctgatgctggccatccacaagaagatcctgcagctggccggccagccctttgaccacagccccatccgcttctgtgccagaaatggagaatatgtgaccatggacacctcctgggccggctttgtgcacccctggagcaggaaggtggcctttgtgctgggccgccacaaggtgaggacagcccccctgaatgaagatgtgttcaccccaccagcccccagccctgcccccagcctggacacagacatccaggagctgtctgagcagatccaccggctgctgctgcagcctgtgcacagccccagccccaccggcctgtgtggggtgggcgctgtgaccagccctggccccctgcacagccctggcagcagcagtgacagcaatggaggagatgctgagggccctggccccccagcccctgtgaccttccagcagatctgcaaggatgtgcacctggtgaagcaccagggccagcagctgttcatcgagagccgggcccggccccagagccggccccggctgcctgccaccggcaccttcaaggccaaggccctgccctgccagagcccagaccctgagctggaggccggcagcgcccctgtgcaggcccccctggccctggtgcctgaggaggccgagaggaaggaggccagcagctgcagctaccagcagatcaactgcctggacagcatcctgcgctacctggagagctgcaacctgcccagcaccaccaagaggaaatgtgccagcagcagcagctacaccaccagcagcgccagtgatgatgaccggcagaggacaggccctgtgtctgtgggcaccaagaaggaccccccatctgctgccctgtctggagagggcgccacccccaggaaggagcctgtggtgggcggcaccctgagccccctggccctggccaacaaggccgagagcgtggtgtctgtgaccagccagtgcagcttcagcagcaccatcgtgcacgtgggggacaagaagcccccagagagtgacatcatcatgatggaggacctgcccggcctggcccctggccctgcccccagccctgcccccagccccaccgtggccccagaccctgccccagatgcctacagacctgtgggcctgaccaaggctgtgctgagcctgcacacccagaaggaggagcaggccttcctgagccgcttccgggacctgggccgcctgcggggcctggacagcagcagcacagcccccagcgccctgggggagcggggctgccaccacggccctgccccacccagcagaagacaccactgccgcagcaaggccaagaggagccgccaccaccagaaccccagggctgaggccccctgctacgtgagccaccccagccctgtgccccccagcaccccctggcccaccccaccagccaccacccccttccctgctgtggtgcagccctaccccctgcctgtgttcagcccccggggcggcccccagcccctgcccccagcccccacctctgtgcccccagctgccttccctgcccccctggtgacccccatggtggccctggtgctgcccaactacctgttccccacccccagcagctacccctacggggccctgcagaccccagctgagggcccccccaccccagccagccacagccccagccccagcctgcctgccctggcccccagccccccccacaggccagacagccccctcttcaacagccgctgcagcagccccctgcagctgaacctgctgcagctggaggagctgcccagggctgagggcgctgctgtggccggcggccctggcagcagcgctggccccccaccacccagcgctgaggccgctgagcctgaggcccggctggccgaggtgacagagagcagcaaccaggatgccctgagcggcagcagtgacctgctggagctgctgctgcaggaggacagccgctctggaactggatctgctgccagcggcagcctgggcagcggcctgggcagcggcagcggcagcggcagccatgagggcggcagcaccagcgccagcatcaccaggagcagccagagcagccacaccagcaagtacttcggcagcattgacagcagcgaggccgaggccggggccgcccggggcggcgctgagcccggggaccaggtgatcaagtatgtgctgcaggaccccatctggctgctgatggccaatgctgaccagagggtgatgatgacctaccaggtgcccagccgggacatgacctctgtgctgaagcaggaccgggagcggctgcgggccatgcagaagcagcagccccgcttcagcgaggaccagaggcgggagctgggcgctgtgcacagctgggtgaggaagggccagctgccccgggccctggatgtgatggcctgtgtggactgtggcagcagcacccaggaccccggccacccagatgaccccctcttcagcgagctggatggcctgggcctggagcccatggaggagggcggcggggagcagggcagcagcggcggcggcagcggggagggggagggctgtgaggaggcccagggcggggccaaggccagcagcagccaggacctggccatggaggaggaggaggagggccgcagcagcagcagccctgccctgcccacagctggcaactgcaccagctag

SEQ ID NO: 18938 - DNA, 2022 bp, Artificial Sequence
  Description of Artificial Sequence: Synthetic coding sequence
atggagaaggctgtgaatgatggcagccacagcgaggagctgttctgccacctgaagaccatcagcgagaaggaggacctgccccgctgcaccagcgagagccacctgagctgcctgaagcaggacatcctgaatgagaagacagagctggaggccaccctgaaggaggccgagctggtgacccacagcgtggagctgctgctgcccctcttcaaggacaccatcgagaagatcaactttgaaaatgccaacctgagcgccctgaacctgaagatcagcgagcagaaggagatcctgatcaaggagctggacaccttcaagtctgtgaagctggccctggagcacctgctgaggaagagggactacaagcagacaggagacaacctgagctccatgctgctggagaacctgacagacaatgaaagtgagaacaccaacctgaagaagaaggtgtttgagaaggaggcccacatccaggagctgagctgcctcttccagagcgagaaggccaacaccctgaaggccaaccgcttcagccagagcgtgaaggtggtgcatgagcggctgcagatccagatccacaagcgggaggctgaaaatgacaagctgaaggagtatgtgaagagcctggagaccaagatcgccaagtggaacctgcagagcaggatgaacaagaatgaggccatcgtgatgaaggaggccagccggcagaagacagtggccctgaagaaggccagcaaggtgtacaagcagaggctggaccacttcaccggggccatcgagaagctgaccagccagatccgggaccaggaggccaagctgtctgagaccatcagcgccagcaatgcctggaagagccactatgagaagatcgtgattgagaagacagagctggaggtgcagatcgagaccatgaagaagcagatcatcaacctgctggaggacctgaagaagatggaggaccacggcaagaacagctgtgaggagatcctgaggaaggtgcacagcattgaatatgaaaatgagaccctgaacctggagaacaccaagctgaagctgcgcttcccctgccgcatcacagagagcaagaacatgaacatcctgattgtgctggacatgctgtgctacatcagcagcgagaagaccaccctggccgccctgaaggatgaggtggtgtctgtggagaatgagctgtctgagctgcaggaggtggagaagaagcagaagaccctcatcgagatgtacaagacccaggtgcagaagctgcaggaggccgctgagatcgtgaagagccgctgtgagaacctgctgcacaagaacaaccagatcaccaagaccaagaacaagaatgtggagaagatgaggggccagatggagagccacctgaaggagctggagcgggtgtgtgacagcctgacagctgctgagcggcggctgcacgagtgccaggagagcctgcagtgctgcaagggcaaatgtgccgaccaggagcacaccatccgggagctgcagggccaggtggatggcaaccacaacctgctgaccaagctgagcctggaggaggagaactgcctgatccagctgaagtgtgagaacctgcagcagaagctggagcagatggatgctgagaacaaggagctggagaagaagctggccaaccaggaggagtgcctgaagcacagcaacctgaagttcaaggagaagtctgctgagtacacagccctggcccggcagctggaggccgccctggaggagggccggcagaaggtggccgaggagattgagaagatgagcagccgggagagcgccctgcagatcaagatcctggacctggagacagagctgaggaagaagaatgaggagcagaaccagctggtgtgcaagatgaacagcaaggcccagcaccaggaggtgtgcctgaaggaggtgcagaacagcctggagaagtctgagaaccagaatgaaagcatcaagaactacctgcagttcctgaagaccagctatgtgaccatgtttgaatag

SEQ ID NO: 18939 - DNA, 798 bp, Artificial Sequence
  Description of Artificial Sequence: Synthetic coding sequence
atggatgacaaggcctctgtgggcaagatctctgtgtccagtgacagcgtgtccaccctgaacagtgaagattttgtgctggtgtcccggcagggagatgagacccccagcaccaacaacggcagtgatgatgagaagacaggcctgaagatcgtgggcaatggcagcgagcagcagctgcagaaggagctggctgatgtgctgatggacccccccatggatgaccagcctggagagaaggagctggtgaagaggagccagctggatggagaaggagatggccccctgagcaaccagctgagcgccagcagcaccatcaaccctgtgcccctggtgggcctgcagaagccagagatgagcctgcctgtgaagccaggccagggcgacagcgaggccagcagccccttcacccctgtggctgatgaggacagcgtggtgttcagcaagctgacctacctgggctgtgcctctgtgaatgcccccaggtctgaggtggaggccctgaggatgatgagcatcctgcggagccagtgccagatcagcctggatgtgaccctgtctgtgcccaacgtgtctgagggcatcgtgcggctgctggacccccagaccaacacagaaattgccaactaccccatctacaagatcctcttctgtgtgcggggccatgatggcaccccagagagtgactgctttgccttcacagagagccactacaatgctgagctgttccgcatccacgtgttccgctgtgagatccaggaggccgtgagcccccaggagaagaccctgtgcaagtag

SEQ ID NO: 18940 - DNA, 636 bp, Artificial Sequence
  Description of Artificial Sequence: Synthetic coding sequence
atgtgggccagcctgagcctggaccaccccagcgccaaggagaaccaggccctgcggctgattgagatgagggaggagaatggaaatgtgcccaagacagagcaggccggcagcctgaagcccctgcgggacaccgggaagagcaacctgaaggagaagaaggccaacagcaagctgaagcagatcgagaaggagtacacccagaagctggccaagagcagccagatcatcgccgagctgcagaccaccatcagcagcctgaaggaggagaacagccagcagcagctggccgctgagcggcggctgcaggatgtgcggcagaagtttgaagatgagaagaagcagctgatccgggacaatgaccaggccatcaaggtgctgcaggatgagctggagaacagaagcaaccaggtgcgctgtgccgagaagaagctgcagcacaaggagctggagagccaggagcagatcacctacatccggcaggagtatgagaccaagctgaagggcctgatgcctgccagcctgcggcaggagctggaggacaccatcagcagcctgaagagccaggtgaacttcctgcagaagagggccagcatcctgcaggaggagctgaccacctaccagggcagaagatag

SEQ ID NO: 18941 - DNA, 867 bp, Artificial Sequence
  Description of Artificial Sequence: Synthetic coding sequence
atgagcagctccatgtggtacatcatgcagagcatccagagcaagtacagcctgtctgagcggctcatccgcaccatcgccgccatccgctccttcccccatgacaacgtggaggacctgatccggggcggcgcagatgtgaactgcacccacggcaccctgaagcccctgcactgtgcctgcatggtgtctgatgctgactgtgtggagctgctgctggagaagggagctgaggtgaatgccctggatggctacaacagaacagccctgcactatgctgctgagaaggatgaggcctgtgtggaggtgctgctggagtatggagccaaccccaatgccctggatggcaacagagacacccccctgcactgggccgccttcaagaacaatgcagaatgtgtgcgggccctgctggagagcggggcctctgtgaatgccctggactacaacaatgacacccccctgtcctgggccgccatgaagggcaacctggagagcgtgtccatcctgctggactatggagctgaggtgcgggtcatcaacctgattggccagacccccatcagccggctggtggccctgctggtgcggggcctgggcacagagaaggaggacagctgctttgagctgctgcacagagctgtgggccactttgagctgaggaagaatggcaccatgccccgggaggtggcccgggacccccagctgtgtgagaagctgactgtgctgtgcagcgcccctggcaccctgaagaccctggcccgctatgctgtgagaagaagcctgggcctgcagtacctgcctgatgctgtgaagggcctgcccctgcctgccagcctgaaggagtacctgctgctgctggagtag

SEQ ID NO: 18942 - DNA, 1341 bp, Artificial Sequence
  Description of Artificial Sequence: Synthetic coding sequence
atgagggagatcgtgcacatccaggccggccagtgtggcaaccagatcggcaccaagttctgggaggtgatcagtgatgagcacggcatcgaccctgctgggggctacgtgggggacagcgccctgcagctggagcgcatcaacgtgtactacaatgaaagcagcagccagaagtatgtgcccagggctgccctggtggacctggagcccggcaccatggattctgtgcgcagcggccccttcggccagctgttccggccagacaacttcatcttcggccagacaggagctggcaacaactgggccaagggccactacacagaaggagctgagctggtggatgctgtgctggatgtggtgaggaaagaatgtgagcactgtgactgcctgcagggcttccagctgacccacagcctgggcggcggcactggaagtggcatgggcaccctgctgatcagcaagatccgggaggagttcccagaccgcatcatgaacaccttctctgtgatgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccaccagcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcagatgtttgatgccaggaacatgatggccgcctgtgaccccaggcatggccgctacctgactgtggccaccgtcttccggggccccatgtccatgaaggaggtggatgagcagatgctggccatccagagcaagaacagcagctactttgtggagtggatccccaacaacgtgaaggtggccgtgtgtgacatccccccccggggcctgaagatggccagcaccttcatcggcaacagcacagccatccaggagctgttcaagaggatcagcgagcagttcagcgccatgttccggaggaaggccttcctgcactggttcaccggggagggcatggatgagatggagttcacagaagctgagagcaacatgaatgacctggtgtctgagtaccagcagtaccaggatgccacagccaatgatggagaggaggcctttgaagatgaggaggaggagattgatggatag

SEQ ID NO: 18943 - DNA, 792 bp, Artificial Sequence
  Description of Artificial Sequence: Synthetic coding sequence
atgctgagcagcaagggcctgactgtggtggatgtgtaccagggctggtgtggcccctgcaagcctgtggtgtccctcttccagaagatgagaattgaggtgggcctggacctgctgcactttgccctggccgaggccgaccggctggatgtgctggagaagtaccggggcaaatgtgagcccaccttcctgttctacgccatcaaggatgaggccctgagtgatgaagatgaatgtgtgagccacggcaagaacaacggggaggatgaggacatggtgtcctctgagaggacctgcaccctggccatcatcaagccagatgctgtggcccacggcaagacagatgagatcatcatgaagatccaggaggccggctttgagatcctgaccaatgaggagaggaccatgacagaagctgaggtgcggctcttctaccagcacaaggccggggaggaggcctttgagaagctggtgcaccacatgtgcagcggccccagccacctgctgatcctgaccaggacagagggctttgaagatgtggtgaccacctggaggacagtgatgggcccccgggaccccaacgtggcccggcgggagcagcctgagagcctgcgggcccagtatggaacagagatgcccttcaatgctgtgcacggcagccgggaccgggaggatgctgaccgggagctggccctgctcttccccagcctgaagttcagtgacaaggacacagaggccccccagggcgagagcagcacccagccccggctgaagatcacagacctggactag

SEQ ID NO: 18944 - DNA, 1089 bp, Artificial Sequence
  Description of Artificial Sequence: Synthetic coding sequence
atgctgaagaacaagggccacagcagcaagaaggacaacctggccgtgaatgctgtggccctgcaggaccacatcctgcatgacctgcagctgaggaacctgtctgtggccgaccacagcaagacccaggtgcagaagaaggagaacaagagcctgaagagggacaccaaggccatcatcgacaccggcctgaagaagaccacccagtgccccaagctggaggacagcgagaaggagtatgtgctggaccccaagcccccacccctgaccctggcccagaagctgggcctcatcggccccccacctccacccctgagcagtgatgagtgggagaaggtgaagcagaggagcctgctgcagggcgacagcgtgcagccctgccccatctgcaaggaggagtttgagctgcggccccaggtgctgctgagctgcagccacgtgttccacaaggcctgcctgcaggcctttgagaagttcaccaacaagaagacctgccccctgtgcaggaagaaccagtaccagaccagggtcatccatgatggagcccggctcttccgcatcaagtgtgtgacccgcatccaggcctactggaggggctgtgtggtgaggaagtggtacagaaacctgaggaagacagtgcccccaacagatgccaagctgaggaagaagttctttgagaagaagttcacagagatcagccaccgcatcctgtgcagctacaacaccaacatcgaggagctgtttgctgagattgaccagtgcctggccatcaacagatctgtgctgcagcagctggaggagaagtgtggccacgagatcacagaggaggagtgggagaagatccaggtgcaggccctgcggcgggagacccatgagtgcagcatctgcctggcccccctgtctgctgctgggggccagagggtgggcgccggccgccgcagccgggagatggccctgctgagctgcagccacgtgttccaccacgcctgcctgctggccctggaggagttctctgtgggggacaggcctcccttccacgcctgccccctgtgccgcagctgctaccagaagaagatcctggagtgctag

SEQ ID NO: 18945 - DNA, 291 bp, Artificial Sequence
  Description of Artificial Sequence: Synthetic coding sequence
atgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggctag

SEQ ID NO: 18946 - DNA, 459 bp, Artificial Sequence
  Description of Artificial Sequence: Synthetic coding sequence
atggccggcctgccccggcgcatcatcaaggagacccagaggctgctggccgagcctgtgcccggcatcaaggccgagccagatgagagcaatgcccgctacttccacgtggtgattgctggcccccaggacagcccctttgaaggaggcaccttcaagctggagctgttcctgcctgaggagtaccccatggccgcccccaaggtgcgcttcatgaccaagatctaccaccccaacgtggacaagctgggccgcatctgcctggacatcctgaaggacaagtggagccctgccctgcagatcagaacagtgctgctgagcatccaggccctgctgagcgcccccaacccagatgaccccctggccaatgatgtggccgagcagtggaagaccaatgaggcccaggccattgaaacagcccgggcctggacccggctgtatgccatgaacaacatctag

SEQ ID NO: 18947 - DNA, 3354 bp, Artificial Sequence
  Description of Artificial Sequence: Synthetic coding sequence
atgtaccgcagcagcgcccggagctctgtgagcagccaccggcccaaggatgatggcggcggcggccccaggagcggccgcagcagcggcagcagcagcggccctgcccggcgcagcagccccccacctccacccagcggcagcagcagcaggaccccagcccggcggcccaggagccccagcggccaccggggccggcgggccagccccagccccccccggggccggcgggtgagccccagccccccccgggcccggcggggcagccccagccccccccggggccggcggctcttccccccaggccctgctggcttccggggcagcagcagaggagagagcagagctgactatgccagagatggccgcggggaccaccctggggacagcggcagcagaagaagaagccctggcctgtgcagcgacagcctggagaagagcctgcgcatcaccgtgggcaatgaccacttctgtgtgtccaccccagagcggcggcggctgagtgaccggctgggcagccctgtggacaacctggaggacatggacagagatgacctgacagatgacagcgtcttcaccaggagcagccagtgcagccggggcctggagcgctacatcagccaggaggagggccccctgagccccttcctgggccagctggatgaggactaccgcaccaaggagaccttcctgcacagaagtgactacagcccccacatcagctgccatgatgagctgctgcggggcacagagaggaaccgggagaagctgaagggctacagcatccgctctgaggagaggagccgggaggccaagaggcccaggtatgatgacacagtgaagatcaacagcatgggcggggaccaccccagcttcaccagcggcaccaggaactaccggcagaggagaagaagccccagcccccgcttcctggaccctgagttccgggagctggacctggcccggaggaagcgggaggaggaggaggagaggagccgcagcctgagccaggagctggtgggcgtggatggcggcggcaccggctgcagcatccctggcctgtctggagtgctgacagccagcgagcccggctacagcctgcacaggcctgaggaggtgtctgtgatgcccaagaagagcatcctgaagaagagaattgaggtggacatcatggagcccagcatgcagctggagagcttcagcagcagcaccagcagcagccaggaccaccccctgtacagcggccaccccagcctgcccctgagcggggccatcgccgcctttgccagcgagattgaaaataaaggcaccatggtggagacagccctgaaggagccccagggcaacctgtaccagtggggccccctgcccggcatccccaaggacaacagccccctgcgggagaagtttggcagcttcctgtgccacaaggacaacctggacctgaaggccgagggccctgagcggcacacagacttcctgctgccccatgagcgggccagccaggacggcagcggcttcagccgcatcctgtccatgctggccgacagcaccagcacccaggagaagagaagaagaagcttcccagacattgaagatgaggagaagttcctgtatggagatgaggaggaggacctgaaggccgagagcgtgcccaagcccctgggcagcagcgagagcgaggtgatgaggcagaaggccagcagcctgcccagcagcgccccagctgtgaagctggagagcctggaggagaccaacccagaatatgccaagatccatgacctgctgaagaccatcggcctggacattggagtggccgagatcagccagctggccgcccggacccaggagcggctgcacggcaagaagcccagcctgcggagcagcgctgaccggcgcagctctgtggaccgctacttctctgctgaccactgcagctctgtggaccaccgcttctctgctgaccgctgcagctctgtggaccactgcttctctgctgaccggcgcagcagtgacccccaccggctggagagccgggaggcccaccacagcaacacccacagccctgaggtgagccacccccacccccccagccctgtggacccctacctgctgaccaagaacagcccccccttcctgaagagtgaccaccctgtgggccacatcagcggccctgaggtggtgggcagcggcttccagagctctgtggccgtgcgctgcatgctgcccagcgcccccagcgcccccatccggctgccccacacagctgccctgagccagttccacatgccccgggccagccagtttgctgctgcccgcatcccccccaactaccagggccctgccatccccccagccagctttgatgcctaccgccactacatggcctatgctgccagccgctggcccatgtaccccaccagccagcccagcaaccaccctgtgcctgagccccaccgcatcatgcccatcaccaagcaggccaccaggagccggcccaacctgcgggtcatccccaccgtgaccccagacaagcccaagcagaaggagagcctgcggggcagcatcccagctgcccaggtgcctgtgcaggtgtccatccccagcctcatccgctacaaccctgagaagatcagtgatgagaagaacagagccagccagaagcagaaggtgattgaggagcgggagaagctgaagaatgaccgggaggcccggcagaagaagatgtactacctgaggacagagctggagcggctgcacaagcagcagggcgagatgctgaggaagaagagaagagagaaggatggccacaaggaccccctgctggtggaggtgtcccggctgcaggacaacatcatgaaggacattgctgagctgcggcaggaggccgaggaggccgagaagaagcagagcgagctggacaaggtggcccagatcctgggcatcaacatctttgacaagagccagaagagcctgagtgacagccgggagcccacagagaagccaggcaaggccgagaagagcaagagccctgagaaggtgagcagcttcagcaacagcagcagcaacaaggagagcaaggtgaacaatgagaagttccgcaccaagagccccaagccagctgagagcccccagagcgccaccaagcagctggaccagcccacagctgcctatgagtactatgatgctggcaaccactggtgcaaggactgcaacaccatctgtggcaccatgtttgacttcttcacccacatgcacaacaagaagcacacccagggccagttccagaagagcagtgacttccagaaggagggcctgcagcagaccttcctgcccccagagcggcagggctag

SEQ ID NO: 18948 - DNA, 576 bp, Artificial Sequence
  Description of Artificial Sequence: Synthetic coding sequence
atgtatgtgtgcctgtgtgtgtctgtggccaaggtgaccatggctgacagagctgctgctgagcgggcctgcaaggaccccaaccccatcattgatggcaggaaggccaacgtgaacctggcctacctgggcgccaagccccgcatcatgcagcccggctttgccttcggcgtgcagcagctgcacccagccctgatccagaggcccttcggcatcccagcccactacgtgtacccccaggcctttgtgcagcccggggtggtgatcccccacgtgcagcccacagctgctgctgccagcaccaccccctacatcgactacaccggggccgcctatgcccagtacagcgctgctgctgctgctgctgctgctgctgctgcctatgaccagtacccctatgctgccagccctgctgctgctggctacgtgacagctgggggctacggctatgctgtgcagcagcccatcacagctgctgcccctggaacagctgctgctgctgctgctgctgctgctgctgctgctgccttcggccagtaccagccccagcagctgcagacagacaggatgcagtag

SEQ ID NO: 18949 - DNA, 330 bp, Artificial Sequence
  Description of Artificial Sequence: Synthetic coding sequence
atggccggggcccccaccgtgtccctgcctgagctgcggagcctgctggccagcggccgggcccggctgtttgatgtgcgcagccgggaggaggccgccgccggcaccatccctggggccctgaacatccctgtgtctgagctggagagcgccctgcagatggagcctgctgccttccaggccctgtacagcgctgagaagcccaagctggaggatgagcacctggtgttcttctgccagatgggcaagaggggcctgcaggccacccagctggcccggagcctgggctacacaggctacggggaggtgtggctgctggccggccgctag

SEQ ID NO: 18950 - DNA, 630 bp, Artificial Sequence
  Description of Artificial Sequence: Synthetic coding sequence
atggccctgctggccgagcacctgctgaagcccctgcctgctgacaagcagatcgagaccggccccttcctggaggccgtgagccacctgccccccttctttgactgcctgggcagccctgtgttcacccccatcaaggctgacatcagcggcaacatcaccaagatcaaggctgtgtatgacaccaacccagccaagttccgcaccctgcagaacatcctggaggtggagaaggagatgtatggagctgagtggcccaaggtgggcgccaccctggccctgatgtggctgaagaggggcctgcgcttcatccaggtgttcctgcagagcatctgtgatggagagagagatgagaaccaccccaacctgatccgggtgaatgccaccaaggcctatgagatggccctgaagaagtaccacggctggatcgtgcagaagatcttccaggccgccctgtatgctgccccctacaagagtgacttcctgaaggccctgagcaagggccagaatgtgacagaggaggagtgcctggagaagatccgcctcttcctggtgaactacacagccaccattgatgtgatctatgagatgtacacccagatgaatgctgagctgaactacaaggtgtag

SEQ ID NO: 18951 - DNA, 474 bp, Artificial Sequence
  Description of Artificial Sequence: Synthetic coding sequence
atggaggaggcccagaggaagaggacccagctgcgggaggcctttgagcagctgcaggccaagaagcagatggccatggagaagagaagagctgtgcagaaccagtggcagctgcagcaggagaagcacctgcagcacctggccgaggtgtctgctgaggtgcgggagaggaagacaggcacccagcaggagctggacagagtcttccagaagctgggcaacctgaagcagcaggccgagcaggagcgggacaagctgcagcgctaccagaccttcctgcagctgctgtacaccctgcagggcaagctgctcttccctgaggccgaggccgaggccgagaacctgcctgatgacaagccccagcagcccacccggccccaggagcagagcactggagacaccatgggccgggaccccggggtgtccttcaaggctgtgggcctgcagcctgctggagatgtgaacctgccctag

SEQ ID NO: 18952 - DNA, 639 bp, Artificial Sequence
  Description of Artificial Sequence: Synthetic coding sequence
atggaggtgctgcggcgcagctctgtgtttgctgctgagatcatggatgcctttgacaggagccccacagacaaggagctggtggcccaggccaaggccctgggccgggagtatgtgcacgcccggctgctgcgggccggcctgtcctggagcgcccctgagcgggccgcccctgtgcccggccgcctggccgaggtgtgtgctgtgctgctgcggctgggagatgagctggagatgatccggcccagcgtgtacagaaatgtggcccggcagctgcacatcagcctgcagagcgagcctgtggtgacagatgccttcctggccgtggccggccacatcttctctgctggcatcacctggggcaaggtggtgtccctgtatgctgtggccgccggcctggccgtggactgtgtgcggcaggcccagcctgccatggtgcacgccctggtggactgcctgggggagtttgtgaggaagaccctggccacctggctgcggaggagaggaggctggacagatgtgctgaagtgtgtggtgtccacagatcctggcctgcggagccactggctggtggccgccctgtgcagctttggccgcttcctgaaggccgccttctttgtgctgctgcctgagaggtag

SEQ ID NO: 18953 - DNA, 2148 bp, Artificial Sequence
  Description of Artificial Sequence: Synthetic coding sequence
atgagccagagcggggctgtgtcctgctgccctggggccaccaacggcagcctgggccgcagtgatggagtggccaagatgagccccaaggacctgtttgagcagaggaagaagtacagcaacagcaatgtcatcatgcatgagaccagccagtaccacgtgcagcacctggccaccttcatcatggacaagtctgaggccatcacctctgtggatgatgccatcaggaagctggtgcagctgagcagcaaggagaagatctggacccaggagatgctgctgcaggtgaatgaccagagcctgcggctgctggacatcgagagccaggaggagctggaggacttccccctgcccaccgtgcagaggagccagacagtgctgaaccagctgcgctaccccagcgtgctgctgctggtgtgccaggacagcgagcagagcaagccagatgtgcacttcttccactgtgatgaggtggaggccgagctggtgcatgaagatattgaaagtgccctggccgactgccgcctgggcaagaagatgaggccccagaccctgaagggccaccaggagaagatccggcagaggcagagcatcctgcccccaccccagggccctgcccccatccccttccagcaccggggcggggacagccctgaggccaagaacagagtgggcccccaggtgcccctgtctgagcccggcttcagaagaagagagagccaggaggagcccagggctgtgctggcccagaagattgagaaggagacccagatcctgaactgtgccctggatgacatcgagtggtttgtggcccggctgcagaaggctgctgaggccttcaagcagctgaaccagaggaagaagggcaagaagaagggcaagaaggccccagctgagggcgtgctgaccctgcgggcccggccccccagcgagggggagttcatcgactgcttccagaagatcaagctggccatcaacctgctggccaagctgcagaagcacatccagaaccccagcgctgctgagctggtgcacttcctgtttggccccctggacctgattgtgaacacctgcagcggccctgacatcgcccggtctgtgtcctgccccctgctgagcagagatgctgtggacttcctgcggggccacctggtgcccaaggagatgagcctgtgggagagcctgggggagagctggatgaggcccaggtctgagtggccccgggagccccaggtgcccctgtatgtgcccaagttccacagcggctgggagccccctgtggatgtgctgcaggaggccccctgggaggtggagggcctggccagcgcccccatcgaggaggtgtcccctgtgtcccggcagagcatccggaacagccagaagcacagccccaccagcgagcccaccccacctggagatgccctgccccctgtgagcagcccccacacccaccggggctaccagcccaccccagccatggccaagtatgtgaagatcctgtatgacttcaccgccagaaatgccaatgagctgtctgtgctgaaggatgaggtgctggaggtgctggaggatggccggcagtggtggaagctgcggagccgcagcggccaggccggctacgtgccctgcaacatcctgggggaggcccggccagaagatgctggggccccctttgagcaggccggccagaagtactggggccctgccagccccacccacaagctgccccccagcttccctggcaacaaggatgagctgatgcagcacatggatgaggtgaatgatgagctgatcaggaagatcagcaacatccgggcccagccccagaggcacttccgggtggagaggagccagcctgtgtcccagcccctgacctatgagagcggcccagatgaggtgcgggcctggctggaggccaaggccttcagcccccgcatcgtggagaacctgggcatcctgaccggcccccagctgttcagcctgaacaaggaggagctgaagaaggtgtgtggggaggagggcgtgcgggtgtacagccagctgaccatgcagaaggccttcctggagaagcagcagagcggcagcgagctggaggagctgatgaacaagttccacagcatgaaccagaggagaggagaggacagctag

SEQ ID NO: 18954 - DNA, 600 bp, Artificial Sequence
  Description of Artificial Sequence: Synthetic coding sequence
atggcctggccctgcatcagccggctgtgctgcctggcccggcgctggaaccagctggacagaagtgatgtggccgtgcccctgaccctgcacggctacagcgacctggacagcgaggagcccggcactggaggagctgccagcagaagaggccagcccccagctggggcccgggacagcggcagagatgtgcccctgacccagtaccagagggactttggcctgtggaccaccccagctggccccaaggaccccccacctggccggggccctggagctgggggccggcggggcaagagcagcgcccagagcagcgcccccccagcccctggggcccggggcgtgtatgtgctgcccatcggagatgctgatgctgctgctgctgtgaccaccagctaccggcaggagttccaggcctggacaggagtgaagcccagccgcagcaccaagaccaagccagcccgggtcatcaccacccacaccagcggctgggacagcagccctggggccggcttccaggtgcctgaggtgaggaagaagttcacccccaaccccagcgccatcttccaggccagcgccccccgcatcctgaatgtgtag

SEQ ID NO: 18955 - DNA, 5106 bp, Artificial Sequence
  Description of Artificial Sequence: Synthetic coding sequence
atgggcaacagcgacagccagtacaccctgcagggcagcaagaaccacagcaacaccatcactggagccaagcagatcccctgcagcctgaagatccggggcatccacgccaaggaggagaagagcctgcacggctggggccacggcagcaatggagctggctacaagagccgcagcctggcccggagctgcctgagccacttcaagagcaaccagccctatgccagccggctgggcggccccacctgcaaggtgtcccggggcgtggcctacagcacccacaggaccaatgcccctgggaaggacttccagggcatctctgctgccttcagcacagaaaatggcttccacagcgtgggccacgagctggccgacaaccacatcaccagccgggactgcaatggccacctgctgaactgctatggaagaaatgaaagcatcgccagcaccccacctggagaggacaggaagagcccccgggtgctgatcaagaccctgggcaagctggatggctgcctgcgggtggagttccacaatggaggcaaccccagcaaggtgcctgctgaggactgcagcgagcctgtgcagctgctgcgctacagccccaccctggccagcgagaccagccctgtgcctgaggcccggcggggcagcagcgctgacagcctgcccagccaccggcccagccccacagacagccggctgcggagcagcaagggcagcagcctgagcagcgagagctcctggtatgacagcccctggggcaatgctggggagctgtctgaggccgagggcagcttcctggcccctggcatgccagaccccagcctgcacgccagcttccccccaggagatgccaagaagcccttcaaccagagcagcagcctgagcagcctgcgggagctgtacaaggatgccaacctgggcagcctgagccccagcggcatccggctgagtgatgagtacatgggcacccacgccagcctgagcaacagagtgtcctttgccagtgacattgatgtgcccagccgggtggcccatggagaccccatccagtacagcagcttcaccctgccctgcaggaagcccaaggcctttgtggaggacacagccaagaaggacagcctgaaggccaggatgaggcgcatcagtgactggacaggcagcctgagcaggaagaagaggaagctgcaggagcccaggagcaaggagggcagtgactactttgacagcagaagtgatggcctgaacacagatgtgcagggcagcagccaggccagcgccttcctgtggagcggcggcagcacccagatcctgagccagaggtctgagagcacccacgccatcggcagtgaccccctgcggcagaacatctatgagaacttcatgagggagctggagatgagcaggaccaacacagagaacatcgagaccagcacagaaacagctgagagcagcagcgagagcctgagcagcctggagcagctggacctgctgtttgagaaggagcagggcgtggtgaggaaggccggctggctgttcttcaagcccctggtgacagtgcagaaggagaggaagctggagctggtggcccggaggaagtggaagcagtactgggtgaccctgaagggctgcaccctgctcttctatgagacctacggcaagaacagcatggaccagagcagcgccccccgctgtgccctgtttgctgaagattccatcgtgcagagcgtgcctgagcaccccaagaaggaaaatgtgttctgcctgagcaacagctttggagatgtgtacctgttccaggccaccagccagacagacctggagaactgggtgacagctgtgcacagcgcctgtgccagcctgtttgccaagaagcacggcaaggaggacaccctgcggctgctgaagaaccagaccaagaacctgctgcagaagattgacatggacagcaagatgaagaagatggccgagctgcagctgtctgtggtgtctgaccccaagaacaggaaggccatcgagaaccagatccagcagtgggagcagaacctggagaagttccacatggacctcttcaggatgcgctgctacctggccagcctgcagggcggggagctgcccaaccccaagagcctgctggccgccgccagccggcccagcaagctggccctgggccgcctgggcatcctgtctgtgagcagcttccacgccctggtgtgcagcagagatgattctgccctgaggaagaggaccctgagcctgacccagagaggaagaaacaagaagggcatcttcagcagcctgaagggcctggacaccctggccaggaagggcaaggagaagaggcccagcatcacccaggtggatgagctgctgcacatctacggcagcacagtggatggagtgccccgggacaatgcctgggagatccagacctacgtgcacttccaggacaaccacggcgtgacagtgggcatcaagccagagcaccgggtggaggacatcctgaccctggcctgcaagatgaggcagctggagcccagccactacggcctgcagctgaggaagctggtggatgacaacgtggagtactgcatcccagccccctatgagtacatgcagcagcaggtgtatgatgaaattgaggtgttccccctgaatgtgtatgatgtgcagctgaccaagacaggctctgtgtgtgactttggatttgctgtgacagcccaggtggatgagcggcagcacctgagccgcatcttcatcagtgatgtgctgcctgatggcctggcctatggagagggcctgaggaaaggaaatgagatcatgaccctgaatggagaggccgtgtctgacctggacctgaagcagatggaggccctcttcagcgagaagtctgtgggcctgaccctgattgcccggcccccagacaccaaggccaccctgtgcacctcctggagcgacagcgacctcttcagccgggaccagaagagcctgctgcccccacccaaccagagccagctgctggaggagttcctggacaacttcaagaagaacacagccaatgacttcagcaatgtgcctgacatcaccaccggcctgaagaggagccagacagatggcaccctggaccaggtgagccaccgggagaagatggagcagaccttccgctctgctgagcagatcacagccctgtgccgctccttcaatgacagccaggccaacggcatggagggcccccgggagaaccaggaccccccacccaggagcctggcccggcacctgagtgatgctgaccggctgaggaaggtgatccaggagctggtggacacagagaagagctatgtgaaggacctgagctgcctgtttgagctgtacctggagcccctgcagaatgagaccttcctgacccaggatgagatggagagcctgtttggcagcctgcctgagatgctggagttccagaaggtgttcctggagaccctggaggatggcatcagcgccagcagtgacttcaacaccctggagacccccagccagttcaggaagctgctcttcagcctgggcggcagcttcctgtactatgctgaccacttcaagctgtacagcggcttctgtgccaaccacatcaaggtgcagaaggtgctggagcgggccaagacagacaaggccttcaaggccttcctggatgccaggaaccccaccaagcagcacagcagcaccctggagagctacctgatcaagcctgtgcagagggtgctgaagtaccccctgctgctgaaggagctggtgtccctgacagaccaggagagcgaggagcactaccacctgacagaggccctgaaggccatggagaaggtggccagccacatcaatgagatgcagaagatctatgaggactatggcaccgtgtttgaccagctggtggccgagcagagcggcacagagaaggaggtgacagagctgtccatgggagagctgctgatgcacagcacagtgtcctggctgaaccccttcctgagcctgggcaaggccaggaaggacctggagctgactgtgtttgtgttcaagagagctgtgatcctggtgtacaaggagaactgcaagctgaagaagaagctgcccagcaacagcaggcctgcccacaacagcacagacctggaccccttcaagttccgctggctgatccccatcagcgccctgcaggtgcggctgggcaacccagctggaacagagaacaacagcatctgggagctgatccacaccaagtcagaaattgagggccggcctgagaccatcttccagctgtgctgcagcgacagcgagagcaagaccaacatcgtgaaggtgatccgcagcatcctgcgggagaacttcagaagacacatcaagtgtgagctgcccctggagaagacctgcaaggaccggctggtgcccctgaagaacagagtgcctgtgtctgccaagctggccagcagccgcagcctgaaggtgctgaagaacagcagcagcaatgagtggacaggagagaccgggaagggcaccctgctggacagtgatgagggcagcctgagcagcggcacccagagcagcggctgccccacagctgagggccggcaggacagcaagagcaccagccctgggaagtacccccaccctggcctggccgactttgctgacaacctgatcaaggagagtgacatcctgagtgatgaagatgatgaccaccggcagacagtgaagcagggcagccccaccaaggacatcgagatccagttccagaggctgcgcatcagtgaagatcctgatgtgcaccctgaggccgagcagcagcccggccctgagagcggggagggccagaagggcggggagcagcccaagctggtgcggggccacttctgccccatcaagaggaaggccaacagcaccaagagggaccggggcaccctgctgaaggcccagatccgccaccagagcctggacagccagagtgaaaatgccaccatcgacctgaacagcgtgctggagcgggagttctctgtgcagagcctgacctctgtggtgtctgaggagtgcttctatgaaacagagagccacggcaagagctag

SEQ ID NO: 18956 - DNA, 3177 bp, Artificial Sequence
  Description of Artificial Sequence: Synthetic coding sequence
atggacctgggccccctgaacatctgtgaggagatgaccatcctgcacggcggcttcctgctggccgagcagctgttccaccccaaggccctggccgagctgaccaagagtgactgggagcgggtgggccggcccatcgtggaggccctgcgggagatcagcagcgctgctgcccacagccagccctttgcctggaagaagaaggccctgatcatcatctgggccaaggtgctgcagccccaccctgtgacccccagcgacacagagacccgctggcaggaggacctcttcttctctgtgggcaacatgatccccaccatcaaccacaccatcctgtttgagctgctgaagagcctggaggccagcggcctcttcatccagctgctgatggccctgcccaccaccatctgccacgccgagctggagcgcttcctggagcacgtgacagtggacaccagcgcagaagatgtggccttcttcctggatgtgtggtgggaggtgatgaagcacaagggccacccccaggaccccctgctgagccagttcagcgccatggcccacaagtacctgcctgccctggatgagttcccccacccccccaagaggctgcggagtgaccctgatgcctgccccaccatgcccctgctggccatgctgctgcggggcctgacccagatccagagccgcatcctgggccctggcaggaagtgctgtgccctggccaacctggccgacatgctgactgtgtttgccctgacagaagatgacccccaggaggtgtctgccaccgtgtacctggacaagctggccaccgtcatctctgtgtggaacagcgacacccagaacccctaccaccagcaggccctggccgagaaggtgaaggaggccgagagagatgtgtccctgaccagcctggccaagctgcccagcgagaccatctttgtgggctgtgagttcctgcaccacctgctgcgggagtggggcgaggagctgcaggccgtgctgcggagcagccagggcaccagctatgacagctaccgcctgtgtgacagcctgaccagcttcagccagaatgccaccctgtacctgaacagaaccagcctgagcaaagaagatcggcaggtggtgtctgagctggctgaatgtgtgcgggacttcctgaggaagaccagcacagtgctgaagaacagagccctggaggacatcacagccagcatcgccatggctgtgatccagcagaagatggacagacacatggaggtgtgctacatctttgccagcgagaagaagtgggccttcagtgatgagtgggtggcctgcctgggcagcaacagagccctcttccggcagcctgacctggtgctgcggctgctggagaccgtgattgatgtgtccacagctgaccgggccatccctgagagccagatccggcaggtgatccacctgatcctggagtgctacgccgacctgagcctgcccgggaagaacaaggtgctggccggcatcctgcgctcctggggcaggaagggcctgtctgagaagctgctggcctacgtggagggcttccaggaggacctgaacaccaccttcaaccagctgacccagagcgccagcgagcagggcctggccaaggctgtggcctctgtggcccggctggtgattgtgcaccctgaggtgacagtgaagaagatgtgcagcctggccgtggtgaacctgggcacccacaagttcctggcccagatcctgacagccttccctgccctgcgctttgtggaggagcagggccccaacagcagcgccaccttcatggtgtcctgcctgaaggagaccgtgtggatgaagttcagcacccccaaggaggagaagcagttcctggagctgctgaactgcctgatgagccctgtgaagccccagggcatccctgtggccgccctgctggagccagatgaggtgctgaaggagtttgtgctgcccttcctgcggctggatgtggaggaggtggacctgagcctgcgcatcttcatccagaccctggaggccaatgcctgccgggaggagtactggctgcagacctgcagccccttccccctgctcttcagcctgtgccagctgctggaccgcttcagcaagtactggcagctgcccaaggagaagcgctgcctgagcctggacaggaaggacctggccatccacatcctggagctgctgtgtgaaattgtgtctgccaatgctgagaccttctccccagatgtgtggatcaagagcctgtcctggctgcacaggaagctggagcagctggactggacagtgggcctgcggctgaagagcttctttgagggccacttcaagtgtgaggtgcctgccaccctgtttgagatctgcaagctgtctgaagatgagtggaccagccaggcccaccctggctatggagctggcaccggcctgctggcctggatggagtgctgctgcgtgagcagcggcatcagcgagaggatgctgagcctgctggtggtggatgtgggcaaccctgaggaggtgcggctcttcagcaagggcttcctggtggccctggtgcaggtgatgccctggtgcagcccccaggagtggcagaggctgcaccagctgacccggcggctgctggagaagcagctgctgcacgtgccctacagcctggagtacatccagtttgtgcccctgctgaacctgaagccctttgcccaggagctgcagctgtctgtgctcttcctgcggaccttccagttcctgtgcagccacagctgccgggactggctgcccctggagggctggaaccacgtggtgaagctgctgtgtggcagcctgacccggctgctggacagcgtgcgggccatccaggccgccggcccctgggtgcagggccctgagcaggacctgacccaggaggccctgtttgtgtacacccaggtgttctgccacgccctgcacatcatggccatgctgcaccctgaggtgtgtgagcccctgtatgtgctggccctggagaccctgacctgctatgagaccctgagcaagaccaaccccagcgtgagcagcctgctgcagagggcccacgagcagcgcttcctgaagagcattgctgagggcatcggccctgaggagcggcggcagaccctgctgcagaagatgagcagcttctag

SEQ ID NO: 18957 - DNA, 267 bp, Artificial Sequence
  Description of Artificial Sequence: Synthetic coding sequence
atgagcggcctgcgggtgtacagcacctctgtgacaggcagccgggagatcaagagccagcagagcgaggtgacccgcatcctggatggcaagaggatccagtaccagctggtggacatcagccaggacaatgccctgagagatgagatgagggccctggccggcaaccccaaggccaccccaccccagatcgtgaatggagaccagtactgcggcgtgtgggccggcggccggggcggcggcggctctgtgggccggggcctgtag

SEQ ID NO: 18958 - DNA, 933 bp, Artificial Sequence
  Description of Artificial Sequence: Synthetic coding sequence
atggatggcagctttgtgcagcacagcgtgcgggtgctgcaggagctgaacaagcagcgggagaagggccagtactgtgatgccaccctggatgtgggcggcctggtgttcaaggcccactggagcgtgctggcctgctgcagccacttcttccagagcctgtatggagatggcagcggcggctctgtggtgctgcctgctggctttgctgagatcttcggcctgctgctggacttcttctacacaggccacctggccctgaccagcggcaacagagaccaggtgctgctggccgcccgggagctgcgggtgcctgaggccgtggagctgtgccagagcttcaagcccaagacctctgtgggccaggccgccggcggccagagcggcctgggccccccagccagccagaatgtgaacagccacgtgaaggagcccgccggcctggaggaggaggaggtgtccaggaccctgggcctggtgccccgggaccaggagccccggggcagccacagcccccagaggccccagctgcacagccctgcccagagcgagggccccagcagcctgtgtgggaagctgaagcaggccctgaagccctgccccctggaggacaagaagccagaggactgcaaggtgcccccccggcccctggaggccgagggcgcccagctgcagggcggcagcaatgagtgggaggtggtggtgcaggtggaggatgatggagatggagactacatgtctgagcctgaggccgtgctgaccaggaggaagagcaatgtcatcaggaagccctgtgccgctgagcccgccctgtctgctggcagcctggccgctgagcctgctgagaacagaaaaggaacagctgtgcctgtggagtgccccacctgccacaagaagttcctgagcaagtactacctgaaggtgcacaactag

SEQ ID NO: 18959 - DNA, 600 bp, Artificial Sequence; identical to SEQ ID NO: 18469
  Description of Artificial Sequence: Synthetic coding sequence

SEQ ID NO: 18960 - DNA, 513 bp, Artificial Sequence
  Description of Artificial Sequence: Synthetic coding sequence
atgtctgtggccggcggggagatccggggggacacaggaggagaggacacagctgcccctggccgcttctccttcagccctgagcccaccctggaggacatccggcggctgcatgctgagtttgctgctgagcgggactgggagcagttccaccagcccaggaacctgctgctggccctggtgggggaggtgggggagctggccgagctgttccagtggaagacagatggagagcccggcccccagggctggagcccccgggagcgggccgccctgcaggaggagctgagtgatgtgctgatctacctggtggccctggccgcccgctgccgggtggacctgcccctggccgtgctgagcaagatggacatcaacagaagacgctacccagcccacctggcccggagcagcagcaggaagtacacagagctgccccacggggccatcagcgaggaccaggccgtgggccctgctgacatcccctgtgacagcacaggccagaccagcacctag

SEQ ID NO: 18961 - DNA, 702 bp, Artificial Sequence
  Description of Artificial Sequence: Synthetic coding sequence
atgtctgccaagagagctgagctgaagaagacccacctgagcaagaactacaaggctgtgtgcctggagctgaagccagagcccaccaagacctttgactacaaggctgtgaagcaggagggccgcttcaccaaggccggcgtgacccaggacctgaagaatgagctgcgggaggtgcgggaggagctgaaggagaagatggaggagatcaagcagatcaaggacctgatggacaaggactttgacaagctgcatgaatttgtggagatcatgaaggagatgcagaaggacatggatgagaagatggacatcctgatcaacacccagaagaactacaagctgcccctgcggcgggcccccaaggagcagcaggagctgcggctgatgggcaagacccaccgggagccccagctgcggcccaagaagatggatggagccagcggcgtgaatggagccccctgtgccctgcacaagaagaccatggccccccagaagaccaagcagggcagcctggaccccctgcaccactgcggcacctgctgtgagaagtgcctgctgtgtgccctgaagaacaactacaacagaggcaacatccccagcgaggccagcggcctgtacaagggcggggaggagcctgtgaccacccagcccagcgtgggccatgctgtgcctgcccccaagagccagacagagggccgctag

SEQ ID NO: 18962 - DNA, 2196 bp, Artificial Sequence
  Description of Artificial Sequence: Synthetic coding sequence
atgtctgtgaccctgacctctgtgaagagggtgcagagcagccccaacctgctggccgccggccgggacagccagagcccagattctgcctggaggagctacaatgatggcaaccaggagaccctgaatggagatgccacctacagcagcctggccgccaagggcttccgctctgtgcggcccaacctgcaggacaagaggagccccacccagagccagatcaccgtgaatggaaacagcggcggcgctgtgagccccatgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccaggcatcggccctgtggatgaaagtggcatccccacagccatccgcaccaccgtggaccggcccaaggactggtacaagaccatgttcaagcagatccacatggtgcacaagccagatgatgacacagacatgtacaacaccccctacacctacaatgccggcctgtacaaccccccctacagcgcccagagccaccctgctgccaagacccagacctaccggcccctgagcaagagccacagcgacaacagccccaatgccttcaaggatgccagcagccctgtgcccccaccccacgtgcccccacctgtgccccccctgcggccccgggacaggagcagcacagagaagcatgactgggaccccccagacaggaaggtggacaccaggaagttccgctctgagcccaggagcatctttgaatatgagcccgggaagagcagcatcctgcagcacgagcggcccccacccctgcccaccacccccacccctgtgccccgggagcccggcaggaagcccctgagcagcagccggctgggggaggtgacaggcagccccagccccccacccaggtctggggcccccacccccagcagccgggccccagccctgagccccacccggccccccaagaagcccctggactatgtgcaggaccacagcagtggagtcttcaatgaggccagcctgtaccagagcagcattgacaggagcctggagcggcccatgagcagcgcctccatggccagtgacttcaggaagaggaggaagtctgagcctgctgtgggccccccccggggcctgggggaccagagcgccagcaggaccagccctggccgggtggacctgcccggcagcagcaccaccctgaccaagagcttcaccagcagcagccccagcagccccagccgggccaaggaccgggagagccccaggagctacagcagcaccctgacagacatgggccgcagcgccccccgggagcggcggggcaccccagagaaggagaagctgcctgccaaggctgtgtatgacttcaaggcccagaccagcaaggagctgtccttcaagaagggggacacagtgtacatcctgaggaagattgaccagaactggtatgaaggagagcaccacggccgggtgggcatcttccccatctcctatgtggagaagctgaccccacctgagaaggcccagcctgcccggcccccacctccagcccagcccggggagattggagaggccatcgccaagtacaacttcaatgctgacaccaacgtggagctgagcctgaggaagggggacagagtcatcctgctgaagagggtggaccagaactggtatgagggcaagatccctggcaccaaccggcagggcatcttccctgtgtcctatgtggaggtggtgaagaagaacaccaagggagctgaggactacccagacccccccatcccccacagctacagcagtgaccgcatccacagcctgagcagcaacaagccccagaggcctgtgttcacccatgagaacatccagggcggcggggagcccttccaggccctgtacaactacaccccaagaaatgaagatgagctggagctgcgggagagtgatgtgattgatgtgatggagaagtgtgatgatggctggtttgtgggcaccagcaggaggaccaagttcttcggcaccttccctggcaactacgtgaagaggctgtag

SEQ ID NO: 18963 - DNA, 969 bp, Artificial Sequence
  Description of Artificial Sequence: Synthetic coding sequence
atgaccctggaggccatccgctacagccggggcagcctgcagatcctggaccagctgctgctgcccaagcagagccgctatgaagctgtgggctctgtgcaccaggcctgggaggccatccgggccatgaaggtgcggggggccccagccatcgccctggtgggctgcctgagcctggccgtggagctgcaggccggggccggcggccctggcctggccgccctggtggcctttgtgcgggacaagctgtccttcctggtgacagcccggcccacagctgtgaacatggcccgggccgcccgggacctggctgatgtggccgcccgggaggccgagcgggagggcgccacagaggaggccgtgcgggagcggcgggagacagagctgtgtgagcactgggaggagcacacccggcagcgggagctgcccctgcggggccccctgggcggcaccgtgctggagacccggccctacaaccagggcgcccggctgacagcctttgagctggtgtatgagcagatcccagccaccctcatcacagacagcatggtggccgccgccatggcccaccggggcgtgtctgctgtggtggtgggcgctgacagagtggtggccaacggggacacagccaacaaggtgggcacctaccagctggccatcgtggccaagcaccacggcatccccttctacgtggccgcccccagcagcagctgtgacctgcggctggagaccgggaaggagatcatcatcgaggagcggcccggccaggagctgacagatgtgaatggagtgagaattgctgcccctggcattggagtgtggaacccagcctttgatgtgacccctcatgacctgatcactggaggcatcatcacagagctgggcgtgtttgcccctgaggagctgaggacagccctgaccaccaccatcagcagcagagatggcaccctggatggcccccagatgtag

SEQ ID NO: 18964 - DNA, 5169 bp, Artificial Sequence
  Description of Artificial Sequence: Synthetic coding sequence
atgggcaaccaggacggcaagctgaagaggtctgctggagatgccctgcatgaaggaggcggcggcgcagaagatgccctgggccccagagatgtggaggccaccaagaagggcagcggcggcaagaaggccctgggcaagcacggcaagggcggcggcggcggcggcggcggcggggagagcggcaagaagaagagcaagagtgacagccgggcctctgtgttcagcaacctgcgcatcaggaagaacctgagcaagggcaagggggccggcggcagcagagaagatgtgctggacagccaggccctgcagacaggagagctggacagcgcccacagcctgctgaccaagaccccagacctgagcctgtctgcagatgaggccggcctgagtgacacagaatgtgccgacccctttgaggtgacaggccctgggggccctggccctgctgaggcccgggtgggcggccggcccatcgcagaagatgtggagacagctgctggggcccaggacggccagaggaccagcagcggcagtgacacagacatctacagcttccacagcgccacagagcaggaggacctgctgagtgacatccagcaggccatccggctgcagcagcagcagcagcagcagctgcagctgcagctgcagcagcagcagcagcagcagcagctgcagggcgctgaggagcctgctgccccacccacagctgtgagcccccagcccggggccttcctgggcctggaccgcttcctgctgggccccagcggcggggccggggaggcccctggcagcccagacacagagcaggccctgagcgccctgagtgacctgcctgagagcctggccgctgagccccgggagccccagcagccccccagccctgggggcctgcctgtgtctgaggcccccagcctgcctgctgcccagcctgctgccaaggacagccccagcagcacagccttccccttccctgaggccggccctggagaggaggccgccggggcccctgtgcggggggccggggacacagatgaggagggggaggaggatgcctttgaagatgccccccggggcagccctggagaggagtgggcccctgaggtgggggaggatgccccccagaggctgggggaggagcctgaggaggaggcccagggcccagatgccccagctgctgccagcctgcccggcagccctgcccccagccagcgctgcttcaagccctaccccctcatcaccccctgctacatcaagaccaccacccggcagctgagcagccccaaccacagccccagccagagccccaaccagagcccccgcatcaagagaagacctgagcccagcctgagccggggcagcaggacagccctggcctctgtggccgccccagccaagaagcacagagcagatggcggcctggccgccggcctgagccgctctgctgactggacagaggagctgggcgcccggaccccccgggtgggcggcagcgcccacctgctggagcggggcgtggccagtgacagcggcggcggcgtgtccccagccctggccgccaaggccagcggggccccagctgctgctgatggcttccagaatgtgttcaccggccgcaccctgctggagaagctgttcagccagcaggagaatggccccccagaggaggccgagaagttctgcagccgcatcatcgccatgggcctgctgctgcccttcagtgactgcttccgggagccctgcaaccagaatgcccagaccaatgctgccagctttgaccaggaccagctgtacacctgggccgctgtgtcccagcccacccacagcctggactacagcgagggccagttcccccggcgggtgcccagcatgggcccccccagcaagcccccagatgaggagcaccggctggaggatgctgagacagagagccagagcgctgtgtctgagaccccccagaagagaagtgatgctgtgcagaaggaggtggtggacatgaagtctgagggccaggccaccgtcatccagcagctggagcagaccatcgaggacctgcggaccaagattgctgagctggagcggcagtacccagccctggacacagaggtggccagcggccaccagggcctggagaatggagtgacagccagcggagatgtgtgcctggaggccctgcggctggaggagaaggaggtgcgccaccaccgcatcctggaggccaagagcatccagaccagccccacagaggagggcggcgtgctgaccctgccccctgtggatggcctgcccggccggcccccctgccccccaggagctgagagcggcccccagaccaagttctgcagcgagatcagcctcatcgtgagcccccggcgcatctctgtgcagctggacagccaccagcccacccagagcatcagccagcccccacctccacccagcctgctgtggagcgctggccagggccagcccggcagccagcccccccacagcatcagcacagagttccagaccagccatgagcacagcgtgtcctctgccttcaagaacagctgcaacatccccagccccccacccctgccctgcacagagagcagcagctccatgcctggcctgggcatggtgcccccacctcctccacccctgcccggcatgacagtgcccaccctgcccagcacagccatcccccagcccccacccctgcagggcacagagatgctgcccccacctcctccacccctgcccggggccggcatccccccacctccacccctgcctggagctggcatcctgcccctgccccccctgcccggggccggcatccccccacctccacccctgcctggagctgccatccccccacctccacccctgcccggggccggcatccccctgcccccacccctgcctggagctggcatccccccacctccacccctgcccggggccggcatccccccacctccacccctgcctggagctggcatccccccacctccacccctgcccggggccggcatccccccacctccacccctgcctggagctggcatccccccacctccacccctgcccggggccggcatccccccacctccacccctgcctggagctggcatccccccacctccacccctgcccggggccggcatccccccacctccacccctgcctggagctggcatccccccacctccacccctgcccggggccggcatccccccacctccacccctgcctggagctggcatccccccacctccacccctgcccggggccggcatccccccacctccacccctgcccggggtgggcatccccccacctccacccctgcccggggccggcatccccccacctccacccctgcctggagctggcatccccccacctccacccctgcccggggccggcatccccccacctccacccctgccccgggtgggcatccccccacctccacccctgcccggggccggcatccccccacctccacccctgcctggagctggcatccccccacctccacccctgcccggggtgggcatccccccacctccacccctgcccggggtgggcatccccccacctccacccctgcccggggccggcatccccccacctccacccctgcccggcatgggcatccccccagccccagccccacccctgcccccacctggcaccggcatccccccaccacccctgctgcctgtgtctggcccccccctgctgccccaggtgggcagcagcaccctgcccaccccccaggtgtgtggcttcctgcccccacccctgcccagcggcctgtttggcctgggcatgaaccaggacaagggcagcaggaagcagcccatcgagccctgccggcccatgaagcccctgtactggacccgcatccagctgcacagcaagagggacagcagcaccagcctcatctgggagaagattgaggagcccagcattgactgccacgagtttgaggagctgttcagcaagacagctgtgaaggagaggaagaagcccatcagtgacaccatcagcaagaccaaggccaagcaggtggtgaagctgctgagcaacaagaggagccaggccgtgggcatcctgatgagcagcctgcacctggacatgaaggacatccagcacgctgtggtgaacctggacaacagcgtggtggacctggagaccctgcaggccctgtatgagaacagagcccagagtgatgagctggagaagattgagaagcacggccgcagcagcaaggacaaggaaaatgccaagagcctggacaagccagagcagttcctgtatgagctgagcctcatccccaacttcagcgagagggtcttctgcatcctcttccagagcaccttcagcgagagcatctgcagcatccggaggaagctggagctgctgcagaagctgtgtgagaccctgaagaatggacctggggtgatgcaggtgctgggcctggtgctggcctttggaaactacatgaatggaggcaacaagacccggggccaggctgatggcttcggcctggacatcctgcccaagctgaaggatgtgaagagcagtgacaacagccgcagcctgctgagctacatcgtgtcctactacctgaggaactttgatgaagatgctgggaaggagcagtgcctcttccccctgcctgagccccaggacctcttccaggccagccagatgaagtttgaggacttccagaaggacctgaggaagctgaagaaggacctgaaggcctgtgaggtggaggccggcaaggtgtaccaggtgagcagcaaggagcacatgcagcccttcaaggagaacatggagcagttcatcatccaggccaagattgaccaggaggccgaggagaacagcctgacagagacccacaagtgcttcctggagaccacagcctacttcttcatgaagcccaagctgggggagaaggaggtgagccccaatgccttcttcagcatctggcatgagttcagcagtgacttcaaggacttctggaagaaggagaacaagctgctgctgcaggagcgggtgaaggaggccgaggaggtgtgccggcagaagaagggcaagagcctgtacaagatcaagcccaggcatgacagcggcatcaaggccaagatctccatgaagacctag

SEQ ID NO: 18965 - DNA, 3048 bp, Artificial Sequence
  Description of Artificial Sequence: Synthetic coding sequence
atgacagtgtcccagaagggcggcccccagcccacccccagccctgctggccctggcacccagctgggccccatcaccggggagatggatgaggccgacagcgccttcctgaagttcaagcagacagcagatgacagcctgagcctgaccagccccaacacagagagcatctttgtggaggacccctacacagccagcctgcggagtgaaattgaaagtgatggccacgagtttgaggccgagagctggagcctggccgtggatgctgcctatgccaagaagcagaagcgggaggtggtgaagaggcaggatgtgctgtatgagctgatgcagacagaggtgcaccacgtgaggaccctgaagatcatgctgaaggtgtacagccgggccctgcaggaggagctgcagttcagcagcaaggccatcggccgcctcttcccctgtgctgatgacctgctggagacccacagccacttcctggcccggctgaaggagcggcggcaggagagcctggaggagggcagtgacagaaattatgtgatccagaagatcggggacctgctggtgcagcagttctctggagaaaatggagagaggatgaaggagaagtatggagtcttctgcagcggccacaatgaggccgtgagccactacaagctgctgctgcagcagaacaagaagttccagaacctgatcaagaagattggcaacttcagcatcgtgcggcggctgggcgtgcaggagtgcatcctgctggtgacccagaggatcaccaagtaccctgtgctggtggagcgcatcatccagaacacagaagctggaacagaggactatgaggacctgacccaggccctgaacctgatcaaggacatcatcagccaggtggatgccaaggtgtctgaatgtgagaagggccagaggctgcgggagattgctgggaagatggacctgaagagcagcagcaagctgaagaatggcctgaccttcaggaaggaggacatgctgcagaggcagctgcacctggagggcatgctgtgctggaagaccaccagcggccgcctgaaggacatcctggccatcctgctgacagatgtgctgctgctgctgcaggagaaggaccagaagtatgtgtttgcctctgtggacagcaagccccctgtgatcagcctgcagaagctgattgtgcgggaggtggccaatgaggagaaggccatgttcctgatcagcgccagcctgcagggccctgagatgtatgagatctacaccagcagcaaggaggacagaaatgcctggatggcccacatccagagagctgtggagagctgcccagatgaggaggagggccccttcagcctgcctgaggaggagaggaaggtggtggaggcccgggccacccggctgcgggacttccaggagcggctgtccatgaaggaccagctgattgcccagagcctgctggagaagcagcagatctacctggagatggccgagatgggcggcctggaggacctgccccagccccggggcctcttccggggcggggaccccagcgagaccctgcagggcgagctgatcctgaagagcgccatgtctgaaattgagggcatccagagcctcatctgccggcagctgggcagcgccaacggccaggccgaggatggcggcagcagcacaggccccccccggcgggcagagacctttgctggctatgactgcaccaacagccccaccaagaatggcagcttcaagaagaaggtgagcagcacagacccccggccccgggactggaggggcccccccaacagcccagacctgaagctgagtgacagcgacatccctggcagcagcgaggagagcccccaggtggtggaggcccctggaacagaaagtgacccccggctgcccaccgtgctggagagcgagctggtgcagaggatccagaccctgagccagctgctgctgaacctgcaggccgtcatcgcccaccaggacagctatgtggagacccagagagctgccatccaggagcgggagaagcagttccggctgcagagcacccggggcaacctgctgctggagcaggagcggcagaggaactttgagaagcagcgggaggagcgggccgccctggagaagctgcagagccagctgcggcatgagcagcagcgctgggagcgggagcggcagtggcagcaccaggagctggagcgggccggggcccggctgcaggagcgggagggggaggcccggcagctgcgggagcggctggagcaggagagagctgagctggagcggcagaggcaggcctaccagcacgacctggagcggctgcgggaggcccagagagctgtggagcgggagcgggagcggctggagctgctgcggcggctgaagaagcagaacacagcccctggggccctgcccccagacaccctggccgaggcccagccccccagccaccccccatccttcaatggagagggcctggagggcccccgggtgtccatgctgcccagcggcgtgggcccagaatatgcagagaggcctgaggtggcccggcgggacagcgcccccacagagaaccggctggccaagagtgatgtgcccatccagctgctgagcgccaccaaccagttccagaggcaggccgctgtgcagcagcagatccccaccaagctggccgccagcaccaagggcggcaaggacaagggcggcaagagccggggcagccagcgctgggagagcagcgccagctttgacctgaagcagcagctgctgctgaacaagctgatgggcaaggatgagagcaccagcaggaacagaagaagcctgagccccatcctgcccggccgccacagccctgcccctcctccagaccccggcttccctgcccccagccccccacctgctgacagccccagcgagggcttcagcctgaaggccggcggcacagccctgctgcccggccccccagcccccagccccctgcctgccacccccctgagcgccaaggaggatgccagcaaggaggatgtgatcttcttctag

SEQ ID NO: 18966 - DNA, 2544 bp, Artificial Sequence
  Description of Artificial Sequence: Synthetic coding sequence
atggaggccctgggccctggaggagaccgggccagccctgccagcagcaccagcagcctggacctgtggcacctgtccatgagagctgacagcgcctacagcagcttctctgctgccagcggcggccctgagcccaggacccagagccctggaacagacctgctgccctacctggactgggactatgtgcgggtggtgtggggcggccctggccctgcccccccagatgctgccctgtgcaccagcccccggcccaggcctgctgtggccgcccggagcggcccccagcccacagaggtgcccggcaccccaggccccctgaaccggcaggccacccccctgctgtatgccctggccgctgaggccgaggccgccgcccaggccgctgagccccccagccccccagccagcagagctgcctaccggcagaggctgcagggcgcccagaggagagtgctgcgggagaccagcttccagaggaaggagctgaggatgagcctgcctgcccggctgcggcccaccgtgcctgcccggcccccagccacccaccccaggtctgccagcctgagccaccctggaggagagggggagcccgcccggagccgggccccagcccctggaacagctggccggggccccctggccaaccagcagaggaagtggtgcttcagcgagcccgggaagctggacagagtgggccggggcggcggccctgccagagaatgtctgggggaggcctgcagcagcagcggcctgcccggccctgagcccctggagttccagcacccagccctggccaagtttgaagatcatgaggtgggctggctgcctgagacccagccccagggctccatgaacctggacagcggcagcctgaagctgggagatgccttccggcctgccagccgcagccgcagcgccagcggggaggtgctgggctcctggggcggcagcggcggcaccatccccatcgtgcaggccgtgccccagggcgctgagaccccccggcccctcttccagaccaagctgagccgcttcctgccccagaaggaggccgctgtgatgtacccagctgagctgccccagagcagccctgctgacagcgagcagagggtgtctgagacctgcatcgtgcctgcctggctgcccagcctgcctgatgaggtgttcctggaggaggcccccctggtgaggatgaggagccccccagacccccacgccagccagggccccccagcctctgtgcacgccagtgaccagccctacggcaccggcctgggccagaggacaggccaggtgacagtgcccacagagtaccccctgcatgaatgtcctggaacagctggagcagatgactgctggcagggcgtgaatggatctgtgggcatcagccggcccaccagccacacccccaccggcacagccaatgacaacatccccaccatcgaccccaccggcctgaccaccaaccccccaacagctgctgagagtgacctgctgaagcctgtgcctgcagatgccctgggcctgtctggaaatgacaccccaggccccagccacaacacagccctggcccggggcaccggccagcccggcagccggcccacctggcccagccagtgcctggaggagctggtgcaggagctggcccggctggaccccagcctgtgtgaccccctggccagccagcccagccctgagccccccctgggcctgctggatggcctcatccccctggccgaggtgcgggccgccatgaggcctgcctgtggggaggccggggaggaggccgccagcacctttgagcccggcagctaccagttctccttcacccagctgctgcctgccccccgggaggagacccggctggagaacccagccacccaccctgtgctggaccagccctgtggccagggcctgcctgcccccaacaacagcatccagggcaagaaggtggagctggccgcccggctgcagaagatgctgcaggacctgcacacagagcaggagcggctgcagggcgaggcccaggcctgggcccggcggcaggccgccctggaggccgctgtgcggcaggcctgtgccccccaggagctggagcgcttcagccgcttcatggctgacctggagcgggtgctgggcctgctgctgctgctgggcagccggctggcccgggtgagaagagccctggcccgggccgccagtgacagcgaccctgatgagcagaggctgcggctgctgcagaggcaggaggaggatgccaaggagctgaaggagcacgtggcccggcgggagagagctgtgcgggaggtgctggtgcgggccctgcctgtggaggagctgcgggtgtactgtgccctgctggccggcaaggctgctgtgctggcccagcagaggaacctggatgagcgcatccggctgctgcaggaccagctggatgccatcagagatgacctgggccaccacgcccccagccccagccctgcccggcccccaggcacctgcccccctgtgcagccccccttccccctgctgctgacctag

SEQ ID NO: 18967 - DNA, 2502 bp, Artificial Sequence
  Description of Artificial Sequence: Synthetic coding sequence
atgaagttcaccaacaccaaggtgcagatgatgcagaatgtgcacctggcccctgagacagatgaagatgacctgtacagcggctacaatgactacaaccccatctatgacatcgaggagctggagaatgatgctgccttccagcaggccgtgaggaccagccatggaagaagaccacccatcacagccaagatcagcagcacagctgtgacccggcccatcgccaccggctacggcagcaagaccagcctggccagcagcatcggccggcccatgactggagccatccaggatggagtgacccggcccatgacagctgtgcgggccgccggcttcaccaaggccgccctgcggggcagcgcctttgaccccctgagccagagccggggccctgccagccccctggaggccaagaagaaggacagccctgaggagaagatcaagcagctggagaaggaggtgaatgagctggtggaggagagctgcatcgccaacagctgtggggacctgaagctggccctggagaaggccaaggatgctggcaggaaggagcgggtgctggtgcggcagcgggagcaggtgaccaccccagagaacatcaacctggacctgacctacagcgtgctcttcaacctggccagccagtacagcgtgaatgagatgtatgcagaggccctgaacacctaccaggtgattgtgaagaacaagatgttcagcaatgccggcatcctgaagatgaacatgggcaacatctacctgaagcagaggaactacagcaaggccatcaagttctacaggatggccctggaccaggtgcccagcgtgaacaagcagatgaggatcaagatcatgcagaacattggagtgaccttcatccaggccggccagtacagtgatgccatcaacagctatgagcacatcatgtccatggcccccaacctgaaggccggctacaacctgaccatctgctactttgccatcggggaccgggagaagatgaagaaggccttccagaagctgatcaccgtgcccctggagattgatgaggacaagtacatcagccccagtgatgacccccacaccaacctggtgacagaggccatcaagaatgaccacctgcggcagatggagcgggagaggaaggccatggccgagaagtacatcatgaccagcgccaagctgattgcccctgtgattgagaccagctttgctgctggctatgactggtgtgtggaggtggtgaaggccagccagtatgtggagctggccaatgacctggagatcaacaaggctgtgacctacctgcggcagaaggactacaaccaggccgtggagatcctgaaggtgctggagaagaaggacagccgggtgaagtctgctgctgccaccaacctgagcgccctgtactacatgggcaaggactttgcccaggccagcagctatgctgacattgctgtgaacagcgaccgctacaacccagctgccctgaccaacaagggcaacacagtgtttgccaacggggactatgagaaggctgctgagttctacaaggaggccctgagaaatgacagcagctgcacagaggccctgtacaacatcggcctgacctatgagaagctgaaccggctggatgaggccctggactgcttcctgaagctgcacgccatcctgaggaacagcgctgaggtgctgtaccagatcgccaacatctatgagctgatggagaaccccagccaggccatcgagtggctgatgcaggtggtgtctgtcatccccacagacccccaggtgctgagcaagctgggggagctgtatgaccgggagggggacaagagccaggccttccagtactactatgagagctaccgctacttcccctgcaacattgaagtcatcgagtggctgggcgcctactacatcgacacccagttctgggagaaggccatccagtactttgagcgggccagcctcatccagcccacccaggtgaagtggcagctgatggtggccagctgcttccgccgcagcggcaactaccagaaggccctggacacctacaaggacacccacaggaagttcccagaaaatgtggagtgcctgcgcttcctggtgcggctgtgcacagacctgggcctgaaggatgcccaggagtatgccaggaagctgaagaggctggagaagatgaaggagatccgggagcagaggatcaagagcggcagagatggcagcggcggcagccggggcaagcgggagggcagcgccagcggggacagcggccagaactacagcgccagcagcaaaggagagcggctgagcgcccggctgcgggccctgcccggcaccaatgagccctatgagagcagcagcaacaaggagattgatgccagctatgtggaccccctgggcccccagatcgagcggcccaagacagctgccaagaagagaattgatgaagatgactttgctgatgaggagctgggagatgacctgctgcctgagtag

SEQ ID NO: 18968 - DNA, 918 bp, Artificial Sequence; identical to SEQ ID NO: 18761
  Description of Artificial Sequence: Synthetic coding sequence

SEQ ID NO: 18969 - DNA, 1119 bp, Artificial Sequence
  Description of Artificial Sequence: Synthetic coding sequence
atggatgtgctgagccccctgtccttcatcaaggtgagccacgtgaggatgcagggcatcctgctgctggtgtttgccaagtaccagcacctgccctacatccagatcctgagcaccaagagcacccccaccggcctgtttggctactggggcaacaagggcggcgtgaacatctgcctgaagctgtatggctactacgtgtccatcatcaactgccacctgcccccccacatcagcaacaactaccagaggctggagcactttgaccgcatcctggagatgcagaactgtgagggccgggacatccccaacatcctggaccatgacctgatcatctggtttggagacatgaacttcagaattgaggactttggcctgcactttgtgcgggagagcatcaagaaccgctgctacggcggcctgtgggagaaggaccagctgagcatcgccaagaagcatgaccccctgctgcgggagttccaggagggccgcctgctcttcccccccacctacaagtttgacaggaacagcaatgactatgacaccagcgagaagaagaggaagccagcctggacagaccgcatcctgtggaggctgaagaggcagccctgtgccggccctgacacccccatccccccagccagccacttcagcctgagcctgcggggctacagcagccacatgacctacggcatcagtgaccacaagcctgtgtctggcacctttgacctggagctgaagcccctggtgtctgcccccctgattgtgctgatgcctgaggacctgtggacagtggagaatgacatgatggtgtcctacagcagcaccagtgacttccccagcagcccctgggactggattggcctgtacaaggtgggcctgagagatgtgaatgactatgtgtcctatgcctgggtgggggacagcaaggtgtcctgcagcgacaacctgaaccaggtgtacatcgacatcagcaacatccccaccacagaagatgagttcctgctgtgctactacagcaacagcctgcggtctgtggtgggcatcagccggcccttccagatccccccaggcagcctgcgggaggaccccctgggggaggcccagccccagatctag

SEQ ID NO: 18970 - DNA, 1692 bp, Artificial Sequence
  Description of Artificial Sequence: Synthetic coding sequence
atgaggctggacctggccagcctgatgtctgcccccaagagcctgggcagcgccttcaagtcctggaggctggacaaggcccccagcccccagcacaccttccccagcaccagcatccctggcatggcctttgccctgctggcctctgtgccccctgtgtttggcctgtacaccagcttcttccctgtgctgatctacagcctgctgggcaccggccgccacctgagcacaggcacctttgccatcctgagcctgatgactggatctgctgtggagcggctggtgcctgagcccctggtgggcaacctgagcggcatcgagaaggagcagctggatgcccagagggtgggcgtggccgctgctgtggccttcggcagcggggccctgatgctgggcatgtttgtgctgcagctgggcgtgctgagcaccttcctgtctgagcctgtggtgaaggccctgaccagcggggccgccctgcacgtgctgctgagccagctgcccagcctgctgggcctgagcctgccccggcagatcggctgcttcagcctcttcaagaccctggccagcctgctgacagccctgcccaggagcagccctgctgagctgaccatcagcgccctgagcctggccctgctggtgcctgtgaaggagctgaatgtgcgcttccgggaccggctgcccacccccatccctggagaggtggtgctggtgctgctggcctctgtgctgtgcttcaccagctctgtggacacccgctaccaggtgcagatcgtgggcctgctgcccggcggcttcccccagcccctgctgcccaacctggccgagctgccccgcatcctggccgacagcctgcccatcgccctggtgtcctttgctgtgtctgccagcctggccagcatccacgccgacaagtacagctacaccatcgacagcaaccaggagttcctggcccacggggccagcaacctgatcagcagcctcttcagctgcttccccaacagcgccaccctggccaccaccaacctgctggtggatgctgggggcaagacccagctggccggcctcttcagctgcaccgtggtgctgtctgtgctgctgtggctgggccccttcttctactacctgcccaaggctgtgctggcctgcatcaacatcagctccatgaggcaggtgttctgccagatgcaggagctgccccagctgtggcacatcagccgggtggacttcctgctgcaggtgcccggcctgtgcatcctgagctaccccacccccctgtacttcggcacccggggccagttccgctgcaacctggagtggcacctgggcctgggggagggggagaaggagaccagcaagccagatggccccatggtggccgtggccgagcctgtgcgggtggtggtgctggacttcagcggcgtgacctttgctgatgctgctggggcccgggaggtggtgcaggtgcgggagcggctggccagccgctgcagagatgcccgcatccggctgctgctggcccagtgcaatgccctggtgcagggcaccctgaccagggtgggcctgctggacagagtgaccccagaccagctgtttgtgtctgtgcaggatgctgctgcctatgccctgggcagcctgctgcggggcagcagcaccaggagcggcagccaggaggccctgggctgcggcaagtag

SEQ ID NO: 18971 - DNA, 2892 bp, Artificial Sequence
  Description of Artificial Sequence: Synthetic coding sequence
atggccgagcggggcggggccggcggcggccctggaggagctgggggcggcagcggccagaggggcagcggcgtggcccagagcccccagcagcccccaccccagcagcagcagcagcagcccccccagcagcccaccccacccaagctggcccaggccaccagcagcagcagcagcaccagcgctgctgctgccagcagcagcagcagcagcaccagcacctccatggctgtggccgtggccagcggcagcgcccctcctgggggccctggccctggccgcaccccagcccctgtgcagatgaacctgtatgccacctgggaggtggacaggagcagcagcagctgtgtgcccaggctcttcagcctgaccctgaagaagctggtgatgctgaaggagatggacaaggacctgaacagcgtggtgattgctgtgaagctgcagggcagcaagaggatcctgcggagcaatgaaattgtgctgcctgccagcggcctggtggagacagagctgcagctgaccttcagcctgcagtacccccacttcctgaagagagatgccaacaagctgcagatcatgctgcagaggaggaagcgctacaagaacagaaccatcctgggctacaagaccctggccgtgggcctcatcaacatggccgaggtgatgcagcaccccaatgaaggagccctggtgctgggcctgcacagcaatgtgaaggatgtgtctgtgcctgtggccgagatcaagatctacagcctgagcagccagcccatcgaccacgagggcatcaagagcaagctgagtgacaggagcccagacatcgacaactacagcgaggaggaggaggagagcttcagcagcgagcaggagggcagtgatgaccccctgcacggccaggacctcttctatgaagatgaggacctgaggaaggtgaagaagaccaggaggaagctgaccagcaccagcgccatcacccggcagcccaacatcaagcagaagtttgtggccctgctgaagcgcttcaaggtgtctgatgaggtgggcttcggcctggagcacgtgtcccgggagcagatccgggaggtggaggaggacctggatgagctgtatgacagcctggagatgtacaaccccagcgacagcggccctgagatggaggagacagagagcatcctgagcacccccaagcccaagctgaagcccttctttgagggcatgagccagagcagcagccagacagaaattggcagcctgaacagcaagggcagcctgggcaaggacaccaccagccccatggagctggccgccctggagaagatcaagagcacctggatcaagaaccaggatgacagcctgacagaaacagacaccctggagatcacagaccaggacatgtttggagatgccagcaccagcctggtggtgcctgagaaggtgaagacccccatgaagagcagcaagacagacctgcagggcagcgccagccccagcaaggtggagggcgtgcacaccccccggcagaagaggagcacccccctgaaggagcggcagctgagcaagcccctgtctgagaggaccaacagcagtgacagcgagaggagcccagacctgggccacagcacccagatccccaggaaggtggtgtatgaccagctgaaccagatcctggtgtctgatgctgccctgcctgaaaatgtcatcctggtgaacaccacagactggcagggccagtatgtggccgagctgctgcaggaccagaggaagcctgtggtgtgcacctgcagcacagtggaggtgcaggccgtgctgagcgccctgctgacccgcatccagcgctactgcaactgcaacagctccatgcccaggcctgtgaaggtggccgctgtgggcggccagagctacctgagcagcatcctgcgcttctttgtgaagagcctggccaacaagaccagtgactggctgggctacatgaggttcctgatcatccccctgggcagccaccctgtggccaagtacctgggctctgtggacagcaagtacagcagcagcttcctggacagcggctggagggacctcttcagccgctctgagccccctgtgtctgagcagctggatgtggccggccgggtgatgcagtatgtgaatggagctgccaccacccaccagctgcctgtggccgaggccatgctgacctgccgccacaagttcccagatgaagattcctaccagaagttcatccccttcatcggcgtggtgaaggtgggcctggtggaggacagccccagcacagctggagatggagatgacagccctgtggtgtccctgactgtgcccagcaccagcccccccagcagcagcggcctgagcagagatgccacagccaccccacccagcagccccagcatgagcagcgccctggccatcgtgggcagccccaacagcccctatggagatgtgattggcctgcaggtggactactggctgggccaccctggagagaggagaagagaaggagacaagagagatgccagcagcaagaacaccctgaagtctgtgttccgctctgtgcaggtgtcccggctgccccacagcggggaggcccagctgagcggcaccatggccatgacagtggtgaccaaggagaagaacaagaaggtgcccaccatcttcctgagcaagaagccccgggagaaggaggtggacagcaagagccaggtgattgagggcatcagccgcctcatctgcagcgccaagcagcagcagaccatgctgcgggtgtccattgatggagtggagtggagcgacatcaagttcttccagctggccgcccagtggcccacccacgtgaagcacttccctgtgggcctcttcagcggcagcaaggccacctag

SEQ ID NO: 18972 - DNA, 546 bp, Artificial Sequence
  Description of Artificial Sequence: Synthetic coding sequence
atggaggagatcccagcccaggaggccgccggcagcccccgggtgcagttccagagcctggagacccagagtgaatgtctgagccctgagccccagtttgtgcaggacacagacatggagcagggcctgaccggggcccctcctgtgccccaggtgcctgccctgccccgggagggcagccctggggaccaggccgccgccctgctgacagcccgctaccaggagtttgtgacctttgaagatgtggccgtgcacctgacccgggaggagtggggctacctggaccctgtgcagagggacctgtaccgggaggtgatgctggagaactatggaaatgtggtgtccctgggcatcctgctgcggctgcccaccacccgcatccacagcgtgaacagctgcccagccctgagccacacccaggccagcgccttctctggagagaccctggccgtgctgacagctggcatcagcaagcgctggcccaagtaccgcctgcccattgatattgcccggccctgcagcgagacccccttcccccggctgtag

SEQ ID NO: 18973 - DNA, 1410 bp, Artificial Sequence
  Description of Artificial Sequence: Synthetic coding sequence
atggtgctggagggcaaccctgaggtgggcagccccaggaccagtgacctgcagcaccggggcaacaagggcagctgtgtgctgagcagccctggagaagatgcccagcctggagaggagcccatcaagtacggggagctgattgtgctgggctgctgtgaggagggcggggaggagacagaggcccagagaggagaggtgacaggcccccgggcccacagctgctacaacggctgcctggccagcggggacaagggcagaagaagaagccggctggccctgagccgccgcagccacgccaatggagtgaagccagatgtgatgcaccacatcagcacccccctggtgtccaaggccctgagcaacagaggccagcacagcatctcctacaccctgagccgcagccacagcgtgattgtggagtacacccatgacagcgacacagacatgttccagatcggccgcagcacagagaacatgattgactttgtggtgacagacaccagccctgggggcggcgctgctgagggccccagcgcccagagcaccatcagccgctatgcctgccgcatcctgtgtgacagaagaccaccctacacagcccgcatctatgctgctggctttgatgccagcagcaacatcttcctgggggagcgggccgccaagtggaggaccccagatggcctgatggatggcctgaccaccaacggggtgctggtgatgcaccctgctgggggcttctctgaagattctgcccctggggtgtggagggagatctctgtgtgtggaaatgtgtacaccctgcgggacagccgcagcgcccagcagaggggcaagctggtggagaatgaaagcaatgtgctgcaggacggcagcctgattgacctgtgtggggccaccctgctgtggaggaccccagctggcctgctgcgggcccccaccctgaagcagctggaggcccagaggcaggaggccaatgctgcccggccccagtgccctgtgggcctgagcaccctggccttccccagccctgcccggggccgcacagccccagacaagcagcagccctgggtgtatgtgcgctgtggccacgtgcacggctaccacggctggggctgccggcgggagcggggcccccaggagagagaatgtcccctgtgccgcctggtgggcccctacgtgcccctgtggctgggccaggaggccggcctgtgcctggaccccggcccccccagccacgcctttgccccctgtggccacgtgtgcagcgagaagacagcccgctactgggcccagacccccctgccccacggcacccacgccttccacgccgcctgccccttctgtggggcctggctgaccggggagcacggctgtgtgcggctcatcttccagggccccctggactag

SEQ ID NO: 18974 - DNA, 3312 bp, Artificial Sequence
  Description of Artificial Sequence: Synthetic coding sequence
atggccggggcctctgtgaaggtggccgtgcgggtgcggcccttcaatgcccgggagaccagccaggatgccaagtgtgtggtgtccatgcagggcaacaccaccagcatcatcaaccccaagcagagcaaggatgcccccaagagcttcacctttgactacagctactggagccacaccagcacagaggacccccagtttgccagccagcagcaggtgtacagagacattggagaggagatgctgctgcacgcctttgagggctacaacgtgtgcatctttgcctacggccagacaggagctgggaagagctacaccatgatgggccggcaggagcccggccagcagggcatcgtgccccagctgtgtgaggacctcttcagccgggtgtctgagaaccagagcgcccagctgagctacagcgtggaggtgtcctacatggagatctactgtgagcgggtgcgggacctgctgaaccccaagagccggggcagcctgcgggtgcgggagcaccccatcctgggcccctacgtgcaggacctgagcaagctggccgtgaccagctatgctgacattgctgacctgatggactgtggcaacaaggccaggacagtggccgccaccaacatgaatgagaccagcagccgcagccatgctgtgttcaccatcgtgttcacccagcgctgccacgaccagctgaccggcctggacagcgagaaggtgtccaagatcagcctggtggacctggccggcagcgagagagctgacagcagcggggcccggggcatgaggctgaaggagggcgccaacatcaacaagagcctgaccaccctgggcaaggtgatcagcgccctggccgacatgcagagcaagaagaggaagagtgacttcatcccctacagagattctgtgctgacctggctgctgaaggagaacctgggcggcaacagcaggacagccatgattgctgccctgagccctgctgacatcaactatgaggagaccctgagcaccctgcgctatgctgacaggaccaagcagatccgctgcaatgccatcatcaatgaagaccccaatgcccggctcatccgggagctgcaggaggaggtggcccggctgcgggagctgctgatggcccagggcctgagcgccagcgccctggagggcctgaagacagaggagggctctgtgcggggggccctgcctgctgtgagcagccccccagcccctgtgagccccagcagccccaccacccacaacggggagctggagcccagcttcagccccaacacagagagccagatcggccctgaggaggccatggagcggctgcaggagacagagaagatcatcgccgagctgaatgagacctgggaggagaagctgaggaagacagaggccctgaggatggagcgggaggccctgctggccgagatgggcgtggccgtgagagaagatggcggcaccgtgggcgtcttcagccccaagaagaccccccacctggtgaacctgaatgaagaccccctgatgtctgagtgcctgctgtaccacatcaaggatggagtgaccagggtgggccaggtggacatggacatcaagctgaccggccagttcatccgggagcagcactgcctcttccgcagcatcccccagccagatggagaggtggtggtgaccctggagccctgtgagggcgctgagacctacgtgaatggcaagctggtgacagagcccctggtgctgaagagcggcaacagaattgtgatgggcaagaaccacgtgttccgcttcaaccaccctgagcaggcccggctggagcgggagcggggcgtgcccccacctcctggccccccatctgagcctgtggactggaactttgcccagaaggagctgctggagcagcagggcatcgacatcaagctggagatggagaagaggctgcaggacctggagaaccagtacaggaaggagaaggaggaggccgacctgctgctggagcagcagaggctgtatgctgacagcgacagcggagatgacagcgacaagaggagctgtgaggagagctggaggctcatcagcagcctgcgggagcagctgccccccaccaccgtgcagaccatcgtgaagagatgtggcctgcccagcagcggcaagagaagagcccccaggagagtgtaccagatcccccagaggcggcggctgcagggcaaggacccccgctgggccaccatggctgacctgaagatgcaggccgtgaaggagatctgctatgaggtggccctggccgacttccgccacggccgggcagaaattgaggccctggccgccctgaagatgagggagctgtgcaggacctacggcaagccagatggccctggagatgcctggagggctgtggccagagatgtgtgggacacagtgggggaggaggagggcggcggggccggcagcggcggcggcagcgaggagggcgcccggggagctgaggtggaggacctgcgggcccacatcgacaagctgaccggcatcctgcaggaggtgaagctgcagaacagcagcaaggaccgggagctgcaggccctgcgggacaggatgctgaggatggagagggtcatccccctggcccaggaccatgaagatgaaaatgaggagggcggggaggtgccctgggcccctcctgagggcagcgaggccgctgaggaggccgcccccagcgacaggatgcccagcgcccggccccccagcccccccctgagctcctgggagcgggtgtcccggctgatggaggaggaccctgccttcagaagaggccgcctgcgctggctgaagcaggagcagctgcggctgcagggcctgcagggcagcggcggccggggcggcggcctgcggcggcccccagccaggtttgtgccccctcatgactgcaagctgcgcttccccttcaagagcaacccccagcaccgggagagctggccaggcatgggcagcggggaggcccccacccccctgcagcccccagaggaggtgaccccccacccagccaccccagcccggcggccccccagcccccggcgcagccaccaccccaggaggaacagcctggatggcggcggccgcagcagaggagctggcagcgcccagcctgagccccagcacttccagcccaagaagcacaacagctacccccagcccccccagccctacccagcccagaggcctcctggcccccgctacccaccctacaccaccccacccaggatgaggcggcagaggtctgccccagacctgaaggagagcggggctgctgtgtag

SEQ ID NO: 18975 - DNA, 1260 bp, Artificial Sequence
  Description of Artificial Sequence: Synthetic coding sequence
atggccgagcctgtgggcaagaggggccgctggagcggcggcagcggggccggccggggcggccggggcggctggggcggccggggccggcggccccgggcccagaggagccccagccggggcaccctggatgtggtgtctgtggacctggtgacagacagtgatgaggagatcctggaggtggccacagcccggggagctgctgatgaggtggaggtggagcccccagagcccccaggccctgtggccagccgggacaacagcaacagcgacagtgaaggagaagatagaagacctgctggccccccccgggagcctgtgagaagaagaagaaggctggtgctggaccctggagaggcccccctggtgcctgtgtacagcggcaaggtgaagagcagcctgcggctcatcccagatgacctgagcctgctgaagctgtacccacctggagatgaggaggaggccgagctggccgacagcagcggcctgtaccacgagggcagccccagccctggcagcccctggaagaccaagctgcggaccaaggacaaggaggagaagaagaagacagagttcctggacctggacaacagccccctgagcccccccagccccaggaccaagagcaggacccacacccgggccctgaagaagctgtctgaggtgaacaagaggctgcaggacctgcggagctgcctgagccccaagccaccccagggccaggagcagcagggccaggaggatgaggtggtgctggtggagggccccaccctgcctgagacccccaggctcttccccctgaagatccgctgcagagctgacctggtgcggctgcccctgaggatgtctgagcccctgcagagcgtggtggaccacatggccacccacctgggcgtgagccccagccgcatcctgctgctgtttggagaaacagagctgagccccacagccacccccaggaccctgaagctgggcgtggccgacatcatcgactgtgtggtgctgaccagcagccctgaggccacagagaccagccagcagctgcagctgcgggtgcagggcaaggagaagcaccagaccctggaggtgtccctgagccgggacagccccctgaagaccctgatgagccactatgaggaggccatgggcctgagcggcaggaagctgtccttcttctttgatggcaccaagctgagcggccgggagctgcctgctgacctgggcatggagagcggggacctgattgaggtgtggggctag

SEQ ID NO: 18976 - DNA, 384 bp, Artificial Sequence
  Description of Artificial Sequence: Synthetic coding sequence
atgaggcccctggacatcgtggagctggccgagcctgaggaggtggaggtgctggagcctgaggaggactttgagcagttcctgctgcccgtcatcaatgagatgagagaagatattgccagcctgacccgggagcacggccgggcctacctgaggaacagaagcaagctgtgggagatggacaacatgctgatccagatcaagacccaggtggaggccagcgaggagagcgccctgaaccacctgcagaaccctggagatgctgctgagggccgggccgccaagagatgtgagaaggccgaggagaaggccaaggagatcgccaagatggccgagatgctggtggagctggtgagaagaattgagaagtctgagagcagctag

SEQ ID NO: 18977 - DNA, 1263 bp, Artificial Sequence
  Description of Artificial Sequence: Synthetic coding sequence
atgcccctgcaggtgtctgactacagctggcagcagaccaagacagctgtgttcctgagcctgcccctgaagggcgtgtgtgtgcgggacacagatgtgttctgcacagagaactacctgaaggtgaacttcccccccttcctgtttgaggccttcctgtatgcccccattgatgatgagagcagcaaggccaagattggaaatgacaccatcgtgttcaccctgtacaagaaggaggccgccatgtgggagaccctgtctgtgactggagtggacaaggagatgatgcagaggatccgggagaagagcatcctgcaggcccaggagcgggccaaggaggccacagaggccaaggccgccgccaagcgggaggaccagaagtatgccctgtctgtgatgatgaagattgaggaggaggagaggaagaagattgaggacatgaaggaaaatgaaagaatcaaggccaccaaggccctggaggcctggaaggagtaccagaggaaggccgaggagcagaagaagatccagcgggaggagaagctgtgccagaaggagaagcagatcaaggaggagaggaagaagatcaagtacaagagcctgaccaggaacctggccagcaggaacctggcccccaagggcaggaacagcgagaacatcttcacagagaagctgaaggaggacagcatcccagcccccaggtctgtgggcagcatcaagatcaacttcacccccagggtcttccccacagccctgcgggagagccaggtggccgaggaggaggagtggctgcacaagcaggccgaggcccggcgggccatgaacacagacattgctgagctgtgtgacctgaaggaggaggagaagaaccctgagtggctgaaggacaagggcaacaagctgtttgccacagagaactacctggccgccatcaatgcctacaacctggccatccggctgaacaacaagatgcccctgctgtacctgaacagagctgcctgccacctgaagctgaagaacctgcacaaggccatcgaggacagcagcaaggccctggagctgctgatgcctcctgtgacagacaatgccaatgccaggatgaaggcccacgtgagaagaggaacagccttctgccagctggagctgtatgtggagggcctgcaggactatgaagctgccctgaagattgaccccagcaacaagatcgtgcagattgatgctgagaagatcagaaatgtcatccagggcacagagctgaagagctag

SEQ ID NO: 18978 - DNA, 348 bp, Artificial Sequence
  Description of Artificial Sequence: Synthetic coding sequence
atgagatatgtggccagctacctgctggccgccctgggcggcaacagcagccccagcgccaaggacatcaagaagatcctggacagcgtgggcatcgaggctgatgatgaccggctgaacaaggtgatcagcgagctgaatggcaagaacattgaagatgtgattgcccagggcatcggcaagctggcctctgtgcctgctggaggagctgtggccgtgtctgctgcccctggcagcgctgccccagctgctggcagcgccccagctgctgctgaggagaagaaggatgagaagaaggaggagagcgaggagagtgatgatgacatgggcttcggcctgtttgattag

SEQ ID NO: 18979 - DNA, 1233 bp, Artificial Sequence
  Description of Artificial Sequence: Synthetic coding sequence
ctcaacagagcctgcttctgtgtgactggagtgcctgagctggaggtgatctgtggcctgcagcaggccgagtggccccggctgggcctgagccacctgggcgctgtgggcggcggctggggcggcctgcccaccagcacctgggtgtccctgcacacccaggaggtggacctggccagcgaggtggccctggaggtggtgaggacagctgagcccggggtgtggctggaggcccaggcccctgtggccctggtggcccagcctgagcccctgcctgccacagctggggtgaagcgggagagcgtgggcatggaggtggccgtgctgacagatgaccccctgcctgtggtggaccagcagcaggtgctggcccggctgcagctgctggagcagcaggtggtgggcggggagcaggccaagaacaaggacctgaaggagaagcacaagaggaggaagagatatgcagatgagaggaggaagcagctggtggccgccctgcagaacagtgatgaagattctggggactgggtgctgctgaatgtgtatgacagcatccaggaggaggtgcgggccaagagcaagctgctggagaagatgcagaggaagctgcgggctgctgaggtggagatcaaggacctgcagagcgagttccagctggagaagattgactacctggccaccatccggcggcaggagcgggacagcatgctgctgcagcagctgctggagcaggtgcagcccctcatccggcgggactgcaactacagcaacctggagaagatcctgcgggagagctgctgggatgaagataatggcttctggaagatcccccaccctgtgatcaccaagaccagcctgcctgtggccgtgtccacaggcccccagaacaagccagccaggaagaccagcgctgctgacaatggagagcccaacatggaggatgaccgctaccgcctgatgctgagccgcagcaacagtgaaaatattgccagcaactacttccgcagcaagagggccagccagatcctgagcacagatgccaggaagagcctgacccaccacaacagccccccaggcctgagctgccccctgagcaacaacagcgccatcccccccacccaggcccctgagatgccccagccccggcccttccggctggagagcctggacatccccttcaccaaggccaagaggaagaagagcaagagcaactttggaagtgagcccctgtag

SEQ ID NO: 18980 - DNA, 1353 bp, Artificial Sequence
  Description of Artificial Sequence: Synthetic coding sequence
atgagggagtgcatcagcatccacgtgggccaggccggcgtgcagattggaaatgcctgctgggagctgtactgcctggagcacggcatccagccagatggccagatgcccagcgacaagaccatcggcggcggagatgacagcttcaacaccttcttcagcgagaccggggccggcaagcacgtgcccagggctgtgtttgtggacctggagcccaccgtggtggatgaggtgaggacaggcacctaccggcagctgttccaccctgagcagctgatcaccgggaaggaggatgctgccaacaactatgcccggggccactacaccatcggcaaggagatcgtggacctggtgctggaccgcatcaggaagctggccgacctgtgcaccggcctgcagggcttcctgatcttccacagctttggaggcggcactggaagtggctttgccagcctgctgatggagcggctgtctgtggactatggcaagaagagcaagctggagtttgccatctacccagccccccaggtgtccacagctgtggtggagccctacaacagcatcctgaccacccacaccaccctggagcacagcgactgtgccttcatggtggacaatgaggccatctatgacatctgcagaagaaacctggacatcgagcggcccacctacaccaacctgaaccggctgattggccagatcgtgagcagcatcacagccagcctgcgctttgatggagccctgaatgtggacctgacagagttccagaccaacctggtgccctacccccgcatccacttccccctggccacctacgcccctgtgatctctgctgagaaggcctaccacgagcagctgtctgtggccgagatcaccaatgcctgctttgagcccgccaaccagatggtgaagtgtgaccccaggcatggcaagtacatggcctgctgcatgctgtacagaggagatgtggtgcccaaggatgtgaatgctgccatcgccaccatcaagaccaagaggaccatccagtttgtggactggtgccccaccggcttcaaggtgggcatcaactaccagcccccaacagtggtgcctggaggagacctggccaaggtgcagagagctgtgtgcatgctgagcaacaccacagccatcgccgaggcctgggcccggctggaccacaagtttgacctgatgtatgccaagagggcctttgtgcactggtacgtgggggagggcatggaggagggggagttcagcgaggcccgggaggacctggccgccctggagaaggactatgaggaggtgggcgtggacagcgtggaggccgaggccgaggagggggaggagtactag

SEQ ID NO: 18981 - DNA, 471 bp, Artificial Sequence
  Description of Artificial Sequence: Synthetic coding sequence
atgtctgggggcctgctgaaggccctgcggagtgacagctatgtggagctgagccagtacagagaccagcacttccggggggacaatgaggagcaggagaagctgctgaagaagagctgcaccctgtatgtgggcaacctgtccttctacaccacagaggagcagatctatgagctgttcagcaagagcggggacatcaagaagatcatcatgggcctggacaagatgaagaagacagcctgtggcttctgctttgtggagtactacagcagagcagatgctgaaaatgccatgagatacatcaatggcacccggctggatgaccgcatcatcagaacagactgggatgctggcttcaaggagggccggcagtatggccggggccgcagcggcggccaggtgagagatgagtaccggcaggactatgatgctggccggggcggctacggcaagctggcccagaaccagtag

SEQ ID NO: 18982 - DNA, 996 bp, Artificial Sequence
  Description of Artificial Sequence: Synthetic coding sequence
atgggcggggagcaggaggaggagagatttgatggcatgctgctggccatggcccagcagcatgaaggaggagtgcaggagctggtgaacaccttcttctccttcctgcggaggaagacagacttcttcatcggcggggaggagggcatggccgagaagctgatcacccagaccttcagccaccacaaccagctggcccagaagacccggcgggagaagagggcccggcaggaggccgagcggcgggagaaggccgagcgggccgcccggctggccaaggaggccaagtctgagaccagcggcccccagatcaaggagctgacagatgaggaggccgagcggctgcagctggagattgaccagaagaaggatgctgagaaccacgaggcccagctgaagaatggcagcctggacagccctgggaagcaggacacagaagaagatgaggaggaggatgagaaggacaagggcaagctgaagcccaacctgggcaatggagctgacctgcccaactaccgctggacccagaccctgtctgagctggacctggccgtgcccttctgtgtgaacttccggctgaagggcaaggacatggtggtggacatccagaggaggcacctgcgggtgggcctgaagggccagcctgccatcattgatggagagctgtacaatgaggtgaaggtggaggagagctcctggctgattgaagatggcaaggtggtgacagtgcacctggagaagatcaacaagatggagtggtggagccggctggtgtccagtgaccctgagatcaacaccaagaagatcaaccctgagaacagcaagctgagtgacctggacagcgagaccaggtccatggtggagaagatgatgtatgaccagaggcagaagtccatgggcctgcccaccagtgatgagcagaagaagcaggagatcctgaagaagttcatggaccagcaccctgagatggacttcagcaaggccaagttcaactag

SEQ ID NO: 18983 - DNA, 1860 bp, Artificial Sequence
  Description of Artificial Sequence: Synthetic coding sequence
atggccggccctggggtgcctggggccccagctgcccgctggaagaggcacatcgtgcggcagctgcggctgcgggacaggacccagaaggccctcttcctggagctggtgcctgcctacaaccacctgctggagaaggccgagctgctggacaagttcagcaagaagctgcagcctgagcccaacagcgtgacccccaccacccaccagggcccctgggaggagagcgagctggacagcgaccaggtgcccagcctggtggccctgcgggtgaagtggcaggaggaggaggagggcctgcggctggtgtgtggggagatggcctaccaggtggtggagaagggggccgccctgggcaccctggagagcgagctgcagcagaggcagagccggctggccgccctggaggcccgggtggcccagctgcgggaggcccgggcccagcaggcccagcaggtggaggagtggagggcccagaatgctgtgcagagagctgcctatgaggccctgcgggcccacgtgggcctgcgggaggccgccctgcggcggctgcaggaggaggcccgggacctgctggagcggctggtgcagaggaaggcccgggctgctgctgagaggaacctgagaaatgaaagaagagagcgggccaagcaggcccgggtgtcccaggagctgaagaaggccgccaagaggacagtgtccatcagcgagggccctgacaccctgggagatggcatgagggagcggcgggagaccctggccctggcccctgagcctgagcccctggagaaggaggcctgtgagaagtggaagaggcccttccgcagcgccagcgccaccagcctgaccctgagccactgtgtggatgtggtgaagggcctgctggacttcaagaagaggcggggccacagcattggaggagcccctgagcagcgctaccagatcatccctgtgtgtgtggccgcccggctgcccacccgggcccaggatgtgctggatgcccacctgtctgaggtgaatgctgtgcgcttcggccccaacagcagcctgctggccactggaggagctgacaggctcatccacctgtggaatgtggtgggcagccggctggaggccaaccagaccctggagggcgccggcggcagcatcacctctgtggactttgaccccagcggctaccaggtgctggccgccacctacaaccaggccgcccagctgtggaaggtgggggaggcccagagcaaggagaccctgagcggccacaaggacaaggtgacagctgccaagttcaagctgaccaggcaccaggccgtgacaggcagccgggacagaacagtgaaggagtgggacctgggccgggcctactgcagcaggaccatcaacgtgctgagctactgcaatgatgtggtgtgtggggaccacatcatcatcagcggccacaatgaccagaagatccgcttctgggacagccggggcccccactgcacccaggtgattcctgtgcagggccgggtgaccagcctgagcctgagccatgaccagctgcacctgctgagctgcagccgggacaacaccctgaaggtgattgacctgcgggtgagcaacatccggcaggtgttccgggcagatggcttcaagtgtggcagtgactggaccaaggctgtgttctccccagacaggagctatgccctggccggcagctgtgatggagccctgtacatctgggatgtggacaccgggaagctggagagccggctgcagggcccccactgtgccgctgtgaatgctgtggcctggtgctacagcggcagccacatggtgtctgtggaccagggcaggaaggtggtgctgtggcagtag

SEQ ID NO: 18984 - DNA, 5049 bp, Artificial Sequence
  Description of Artificial Sequence: Synthetic coding sequence
atggagggcaatggaacagagaacagctgcagcaggacccggggctggctgcagcaggacaatgatgccaagccctggctgtggaagttcagcaactgcttcagcaggcctgagcagaccctgccccacagcccccagaccaaggagtacatggagaacaagaaggtggccgtggagctgaaggatgtgcccagccccctgcatgctggcagcaagctgtttcctgctgtgcccctgcctgacatccgcagcctgcagcagcccaagatccagctgagctctgtgcccaaggtgtcctgctgtgcccactgccccaatgagcccagcaccagccccatgagatttggaggcggcggcggcggcagcggcggcaccagcagcctcatccaccctggggccctgctggacagccagagcaccaggaccatcacctgccaggtgggcagcggctttgccttccagagcgccagcagcctgcagaatgccagcgccaggaacaacctggccggcatcgccagtgacttccccagcatgtgcctggagagcaacctgagcagctgcaagcacctgccctgctgcggcaagctgcacttccagagctgccacggcaatgtgcacaagctgcaccagttccccagcctgcagggctgcaccagcgctggctacttcccctgcagcgacttcaccagcggggcccctggccacctggaggagcacatcagccagagcgagctgaccccccacctgtgcaccaacagcctgcacctgaatgtggtgccccctgtgtgcctgaagggcagcctgtactgtgaggactgcctgaacaagccagccagaaattccatcattgatgctgccaaggtgtggcccaacatccccccacccaacacccagcctgcccccctggccgtgcccctgtgcaatggctgcggcaccaagggcaccgggaaggagaccaccctgctgctggccaccagcctgggcaaggccgccagcaagtttggcagccctgaggtggccgtggccggccaggtgctggagaacctgccccccatcggggtcttctgggacatcgagaactgcagcgtgcccagcggccgcagcgccacagctgtggtgcagaggatccgggagaagttcttcaagggccaccgggaggccgagttcatctgtgtgtgtgacatcagcaaggagaacaaggaggtgatccaggagctgaacaactgccaggtgacagtggcccacatcaatgccacagccaagaatgctgctgatgacaagctgcggcagagcctgcggagatttgccaacacccacacagccccagccaccgtggtgctggtgtccacagatgtgaactttgccctggagctgagtgacctgcggcacagacatggcttccacatcatcctggtgcacaagaaccaggccagcgaggccctgctgcaccacgccaatgagctgatccgctttgaggagttcatcagtgacctgcccccccggctgcccctgaagatgccccagtgccacaccctgctgtatgtgtacaacctgcctgccaacaaggatggcaagtctgtgagcaaccggctgcggcggctgagtgacaactgtggcggcaaggtgctgagcatcaccggctgcagcgccatcctgcgcttcatcaaccaggacagcgctgagcgggcccagaagaggatggagaatgaagatgtgtttggaaaccgcatcatcgtgtccttcacccccaagaaccgggagctgtgtgagaccaagagcagcaatgccatcgctgacaaggtgaagagccccaagaagctgaagaaccccaagctgtgcctgatcaaggatgccagcgagcagagcagcagcgccaaggccaccccaggcaagggcagccaggccaacagcggcagcgccaccaagaacaccaacgtgaagagcctgcaggagctgtgcaggatggagagcaagacaggccacaggaacagcgagcaccagcagggccacctgcggctggtggtgcccacccacggcaacagcagcgctgctgtgtccacccccaagaacagcggcgtggccgagcctgtgtacaagaccagccagaagaaggagaacctgagcgcccggtctgtgaccagcagccctgtggagaagaaggacaaggaggagaccgtcttccaggtgtcctaccccagcgccttcagcaagctggtggccagccggcaggtgagccccctgctggccagccagagctggagcagccgctccatgagccccaacctgctgaacagagccagccccctggccttcaacatcgccaacagcagcagcgaggccgactgcccagacccctttgccaacggggctgatgtgcaggtgagcaacatcgactaccgcctgagcaggaaggagctgcagcagctgctgcaggaggcctttgcccggcacggcaaggtgaagtctgtggagctgagcccccacacagactaccagctgaaggctgtggtgcagatggagaacctgcaggatgccatcggggctgtgaacagcctgcaccgctacaagattggcagcaagaagatcctggtgtccctggccaccggggccgccagcaagagcctgagcctgctgtctgctgagaccatgtctgtgctgcaggatgccccagcctgctgcctgcccctcttcaagttcacagacatctatgagaagaagtttggccacaagctgaatgtgtctgacctgtacaagctgacagacacagtggccatccgggagcagggcaatggccgcctggtgtgcctgctgcccagcagccaggcccggcagagccccctgggcagcagccagagccatgatggcagcagcaccaactgcagccccatcatctttgaggagctggagtaccacgagcctgtgtgccggcagcactgcagcaacaaggacttcagcgagcatgaatttgatcctgacagctacaagatccccttcgtcatcctgagcctgaagacctttgccccccaggtgcacagcctgctgcagacccatgagggcaccgtgcccctgctggacccctggctgctgcggagcaagagccctgtgggcaacccccagctgatccagttcagccgggaggtgattgacctgctgaagagccagcccagctgtgtgatccccatcagccacttcatccccagctaccaccaccactttgccaagcagtgccgggtgtctgactatggctacagcaagctgattgagctgctggaggccgtgccccacgtgctgcagatcctgggcatgggcagcaagaggctgctgaccctgacccaccgggcccaggtgaagcgcttcacccaggacctgctgaagctgctgaagagccaggccagcaagcaggtgattgtgcgggagttcagccaggcctaccactggtgcttcagcaaggactgggatgtgacagaatatggagtgtgtgagctgattgatattgtgtctgagatcccagacaccaccatctgcctgagccagcaggacaatgagatggtgatctgcatccccaagcgggagaggacccaggatgaaattgaaagaaccaagcagttcagcaaggatgtggtggacctgctgcggcaccagccccacttcaggatgcccttcaacaagttcatccccagctaccaccaccacttcggccggcagtgcaagctggcctactacggcttcaccaagctgctggagctgtttgaggccatcccagacaccctgcaggtgctggagtgtggggaggagaagatcctgaccctgacagaggtggagcgcttcaaggccctggccgcccagtttgtgaagctgctgcggagccagaaggacaactgcctgatgatgacagacctgctgacagaatatgccaagaccttcggctacaccttccggctgcaggactatgatgtgagcagcatcagcgccctgacccagaagctgtgccacgtggtgaaggtggccgacatcgagagcggccggcagatccagctgatcaacaggaagagcctgcggagcctgacagcccagctgctggtgctgctgatgtcctgggagggcaccacccacctgtctgtggaggagctgaagaggcactatgagagcacccacaacacccccctgaacccctgtgaatatggcttcatgaccctgacagagctgctgaagagcctgccctacctggtggaggtgttcaccaatgacaagatggaggagtgtgtgaagctgaccagcctgtacctgtttgccaagaatgtgcgcagcctgctgcacacctaccactaccagcagatcttcctgcacgagttctccatggcctacaccaagtatgtgggggagaccctgcagcccaagacctacggccacagctctgtggaggagctgctgggcgccatcccccaggtggtgtggatcaagggccacggccacaagagaattgtggtgctgaagaatgacatgaagagccggctgagcagcctgagcctgagccctgccaaccacgagaaccagcccagcgagggggagcgcatcctggaggtgcctgagagccacacagccagcgagctgaagctgggcgcagatggcagcggccccagccacacagagcaggagctgctgcggctgacagatgacagccctgtggacctgctgtgtgcccctgtgcccagctgcctgcccagcccccagctgcggccagaccccgtcatcctgcagagcgctgacctgatccagtttgaggagcggccccaggagcccagcgagatcatgatcctgaaccaggaggagaagatggagatccccatccctgggaagagcaagaccctgaccagtgacagcagcagcagctgcatctctgctgctgtgcctgtgcccccctgccccagcagcgagaccagcgagagcctgctgagcaaggaccctgtggagagccctgccaagaagcagcccaagaacagagtgaagctggccgccaacttcagcctggcccccatcaccaagctgtag

SEQ ID NO: 18985 - DNA, 735 bp, Artificial Sequence
  Description of Artificial Sequence: Synthetic coding sequence
gggggcggctatgacctgaacctgtttgccagccccccagacagcaactttgtgtgcagcgtgtgccacggcgtgctgaagaggcctgcccggctgccctgcagccacatcttctgcaagaagtgcatcctgcgctggctggcccggcagaagacctgcccctgctgcaggaaggaggtgaagaggaagaaggtggtgcacatgaacaagctgaggaagaccatcggccgcctggaggtgaagtgcaagaatgctgatgctggctgcatcgtgacctgccccctggcccacaggaagggccaccaggacagctgcccctttgagctgacagcctgccccaatgaaggctgcaccagccaggtgccccggggcaccctggccgagcaccggcagcactgccagcagggcagccagcagcgctgccccctgggctgtggggccaccctggaccctgctgagcgggcccggcacaactgctaccgggagctgcacaatgcctggagcgtgcggcaggagcggcggcggcccctgctgctgagcctgctgcggcgggtgcgctggctggaccaggccacctctgtggtgcggcgggagctggccgagctgagcaacttcctggaggaggacacagccctgctggagggcgccccccaggaggaggccgaggccgcccctgagggcaatgtgggcgctgaggtggtgggggagccccgggccaacatcccctgcaagtag

SEQ ID NO: 18986 - DNA, 705 bp, Artificial Sequence
  Description of Artificial Sequence: Synthetic coding sequence
ctgccctgcaagcgctgccggcccagcgtgtacagcctgagctacatcaagaggggcaagaccaggaactacctgtaccccatctggagcccctatgcctactacctgtactgctacaagtaccgcatcaccctgcgggagaagatgctgccccgctgctacaagagcatcacctacaaggaggaggaggacctgaccctgcagcccaggagctgcctgcagtgtgagagcctggtgggcctgcaggagggcaagagcacagagcagggcaaccacgaccagctgaaggagctgtacagcgctggcaacctgactgtgctggccacagaccccctgctgcaccaggaccctgtgcagctggacttccacttccggctgaccagccagaccagcgcccactggcacggcctgctgtgtgacagaagactcttcctggacatcccctaccaggccctggaccagggcaaccgggagagcctgacagccaccctggagtatgtggaggagaagaccaacgtggacagcgtgtttgtgaacttccagaatgacagaaatgacagaggagccctgctgcgggccttctcctacatgggctttgaggtggtgcggccagaccacccagccctgccccccctggacaacgtcatcttcatggtgtaccccctggagagagatgtgggccacctgcccagcgagcccccatag

SEQ ID NO: 18987 - DNA, 2403 bp, Artificial Sequence
  Description of Artificial Sequence: Synthetic coding sequence
atggctgctgctgcctctgtgacaggccgggtgacctgggccgccagccccatgaggagcctgggcctgggccgccgcctgagcctgcccggcccccggctggatgctgtgacagctgctgtgaaccccagcctgagtgaccacggcaatggcctgggccggggcacccggggcagcggctgcagcggcggcagcctggtggccgactggggcggcggcgctgctgctgctgctgctgtggccctggccctggccccagccctgagcaccatgaggcggggcagcagcgagagcgagctggccgcccgctgggaggccgaggccgtggccgccgccaaggctgctgccaaggccgaggccgaggccacagctgagaccgtggccgagcaggtgcgggtggatgctggagctgctggggagcctgagtgcaaggccggggaggagcagcccaaggtgctggccccagccccagcccagcccagcgctgctgaggagggcaacacccaggtgctgcagaggcccccacccaccctgccccccagcaagcccaagcctgtgcagggcctgtgcccccacggcaagccccgggacaagggccgcagctgcaagaggagcagcggccacggcagcggggagaatggcagccagaggcctgtgacagtggacagcagcaaggcccggaccagcctggatgccctgaagatcagcatccggcagctgaagtggaaggagttcccctttggaagaaggctgccctgtgacatctactggcacggcgtgtccttccatgacaatgacatcttcagcggccaggtgaacaagtttcctggcatgacagagatggtgaggaagatcaccctgagcagagctgtgaggaccatgcagaacctcttccctgaggagtacaacttctaccccaggtcctggatcctgcctgatgagttccagctgtttgtggcccaggtgcagatggtgaaggatgatgaccccagctggaagcccaccttcatcgtgaagccagatggcggctgccagggagatggcatctacctgatcaaggaccccagcgacatccggctggccggcaccctgcagagcaggcctgctgtggtgcaggagtacatctgcaagcccctgctgattgacaagctgaagtttgacatccggctgtatgtgctgctgaagagcctggaccccctggagatctacatcgccaaggatggcctgagccgcttctgcacagagccctaccaggagcccacccccaagaacctgcaccgcatcttcatgcacctgaccaactacagcctgaacatccacagcggcaacttcatccacagcgacagcgccagcacaggcagcaagaggaccttcagcagcatcctgtgccgcctgagcagcaagggcgtggacatcaagaaggtgtggagcgacatcatctctgtggtgatcaagacagtcatcgccctgaccccagagctgaaggtgttctaccagagcgacatccccaccggccggcccggccccacctgcttccagatcctgggctttgacatcctgctgatgaagaacctgaagcccatcctgctggaggtgaatgccaaccccagcatgagaattgagcacgagcacgagctgagccctggggtgtttgaaaatgtgcccagcctggtggatgaggaggtgaaggtggccgtcatccgggacaccctgcggctgatggaccccctgaagaagaagcgggagaaccagagccagcagctggagaagccctttgctgggaaggaggatgccctggatggagagctgaccagcgccccagactgcaatgccaaccctgaggcccacctgcccagcatctgcctgaagcaggtgttccccaagtatgccaagcagttcaactacctgcggctggtggacaggatggccaacctcttcatccgcttcctgggcatcaagggcaccatgaagctgggccccaccggcttccgcaccttcatccgcagctgcaagctgagcagcagcagcctgtccatggctgctgtggacatcctgtacatcgacatcacccggcgctggaacagcatgaccctggaccagagggacagcggcatgtgcctgcaggcctttgtggaggccttcttcttcctggcccagaggaagttcaagatgctgcccctgcacgagcaggtggccagcctgattgacctgtgtgagtaccacctgagcctgctggatgagaagaggctggtgtgtggccggggcgtgcccagcggcggccggcccccccaccggggccccccccaggagcccagccccagcgcccagcctgctggggacaaccccccacccaggaccagctgtgccaacaagctgagccaccccaggcacaccctgtcctag

SEQ ID NO: 18988 - DNA, 981 bp, Artificial Sequence
  Description of Artificial Sequence: Synthetic coding sequence
atgagggagtgcatcagcatccacgtgggccaggccggcgtgcagattggaaatgcctgctgggagctgtactgcctggagcacggcatccagccagatggccagatgcccagcgacaagaccatcggcggcggagatgacagcttcaacaccttcttcagcgagaccggggccggcaagcacgtgcccagggctgtgtttgtggacctggagcccaccgtgattgatgaggtgaggacaggcacctaccggcagctgttccaccctgagcagctgatcaccgggaaggaggatgctgccaacaactatgcccggggccactacaccatcggcaaggagatcatcgacctggtgctggaccgcatcaggaagctgaagagcttctttgccaccaagccccgcatccacttccccctggccacctacgcccctgtgatctctgctgagaaggcctaccacgagcagctgactgtggccgagatcaccaatgcctgctttgagcccgccaaccagatggtgaagtgtgaccccaggcatggcaagtacatggcctgctgcctgctgtacagaggagatgtggtgcccaaggatgtgaatgctgccatcgccaccatcaagaccaagaggaccatccagtttgtggactggtgccccaccggcttcaaggtgggcatcaactaccagcccccaacagtggtgcctggaggagacctggccaaggtgcagagagctgtgtgcatgctgagcaacaccacagctgtggccgaggcctgggcccggctggaccacaagtttgacctgatgcccctgcggcgcatcatgaggcggctggagcagatcgtgctgacagagaggatgagggtgaagagcatcaacctgtgtgctgtgctgctgcacagctttgtgctggagctgagctacttctgcagcgtgaatgtgtactgcaggaagctgctgatcaagctgaagttccccttctag

SEQ ID NO: 18989 - DNA, 1005 bp, Artificial Sequence
  Description of Artificial Sequence: Synthetic coding sequence
atggtgggccgggagaaggagctgagcatccactttgtgcccggcagctgccgcctggtggaggaggaggtgaacatccccaacagaagagtgctggtgactggagccaccggcctgctgggccgggctgtgcacaaggagttccagcagaacaactggcatgctgtgggctgcggcttcagaagagcccggcccaagtttgagcaggtgaacctgctggacagcaatgctgtgcaccacatcatccatgacttccagccccacgtgattgtgcactgtgccgctgagaggaggccagatgtggtggagaaccagccagatgctgccagccagctgaatgtggatgccagcggcaacctggccaaggaggccgctgctgtgggcgccttcctgatctacatcagcagtgactatgtgtttgatggcaccaaccccccctaccgggaggaggacatcccagcccccctgaacctgtatggcaagaccaagctggatggagagaaggctgtgctggagaacaacctgggcgctgctgtgctgcgcatccccatcctgtatggagaggtggagaagctggaggagagcgctgtgacagtgatgtttgacaaggtgcagttcagcaacaagagcgccaacatggaccactggcagcagcgcttccccacccacgtgaaggatgtggccaccgtgtgccggcagctggccgagaagaggatgctggaccccagcatcaagggcaccttccactggagcggaaatgagcagatgaccaagtatgagatggcctgtgccatcgcagatgccttcaacctgcccagcagccacctgcggcccatcacagacagccctgtgctgggcgcccagaggcccagaaatgcccagctggactgcagcaagctggagaccctgggcatcggccagaggacccccttcagaattggcatcaaggagagcctgtggcccttcctgattgacaagcgctggaggcagacagtgttccactag

SEQ ID NO: 18990 - DNA, 513 bp, Artificial Sequence
  Description of Artificial Sequence: Synthetic coding sequence
atggccagcgaggccgagaagaccttccacagatttgctgcctttggagagagcagcagcagcggcacagagatgaacaacaagaacttcagcaagctgtgcaaggactgtggcatcatggatggcaagacagtgaccagcacagatgtggacatcgtgttcagcaaggtgaaggccaagaatgcccggaccatcaccttccagcagttcaaggaggccgtgaaggagctgggccagaagcgcttcaagggcaagagcccagatgaggtgctggagaacatctacggcctgatggagggcaaggaccctgccaccaccggggccaccaaggccaccaccgtgggcgctgtggaccggctgacagacaccagcaagtacacaggcacccacaaggagagatttgatgaaagtggaaaaggaaaaggaattgctggccgggaggagatgacagacaacacaggctacgtgtctggctacaagggcagcggcacctatgacaagaagaccaagtag

SEQ ID NO: 18991 - DNA, 3582 bp, Artificial Sequence
  Description of Artificial Sequence: Synthetic coding sequence
atgtggagggtgaagaagctgagcctgagcctgagccccagcccccagacaggcaagcccagcatgaggacccccctgcgggagctgaccctgcagcccggggccctgaccaacagcggcaagaggagccctgcctgcagcagcctgacccccagcctgtgcaagctgggcctgcaggagggcagcaacaacagcagccctgtggactttgtgaacaacaagaggacagacctgagcagcgagcacttcagccacagcagcaagtggctggagacctgccagcatgaaagtgatgagcagcccctggaccccatcccccagatcagcagcacccccaagaccagcgaggaggccgtggaccccctgggcaactacatggtgaagaccatcgtgctggtgcccagccccctgggccagcagcaggacatgatctttgaggcccggctggacaccatggccgagaccaacagcatcagcctgaatggccccctgaggacagatgacctggtgcgggaggaggtggccccctgcatgggagaccgcttcagcgaggtggccgctgtgtctgagaagcccatcttccaggagagccccagccacctgctggaggagagcccccccaacccctgcagcgagcagctgcactgcagcaaggagagcctgagcagcaggacagaagctgtgcgggaggacctggtgcccagcgagagcaatgccttcctgcccagctctgtgctgtggctgagccccagcacagccctggccgctgacttccgggtgaaccacgtggaccctgaggaggagatcgtggagcacggggccatggaggagcgggagatgaggttccccacccaccccaaggagagcgagacagaggaccaggccctggtgtcctctgtggaggacatcctgagcacctgcctgacccccaacctggtggagatggagagccaggaggcccctggccctgctgtggaggatgtgggccgcatcctgggcagtgacacagagagctggatgagccccctggcctggctggagaagggcgtgaacacctctgtgatgctggagaacctgcggcagagcctgagcctgcccagcatgctgagagatgctgccatcggcaccacccccttcagcacctgcagcgtgggcacctggttcaccccatctgccccccaggagaagagcaccaacaccagccagacaggcctggtgggcaccaagcacagcaccagcgagacagagcagctgctgtgtggccggcccccagacctgacagccctgagcagacatgacctggaggacaacctgctgagcagcctggtgatcctggaggtgctgagccggcagctgcgggactggaagagccagctggccgtgccccaccctgagacccaggacagcagcacccagacagacaccagccacagcggcatcaccaacaagctgcagcacctgaaggagagccatgagatgggccaggccctgcagcaggccagaaatgtgatgcagagctgggtgctgatcagcaaggagctgatcagcctgctgcacctgagcctgctgcacctggaggaggacaagaccaccgtgtcccaggagagcagaagagctgagaccctggtgtgctgctgctttgacctgctgaagaagctgcgggccaagctgcagagcctgaaggccgagcgggaggaggcccggcaccgggaggagatggccctgcggggcaaggatgctgctgagatcgtgctggaggccttctgtgcccacgccagccagaggatcagccagctggagcaggacctggcctccatgagggagttccggggcctgctgaaggatgcccagacccagctggtgggcctgcacgccaagcaggaggagctggtgcagcagacagtgtccctgaccagcaccctgcagcaggactggaggtccatgcagctggactacaccacctggacagccctgctgagccgcagccggcagctgacagagaagctgactgtgaagagccagcaggccctgcaggagagagatgtggccatcgaggagaagcaggaggtgtcccgggtgctggagcaggtgtctgcccagctggaggagtgcaagggccagacagagcagctggagctggagaacagccggctggccacagacctgcgggcccagctgcagatcctggccaacatggacagccagctgaaggagctgcagagccagcacacccactgtgcccaggacctggccatgaaggatgagctgctgtgccagctgacccagagcaatgaggagcaggccgcccagtggcagaaggaggagatggccctgaagcacatgcaggccgagctgcagcagcagcaggccgtgctggccaaggaggtgcgggacctgaaggagaccctggagtttgctgaccaggagaaccaggtggcccacctggagctgggccaggtggagtgccagctgaagaccaccctggaggtgctgcgggagaggagcctgcagtgtgagaacctgaaggacacagtggagaacctgacagccaagctggccagcaccatcgctgacaaccaggagcaggacctggagaagacccggcagtacagccagaagctgggcctgctgacagagcagctgcagagcctgaccctcttcctgcagaccaagctgaaggagaagacagagcaggagaccctgctgctgagcacagcctgcccccccacccaggagcaccccctgcccaatgacaggaccttcctgggcagcatcctgacagctgtggctgatgaggagcctgagagcacccctgtgcccctgctgggcagtgacaagagcgccttcaccagggtggcctccatggtgtccctgcagcctgctgagaccccaggcatggaggagagcctggccgagatgagcatcatgaccacagagctgcagagcctgtgcagcctgctgcaggagagcaaggaggaggccatccgcaccctgcagaggaagatctgtgagctgcaggcccggctgcaggcccaggaggagcagcaccaggaggtgcagaaggccaaggaggccgacatcgagaagctgaaccaggccctgtgcctgcgctacaagaatgagaaggagctgcaggaggtgatccagcagcagaatgagaagatcctggagcagattgacaagagcggggagctgatcagcctgcgggaggaggtgacccacctgaccaggagcctgcggcgggcagagacagagaccaaggtgctgcaggaggccctggccggccagctggacagcaactgccagcccatggccaccaactggatccaggagaaggtgtggctgagccaggaggtggacaagctgcgggtgatgttcctggagatgaagaatgagaaggagaagctgatgatcaagttccagagccacaggaacatcctggaggagaacctgcggcggagtgacaaggagctggagaagctggatgacatcgtgcagcacatctacaagaccctgctgagcatccctgaggtggtgcggggctgcaaggagctgcagggcctgctggagttcctgtcctag

SEQ ID NO: 18992 - DNA, 9141 bp, Artificial Sequence
  Description of Artificial Sequence: Synthetic coding sequence
atgaggggccggcggggccggccccccaagcagcctgctgccccagctgctgagcgctgtgccccagcccctcctcctcctcctcctccacccaccagcggccccatcggcggcctgcggagccgccaccggggcagcagccggggccgctgggccgccgcccaggccgaggtggcccccaagacccggctgagcagcccccggggcggcagcagcagcaggaggaagcccccacctcctcctccagccccacccagcaccagcgcccctggccggggcggccggggcggcggcggcggccgcactggaggcggcggcggcggcggccacctggcccggaccacagctgcccggcgggctgtgaacaaggtggtgtatgatgaccatgaaagtgaggaggaggaggaggaggaggacatggtgtctgaggaggaggaggaggaggatggagatgctgaggagacccaggacagtgaagatgatgaagaagatgagatggaggaggatgatgatgacagcgactacccagaggagatggaggatgatgatgatgatgccagctactgcacagagagcagcttccgcagccacagcacctacagcagcaccccaggccgcaggaagccccgggtgcaccggcccaggagccccatcctggaggagaaggacatcccccccctggagttccccaagagcagcgaggacctgatggtgcccaatgagcacatcatgaatgtgattgccatctatgaggtgctgaggaactttggcaccgtgctgcggctgagccccttccgctttgaggacttctgtgccgccctggtgtcccaggagcagtgcaccctgatggccgagatgcacgtggtgctgctgaaggctgtgctgcgggaggaggacaccagcaacaccacctttggacctgctgacctgaaggacagcgtgaacagcaccctgtacttcattgatggcatgacctggccagaggtgctgcgggtgtactgtgagagtgacaaggagtaccaccacgtgctgccctaccaggaggccgaggactacccctacggccctgtggagaacaagatcaaggtgctgcagttcctggtggaccagttcctgaccaccaacatcgcccgggaggagctgatgtctgaaggagtcatccagtatgatgaccactgccgggtgtgccacaagctgggggacctgctgtgctgtgagacctgcagcgctgtgtaccacctggagtgtgtgaagccacccctggaggaggtgcctgaagatgagtggcagtgtgaggtgtgtgtggcccacaaggtgcctggggtgacagactgtgtggccgagatccagaagaacaagccctacatcagacatgagcccatcggctatgacaggagcaggaggaagtactggttcctgaacagaagactcatcatcgaggaggacacagaaaatgaaaatgagaagaagatctggtactacagcaccaaggtgcagctggccgagctgattgactgcctggacaaggactactgggaggccgagctgtgcaagatcctggaggagatgagggaggagatccaccgccacatggacatcacagaggacctgaccaacaaggcccggggcagcaacaagagcttcctggccgccgccaatgaggagatcctggagagcatccgggccaagaagggggacatcgacaacgtgaagagccctgaggagacagagaaggacaagaatgaaacagaaaatgacagcaaggatgctgagaagaaccgggaggagtttgaggaccagagcctggagaaggacagtgatgacaagaccccagatgatgatcctgagcagggcaagtctgaggagcccacagaggtgggggacaagggcaacagcgtgtctgccaacctgggggacaacaccaccaatgccaccagcgaggagaccagccccagcgagggccgcagccctgtgggctgcctgtctgagaccccagacagcagcaacatggccgagaagaaggtggccagcgagctgccccaggatgtgcctgaggagcccaacaagacctgtgagagcagcaacaccagcgccaccaccaccagcatccagcccaacctggagaacagcaacagcagcagcgagctgaacagcagccagagcgagagcgccaaggctgctgatgatcctgaaaatggagagcgggagagccacacccctgtgtccatccaggaggagatcgtgggggacttcaagtctgagaagagcaatggagagctgtctgagagccctggggccggcaagggggccagcggcagcacccgcatcatcacccggctgagaaatccagacagcaagctgagccagctgaagagccagcaggtggccgccgccgcccacgaggccaacaagctgttcaaggagggcaaggaggtgctggtggtgaacagccagggcgagatcagccggctgagcaccaagaaggaggtgatcatgaagggcaacatcaacaactacttcaagctgggccaggagggcaagtacagagtgtaccacaaccagtacagcaccaacagctttgccctgaacaagcaccagcacagagaagatcatgacaagaggaggcacctggcccacaagttctgcctgaccccagctggggagttcaagtggaatggatctgtgcacggcagcaaggtgctgaccatcagcaccctgcggctgaccatcacccagctggagaacaacatccccagcagcttcctgcaccccaactgggccagccaccgggccaactggatcaaggctgtgcagatgtgcagcaagccccgggagtttgccctggccctggccatcctggagtgtgctgtgaagcctgtggtgatgctgcccatctggagggagagcctgggccacacccggctgcacaggatgaccagcattgagcgggaggagaaggagaaggtgaagaagaaggagaagaagcaggaggaggaggagaccatgcagcaggccacctgggtgaagtacaccttccctgtgaagcaccaggtgtggaagcagaagggggaggagtacagagtgacaggctatggaggctggagctggatcagcaagacccacgtgtacagatttgtgcccaagctgcccggcaacaccaacgtgaactacaggaagagcctggagggcaccaagaacaacatggatgagaacatggatgaaagtgacaagaggaagtgcagccgcagccccaagaagatcaagattgaaccagattctgagaaggatgaggtgaagggcagtgatgctgccaagggagctgaccagaatgagatggacatcagcaagatcacagagaagaaggaccaggatgtgaaggagctgctggacagcgacagcgacaagccctgcaaggaggagcccatggaggtggatgatgacatgaagacagagagccacgtgaactgccaggagagcagccaggtggatgtggtgaatgtgtctgagggcttccacctgcggaccagctacaagaagaagaccaagagcagcaagctggatggcctgctggagcggcgcatcaagcagttcaccctggaggagaagcagaggctggagaagatcaagctggagggcggcatcaagggcatcggcaagaccagcaccaacagcagcaagaacctgtctgagagccctgtgatcaccaaggccaaggagggctgccagagcgacagcatgaggcaggagcagagccccaatgccaacaatgaccagcctgaggacctgatccagggctgcagcgagagtgacagctctgtgctgaggatgtctgaccccagccacaccaccaacaagctgtaccccaaggacagagtgctggatgatgtgtccatccgcagccctgagaccaagtgccccaagcagaacagcattgaaaatgacatcgaggagaaggtgtctgacctggccagccggggccaggagcccagcaagagcaagaccaagggaaatgacttcttcattgatgacagcaagctggccagcgcagatgacatcggcaccctcatctgcaagaacaagaagcccctcatccaggaggagagtgacaccatcgtgagcagcagcaagagcgccctgcacagctctgtgcccaagagcaccaatgacagagatgccacccccctgagccgggccatggactttgagggcaagctgggctgtgacagcgagagcaacagcaccctggagaacagcagtgacacagtgtccatccaggacagcagcgaggaggacatgattgtgcagaacagcaatgaaagcatcagcgagcagttccgcacccgggagcaggatgtggaggtgctggagcccctgaagtgtgagctggtgtctggagagagcacaggcaactgtgaggaccggctgcctgtgaagggcacagaggccaacgggaagaagcccagccagcagaagaagctggaggagaggcctgtgaacaagtgcagcgaccagatcaagctgaagaacaccacagacaagaagaacaatgaaaatcgggagagcgagaagaagggccagaggaccagcaccttccagatcaacgggaaggacaacaagcccaagatctacctgaagggagaatgtctgaaggagatcagcgagagccgggtggtgtctggaaatgtggagcccaaggtgaacaacatcaacaagatcatcccagaaaatgacatcaagagcctgactgtgaaggagagcgccatccggcccttcatcaatggagatgtgatcatggaggacttcaatgaaagaaacagcagcgagaccaagagccacctgctgagcagcagtgatgctgagggcaactacagagacagcctggagaccctgcccagcaccaaggagagtgacagcacccagaccaccaccccatctgccagctgcccagagagcaacagcgtgaaccaggtggaggacatggagattgagaccagcgaggtgaagaaggtgaccagcagccccatcaccagcgaggaggagagcaacctgagcaatgacttcattgatgaaaatggcctgcccatcaacaagaatgaaaatgtgaatggagagagcaagaggaagacagtcatcacagaggtgaccaccatgaccagcacagtggccacagagagcaagacagtcatcaaggtggagaagggggacaagcagacagtggtgagcagcacagagaactgtgccaagagcacagtgaccaccaccaccaccaccgtgaccaagctgagcacccccagcactggaggctctgtggacatcatctctgtgaaggagcagagcaagacagtggtgaccaccaccgtgacagacagcctgaccaccaccggcggcaccctggtgacctccatgacagtgtccaaggagtacagcacccgggacaaggtgaagctgatgaagttcagccggcccaagaagaccaggtctggaacagccctgcccagctacaggaagtttgtgaccaagagcagcaagaagagcatctttgtgctgcccaatgatgacctgaagaagctggccaggaagggcggcatccgggaggtgccctacttcaactacaatgccaagccagccctggacatctggccctaccccagcccccggcccaccttcggcatcacctggagataccgcctgcagacagtgaagagcctggccggcgtgtccctgatgctgcggctgctgtgggccagcctgcgctgggatgacatggccgccaaggcccctcctgggggcggcaccaccaggacagagaccagcgagacagagatcaccaccacagagatcatcaagagaagagatgtgggcccctacggcatccgctctgagtactgcatcaggaagatcatctgccccatcggcgtgcctgagacccccaaggagacccccaccccccagaggaagggcctgcggagcagcgccctgcggcccaagaggcctgagacccccaagcagacaggccctgtgatcatcgagacctgggtggccgaggaggagctggagctgtgggagatccgggcctttgctgagcgggtggagaaggagaaggcccaggccgtggagcagcaggccaagaagaggctggagcagcagaagcccaccgtcatcgccaccagcaccaccagccccaccagcagcaccaccagcaccatcagccctgcccagaaggtgatggtggcccccatcagcggctctgtgaccaccggcaccaagatggtgctgaccaccaaggtgggcagccctgccaccgtgaccttccagcagaacaagaacttccaccagacctttgccacctgggtgaagcagggccagagcaacagcggcgtggtgcaggtgcagcagaaggtgctgggcatcatccccagcagcacaggcaccagccagcagaccttcaccagcttccagcccaggacagccaccgtgaccatccggcccaacaccagcggcagcggcggcaccaccagcaacagccaggtgatcaccggcccccagatccggcccggcatgaccgtcatccgcacccccctgcagcagagcaccctgggcaaggccatcatccgcacccctgtgatggtgcagcccggggccccccagcaggtgatgacccagatcatccggggccagcctgtgtccacagctgtgtctgcccccaacacagtgagcagcaccccaggccagaagagcctgaccagcgccaccagcaccagcaacatccagagcagcgccagccagcccccccggccccagcagggccaggtgaagctgaccatggcccagctgacccagctgacccagggccatggaggcaaccagggcctgactgtggtgatccagggccagggccagaccaccggccagctgcagctgatcccccagggcgtgacagtgctgcccggccctggccagcagctgatgcaggccgccatgcccaatggaacagtgcagcgcttcctgttcacccccctggccaccacagccaccacagccagcaccaccaccaccaccgtgtccaccacagctgctggcactggagagcagaggcagagcaagctgagcccccagatgcaggtgcaccaggacaagaccctgcccccagcccagagcagctctgtgggccctgctgaggcccagccccagacagcccagcccagcgcccagccccagccccagacccagccccagagccctgcccagcctgaggtgcagacccagcctgaggtgcagacccagaccaccgtgagcagccacgtgcccagcgaggcccagcccacccacgcccagagcagcaagccccaggtggccgcccagagccagccccagagcaatgtgcagggccagagccctgtgcgggtgcagagccccagccagacccgcatccggcccagcacccccagccagctgagccctggccagcagagccaggtgcagaccaccaccagccagcccatccccatccagccccacaccagcctgcagatccccagccagggccagccccagagccagccccaggtgcagagcagcacccagaccctgagcagcggccagaccctgaaccaggtgacagtgagcagccccagccggccccagctgcagatccagcagccccagccccaggtgattgctgtgccccagctgcagcagcaggtgcaggtgctgagccagatccagagccaggtggtggcccagatccaggcccagcagagcggcgtgccccagcagatcaagctgcagctgcccatccagatccagcagagcagcgctgtgcagacccaccagatccagaatgtggtgacagtgcaggccgcctctgtgcaggagcagctgcagagggtgcagcagctgcgggaccagcagcagaagaagaagcagcagcagatcgagatcaagcgggagcacaccctgcaggccagcaaccagagcgagatcatccagaagcaggtggtgatgaagcacaatgctgtgattgagcacctgaagcagaagaagtccatgaccccagctgagcgggaggagaaccagaggatgattgtgtgcaaccaggtgatgaagtacatcctggacaagattgacaaggaggagaagcaggccgccaagaagaggaagcgggaggagagcgtggagcagaagaggagcaagcagaatgccaccaagctgagcgccctgctcttcaagcacaaggagcagctgcgggcagagatcctgaagaagagggccctgctggacaaggacctgcagatcgaggtgcaggaggagctgaagagggacctgaagatcaagaaggagaaggacctgatgcagctggcccaggccacagctgtggccgccccctgcccccctgtgaccccagcccccccagcccccccagcccccccacccagccccccacctcctcctgctgtgcagcacacaggcctgctgagcacccccaccctgcctgctgccagccagaagaggaagcgggaggaggagaaggacagcagcagcaagagcaagaagaagaagatgatcagcaccaccagcaaggagaccaagaaggacaccaagctgtactgcatctgcaagaccccctatgatgagagcaagttctacatcggctgtgaccgctgccagaactggtaccacggccgctgtgtgggcatcctgcagagcgaggccgagctgattgatgaatatgtgtgcccccagtgccagagcacagaagatgccatgacagtgctgacccccctgacagagaaggactatgagggcctgaagagggtgctgcggagcctgcaggcccacaagatggcctggcccttcctggagcctgtggaccccaatgatgccccagactactatggagtcatcaaggagcccatggacctggccaccatggaggagcgggtgcagaggcgctactatgagaagctgacagaatttgtggccgacatgaccaagatctttgacaactgccgctactacaaccccagcgacagccccttctaccagtgtgccgaggtgctggagagcttctttgtgcagaagctgaagggcttcaaggccagccgcagccacaacaacaagctgcagagcacagccagctag

SEQ ID NO: 18993 - DNA, 927 bp, Artificial Sequence
  Description of Artificial Sequence: Synthetic coding sequence
atggccagcagcaacacagtgctgatgaggctggtggccagcgcctacagcatcgcccagaaggccggcatgattgtgagaagagtgattgctgagggggacctgggcatcgtggagaagacctgtgccacagacctgcagaccaaggctgaccggctggcccagatgagcatctgcagcagcctggccaggaagttccccaagctgaccatcatcggggaggaggacctgcccagcgaggaggtggaccaggagctgattgaggacagccagtgggaggagatcctgaagcagccctgccccagccagtacagcgccatcaaggaggaggacctggtggtgtgggtggaccccctggatggcaccaaggagtacacagagggcctgctggacaacgtgacagtgctgattggaattgcctatgagggcaaggccatcgccggggtcatcaaccagccctactacaactatgaagctggcccagatgctgtgctgggccgcaccatctggggcgtgctgggcctgggcgccttcggcttccagctgaaggaggtgcctgctgggaagcacatcatcaccaccaccaggagccacagcaacaagctggtgacagactgtgtggccgccatgaacccagatgctgtgctgcgggtgggcggggccggcaacaagatcatccagctgattgagggcaaggccagcgcctacgtgtttgccagccctggctgcaagaagtgggacacctgtgcccctgaggtgatcctgcatgctgtgggcggcaagctgacagacatccacggcaatgtgctgcagtaccacaaggatgtgaagcacatgaacagcgctggggtgctggccaccctgagaaattatgactactatgccagccgggtgcctgagagcatcaagaatgccctggtgccctag

SEQ ID NO: 18994 - DNA, 1212 bp, Artificial Sequence
  Description of Artificial Sequence: Synthetic coding sequence
atgagcggcagtgatggcggcctggaggaggagcctgagctgagcatcaccctgaccctgaggatgctgatgcacggcaaggaggtgggcagcatcatcggcaagaagggggagaccgtgaagaggatccgggagcagagcagcgcccgcatcaccatcagcgagggcagctgcccagagcgcatcaccaccatcaccggcagcacagctgctgtgttccacgctgtgtccatgattgccttcaagctggatgaggacctgtgtgccgccccagccaatggaggaaatgtgtcccggccccctgtgaccctgcggctggtgatcccagccagccagtgtggcagcctgattggcaaggccggcaccaagatcaaggagatccgggagaccactggagcccaggtgcaggtggccggggacctgctgcccaacagcacagaaagagctgtgacagtgtctggagtgcctgatgccatcatcctgtgtgtgcggcagatctgtgccgtcatcctggagagcccccccaagggggccaccatcccctaccaccccagcctgagcctgggcaccgtgctgctgagcgccaaccagggcttctctgtgcagggccagtatggagctgtgaccccagctgaggtgaccaagctgcagcagctgagcagccatgctgtgccctttgccacccccagcgtggtgcccggcctggaccccggcacccagaccagcagccaggagttcctggtgcccaatgacctgattggctgtgtgattggccggcagggcagcaagatcagcgagatccggcagatgtctggggcccacatcaagattggcaaccaggccgagggcgctggggagcggcacgtgaccatcaccggcagccctgtgtccatcgccctggcccagtacctgatcacagcctgcctggagacagccaagagcaccagcggcggcacccccagcagcgccccagctgacctgcctgcccccttcagcccccccctgacagccctgcccacagcccctcctggcctgctgggcaccccctatgccatcagcctgagcaacttcatcggcctgaagcccatgcccttcctggccctgcccccagccagccctggccccccacctggcctggccgcctacacagccaagatggccgccgccaacggcagcaagaaggccgagcggcagaagttcagcccctactag

SEQ ID NO: 18995 - DNA, 654 bp, Artificial Sequence
  Description of Artificial Sequence: Synthetic coding sequence
atgagcagcaaggtgtcccgggacaccctgtatgaagctgtgcgggaggtgctgcacggcaaccagaggaagaggaggaagttcctggagaccgtggagctgcagatcagcctgaagaactatgacccccagaaggacaagcgcttcagcggcaccgtgcggctgaagagcaccccccggcccaagttctctgtgtgtgtgctgggggaccagcagcactgtgatgaggccaaggctgtggacatcccccacatggacatcgaggccctgaagaagctgaacaagaacaagaagctggtgaagaagctggccaagaagtatgatgccttcctggccagcgagagcctcatcaagcagatcccccgcatcctgggccctggcctgaacaaggccggcaagttccccagcctgctgacccacaatgaaaacatggtggccaaggtggatgaggtgaagagcaccatcaagttccagatgaagaaggtgctgtgcctggccgtggccgtgggccacgtgaagatgacagatgatgagctggtgtacaacatccacctggccgtgaacttcctggtgtccctgctgaagaagaactggcagaatgtgcgggccctgtacatcaagagcaccatgggcaagccccagaggctgtactag

SEQ ID NO: 18996 - DNA, 3159 bp, Artificial Sequence
  Description of Artificial Sequence: Synthetic coding sequence
atggagggcagcgagcctgtggccgcccaccagggcgaggaggccagctgcagctcctggggcaccggcagcaccaacaagaacctgcccatcatgagcacagcctctgtggagattgatgatgccctgtacagccggcagagatatgtgctgggggacacagccatgcagaagatggccaagagccacgtgttcctgagcggcatgggcggcctgggcctggagatcgccaagaacctggtgctggccggcatcaaggctgtgaccatccatgacacagagaagtgccaggcctgggacctgggcaccaacttcttcctgtctgaagatgatgtggtgaacaagaggaacagagctgaggccgtgctgaagcacatcgccgagctgaacccctacgtgcacgtgaccagcagctctgtgcccttcaatgagaccacagacctgtccttcctggacaagtaccagtgtgtggtgctgacagagatgaagctgcccctgcagaagaagatcaatgacttctgccgcagccagtgcccccccatcaagttcatctctgcagatgtgcacggcatctggagccgcctcttctgtgactttggagatgaatttgaggtgctggacaccactggagaggagcccaaggagatcttcatcagcaacatcacccaggccaaccctggcatcgtgacctgcctggagaaccacccccacaagctggagaccggccagttcctgaccttccgggagatcaatggcatgacaggcctgaatggcagcatccagcagatcaccgtcatcagccccttctccttcagcattggagacaccacagagctggagccctacctgcacggcggcattgctgtgcaggtgaagacccccaagacagtgttctttgagagcctggagcggcagctgaagcaccccaagtgcctgattgtggacttcagcaaccctgaggcccccctggagatccacacagccatgctggccctggaccagttccaggagaagtacagcaggaagcccaacgtgggctgccagcaggacagcgaggagctgctgaagctggccaccagcatcagcgagaccctggaggagaagccagatgtgaatgctgacatcgtgcactggctgtcctggacagcccagggcttcctgagccccctggccgctgctgtgggcggcgtggccagccaggaggtgctgaaggctgtgacaggcaagttcagccccctgtgccagtggctgtacctggaggccgctgacatcgtggagagcctgggcaagccagaatgtgaggagttcctgcccaggggggacagatatgatgccctgcgggcctgcatcggggacaccctgtgccagaagctgcagaacctgaacatcttcctggtgggctgtggggccatcggctgtgagatgctgaagaactttgccctgctgggcgtgggcaccagcaaggagaagggcatgatcaccgtgacagatcctgacctgattgagaagagcaacctgaaccggcagttcctgttccggccccaccacatccagaagcccaagagctacacagctgctgatgccaccctgaagatcaacagccagatcaagattgatgcccacctgaacaaggtgtgccccaccacagagaccatctacaatgatgagttctacaccaagcaggacgtcatcatcacagccctggacaacgtggaggcccggcgctacgtggacagccgctgcctggccaacctgcggcccctgctggacagcggcaccatgggcaccaagggccacacagaggtgattgtgccccacctgacagagagctacaacagccaccgggaccccccagaggaggagatccccttctgcaccctgaagagcttccctgctgccatcgagcacaccatccagtgggcccgggacaagtttgagagcagcttcagccacaagcccagcctcttcaacaagttctggcagacctacagcagcgctgaggaggtgctgcagaagatccagagcggccacagcctggagggctgcttccaggtgatcaagctgctgagcagaagacccaggaactggagccagtgtgtggagctggcccggctgaagtttgagaagtacttcaaccacaaggccctgcagctgctgcactgcttccccctggacatccggctgaaggatggcagcctcttctggcagagccccaagaggcctcccagccccatcaagtttgacctgaatgagcccctgcacctgtccttcctgcagaatgctgccaagctgtatgccaccgtgtactgcatcccctttgctgaggaggacctgtctgcagatgccctgctgaacatcctgtctgaggtgaagatccaggagttcaagcccagcaacaaggtggtgcagacagatgaaacagccaggaagccagaccacgtgcccatcagcagtgaagatgaaagaaatgccatcttccagctggagaaggccatcctgagcaatgaggccaccaagagtgacctgcagatggctgtgctgagctttgagaaggatgatgaccacaacggccacatcgacttcatcacagctgccagcaacctgcgggccaagatgtacagcattgagcctgctgaccgcttcaagaccaagagaattgctgggaagatcatcccagccatcgccaccaccacagccaccgtgtctggcctggtggccctggagatgatcaaggtgactggaggctacccctttgaggcctacaagaactgcttcctgaacctggccatccccatcgtggtgttcacagagaccacagaggtgaggaagaccaagatcagaaatggcatctccttcaccatctgggaccgctggacagtgcacggcaaggaggacttcaccctgctggacttcatcaatgctgtgaaggagaagtatggaattgagcccaccatggtggtgcagggcgtgaagatgctgtatgtgcctgtgatgcctggccacgccaagaggctgaagctgaccatgcacaagctggtgaagcccaccacagagaagaagtatgtggacctgactgtgtcctttgccccagacattgatggagatgaggacctgcccggcccccctgtgcgctactacttcagccatgacacagactag

SEQ ID NO: 18997 - DNA, 1134 bp, Artificial Sequence
  Description of Artificial Sequence: Synthetic coding sequence
atgctgcggctggtgcccactggagcccgggccatcgtggacatgtcctatgcccggcacttcctggacttccagggcagcgccatcccccaggccatgcagaagctggtggtgacccggctgagccccaacttccgggaggccgtgaccctgagccgggactgccctgtgcccctgcctggagatggagacctgctggtgaggaacagatttgtgggcgtgaatgccagtgacatcaactacagcgctggccgctatgaccccagcgtgaagcccccatttgacatcggctttgagggcattggagaggtggtggccctgggcctgagcgccagcgcccgctacacagtgggccaggccgtggcctacatggcccctggcagctttgctgagtacacagtggtgcctgccagcatcgccacccctgtgcccagcgtgaagccagagtacctgaccctgctggtgtctggcaccacagcctacatcagcctgaaggagctgggcggcctgtctgagggcaagaaggtgctggtgacagctgctgctgggggcaccggccagtttgccatgcagctgagcaagaaggccaagtgccacgtgattggcacctgcagcagtgatgagaagagcgccttcctgaagagcctgggctgtgaccggcccatcaactacaagacagagcctgtgggcaccgtgctgaagcaggagtacccagagggcgtggatgtggtgtatgaatctgtgggcggggccatgtttgacctggccgtggatgccctggccaccaagggccgcctgattgtgattggcttcatcagcggctaccagacccccaccggcctgagccctgtgaaggccggcaccctgcctgccaagctgctgaagaagagcgcctctgtgcagggcttcttcctgaaccactacctgagcaagtaccaggccgccatgagccacctgctggagatgtgtgtgtctggggacctggtgtgtgaggtggacctgggggacctgagccctgagggccgcttcaccggcctggagagcatcttccgggctgtgaactacatgtacatgggcaagaacacaggcaagatcgtggtggagctgccccacagcgtgaacagcaagctgtag

SEQ ID NO: 18998 - DNA, 2538 bp, Artificial Sequence
  Description of Artificial Sequence: Synthetic coding sequence
atgagcaacagccggcccaggagcagaagagatgctgggggcggggccggggctgctggaagagatgagctggtgagccgcagcctgcagagcgctgagcactgcctgggcgtgcaggactttggaacagcctatgcccactacctgctggtgctgagcctggcccctgagctgaagcatgatgtgaaggagaccttccagtacaccctcttccgctgggccgaggagctggatgccctgagccgcatccaggacctgctgggctgctatgagcaggccctggagctgttcccagatgatgaggtgatctgcaacagcatgggagagcacctgttcaggatgggcttcagagatgaggccgccggctacttccacaaggctgtgaagctgaacccagacttcagtgatgccaaggagaacttctacagagtggccaactggctggtggagcgctggcacttcatcatgctgaatgacaccaagaggaacaccatctacaatgctgccatccagaaggctgtgtgcctgggcagcaagtctgtgctggacatcggggccggcaccggcatcctgtccatgtttgccaagaaggccggggcccacagcgtgtatgcctgtgagctgagcaagaccatgtatgagctggcctgtgatgtggtggccgccaacaagatggaggccggcatcaagctgctgcacaccaagagcctggacatcgagatccccaagcacatccctgagcgggtgtccctggtggtgacagagaccgtggatgctggcctgtttggagagggcatcgtggagagcctcatccacgcctgggagcacctgctgctgcagcccaagaccaagggggagagcgccaactgtgagaagtatggcaaggtgatcccagccagcgctgtgatcttcggcatggctgtggagtgtgccgagatccgccgccaccaccgggtgggcatcaaggacattgctggcatccacctgcccaccaacgtgaagttccagagccctgcctacagctctgtggacacagaggagaccatcgagccctacaccacagagaagatgagccgggtgcctgggggctacctggccctgacagaatgttttgagatcatgacagtggacttcaacaacctgcaggagctgaagagcctggccaccaagaagccagacaagattggcatccctgtgatcaaggagggcatcctggatgccatcatggtgtggtttgtgctgcagctggatgatgagcacagcctgagcaccagccccagcgaggagacctgctgggagcaggccgtgtaccctgtgcaggacctggccgactactggatcaagccaggggaccacgtgatgatggaggtgtcctgccaggactgctacctgcgcatccagagcatctctgtgctgggcctggagtgtgagatggatgtggccaagagcttcacccagaacaaggacctgctgagcctgggcaatgaagctgagctgtgcagcgccctggccaacctgcagaccagcaagccagatgctgtggagcagacctgcatcctggagagcacagaaattgccctgctgaacaacatcccctaccacgagggcttcaagatggccatgagcaaggtgctgagcagcctgaccccagagaagctgtaccagaccatggacacccactgccagaatgagatgagcagcggcaccggccagagcaacacagtgcagaacatcctggagcccttctacgtgctggatgtgtctgagggcttctctgtgctgcctgtgattgctggcaccctgggccaggtgaagccctacagctctgtggagaaggaccagcacagaattgccctggacctgatcagcgaggccaaccacttccccaaggagaccctggagttctggctgcggcacgtggaggatgagagcgccatgctgcagaggcccaagagtgacaagctgtggagcatcatcatcctggatgtgattgagcccagcggcctcatccagcaggagatcatggagaaggccgccatcagccgctgcctgctgcagagcggcggcaagatcttcccccagtatgtgctgatgtttggcctgctggtggagagccagaccctgctggaggagaatgctgtgcagggcacagagaggaccctgggcctgaacatcgcccccttcatcaaccagttccaggtgcccatccgggtcttcctggacctgagcagcctgccctgcatccccctgagcaagcctgtggagctgctgcggctggacctgatgaccccctacctgaacaccagcaaccgggaggtgaaggtgtatgtgtgcaagagcggccgcctgacagccatccccttctggtaccacatgtacctggatgaggagatccggctggacaccagcagcgaggccagccactggaagcaggccgctgtggtgctggacaaccccatccaggtggagatgggagaggagctggtgctgagcatccagcaccacaagagcaatgtgtccatcaccgtgaagcagtag

SEQ ID NO: 18999 - DNA, 756 bp, Artificial Sequence
  Description of Artificial Sequence: Synthetic coding sequence
atggctgacctgacctctgtgctgacctctgtgatgttcagccccagcagcaagatgtttattggaggcctgtcctggcagaccagcccagacagcctgcgggactacttcagcaagtttggagagatccgggagtgcatggtgatgagggaccccaccaccaagaggagccggggcttcggctttgtgacctttgctgaccctgcctctgtggacaaggtgctgggccagccccaccacgagctggacagcaagaccatcgaccccaaggtggccttcccccggcgggcccagcccaagatggtgaccaggaccaagaagatctttgtgggcggcctgagcgccaacacagtggtggaggatgtgaagcagtactttgagcagtttgggaaggtggaggatgccatgctgatgtttgacaagaccaccaacagacaccggggctttggatttgtgacctttgaaaatgaagatgtggtggagaaggtgtgtgagatccacttccacgagatcaacaacaagatggtggagtgcaagaaggcccagcccaaggaggtgatgtttcctcctggcacccggggccgggcccggggcctgccctacaccatggatgccttcatgctgggcatgggcatgctgggctaccccaactttgtggccacctacggccggggctacccaggctttgcccccagctatggctaccagttcccagactacctgcctgtgtcccaggacatcatcttcatcaactag

SEQ ID NO: 19000 - DNA, 510 bp, Artificial Sequence
  Description of Artificial Sequence: Synthetic coding sequence
atggcccccaagagggccaagagaagaacagtggagggcggcagcagctctgtgttctccatgtttgaccagacccagatccaggagttcaaggaggccttcaccgtgattgaccagaacagagatggcatcatcgacaaggaggacctgcgggacacctttgctgccatgggccgcctgaatgtgaagaatgaggagctggatgccatgatgaaggaggccagcggccccatcaacttcaccgtcttcctgaccatgtttggagagaagctgaagggagctgaccctgaagatgtgatcactggagccttcaaggtgctggaccctgagggcaagggcaccatcaagaagaagttcctggaggagctgctgaccacccagtgtgaccgcttcagccaggaggagatcaagaacatgtgggccgccttccccccagatgtgggcggcaatgtggactacaagaacatctgctacgtgatcacccatggagatgccaaggaccaggagtag

SEQ ID NO: 19001 - DNA, 546 bp, Artificial Sequence
  Description of Artificial Sequence: Synthetic coding sequence
atggccacagagcctgaggccgctgagcctgtggtgcccagcctggtggaccgctacttcacccgctggtacaagccagatgtgaagggcaagttctgtgaggaccactgcatcctgcagcacagcaaccgcatctgtgtgatcaccctggccgagagccaccctgtgctgcagagcggcaagaccatcaagagcatctcctaccagatcagcaccaactgcagccggctgcagaacaaggtgtctgggaagttcaagagaggagcccagttcctgacagagctggcccccctgtgcaagatctactgcagtgatggagaggagtacacagtgagcagctgtgtgcggggccgcctgatggaggtgaatgaaaacatcctgcacaagcccagcatcctgcaggagaagcccagcacagagggctacatcgctgtggtgctgcccaagtttgaggagagcaagagcatcacagagggcctgctgacccagaagcagtatgaggaggtgatggtgaagaggatcaatgccaccacagccaccagctag

SEQ ID NO: 19002 - DNA, 2154 bp, Artificial Sequence
  Description of Artificial Sequence: Synthetic coding sequence
atggagctgcgctgtggcggcctgctcttcagcagcagatttgacagcggcaacctggcccacgtggagaaggtggagagcctgagcagtgatggagagggcgtgggcggcggggccagcgccctgaccagcggcatcgccagcagcccagactatgagttcaacgtgtggaccaggccagactgtgccgagacagaatttgaaaatggaaacagatcctggttctacttctctgtgcggggcggcatgcctgggaagctgatcaagatcaacatcatgaacatgaacaagcagagcaagctgtacagccagggcatggccccctttgtgaggaccctgcccacccggccccgctgggagcgcatccgggaccggcccacctttgagatgacagagacccagtttgtgctgagctttgtgcacagatttgtggagggccgcggggccaccaccttctttgccttctgctaccccttctcctacagcgactgccaggagctgctgaaccagctggaccagcgcttccctgagaaccaccccacccacagcagccccctggacaccatctactaccaccgggagctgctgtgctacagcctggatggcctgcgggtggacctgctgaccatcaccagctgccacggcctgcgggaggaccgggagccccggctggagcagctgttcccagacaccagcaccccccggcccttccgctttgctgggaagaggatcttcttcctgagcagccgggtgcaccctggagagacccccagcagctttgtgttcaacggcttcctggacttcatcctgcggccagatgacccccgggcccagaccctgcggcggctgtttgtgttcaagctgatccccatgctgaacccagatggagtggtgcggggccactacagaacagacagccggggcgtgaacctgaaccggcagtacctgaagccagatgctgtgctgcacccagccatctatggagccaaggctgtgctgctgtaccaccacgtgcacagccggctgaacagccagagcagcagcgagcaccagcccagcagctgcctgcccccagatgcccctgtgtctgacctggagaaggccaacaacctgcagaatgaggcccagtgtggccacagcgctgacagacacaatgctgaggcctggaagcagacagagcctgctgagcagaagctgaacagcgtgtggatcatgccccagcagagcgctggcctggaggagagcgccccagacaccatcccccccaaggagagcggcgtggcctactacgtggacctgcacggccacgccagcaagaggggctgcttcatgtatggcaacagcttcagtgatgagagcacccaggtggagaacatgctgtaccccaagctgatcagcctgaacagcgcccactttgacttccagggctgcaacttcagcgagaagaacatgtatgcccgggacagaagagatggccagagcaaggagggcagcggccgggtggccatctacaaggccagcggcatcatccacagctacaccctggagtgcaactacaacacaggccgctctgtgaacagcatcccagctgcctgccacgacaatggccgggccagccccccacctcctccagccttccccagccgctacacagtggagctgtttgagcaggtgggccgggccatggccatcgccgccctggacatggccgagtgcaacccctggccccgcatcgtgctgtctgagcacagcagcctgaccaacctgcgggcctggatgctgaagcacgtgaggaacagccggggcctgagcagcaccctgaatgtgggcgtgaacaagaagaggggcctgcggaccccacccaagagccacaacggcctgcctgtgtcctgcagcgagaacaccctgagccgggcccgctccttcagcacaggcaccagcgctgggggcagcagcagcagccagcagaacagcccccagatgaagaacagccccagcttccccttccacggcagcaggcctgctggcctgcccggcctgggcagcagcacccagaaggtgacccaccgggtgctgggccctgtgcggggcaagcctgtgtgggagcccctgcagcacgtgtttggctgcctgggccactgctggggcaagtag

SEQ ID NO: 19003 - DNA, 678 bp, Artificial Sequence
  Description of Artificial Sequence: Synthetic coding sequence
atggtgatggccgagggcacagctgtgctgcggaggaacagacctggcaccaaggcccaggacttctacaactggccagatgagagctttgatgagatggacagcaccctggccgtgcagcagtacatccagcagaacatccgggctgactgcagcaacatcgacaagatcctggagcccccagagggccaggatgaaggagtgtggaagtatgagcacctgcggcagttctgcctggagctgaatggcctggccgtgaagctgcagagcgagtgccacccagacacctgcacccagatgacagccacagagcagtggatcttcctgtgtgccgcccacaagacccccaaggagtgcccagccatcgactacaccaggcacaccctggatggagctgcctgcctgctgaacagcaacaagtacttccccagccgggtgtccatcaaggagagctctgtggccaagctgggctctgtgtgccgccgcatctaccgcatcttcagccacgcctacttccaccaccggcagatctttgatgaatatgaaaatgagaccttcctgtgccaccgcttcaccaagtttgtgatgaagtacaacctgatgagcaaggacaacctgattgtgcccatcctggaggaggaggtgcagaacagcgtgtctggagagagcgaggcctag

SEQ ID NO: 19004 - DNA, 1173 bp, Artificial Sequence
  Description of Artificial Sequence: Synthetic coding sequence
atggccgcccagaaggacctgtgggatgccatcgtgattggagctggcatccagggctgcttcaccgcctaccacctggccaagcacaggaagaggatcctgctgctggagcagttcttcctgccccacagccggggcagcagccacggccagagccgcatcatcaggaaggcctacctggaggacttctacaccaggatgatgcatgagtgctaccagatctgggcccagctggagcacgaggccggcacccagctgcaccggcagacaggcctgctgctgctgggcatgaaggagaaccaggagctgaagaccatccaggccaacctgagccggcagagggtggagcaccagtgcctgagcagcgaggagctgaagcagcgcttccccaacatccggctgcccagaggagaggtgggcctgctggacaacagcggaggagtcatctatgcctacaaggccctgcgggccctgcaggatgccatccggcagctgggcggcatcgtgagagatggagagaaggtggtggagatcaaccctggcctgctggtgacagtgaagaccaccagccgcagctaccaggccaagagcctggtgatcacagctggcccctggaccaaccagctgctgcggcccctgggcatcgagatgcccctgcagaccctgcgcatcaacgtgtgctactggagggagatggtgcccggcagctatggagtgtcccaggccttcccctgcttcctgtggctgggcctgtgcccccaccacatctacggcctgcccactggagagtacccaggcctgatgaaggtgtcctaccaccacggcaaccacgccgaccctgaggagcgggactgccccacagccaggacagacattggagatgtgcagatcctgagcagctttgtgcgggaccacctgcctgacctgaagccagagcctgctgtgattgagagctgcatgtacaccaacaccccagatgagcagttcatcctggacagacaccccaagtatgacaacatcgtcatcggggccggcttcagcggccacggcttcaagctggcccctgtggtgggcaagatcctgtatgagctgtccatgaagctgacccccagctatgacctggcccccttccgcatcagccgcttccccagcctgggcaaggcccacctgtag

SEQ ID NO: 19005 - DNA, 135 bp, Artificial Sequence
  Description of Artificial Sequence: Synthetic coding sequence
atgtctgacaagccagacatggccgagattgagaagtttgacaagagcaagctgaagaagacagagatgcaggagaagaaccccctgcccagcaaggagaccatcgagcaggagaagcaggccagcgagagctag

SEQ ID NO: 19006 - DNA, 1323 bp, Artificial Sequence
  Description of Artificial Sequence: Synthetic coding sequence
atgcccatccccccacctcctcctcctcctcctggccccccacctccacccaccttccaccaggccaacacagagcagcccaagctgagcagagatgagcagaggggccgcggggccctgctgcaggacatctgcaagggcaccaagctgaagaaggtgaccaacatcaatgacagaagtgcccccatcctggagaagcccaagggcagcagcggcggctacggcagcggcggggccgccctgcagcccaagggcggcctcttccagggcggcgtgctgaagctgcggcctgtgggcgccaaggatggcagcgagaacctggccggcaagccagccctgcagatccccagcagcagagctgctgcccccaggcctcctgtgtctgctgccagcggccggccccaggatgacacagacagcagccgggccagcctgcctgagctgcccaggatgcagaggcccagcctgcctgacctgagccggcccaacaccaccagcagcacaggcatgaagcacagcagcagcgcccctcctcctcctcctcctggccggcgggccaatgccccacccacccccctgcccatgcacagcagcaaggccccagcctacaaccgggagaagcccctgccccccaccccaggccagaggctgcaccctggccgggagggccccccagcccctcctcctgtgaagcccccacccagccctgtgaacatcagaacaggccccagcggccagagcctggcccctcctcctccaccctaccggcagcccccaggagtgcccaacggccccagcagccccaccaatgaaagtgcccctgagctgccccagaggcacaacagcctgcacaggaagaccccaggccctgtgcggggcctggcccctcctccacccaccagcgccagccccagcctgctgagcaacagacctcctcctccagcccgggacccccccagcagaggagctgcccctcctcctcctcctcctgtgatcagaaatggagccagagatgcccctcctcctcctccaccctacaggatgcacggcagcgagccccccagccggggcaagcccccacctccacccagcaggaccccagctggccccccacctcctcctcctccacccctgagaaatggccaccgggacagcatcaccaccgtgcgctccttcctggatgactttgagagcaagtacagcttccaccctgtggaggacttccctgcccctgaggagtacaagcacttccagaggatctaccccagcaagaccaacagagctgcccggggggccccacccctgccccccatcctgaggtag

SEQ ID NO: 19007 - DNA, 2703 bp, Artificial Sequence
  Description of Artificial Sequence: Synthetic coding sequence
atgaactacccaggccggggcagccccaggagccctgagcacaacggccggggcggcggcggcggggcctgggagctgggcagtgatgcccggcctgccttcggcggcggcgtgtgctgctttgagcacctgcctggaggagaccctgatgatggagatgtgcccctggccctgctgcggggggagcccggcctgcacctggcccctggaacagatgaccacaaccaccacctggccctggacccctgcctgagtgatgaaaattatgacttcagcagcgctgagagcggcagcagcctgcgctactacagcgagggggagagcggcggcggcggcagcagcctgagcctgcaccccccccagcagccccccctggtgcccaccaacagcggcggcggcggggccaccggcggcagccctggagagaggaagaggacccggctgggcggccctgctgcccggcacagatatgaggtggtgacagagctgggccctgaggaggtgcgctggttctacaaggaggacaagaagacctggaagcccttcatcggctatgacagcctgcgcatcgagctggccttccgcaccctgctgcagaccactggagcccggccccagggcggggacagagatggagaccacgtgtgcagccccactggacctgccagcagcagtggagaagatgatgatgaagatcgggcctgtggcttctgccagagcaccaccggccacgagcctgagatggtggagctggtgaacatcgagcctgtgtgtgtgcggggcggcctgtatgaggtggatgtgacccagggcgagtgctaccctgtgtactggaaccaggccgacaagatccctgtgatgaggggccagtggttcattgatggcacctggcagcccctggaggaggaggagagcaacctgattgagcaggagcacctgaactgcttccggggccagcagatgcaggagaactttgatattgaggtgtccaagagcattgatggcaaggatgctgtgcacagcttcaagctgagcaggaaccacgtggactggcacagcgtggatgaggtgtacctgtacagtgatgccaccaccagcaagatcgccaggacagtgacccagaagctgggcttcagcaaggccagcagcagcggcacccggctgcaccggggctacgtggaggaggccaccctggaggacaagcccagccagaccacccacatcgtgtttgtggtgcatggaattggccagaagatggaccagggccgcatcatcaagaacacagccatgatgagggaggccgccaggaagattgaggagcggcacttcagcaaccacgccacccacgtggagttcctgcctgtggagtggaggagcaagctgaccctggatggagacacagtggacagcatcaccccagacaaggtgcggggcctgcgggacatgctgaacagcagcgccatggacatcatgtactacaccagccccctgtacagagatgagctggtgaagggcctgcagcaggagctgaacagactctacagcctcttctgcagcaggaacccagactttgaggagaagggcggcaaggtgtccatcgtgagccacagcctgggctgcgtcatcacctatgacatcatgacaggctggaaccctgtgcggctgtatgagcagctgctgcagaaggaggaggagctgcctgatgagcgctggatgtcctatgaggagcggcacctgctggatgagctgtacatcaccaagaggcggctgaaggagattgaggagcggctgcacggcctgaaggccagctccatgacccagaccccagccctgaagttcaaggtggagaacttcttctgcatgggcagccccctggccgtgttcctggccctgcggggcatccggcccggcaacacaggcagccaggaccacatcctgccccgggagatctgcaaccggctgctgaacatcttccaccccacagatcctgtggcctaccgcctggagcccctcatcctgaagcactacagcaacatcagccctgtgcagatccactggtacaacaccagcaaccccctgccctatgagcacatgaagcccagcttcctgaacccagccaaggagcccacctctgtgtctgaaaatgaaggcatcagcaccatccccagccctgtgaccagccctgtgctgagccgccgccactatggagagagcatcaccaacatcggcaaggccagcatcctgggcgccgccagcatcggcaagggcctgggcggcatgctgttcagcagatttggccgcagcagcaccacccagagcagcgagaccagcaaggacagcatggaggatgagaagaagcctgtggccagccccagcgccaccaccgtgggcacccagaccctgccccacagcagcagcggcttcctggacagcgcctacttccggctgcaggagagcttcttcaacctgccccagctgctcttcccagaaaatgtgatgcagaacaaggacaatgccctggtggagctggaccacagaattgactttgagctgcgggagggcctggtggagagccgctactggagcgctgtgaccagccacacagcctactggagcagcctggatgtggccctcttcctgctgaccttcatgtacaagcatgaacatgatgatgatgccaagcccaacctggaccccatctag

SEQ ID NO: 19008 - DNA, 1278 bp, Artificial Sequence
  Description of Artificial Sequence: Synthetic coding sequence
atgaacaagatgcctgctggggagcaggagtgtgagtacaacaaggagggcaagtactacagcaagggcgtgaagctggtgaggaagaagaagaagatccctggctaccgctggggagacatcaagatcaacatcatcggggagaaggatgacctgcccatccacttctgtgacaagtgtgacctgcccatcaagatctacggccgcatcatcccctgcaagcacgccttctgctaccactgtgccaacctgtatgacaaggtgggctacaaggtgtgcccccgctgccgctaccctgtgctgagaattgaggcccacaagaggggcagcgtcttcatgtgcagcatcgtgcagcagtgcaagaggacctacctgagccagaagagcctgcaggcccacatcaagaggaggcacaagagggccaggaagcaggtgaccagcgccagcctggagaaggtgcggccccacatcgccccaccccagacagagatcagtgacatccccaagaggctgcaggaccgggaccacctgagctacatccccccagagcagcacaccatggtgtccctgcccagcgtgcagcacatgctgcaggagcagcacaaccagccccacaaggacatccaggcccctcctcctgagctgagcctgagcctgcccttccccatccagtgggagaccgtgtccatcttcaccaggaagcacggcaacctgactgtggaccacatccagaacaacagcgacagcggggccaagaagcccaccccaccagactactacccagagtgccagagccagcctgctgtgagcagcccccaccacatcatcccccagaagcagcactacgcccccccacccagccccagcagccctgtgaaccaccagatgccctacccaccccaggatgtggtgacccccaacagcgtgcgcagccaggtgcctgccctgaccaccacctatgaccccagcagcggctacatcatcgtgaaggtgcccccagacatgaacagcccccccctgcgggccccccagagccagaatggaaaccccagcgccagcgagtttgccagccaccactacaacctgaacatcctgccccagttcacagagaaccaggagaccctgagcccccagttcacccagacagatgccatggaccaccggcgctggccagcctggaagaggctgagcccctgcccccccaccaggagccccccacccagcaccctgcacggccgcagccaccacagccaccagaggaggcaccggcgctactag

SEQ ID NO: 19009 - DNA, 1926 bp, Artificial Sequence
  Description of Artificial Sequence: Synthetic coding sequence
atgggcccccccctgaagctgttcaagaaccagaagtaccaggagctgaagcaggagtgcatcaaggacagccgcctcttctgtgaccccaccttcctgcctgaaaatgacagcctcttctacaaccggctgctgcccgggaaggtggtgtggaagaggccccaggacatctgtgatgacccccacctgattgtgggcaacatcagcaaccaccagctgacccagggccgcctgggccacaagcccatggtgtctgccttcagctgcctggccgtgcaggagagccactggaccaagaccatccccaaccacaaggagcaggagtgggacccccagaagacagagaagtatgccggcatcttccacttccgcttctggcactttggagagtggacagaggtggtgattgatgacctgctgcccaccatcaacggggacctggtgttctccttcagcacctccatgaatgagttctggaatgccctgctggagaaggcctatgccaagctgctgggctgctatgaggccctggatggcctgaccatcacagacatcatcgtggacttcaccggcaccctggccgagaccgtggacatgcagaagggccgctacacagagctggtggaggagaagtacaagctgtttggagagctgtacaagaccttcaccaagggcggcctcatctgctgcagcattgagagccccaaccaggaggagcaggaggtggagacagactggggcctgctgaagggccacacctacaccatgacagacatcaggaagatccggctgggggagcggctggtggaggtgttttctgctgagaaggtgtacatggtgcggctgaggaaccccctgggccggcaggagtggagcggcccctggagcgagatcagcgaggagtggcagcagctgacagccagtgacaggaagaacctgggcctggtgatgtctgatgatggagagttctggatgagcctggaggacttctgcaggaacttccacaagctgaatgtgtgcagaaatgtgaacaaccccatcttcggcaggaaggagctggagagcgtgctgggctgctggacagtggatgatgaccccctgatgaacagaagtggcggctgctacaacaacagagacaccttcctgcagaacccccagtacatcttcaccgtgcctgaagatggccacaaggtgatcatgagcctgcagcagaaggacctgcggacctacagaaggatgggccgcccagacaactacatcattggatttgagctgttcaaggtggagatgaacaggaagttccggctgcaccacctgtacatccaggagagagctggcaccagcacctacatcgacaccaggacagtgttcctgagcaagtacctgaagaagggcaactacgtgctggtgcccaccatgttccagcacggccgcaccagcgagttcctgctgcgcatcttcagcgaggtgcctgtgcagctgcgggagctgaccctggacatgcccaagatgagctgctggaacctggcccggggctaccccaaggtggtgacccagatcaccgtgcacagcgctgaggacctggagaagaagtatgccaatgagaccgtgaacccctacctggtgatcaagtgtgggaaggaggaggtgcgcagccctgtgcagaagaacacagtgcacgccatctttgacacccaggccatcttctacagaaggaccacagacatccccatcatcgtgcaggtgtggaacagcaggaagttctgtgaccagttcctgggccaggtgaccctggatgctgaccccagcgactgccgggacctgaagagcctgtacctgaggaagaagggcggccccacagccaaggtgaagcagggccacatctccttcaaggtgatcagcagtgatgacctgacagagctgtag

SEQ ID NO: 19010 - DNA, 3180 bp, Artificial Sequence
  Description of Artificial Sequence: Synthetic coding sequence
atggctgctgtggccggcagcggggctgctgctgcccccagcagcctgctgctggtggtgggcagcgagtttggcagccctggcctgctgacctacgtgctggaggagctggagcggggcatccgctcctgggatgtggaccccggggtgtgcaacctggatgagcagctgaaggtgtttgtgagccgccacagcgccaccttcagcagcatcgtgaagggccagaggagcctgcaccacagaggagacaacctggagaccctggtgctgctgaaccccagcgacaagagcctgtatgatgagctgaggaacctgctgctggaccctgccagccacaagctgctggtgctggccggcccctgcctggaggagactggagagctgctgctgcagacaggaggcttcagcccccaccacttcctgcaggtgctgaaggaccgggagatccgggacatcctggccaccaccccacctcctgtgcagccccccatcctgaccatcacctgccccaccttcggggactgggcccagctggccccagctgtgcccggcctgcagggcgccctgcggctgcagctgcggctgaaccccccagcccagctgcccaacagcgagggcctgtgtgagttcctggagtatgtggccgagagcctggagccccccagcccctttgagctgctggagccccccaccagcggcggcttcctgcggctgggccggccctgctgctacatcttccctgggggcctgggagatgctgccttctttgctgtgaatggcttcaccgtgctggtgaatggaggcagcaaccccaagagcagcttctggaagctggtgcgccacctggacagagtggatgctgtgctggtgacccaccctggagctgacagcctgcccggcctgaacagcctgctgcggaggaagctggccgagaggtctgaggtggccgccggcggcggctcctgggatgaccggctgcggcggctcatcagccccaacctgggcgtggtgttcttcaatgcctgtgaggccgccagccggctggcccggggggaggatgaagctgagctggccctgagcctgctggcccagctgggcatcacccccctgcccctgagccggggccctgtgcctgccaagcccaccgtgctgtttgagaagatgggcgtgggccgcctggacatgtatgtgctgcacccccccagcgctggagctgagaggaccctggcctctgtgtgtgccctgctggtgtggcaccctgctggccctggagagaaggtggtgcgggtgctcttccctggctgcaccccaccagcctgcctgctggatggcctggtgcggctgcagcacctgcgcttcctgcgggagcctgtggtgaccccccaggacctggagggccctggccgggcagagagcaaggagagcgtgggcagccgggacagcagcaagcgggagggcctgctggccacccacccccggcccggccaggagaggcctggggtggccaggaaggagcccgcccgggcagaggcccccaggaagacagagaaggaggccaagaccccccgggagctgaagaaggaccccaagcccagcgtgtccaggacccagccccgggaggtgcggcgggccgccagctctgtgcccaacctgaagaagaccaatgcccaggccgcccccaagcccaggaaggcccccagcaccagccacagcggcttcccccctgtggccaacggccccaggagcccccccagcctgcgctgtggggaggccagccccccatctgctgcctgtggcagccctgccagccagctggtggccacccccagcctggagctgggccccatcccagctggggaggagaaggccctggagctgcccctggccgccagcagcatcccccggcccaggacccccagccctgagagccacaggagccctgctgagggcagcgagcggctgagcctgagccccctgcggggcggggaggccggcccagatgccagccccaccgtgaccacccccaccgtgaccacccccagcctgcctgctgaggtgggcagcccccacagcacagaggtggatgagagcctgtctgtgtcctttgagcaggtgctgcccccatctgcccccaccagcgaggccggcctgagcctgcccctgcggggcccccgggccaggagaagtgccagcccccatgatgtggacctgtgcctggtgagcccctgtgaatttgagcacaggaaggctgtgcccatggccccagccccagccagccctggcagcagcaatgacagcagcgcccggagccaggagcgggccggcggcctgggcgctgaggagaccccacccacctctgtgtctgagagcctgcccaccctgagtgacagcgaccctgtgcccctggcccctggagctgctgacagtgatgaggacacagagggcttcggcgtgcccaggcatgaccccctgcctgaccccctgaaggtgcccccacccctgcctgaccccagcagcatctgcatggtggaccctgagatgctgccccccaagacagcccggcagacagaaaatgtgtccaggaccaggaagcccctggcccggcccaacagcagagctgctgcccccaaggccacccctgtggccgccgccaagaccaagggcctggccggcggggaccgggccagccggcccctgagcgcccggtctgagcccagcgagaagggcggccgggcccccctgagcaggaagagcagcacccccaagacagccacccggggccccagcggcagcgccagcagcaggcctggggtgtctgccaccccacccaagagccctgtgtacctggacctggcctacctgcccagcggcagcagcgcccacctggtggatgaggagttcttccagagggtgcgggccctgtgctacgtgatcagcggccaggaccagaggaaggaggagggcatgagagctgtgctggatgccctgctggccagcaagcagcactgggaccgggacctgcaggtgaccctcatccccacctttgattctgtggccatgcacacctggtatgcagagacccacgcccggcaccaggccctgggcatcaccgtgctgggcagcaacagcatggtgtccatgcaggatgatgccttccctgcctgcaaggtggagttctag

SEQ ID NO: 19011 - DNA, 4734 bp, Artificial Sequence
  Description of Artificial Sequence: Synthetic coding sequence
atggaggccggctctgtggtgcgggccatctttgacttctgccccagcgtgtctgaggagctgcccctgtttgtgggggacatcatcgaggtgctggccgtggtggatgagttctggctgctgggcaagaaggaggatgtgacaggccagttccccagcagctttgtggagatcgtgaccatccccagcctgaaggagggggagcggctgtttgtgtgcatctgtgagttcaccagccaggagctggacaacctgcccctgcacagaggagacctggtgatcctggatggcatccccacagctggctggctgcagggccgcagctgctggggcgcccggggcttcttccccagcagctgtgtgcgggagctgtgcctgagcagccagagccggcagtggcacagccagagcgccctcttccagatccctgagtacagcatgggccaggcccgggccctgatgggcctgagcgcccagctggatgaggagctggacttccgggagggagatgtgatcaccatcattggagtgcctgagcccggctggtttgaaggagagctggagggccggcggggcatcttccctgagggctttgtggagctgctgggccccctgaggacagtggatgaatctgtgagcagcggcaaccaggatgactgcatcgtgaatggagaggtggacacccctgtgggggaggaggagattggaccagatgaagatgaggaggagcccggcacctatggagtggccctgtaccgcttccaggccctggagcccaatgagctggactttgaggtgggggacaagatccgcatcctggccaccctggaggatggctggctggagggcagcctgaagggccgcacaggcatcttcccctacagatttgtgaagctgtgcccagacaccagggtggaggagaccatggccctgccccaggagggcagcctggcccgcatccctgagaccagcctggactgcctggagaacaccctgggcgtggaggagcagagacatgagaccagtgaccacgaggccgaggagccagactgcatcatcagcgaggcccccaccagccccctgggccacctgaccagtgaatatgacacagacaggaacagctaccaggatgaggacacagctgggggcccccccaggagccctggggtggagtgggagatgcccctggccacagacagccccaccagtgaccccacagaggtggtgaatggcatcagcagccagccccaggtgcccttccaccccaacctgcagaagagccagtactacagcacagtgggcggcagccacccccacagcgagcagtacccagacctgctgcccctggaggcccggacccgggactatgccagcctgccccccaagaggatgtacagccagctgaagaccctgcagaagcctgtgctgcccctgtaccggggcagctctgtgtctgccagccgggtggtgaagccccggcagagcagcccccagctgcacaacctggccagctacaccaagaagcaccacaccagctctgtgtacagcatcagcgagcggctggagatgaagccaggcccccaggcccagggcctggtgatggaggccgccacccacagccagggagatggcagcacagacctggacagcaagctgacccagcagctgattgaatttgagaagagcctggccggccctggaacagagccagacaagatcctgcggcacttcagcatcatggacttcaacagcgagaaggacatcgtgcggggcagcagcaagctgatcacagagcaggagctgcctgagaggaggaaggccctgcggcccccaccaccccggccctgcacccctgtgtccaccagcccccacctgctggtggaccagaacctgaagccagccccacccctggtggtgcggcccagcaggcctgcccccctgccccccagcgcccagcagaggaccaatgctgtgagccccaagctgctgagccgccaccggcccacctgtgagaccctggagaaggagggccctggccacatgggccgcagcctggaccagaccagcccctgccccctggtgctggtgcgcatcgaggagatggagcgggacctggacatgtacagccgggcccaggaggagctgaacctgatgctggaggagaagcaggatgagagcagcagagctgagaccctggaggacctgaagttctgtgagagcaacatcgagagcctgaacatggagctgcagcagctgcgggagatgaccctgctgagcagccagagcagcagcctggtggcccccagcggctctgtgtctgcagaaaatcctgagcagaggatgctggagaagagggccaaggtgattgaggagctgctgcagacagagcgggactacatccgggacctggagatgtgcatcgagcgcatcatggtgcccatgcagcaggcccaggtgcccaacatcgactttgagggcctgtttggaaacatgcagatggtgatcaaggtgtccaagcagctgctggccgccctggagatcagtgatgctgtgggccctgtgttcctgggccacagagatgagctggagggcacctacaagatctactgccagaaccatgatgaggccatcgccctgctggagatctatgagaaggatgagaagatccagaagcacctgcaggacagcctggccgacctgaagagcctgtacaatgagtggggctgcaccaactacatcaacctgggcagcttcctgatcaagcctgtgcagagggtgatgagataccccctgctgctgatggagctgctgaacagcaccccagagagccacccagacaaggtgcccctgaccaatgctgtgctggccgtgaaggagatcaacgtgaacatcaatgagtacaagaggaggaaggacctggtgctgaagtacagaaaaggagatgaggacagcctgatggagaagatcagcaagctgaacatccacagcatcatcaagaagagcaacagagtgagcagccacctgaagcacctgaccggctttgccccccagatcaaggatgaggtgtttgaggagacagagaagaacttcaggatgcaggagcggctcatcaagagcttcatccgggacctgagcctgtacctgcagcacatccgggagagcgcctgtgtgaaggtggtggccgctgtgtccatgtgggatgtgtgcatggagcggggccaccgggacctggagcagtttgagcgggtgcaccgctacatcagtgaccagctgttcaccaacttcaaggagaggacagagcggctggtgatcagccccctgaaccagctgctgtccatgttcaccggcccccacaagctggtgcagaagagatttgacaagctgctggacttctacaactgcacagagcgggcagagaagctgaaggacaagaagaccctggaggagctgcagagcgccaggaacaactatgaggccctgaatgcccagctgctggatgagctgcccaagttccaccagtatgcccagggcctcttcaccaactgtgtgcacggctatgcagaggcccactgtgactttgtgcaccaggccctggagcagctgaagcccctgctgagcctgctgaaggtggccggccgggagggcaacctgattgccatcttccacgaggagcacagccgggtgctgcagcagctgcaggtgttcaccttcttccctgagagcctgcctgccaccaagaagccctttgagaggaagaccatcgaccggcagagcgccaggaagcccctgctgggcctgcccagctacatgctgcagagcgaggagctgcgggccagcctgctggcccgctacccacctgagaagctgttccaggccgagaggaacttcaatgctgcccaggacctggatgtgtccctgctggagggggacctggtgggcgtcatcaagaagaaggaccccatgggcagccagaaccgctggctgattgacaatggagtgaccaagggctttgtgtacagcagcttcctgaagccctacaaccccaggaggagccacagtgatgcctctgtgggcagccacagcagcacagaaagtgaacatggcagcagcagcccccgcttcccccggcagaacagcggcagcaccctgaccttcaaccccagctccatggctgtgtccttcaccagcggcagctgccagaagcagccccaggatgccagccccccacccaaggaatgtgaccagggcaccctgagcgccagcctgaaccccagcaacagcgagagcagccccagccgctgccccagcgaccctgacagcaccagccagcccaggtctggggacagcgcagatgtggccagagatgtgaagcagcccacagccacccccaggagctacagaaacttccgccaccctgagatcgtgggctacagcgtgcccggcagaaatggccagagccaggacctggtgaagggctgtgccaggacagcccaggccccagaagatagaagcacagagccagatggcagcgaggccgagggcaaccaggtgtactttgctgtgtacaccttcaaggccaggaaccccaatgagctgtctgtgtctgccaaccagaagctgaagatcctggagttcaaggatgtgactggaaacacagagtggtggctggccgaggtgaatggcaagaagggctacgtgcccagcaactacatcaggaagacagagtacacctag

SEQ ID NO: 19012 - DNA, 3186 bp, Artificial Sequence
  Description of Artificial Sequence: Synthetic coding sequence
atgctgaggacagctggaagagatggcctgtgccgcctgagcacctacctggaggagctggaggccgtggagctgaagaagttcaagctgtacctgggcacagccacagagctgggggagggcaagatcccctggggctccatggagaaggccggccccctggagatggcccagctgctgatcacccacttcggccctgaggaggcctggaggctggccctgagcacctttgagcgcatcaacaggaaggacctgtgggagcggggccagcgggaggacctggtgcgggacaccccacctgggggccccagcagcctgggcaaccagagcacctgcctgctggaggtgtccctggtgacccccaggaaggacccccaggagacctacagagattatgtgcggaggaagttccggctgatggaggacagaaatgcccggctgggagaatgtgtgaacctgagccaccgctacacccggctgctgctggtgaaggagcacagcaaccccatgcaggtgcagcagcagctgctggacaccggccggggccacgccaggacagtgggccaccaggccagccccatcaagattgagaccctgtttgagccagatgaggagaggcctgagccccccaggacagtggtgatgcagggcgctgctggcatcggcaagtccatgctggcccacaaggtgatgctggactgggcagatggcaagctgttccagggccgctttgactacctgttctacatcaactgccgggagatgaaccagagcgccacagaatgttccatgcaggacctgatcttcagctgctggccagagcccagcgcccccctgcaggagctgatccgggtgcctgagcggctgctcttcatcattgatggctttgatgagctgaagcccagcttccatgacccccagggcccctggtgcctgtgctgggaggagaagaggcccacagagctgctgctgaacagcctcatcaggaagaagctgctgcctgagctgagcctgctgatcaccacccggcccacagccctggagaagctgcaccggctgctggagcaccccaggcatgtggagatcctgggcttcagcgaggccgagaggaaggagtacttctacaagtacttccacaatgctgagcaggccggccaggtgttcaactacgtgcgggacaatgagcccctcttcaccatgtgctttgtgcccctggtgtgctgggtggtgtgcacctgcctgcagcagcagctggagggcggcggcctgctgcggcagaccagcaggaccaccacagctgtgtacatgctgtacctgctgagcctgatgcagcccaagccaggggccccccggctgcagcccccacccaaccagaggggcctgtgcagcctggccgcagatggcctgtggaaccagaagatcctgtttgaggagcaggacctgaggaagcacggcctggatggagaagatgtgtctgccttcctgaacatgaacatcttccagaaggacatcaactgtgagcgctactacagcttcatccacctgtccttccaggagttctttgctgccatgtactacatcctggatgaaggagagggcggggccggccctgaccaggatgtgacccggctgctgacagaatatgccttcagcgagaggagcttcctggccctgaccagccgcttcctgtttggcctgctgaatgaggagaccaggagccacctggagaagagcctgtgctggaaggtgagcccccacatcaagatggacctgctgcagtggatccagagcaaggcccagagtgatggcagcaccctgcagcagggcagcctggagttcttcagctgcctgtatgagatccaggaggaggagttcatccagcaggccctgagccacttccaggtgattgtggtgagcaacatcgccagcaagatggagcacatggtgtcctccttctgcctgaagcgctgccgcagcgcccaggtgctgcacctgtatggagccacctacagcgcagatggagaagatcgggcccgctgcagcgctggggcccacaccctgctggtgcagctgcctgagaggacagtgctgctggatgcctacagcgagcacctggccgccgccctgtgcaccaaccccaacctgattgagctgagcctgtacagaaatgccctgggcagcagaggagtgaagctgctgtgccagggcctgcggcaccccaactgcaagctgcagaacctgcggctgaagcgctgccgcatcagcagcagcgcctgtgaggacctgtctgctgccctgattgccaacaagaacctgaccaggatggacctgtctggaaatggagtgggcttccctggcatgatgctgctgtgtgagggcctgcggcacccccagtgccgcctgcagatgatccagctgaggaagtgccagctggagagcggggcctgccaggagatggcctctgtgctgggcaccaacccccacctggtggagctggacctgactggaaatgccctggaggacctgggcctgcggctgctgtgccagggcctgcggcaccctgtgtgccgcctgcggaccctgtggctgaagatctgccgcctgacagctgctgcctgtgatgagctggccagcaccctgtctgtgaaccagagcctgcgggagctggacctgagcctgaatgagctgggggacctgggcgtgctgctgctgtgtgagggcctgcggcaccccacctgcaagctgcagaccctgcggctgggcatctgccgcctgggcagcgctgcctgtgagggcctgtctgtggtgctgcaggccaaccacaacctgcgggagctggacctgtccttcaatgacctgggggactggggcctgtggctgctggccgagggcctgcagcacccagcctgccgcctgcagaagctgtggctggacagctgtggcctgacagccaaggcctgtgagaacctgtacttcaccctgggcatcaaccagaccctgacagacctgtacctgaccaacaatgccctgggggacacaggagtgcggctgctgtgcaagaggctgagccaccctggctgcaagctgcgggtgctgtggctgtttggcatggacctgaacaagatgacccacagccggctggccgccctgcgggtgaccaagccctacctggacatcggctgctag

SEQ ID NO: 19013 - DNA, 3963 bp, Artificial Sequence
  Description of Artificial Sequence: Synthetic coding sequence
atggccaatgacagccctgccaagagcctggtggacatcgacctgagcagcctgcgggaccctgctggcatctttgagctggtggaggtggtgggcaatggcacctacggccaggtgtacaagggccgccacgtgaagacaggccagctggccgccatcaaggtgatggatgtgacagaagatgaggaggaggagatcaagctggagatcaacatgctgaagaagtacagccaccacaggaacatcgccacctactacggggccttcatcaagaagagccccccaggccatgatgaccagctgtggctggtgatggagttctgtggggccggcagcatcacagacctggtgaagaacaccaagggcaacaccctgaaggaggactggatcgcctacatcagccgggagatcctgcggggcctggcccacctgcacatccaccacgtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgactacagaagtgacctgtggagctgtggcatcacagccatcgagatggccgagggcgccccacccctgtgtgacatgcaccccatgagggccctcttcctgatccccagaaatcctccaccccggctgaagagcaagaagtggagcaagaagttcttctccttcatcgagggctgcctggtgaagaactacatgcagaggcccagcacagagcagctgctgaagcaccccttcatccgggaccagcccaatgaaaggcaggtgcgcatccagctgaaggaccacatcgacaggaccaggaagaagagaggagagaaggatgaaacagaatatgagtacagcggcagcgaggaggaggaggaggaggtgcctgagcaggagggggagcccagcagcatcgtgaatgtgcctggagagagcaccctgcggcgggacttcctgcggctgcagcaggagaacaaggagaggtctgaggccctgcggcggcagcagctgctgcaggagcagcagctgcgggagcaggaggagtacaagaggcagctgctggccgagcggcagaagagaattgagcagcagaaggagcagaggcggcggctggaggagcagcagaggcgggagcgggaggcccggcggcagcaggagcgggagcagaggagaagagagcaggaggagaagaggcggctggaggagctggagaggaggaggaaggaggaggaggagcggcggcgggcagaggaggagaagagaagagtggagcgggagcaggagtacatccggcggcagctggaggaggagcagaggcacctggaggtgctgcagcagcagctgctgcaggagcaggccatgctgctggagtgccgctggagggagatggaggagcaccggcaggccgagcggctgcagaggcagctgcagcaggagcaggcctacctgctgagcctgcagcacgaccacagaagaccccacccccagcacagccagcagcccccaccaccccagcaggagaggagcaagcccagcttccacgcccctgagcccaaggcccactatgagcctgctgaccgggcccgggaggtggaggaccgcttcaggaagaccaaccacagcagccctgaggcccagagcaagcagacaggccgggtgctggagccccctgtgcccagccgctctgagagcttcagcaatggaaacagcgagagcgtgcacccagccctgcagaggcctgctgagccccaggtgcagtggagccacctggccagcctgaagaacaacgtgtcccctgtgagccgcagccacagcttcagtgaccccagccccaagtttgcccaccaccacctgcggagccaggacccctgcccccccagccgctctgaggtgctgagccagagcagtgacagcaagtctgaggccccagaccccacccagaaggcctggagcagaagtgacagtgatgaggtgcccccccgggtgcctgtgaggaccaccagccgcagccctgtgctgagcagaagagacagccccctgcagggcagcggccagcagaacagccaggccggccagaggaacagcaccagcagcattgagccccggctgctgtgggagcgggtggagaagctggtgcccaggcctggcagcggcagcagcagcggcagcagcaacagcggcagccagcccggcagccaccctggcagccagagcggcagcggggagcgcttccgggtgcgcagcagcagcaagtctgagggcagccccagccagaggctggagaatgctgtgaagaagccagaggacaagaaggaggtgttccggcccctgaagccagctgtgagaattgacctgacagccctggccaaggagctgcgggctgtggaggatgtgcggcccccccacaaggtgacagactacagcagcagcagcgaggagagcggcaccacagatgaggaggatgatgatgtggagcaggagggcgcagatgagagcaccagcggccctgaggacaccagggctgccagcagcctgaacctgagcaatggagaaacagagagcgtgaagaccatgattgtgcatgatgatgtggagagcgagcccgccatgacccccagcaaggagggcaccctgattgtgcggcagacccagagcgccagcagcaccctgcagaagcacaagagcagcagcagcttcacccccttcatcgacccccggctgctgcagatcagccccagcagcggcaccaccgtgacctctgtggtgggcttcagctgtgatggcatgaggcctgaggccatccggcaggaccccaccaggaaaggatctgtggtgaatgtgaaccccaccaacacccggccccagagcgacaccccagagatcaggaagtacaagaagcgcttcaacagcgagatcctgtgtgccgccctgtggggcgtgaacctgctggtgggcacagagagcggcctgatgctgctggacaggagcggccagggcaaggtgtaccccctcatcaacagaagacgcttccagcagatggatgtgctggagggcctgaatgtgctggtgaccatcagcggcaagaaggacaagctgcgggtgtactacctgtcctggctgaggaacaagatcctgcacaatgaccctgaggtggagaagaagcagggctggaccaccgtgggggacctggagggctgtgtgcactacaaggtggtgaagtatgaaagaatcaagttcctggtgattgccctgaagagctctgtggaggtgtatgcctgggcccccaagccctaccacaagttcatggccttcaagagctttggagagctggtgcacaagcccctgctggtggacctgactgtggaggagggccagaggctgaaggtgatctacggcagctgtgccggcttccacgctgtggatgtggacagcggctctgtgtatgacatctacctgcccacccacatccagtgcagcatcaagccccacgccatcatcatcctgcccaacacagatggcatggagctgctggtgtgctatgaagatgagggcgtgtatgtgaacacctacggccgcatcaccaaggatgtggtgctgcagtggggcgagatgcccacctctgtggcctacatccgcagcaaccagaccatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgggccgcaccagcctgctgtcctggtag

SEQ ID NO: 19014 - DNA, 606 bp, Artificial Sequence
  Description of Artificial Sequence: Synthetic coding sequence
atgtacaccctgctgagcggcctgtacaagtacatgttccagaaggatgagtactgcatcctgatcctgggcctggacaatgctgggaagaccaccttcctggagcagagcaagacccgcttcaacaagaactacaagggcatgagcctgagcaagatcaccaccaccgtgggcctgaacattggaacagtggatgtgggcaaggcccggctgatgttctgggacctgggcggccaggaggagctgcagagcctgtgggacaagtactatgcagagtgccacggcgtcatctacgtgattgacagcacagatgaggagcggctggccgagagcaagcaggcctttgagaaggtggtgaccagcgaggccctgtgtggggtgcctgtgctggtgctggccaacaagcaggatgtggagacctgcctgagcatcccagacatcaagacagccttcagtgactgcaccagcaagattggccggcgggactgcctgacccaggcctgcagcgccctgaccgggaagggcgtgcgggagggcatcgagtggatggtgaagtgtgtggtgagaaatgtgcaccggcccccccggcagagggacatcacctag

SEQ ID NO: 19015 - DNA, 1329 bp, Artificial Sequence
  Description of Artificial Sequence: Synthetic coding sequence
atgagaggagccatggagctggagcctgagctgctgctgcaggaggcccgggagaatgtggaggccgcccagagctacagaagagagctgggccaccggctggagggcctgcgggaggcccggcggcagatcaaggagagcgccagccagaccagagatgtgctgaagcagcacttcaatgacctgaagggcaccctgggcaagctgctggatgagcggctggtgaccctgctgcaggaggtggacaccatcgagcaggagaccatcaagcccctggatgactgccagaagctgattgaacatggagtgaacacagctgaggacctggtgcgggagggggagatcgccatgctgggcggcgtgggggaggagaatgagaagctgtggagcttcaccaagaaggccagccacatccagctggacagcctgcctgaggtgcccctgctggtggatgtgccctgcctgagcgcccagctggatgacagcatcctgaacatcgtgaaggaccacatcttcaagcacggcaccgtggccagcaggcctcctgtgcagatcgaggagctgattgagaagccaggcggcatcatcgtgcgctggtgcaaggtggatgatgacttcaccgcccaggactaccgcctgcagttcaggaagtgcaccagcaaccactttgaagatgtgtatgtgggcagcgagacagagttcatcgtgctgcacatcgaccccaacgtggactaccagttccgggtgtgtgcccggggagatggccggcaggagtggagcccctggagcgtgccccagatcggccacagcaccctggtgccccatgagtggacagctggctttgagggctacagcctgagcagcagaagaaacatcgccctgagaaatgacagcgagagcagtggagtgctgtacagccgggcccccacctacttctgtggccagaccctgaccttccgggtggagaccgtgggccagcctgacagaagagacagcattggagtgtgtgccgagaagcaggacggctatgacagcctgcagagggaccaggccgtgtgcatcagcaccaatggagctgtgtttgtgaatggcaaggagatgaccaaccagctgcctgctgtgaccagcggcagcacagtgacctttgacatcgaggccgtgaccctgggcaccaccagcaacaatgaaggaggccacttcaagctgcgggtgaccatcagcagcaacaaccgggaggtggtgtttgactggctgctggaccagagctgtggcagcctgtacttcggctgcagcttcttctacccaggctggaaggtgctggtgttctag

SEQ ID NO: 19016 - DNA, 1428 bp, Artificial Sequence
  Description of Artificial Sequence: Synthetic coding sequence
atggccgccctgaccaccctcttcaagtacattgatgagaaccaggaccgctacatcaagaagctggccaagtgggtggccatccagagcgtgtctgcctggccagagaagagaggagagatccggaggatgatggaggtggccgctgctgatgtgaagcagctgggcggctctgtggagctggtggacatcggcaagcagaagctgcctgatggcagcgagatccccctgccccccatcctgctgggccgcctgggcagtgacccccagaagaagacagtgtgcatctacggccacctggatgtgcagcctgctgccctggaggatggctgggacagcgagcccttcaccctggtggagagagatggcaagctgtatggccggggcagcacagatgacaagggccctgtggccggctggatcaatgccctggaggcctaccagaagacaggccaggagatccctgtgaatgtgcgcttctgcctggagggcatggaggagagcggcagcgagggcctggatgagctgatctttgccaggaaggacaccttcttcaaggatgtggactatgtgtgcatcagtgacaactactggctgggcaagaagaagccctgcatcacctacggcctgcggggcatctgctacttcttcatcgaggtggagtgcagcaacaaggacctgcacagcggcgtgtatggaggctctgtgcatgaggccatgacagacctgatcctgctgatgggcagcctggtggacaagaggggcaacatcctgatccctggcatcaatgaagctgtggccgctgtgacagaggaggagcacaagctgtatgatgacatcgactttgacatcgaggagtttgccaaggatgtgggcgcccagatcctgctgcacagccacaagaaggacatcctgatgcaccgctggagataccccagcctgagcctgcatggaattgaaggagccttcagcggcagcggggccaagacagtcatccccaggaaggtggtgggcaagttcagcatccggctggtgcccaacatgaccccagaggtggtgggggagcaggtgaccagctacctgaccaagaagtttgctgagctgcggagccccaatgagttcaaggtgtacatgggccacggcggcaagccctgggtgtctgacttcagccacccccactacctggccggccggcgggccatgaagacagtgtttggagtggagccagacctgacccgggagggcggcagcatccctgtgaccctgaccttccaggaggccaccgggaagaatgtgatgctgctgcctgtgggcagcgcagatgatggagcccacagccagaatgagaagctgaaccgctacaactacatcgagggcaccaagatgctggccgcctacctgtatgaggtgtcccagctgaaggactag

SEQ ID NO: 19017 - DNA, 6291 bp, Artificial Sequence
  Description of Artificial Sequence: Synthetic coding sequence
atggccgaggtgacagtgccccgggtgtatgtggtgtttggcatccactgcatcatggccaaggccagcagtgatgtgcaggtgtctggcttccacaggaagatccagcacgtgaagaatgagctgtgccacatgctgagcctggaggaggtggcccctgtgctgcagcagaccctgctgcaggacaacctgctgggccgggtgcactttgaccagttcaaggaggccctgatcctgatcctgagcaggaccctgagcaatgaggagcacttccaggagccagactgcagcctggaggcccagcccaagtatgtgcggggcggcaagagatatggaagaagaagcctgcctgagttccaggagagcgtggaggagttccctgaggtgaccgtcatcgagcccctggatgaggaggcccggcccagccacatcccagctggggactgcagcgagcactggaagacccagaggtctgaggagtatgaagctgagggccagctgcgcttctggaacccagatgacctgaatgccagccagagcggcagcagccccccccaggactggattgaggagaagctgcaggaggtgtgtgaggacctgggcatcaccagagatggccacctgaacaggaagaagctggtgtccatctgtgagcagtatggcctgcagaatgtggatggagagatgctggaggaggtgttccacaacctggaccctgatggcaccatgtctgtggaggacttcttctacggcctcttcaagaatggcaagagcctgacccccagcgccagcaccccctaccggcagctgaagaggcacctgtccatgcagagctttgatgagagcggccgccgcaccaccaccagcagcgccatgaccagcaccatcggcttccgggtcttcagctgcctggatgatggcatgggccacgcctctgtggagcgcatcctggacacctggcaggaggagggcatcgagaacagccaggagatcctgaaggccctggacttcagcctggatggcaacatcaacctgacagagctgaccctggccctggagaatgagctgctggtgaccaagaacagcatccaccaggccgccctggccagcttcaaggccgagatccgccacctgctggagcgggtggaccaggtggtgcgggagaaggagaagctgcggagtgacctggacaaggccgagaagctgaagagcctgatggccagcgaggtggatgaccaccacgccgccattgaaagaagaaatgagtacaacctgaggaagctggatgaggagtacaaggagagaattgctgccctgaagaatgagctgaggaaggagcgggagcagatcctgcagcaggccggcaagcagaggctggagctggagcaggagattgagaaggccaagacagaggagaactacatccgggaccggctggccctgagcctgaaggagaacagccggctggagaatgagctgctggagaatgctgagaagctggccgagtatgagaacctgaccaacaagctgcagaggaacctggagaatgtgctggccgagaagtttggagacctggaccccagcagcgctgagttcttcctgcaggaggagcggctgacccagatgagaaatgaatatgaaaggcagtgccgggtgctgcaggaccaggtggatgagctgcagagcgagctggaggagtaccgggcccagggccgggtgctgcggctgcccctgaagaacagccccagcgaggaggtggaggccaacagcggcggcatcgagcctgagcacggcctgggcagcgaggagtgcaaccccctgaacatgagcattgaagctgagctggtgattgagcagatgaaggagcagcaccaccgggacatctgctgcctgcggctggagctggaggacaaggtgcgccactatgagaagcagctggatgaaacagtggtgtcctgcaagaaggcccaggagaacatgaagcagagacatgaaaatgagacccacaccctggagaagcagatcagtgacctgaagaatgaaattgctgagctgcagggccaggccgctgtgctgaaggaggcccaccacgaggccacctgcagacatgaggaggagaagaagcagctgcaggtgaagctggaggaggagaagacccacctgcaggagaagctgcggctgcagcacgagatggagctgaaggcccggctgacccaggcccaggccagctttgagcgggagcgggagggcctgcagagcagcgcctggacagaggagaaggtgcggggcctgacccaggagctggagcagttccaccaggagcagctgaccagcctggtggagaagcacaccctggagaaggaggagctgaggaaggagctgctggagaagcaccagcgggagctgcaggagggccgggagaagatggagacagagtgcaacagaaggaccagccagatcgaggcccagttccagagcgactgccagaaggtgacagagcgctgtgagagcgccctgcagagcctggagggccgctaccggcaggagctgaaggacctgcaggagcagcagcgggaggagaagagccagtgggagtttgagaaggatgagctgacccaggagtgtgccgaggcccaggagctgctgaaggagaccctgaagcgggagaagaccaccagcctggtgctgacccaggagcgggagatgctggagaagacctacaaggagcacctgaacagcatggtggtggagcggcagcagctgctgcaggacctggaggacctgagaaatgtgtctgagacccagcagagcctgctgagtgaccagatcctggagctgaagagcagccacaagcgggagctgcgggagcgggaggaggtgctgtgccaggccggggccagcgagcagctggccagccagaggctggagcggctggagatggagcatgaccaggagcggcaggagatgatgagcaagctgctggccatggagaacatccacaaggccacctgtgaaacagctgaccgggagcgggcagagatgagcacagagatcagccggctgcagagcaagatcaaggagatgcagcaggccaccagccccctgtccatgctgcagagcggctgccaggtgattggagaggaggaggtggagggagatggagccctgagcctgctgcagcagggcgagcagctgctggaggagaatggagatgtgctgctgagcctgcagagggcccacgagcaggccgtgaaggaaaatgtgaagatggccacagagatcagccggctgcagcagaggctgcagaagctggagcccggcctggtgatgagcagctgcctggatgagcccgccacagagttcttcggcaacacagctgagcagacagagcagttcctgcagcagaacagaaccaagcaggtggagggcgtgacccggcggcacgtgctgagtgacctggaggatgatgaggtgcgggacctgggcagcacaggcaccagctctgtgcagaggcaggaggtgaagattgaggagagcgaggcctctgtggagggcttcagcgagctggagaacagcgaggagaccaggacagagagctgggagctgaagaaccagatcagccagctgcaggagcagctgatgatgctgtgtgccgactgtgaccgggccagcgagaagaagcaggacctgctgtttgatgtgtctgtgctgaagaagaagctgaagatgctggagcgcatccctgaggccagccccaagtacaagctgctgtatgaagatgtgtcccgggagaatgactgcctgcaggaggagctgaggatgatggagaccaggtatgatgaggccctggagaacaacaaggagctgacagctgaggtgttccggctgcaggatgagctgaagaagatggaggaggtgacagagaccttcctgagcctggagaagagctatgatgaggtgaagattgaaaatgaaggcctgaatgtgctggtgctgcggctgcagggcaagattgagaagctgcaggagagcgtggtgcagagatgtgactgctgcctgtgggaggccagcctggagaacctggagattgaaccagatggcaacatcctgcagctgaaccagaccctggaggagtgtgtgccccgggtgcgctctgtgcaccacgtgattgaggagtgcaagcaggagaaccagtacctggagggcaacacccagctgctggagaaggtgaaggcccatgaaattgcctggctgcacggcaccatccagacccaccaggagcggccccgggtgcagaaccaggtgatcctggaggagaacaccaccctgctgggcttccaggacaagcacttccagcaccaggccaccatcgccgagctggagctggagaagaccaagctgcaggagctgaccaggaagctgaaggagcgggtgaccatcctggtgaagcagaaggatgtgctgagccacggggagaaggaggaggagctgaaggccatgatgcatgacctgcagatcacctgcagcgagatgcagcagaaggtggagctgctgcgctatgagagcgagaagctgcagcaggagaacagcatcctgagaaatgagatcaccaccctgaatgaggaggacagcatcagcaacctgaagctgggcaccctgaatggcagccaggaggagatgtggcagaagacagagaccgtgaagcaggagaatgctgctgtgcagaagatggtggagaacctgaagaagcagatcagcgagctgaagatcaagaaccagcagctggacctggagaacacagagctgagccagaagaacagccagaaccaggagaagctgcaggagctgaaccagaggctgacagagatgctgtgccagaaggagaaggagcccggcaacagcgccctggaggagcgggagcaggagaagttcaacctgaaggaggagctggagcgctgcaaggtgcagagcagcaccctggtgagcagcctggaggccgagctgtctgaggtgaagatccagacccacatcgtgcagcaggagaaccacctgctgaaggatgagctggagaagatgaagcagctgcaccgctgcccagacctgagtgacttccagcagaagatcagctctgtgctgagctacaatgagaagctgctgaaggagaaggaggccctgtctgaggagctgaacagctgtgtggacaagctggccaagagcagcctgctggagcaccgcatcgccaccatgaagcaggagcagaagtcctgggagcaccagagcgccagcctgaagagccagctggtggccagccaggagaaggtgcagaacctggaggacacagtgcagaatgtgaacctgcagatgagcaggatgaagagtgacctgcgggtgacccagcaggagaaggaggccctgaagcaggaggtgatgagcctgcacaagcagctgcagaatgccggcggcaagtcctgggcccctgagatcgccacccaccccagcggcctgcacaaccagcagaagaggctgtcctgggacaagctggaccacctgatgaatgaggagcagcagctgctgtggcaggagaatgaaaggctgcagaccatggtgcagaacaccaaggccgagctgacccacagccgggagaaggtgcggcagctggagagcaacctgctgcccaagcaccagaagcacctgaaccccagcggcaccatgaaccccacagagcaggagaagctgagcctgaagagagaatgtgaccagttccagaaggagcagagccctgccaacaggaaggtgtcccagatgaacagcctggagcaggagctggagaccatccacctggagaatgaaggcctgaagaagaagcaggtgaagctggatgagcagctgatggagatgcagcacctgcggagcacagccacccccagccccagcccccacgcctgggacctgcagctgctgcagcagcaggcctgccccatggtgccccgggagcagttcctgcagctgcagaggcagctgctgcaggccgagcgcatcaaccagcacctgcaggaggagctggagaacagaaccagcgagaccaacaccccccagggcaaccaggagcagctggtgacagtgatggaggagaggatgattgaggtggagcagaagctgaagctggtgaagaggctgctgcaggagaaggtgaaccagctgaaggagcaggtgtccctgcccggccacctgtgcagccccaccagccacagcagcttcaacagcagcttcaccagcctgtactgccactag

SEQ ID NO: 19018 - DNA, 1176 bp, Artificial Sequence
  Description of Artificial Sequence: Synthetic coding sequence
atggccgccctgaccaccctcttcaagtacattgatgagaaccaggaccgctacatcaagaagctggccaagtgggtggccatccagagcgtgtctgcctggccagagaagagaggagagatccggaggatgatggaggtggccgctgctgatgtgaagcagctgggcggctctgtggagctggtggacatcggcaagcagaaggagatccctgtgaatgtgcgcttctgcctggagggcatggaggagagcggcagcgagggcctggatgagctgatctttgccaggaaggacaccttcttcaaggatgtggactatgtgtgcatcagtgacaactactggctgggcaagaagaagccctgcatcacctacggcctgcggggcatctgctacttcttcatcgaggtggagtgcagcaacaaggacctgcacagcggcgtgtatggaggctctgtgcatgaggccatgacagacctgatcctgctgatgggcagcctggtggacaagaggggcaacatcctgatccctggcatcaatgaagctgtggccgctgtgacagaggaggagcacaagctgtatgatgacatcgactttgacatcgaggagtttgccaaggatgtgggcgcccagatcctgctgcacagccacaagaaggacatcctgatgcaccgctggagataccccagcctgagcctgcatggaattgaaggagccttcagcggcagcggggccaagacagtcatccccaggaaggtggtgggcaagttcagcatccggctggtgcccaacatgaccccagaggtggtgggggagcaggtgaccagctacctgaccaagaagtttgctgagctgcggagccccaatgagttcaaggtgtacatgggccacggcggcaagccctgggtgtctgacttcagccacccccactacctggccggccggcgggccatgaagacagtgtttggagtggagccagacctgacccgggagggcggcagcatccctgtgaccctgaccttccaggaggccaccgggaagaatgtgatgctgctgcctgtgggcagcgcagatgatggagcccacagccagaatgagaagctgaaccgctacaactacatcgagggcaccaagatgctggccgcctacctgtatgaggtgtcccagctgaaggactag

SEQ ID NO: 19019 - DNA, 5970 bp, Artificial Sequence
  Description of Artificial Sequence: Synthetic coding sequence
atggatgaggtggagcaggaccagcacgaggcccggctgaaggagctgtttgacagctttgacaccactggaacaggcagcctgggccaggaggagctgacagacctgtgccacatgctgagcctggaggaggtggcccctgtgctgcagcagaccctgctgcaggacaacctgctgggccgggtgcactttgaccagttcaaggaggccctgatcctgatcctgagcaggaccctgagcaatgaggagcacttccaggagccagactgcagcctggaggcccagcccaagtatgtgcggggcggcaagagatatggaagaagaagcctgcctgagttccaggagagcgtggaggagttccctgaggtgaccgtcatcgagcccctggatgaggaggcccggcccagccacatcccagctggggactgcagcgagcactggaagacccagaggtctgaggagtatgaagctgagggccagctgcgcttctggaacccagatgacctgaatgccagccagagcggcagcagccccccccaggactggattgaggagaagctgcaggaggtgtgtgaggacctgggcatcaccagagatggccacctgaacaggaagaagctggtgtccatctgtgagcagtatggcctgcagaatgtggatggagagatgctggaggaggtgttccacaacctggaccctgatggcaccatgtctgtggaggacttcttctacggcctcttcaagaatggcaagagcctgacccccagcgccagcaccccctaccggcagctgaagaggcacctgtccatgcagagctttgatgagagcggccgccgcaccaccaccagcagcgccatgaccagcaccatcggcttccgggtcttcagctgcctggatgatggcatgggccacgcctctgtggagcgcatcctggacacctggcaggaggagggcatcgagaacagccaggagatcctgaaggccctggacttcagcctggatggcaacatcaacctgacagagctgaccctggccctggagaatgagctgctggtgaccaagaacagcatccaccaggccgccctggccagcttcaaggccgagatccgccacctgctggagcgggtggaccaggtggtgcgggagaaggagaagctgcggagtgacctggacaaggccgagaagctgaagagcctgatggccagcgaggtggatgaccaccacgccgccattgaaagaagaaatgagtacaacctgaggaagctggatgaggagtacaaggagagaattgctgccctgaagaatgagctgaggaaggagcgggagcagatcctgcagcaggccggcaagcagaggctggagctggagcaggagattgagaaggccaagacagaggagaactacatccgggaccggctggccctgagcctgaaggagaacagccggctggagaatgagctgctggagaatgctgagaagctggccgagtatgagaacctgaccaacaagctgcagaggaacctggagaatgtgctggccgagaagtttggagacctggaccccagcagcgctgagttcttcctgcaggaggagcggctgacccagatgagaaatgaatatgaaaggcagtgccgggtgctgcaggaccaggtggatgagctgcagagcgagctggaggagtaccgggcccagggccgggtgctgcggctgcccctgaagaacagccccagcgaggaggtggaggccaacagcggcggcatcgagcctgagcacggcctgggcagcgaggagtgcaaccccctgaacatgagcattgaagctgagctggtgattgagcagatgaaggagcagcaccaccgggacatctgctgcctgcggctggagctggaggacaaggtgcgccactatgagaagcagctggatgaaacagtggtgtcctgcaagaaggcccaggagaacatgaagcagagacatgaaaatgagacccacaccctggagaagcagatcagtgacctgaagaatgaaattgctgagctgcagggccaggccgctgtgctgaaggaggcccaccacgaggccacctgcagacatgaggaggagaagaagcagctgcaggtgaagctggaggaggagaagacccacctgcaggagaagctgcggctgcagcacgagatggagctgaaggcccggctgacccaggcccaggccagctttgagcgggagcgggagggcctgcagagcagcgcctggacagaggagaaggtgcggggcctgacccaggagctggagcagttccaccaggagcagctgaccagcctggtggagaagcacaccctggagaaggaggagctgaggaaggagctgctggagaagcaccagcgggagctgcaggagggccgggagaagatggagacagagtgcaacagaaggaccagccagatcgaggcccagttccagagcgactgccagaaggtgacagagcgctgtgagagcgccctgcagagcctggagggccgctaccggcaggagctgaaggacctgcaggagcagcagcgggaggagaagagccagtgggagtttgagaaggatgagctgacccaggagtgtgccgaggcccaggagctgctgaaggagaccctgaagcgggagaagaccaccagcctggtgctgacccaggagcgggagatgctggagaagacctacaaggagcacctgaacagcatggtggtggagcggcagcagctgctgcaggacctggaggacctgagaaatgtgtctgagacccagcagagcctgctgagtgaccagatcctggagctgaagagcagccacaagcgggagctgcgggagcgggaggaggtgctgtgccaggccggggccagcgagcagctggccagccagaggctggagcggctggagatggagcatgaccaggagcggcaggagatgatgagcaagctgctggccatggagaacatccacaaggccacctgtgaaacagctgaccgggagcgggcagagatgagcacagagatcagccggctgcagagcaagatcaaggagatgcagcaggccaccagccccctgtccatgctgcagagcggctgccaggtgattggagaggaggaggtggagggagatggagccctgagcctgctgcagcagggcgagcagctgctggaggagaatggagatgtgctgctgagcctgcagagggcccacgagcaggccgtgaaggaaaatgtgaagatggccacagagatcagccggctgcagcagaggctgcagaagctggagcccggcctggtgatgagcagctgcctggatgagcccgccacagagttcttcggcaacacagctgagcagacagagcagttcctgcagcagaacagaaccaagcaggtggagggcgtgacccggcggcacgtgctgagtgacctggaggatgatgaggtgcgggacctgggcagcacaggcaccagctctgtgcagaggcaggaggtgaagattgaggagagcgaggcctctgtggagggcttcagcgagctggagaacagcgaggagaccaggacagagagctgggagctgaagaaccagatcagccagctgcaggagcagctgatgatgctgtgtgccgactgtgaccgggccagcgagaagaagcaggacctgctgtttgatgtgtctgtgctgaagaagaagctgaagatgctggagcgcatccctgaggccagccccaagtacaagctgctgtatgaagatgtgtcccgggagaatgactgcctgcaggaggagctgaggatgatggagaccaggtatgatgaggccctggagaacaacaaggagctgacagctgaggtgttccggctgcaggatgagctgaagaagatggaggaggtgacagagaccttcctgagcctggagaagagctatgatgaggtgaagattgaaaatgaaggcctgaatgtgctggtgctgcggctgcagggcaagattgagaagctgcaggagagcgtggtgcagagatgtgactgctgcctgtgggaggccagcctggagaacctggagattgaaccagatggcaacatcctgcagctgaaccagaccctggaggagtgtgtgccccgggtgcgctctgtgcaccacgtgattgaggagtgcaagcaggagaaccagtacctggagggcaacacccagctgctggagaaggtgaaggcccatgaaattgcctggctgcacggcaccatccagacccaccaggagcggccccgggtgcagaaccaggtgatcctggaggagaacaccaccctgctgggcttccaggacaagcacttccagcaccaggccaccatcgccgagctggagctggagaagaccaagctgcaggagctgaccaggaagctgaaggagcgggtgaccatcctggtgaagcagaaggatgtgctgagccacggggagaaggaggaggagctgaaggccatgatgcatgacctgcagatcacctgcagcgagatgcagcagaaggtggagctgctgcgctatgagagcgagaagctgcagcaggagaacagcatcctgagaaatgagatcaccaccctgaatgaggaggacagcatcagcaacctgaagctgggcaccctgaatggcagccaggaggagatgtggcagaagacagagaccgtgaagcaggagaatgctgctgtgcagaagatggtggagaacctgaagaagcagatcagcgagctgaagatcaagaaccagcagctggacctggagaacacagagctgagccagaagaacagccagaaccaggagaagctgcaggagctgaaccagaggctgacagagatgctgtgccagaaggagaaggagcccggcaacagcgccctggaggagcgggagcaggagaagttcaacctgaaggaggagctggagcgctgcaaggtgcagagcagcaccctggtgagcagcctggaggccgagctgtctgaggtgaagatccagacccacatcgtgcagcaggagaaccacctgctgaaggatgagctggagaagatgaagcagctgcaccgctgcccagacctgagtgacttccagcagaagatcagctctgtgctgagctacaatgagaagctgctgaaggagaaggaggccctgtctgaggagctgaacagctgtgtggacaagctggccaagagcagcctgctggagcaccgcatcgccaccatgaagcaggagcagaagtcctgggagcaccagagcgccagcctgaagagccagctggtggccagccaggagaaggtgcagaacctggaggacacagtgcagaatgtgaacctgcagatgagcaggatgaagagtgacctgcgggtgacccagcaggagaaggaggccctgaagcaggaggtgatgagcctgcacaagcagctgcagaatgccggcggcaagtcctgggcccctgagatcgccacccaccccagcggcctgcacaaccagcagaagaggctgtcctgggacaagctggaccacctgatgaatgaggagcagcagctgctgtggcaggagaatgaaaggctgcagaccatggtgcagaacaccaaggccgagctgacccacagccgggagaaggtgcggcagctggagagcaacctgctgcccaagcaccagaagcacctgaaccccagcggcaccatgaaccccacagagcaggagaagctgagcctgaagagagaatgtgaccagttccagaaggagcagagccctgccaacaggaaggtgtcccagatgaacagcctggagcaggagctggagaccatccacctggagaatgaaggcctgaagaagaagcaggtgaagctggatgagcagctgatggagaacagcgtggtgggcagcagccgggagggctgcagcagcctgcctgagatcgtgtgtgaagatgctgcccctgaggtgcactgtgatgcctag

SEQ ID NO: 19020 - DNA, 915 bp, Artificial Sequence
  Description of Artificial Sequence: Synthetic coding sequence
atgggccagtgtgtgaccaagtgcaagaaccccagcagcaccctgggcagcaagaatggagaccgggagcccagcaacaagagccacagcagaagaggagctggccaccgggaggagcaggtgcccccctgtgggaagccaggaggagacatcctggtgaatggcaccaagaaggccgaggccgccacagaggcctgccagctgcccaccagcagtggagatgctggccgggagagcaagagcaatgctgaggagagcagcctgcagaggctggaggagctgttccgccgctacaaggatgaaagagaagatgccatcctggaggagggcatggagcgcttctgcaatgacctgtgtgtggaccccacagagttccgggtgctgctgctggcctggaagttccaggccgccaccatgtgcaagttcaccaggaaggagttctttgatggctgcaaggccatctctgctgacagcattgatggcatctgtgcccgcttccccagcctgctgacagaggccaagcaggaggacaagttcaaggacctgtaccgcttcaccttccagtttggcctggacagcgaggagggccagaggagcctgcaccgggagatcgccatcgccctgtggaagctggtgttcacccagaacaacccccctgtgctggaccagtggctgaacttcctgacagagaaccccagcggcatcaagggcatcagccgggacacctggaacatgttcctgaacttcacccaggtgattggaccagacctgagcaactacagtgaagatgaggcctggcccagcctgtttgacacctttgtggagtgggagatggagaggaggaagcgggagggggagggccgcggggccctgagcagcggccctgagggcctgtgcccagaggagcagacctag

SEQ ID NO: 19021 - DNA, 1914 bp, Artificial Sequence
  Description of Artificial Sequence: Synthetic coding sequence
atggccgccatggctgtgggcggggccggcggcagccgggtgagcagcggccgggacctgaactgtgtgcctgagattgctgacaccctgggcgctgtggccaagcagggctttgacttcctgtgcatgcctgtgttccacccccgcttcaagcgggagttcatccaggagcccgccaagaacagacctggcccccagaccaggagtgacctgctgctgagcggccgggactggaacaccctcatcgtgggcaagctgagcccctggatccggccagacagcaaggtggagaagatcagaagaaattctgaggccgccatgctgcaggagctgaactttggagcctacctgggcctgcctgccttcctgctgcccctgaaccaggaggacaacaccaacctggcccgggtgctgaccaaccacatccacacaggccaccacagctccatgttctggatgagggtgcccctggtggcccctgaggacctgagagatgacatcattgaaaatgcccccaccacccacacagaggagtacagcggggaggagaagacctggatgtggtggcacaacttccgcaccctgtgtgactacagcaagagaattgctgtggccctggagatcggggctgacctgcccagcaaccacgtgattgaccgctggctgggggagcccatcaaggccgccatcctgcccaccagcatcttcctgaccaacaagaagggcttccctgtgctgagcaagatgcaccagaggctcatcttccggctgctgaagctggaggtgcagttcatcatcaccggcaccaaccaccacagcgagaaggagttctgcagctacctgcagtacctggagtacctgagccagaaccggcccccaccaaatgcctatgagctgtttgccaagggctatgaggactacctgcagagccccctgcagcccctgatggacaacctggagagccagacctatgaggtgtttgagaaggaccccatcaagtacagccagtaccagcaggccatctacaagtgcctgctggacagagtgcctgaggaggagaaggacaccaacgtgcaggtgctgatggtgctgggcgccggccggggccccctggtgaatgccagcctgcgggccgccaagcaggccgaccggcgcatcaagctgtatgctgtggagaagaaccccaatgctgtggtgaccctggagaactggcagtttgaggagtggggcagccaggtgacagtggtgtccagtgacatgagggagtgggtggcccctgagaaggctgacatcatcgtgtctgagctgctgggcagctttgctgacaatgagctgagccctgagtgcctggatggagcccagcacttcctgaaggatgatggagtgtccatccctggagagtacaccagcttcctggcccccatcagcagcagcaagctgtacaatgaggtgcgggcctgccgggagaaggaccgggaccctgaggcccagtttgagatgccctacgtggtgcggctgcacaacttccaccagctgagcgccccccagccctgcttcaccttcagccaccccaacagagaccccatgattgacaacaaccgctactgcaccctggagttccctgtggaggtgaacacagtgctgcacggctttgctggctactttgaaacagtgctgtaccaggacatcaccctgagcatccggcctgagacccacagccctggcatgttctcctggttccccatcctcttccccatcaagcagcccatcaccgtgcgggagggccagaccatctgtgtgcgcttctggcgctgcagcaacagcaagaaggtgtggtatgagtgggccgtgacagcccctgtgtgcagcgccatccacaaccccaccggccgcagctacaccatcggcctgtag

SEQ ID NO: 19022 - DNA, 1041 bp, Artificial Sequence
  Description of Artificial Sequence: Synthetic coding sequence
atggcccctggctctgtgaccagtgacatcagccccagcagcaccagcacagctggcagcagccgcagccctgagagcgagaagccaggccccagccatggaggagtgcccccaggcggccccagccacagcagcctgcctgtgggccgccgccacccccctgtgctgaggatggtgctggaggccctgcaggccggggagcagaggcggggcacctctgtggccgccatcaagctgtacatcctgcacaagtaccccaccgtggatgtgctgcgcttcaagtacctgctgaagcaggccctggccaccggcatgaggcggggcctgctggcccggcccctgaacagcaaggcccggggggccaccggcagcttcaagctggtgcccaagcacaagaagaagatccagcccaggaagatggccccagccacagcccccaggagagctggggaggccaagggcaagggccccaagaagcccagcgaggccaaggaggaccccccaaatgtgggcaaggtgaagaaggccgccaagaggcctgccaaggtgcagaagcccccacccaagccaggggccgccacagagaaggccaggaagcagggcggggccgccaaggacacccgggcccagagcggggaggccaggaaggtgccccccaagccagacaaggccatgagggcccccagcagcgctgggggcctgagcaggaaggccaaggccaagggcagccgcagcagccagggagatgctgaggcctacaggaagaccaaggccgagagcaagagcagcaagcccacagccagcaaggtgaagaatggagctgccagccccaccaagaagaaggtggtggccaaggccaaggcccccaaggccggccagggccccaacaccaaggccgccgccccagccaagggcagcggcagcaaggtggtgcctgcccacctgagcaggaagacagaggcccccaagggccccaggaaggccggcctgcccatcaaggccagcagcagcaaggtgagcagccagagagctgaggcctag

SEQ ID NO: 19023 - DNA, 1869 bp, Artificial Sequence
  Description of Artificial Sequence: Synthetic coding sequence
atggccatggcccccagccccagcctggtgcaggtgtacaccagccctgctgctgtggccgtgtgggagtggcaggacggcctgggcacctggcacccctacagcgccaccgtgtgcagcttcatcgagcagcagtttgtgcagcagaagggccagcgcttcggcctgggcagcctggcccacagcatccccctgggccaggccgaccccagcctggccccctacatcatcgacctgcccagctggacccagttccggcaggacaccggcaccatgagagctgtgcggcggcacctgttcccccagcacagcgcccctggccggggcgtggtgtgggagtggctgagtgatgatggctcctggacagcctatgaggcctctgtgtgtgactacctggagcagcaggtggcccggggcaaccagctggtggacctggcccccctgggctacaactacacagtgaactacaccacccacacccagaccaacaagaccagcagcttctgccgctctgtgcggcggcaggccggccccccctaccctgtgaccaccatcatcgcccctcctggccacactggagtggcctgcagctgccaccagtgcctgagcggcagcaggactggacctgtgtctggccgctaccgccacagcatgaccaacctgcctgcctaccctgtgccccagcaccccccccacaggacagcctctgtgtttggcacccaccaggcctttgccccctacaacaagcccagcctgagcggggcccggagcgccccccggctgaacaccaccaatgcctggggcgccgccccacccagcctgggcagccagcccctgtaccgcagcagcctgagccacctgggcccccagcacctgcccccaggcagcagcaccagcggggctgtgtctgccagcctgcccagcggccccagcagcagccctggctctgtgcctgccaccgtgcccatgcagatgcccaagcccagccgggtgcagcaggccctggccggcatgacctctgtgctgatgtctgccatcggcctgcctgtgtgcctgagccgggccccccagcccaccagccccccagccagccggctggccagcaagagccacggctctgtgaagaggctgaggaagatgtctgtgaagggggccacccccaagccagagcctgagcctgagcaggtgatcaagaactacacagaggagctgaaggtgcccccagatgaggactgcatcatctgcatggagaagctgagcacagccagcggctacagtgatgtgacagacagcaaggccatcggcagcctggccgtgggccacctgaccaagtgcagccacgccttccacctgctgtgcctgctggccatgtactgcaatggaaacaaggatggcagcctgcagtgccccagctgcaagaccatctacggggagaagacaggcacccagccccagggcaagatggaggtgctgcgcttccagatgagcctgcccggccacgaggactgtggcaccatcctgattgtgtacagcatcccccacggcatccagggccctgagcaccccaaccctgggaagcccttcaccgcccggggcttcccccggcagtgctacctgcctgacaatgcccagggcaggaaggtgctggagctgctgaaggtggcctggaagaggaggctcatcttcaccgtgggcaccagcagcaccaccggggagacagacacagtggtgtggaatgagatccaccacaagacagagatggacaggaacatcaccggccacggctacccagaccccaactacctgcagaatgtgctggccgagctggccgcccagggcgtgacagaggactgcctggagcagcagtag

SEQ ID NO: 19024 - DNA, 786 bp, Artificial Sequence
  Description of Artificial Sequence: Synthetic coding sequence
atggccgccacagccagagaagatggagccagcggccaggagcggggccagaggggctgtgagcactatgaccggggctgcctgctgaaggccccctgctgtgacaagctgtacacctgccgcctgtgccacgacaacaatgaagaccaccagctggaccgcttcaaggtgaaggaggtgcagtgcatcaactgtgagaagatccagcacgcccagcagacctgtgaagaatgttccaccctgtttggagagtactactgtgacatctgccacctgtttgacaaggacaagaagcagtaccactgtgagaactgtggcatctgccgcatcggccccaaggaggacttcttccactgcctgaagtgcaacctgtgcctggccatgaacctgcagggccgccacaagtgcattgaaaatgtgtcccggcagaactgccccatctgcctggaggacatccacaccagccgggtggtggcccacgtgctgccctgtggccacctgctgcacaggacctgctatgaggagatgctgaaggagggctaccgctgccccctgtgcatgcacagcgccctggacatgacccgctactggaggcagctggatgatgaggtggcccagacccccatgcccagcgagtaccagaacatgacagtggacatcctgtgcaatgactgcaatggccgcagcacagtgcagttccacatcctgggcatgaagtgcaagatctgtgagagctacaacacagcccaggccggcggccgccgcatcagcctggaccagcagtag

SEQ ID NO: 19025 - DNA, 1983 bp, Artificial Sequence
  Description of Artificial Sequence: Synthetic coding sequence
ctgagcctgcccagcgtgacctacctgctgctggaggtgatcccagacagcatgaggaagcaggaggtgaggacaggccgggaggccggccagggccatggaacaggcagccctgctgagcaggtgaaggccctgatggacctgctggccggcaagggcagccagggcagccaggccccccaggccctggacaggaccccagatgcccccctgggcccctgcagcaatgacagccgcatccagaggcacaggaaggccctgctgagcaaggtggaggccacccggggcggcggccacccagccaggacagtggccctggacaggctcttcctgcccctgagccgggtgtctgtgcccccccgggtgtccatcaccatcggcgtggccggcatgggcaagaccaccctggtgcgccactttgtgcggctgtgggcccacggccaggtgggcaaggacttcagcctggtgctgcccctgaccttccgggacctgaacacccatgagaagctgtgtgccgacaggctcatctgcagcgtcttcccccacgtgggggagcccagcctggccgtggccgtgcctgcccgggccctgctgatcctggatggcctggatgaatgtaggacccccctggacttcagcaacacagtggcctgcacagaccccaagaaggagatccctgtggaccacctgatcaccaacatcatccggggcaacctcttccctgaggtgtccatctggatcaccagccggcccagcgccagcggccagatccctgggggcctggtggacaggatgacagagatccggggcttcaatgaggaggagatcaaggtgtgcctggagcagatgtttcctgaggaccaggccctgctgggctggatgctgagccaggtgcaggccgaccgggccctgtacctgatgtgcaccgtgcctgccttctgccgcctgaccggcatggccctgggccacctgtggaggagcaggacaggcccccaggatgctgagctgtggccacccaggaccctgtgtgagctgtacagctggtacttcaggatggccctgtctggagagggccaggagaagggcaaggccagcccccgcatcgagcaggtggcccatggaggcaggaagatggtgggcaccctgggccgcctggccttccacggcctgctgaagaagaagtatgtgttctatgagcaggacatgaaggcctttggagtggacctggccctgctgcagggcgccccctgcagctgcttcctgcagcgggaggagaccctggccagctctgtggcctactgcttcacccacctgagcctgcaggagtttgtggccgccgcctactactacggggccagccggcgggccatctttgacctcttcacagagagcggcgtgtcctggccccggctgggcttcctgacccacttccgctctgctgcccagagggccatgcaggccgaggatggccgcctggatgtgttcctgcgcttcctgagcggcctgctgagcccccgggtgaatgccctgctggccggcagcctgctggcccagggcgagcaccaggcctaccgcacccaggtggccgagctgctgcagggctgcctgcggccagatgctgctgtgtgtgcccgggccatcaacgtgctgcactgcctgcacgagctgcagcacacagagctggcccggtctgtggaggaggccatggagagcggggccctggcccggctgaccggccctgcccaccgggccgccctggcctacctgctgcaggtgtctgatgcctgtgcccaggaggccaacctgagcctgagcctgagccagggcgtgctgcagagcctgctgccccagctgctgtactgcaggaagctgcgctggatccctggccagggcgctggggccggggagggcgctgaggagcgggcagaggccgtgcccagccccccacccagcttctctgtgtccctgctgggcctgccctag

SEQ ID NO: 19026 - DNA, 1152 bp, Artificial Sequence
  Description of Artificial Sequence: Synthetic coding sequence
atgctgagcaggaagaagaccaagaatgaggtgtccaagccagctgaggtgcagggcaagtatgtgaagaaggagaccagccccctgctgaggaacctgatgcccagcttcatccgccacggccccaccatccccaggagaacagacatctgcctgcctgacagcagccccaatgccttcagcaccagcggagatgtggtgtccaggaaccagagcttcctgcggacccccatccagaggacccctcatgagatcatgagaagagagagcaaccggctgagcgcccccagctacctggcccggagcctggctgatgtgccccgggagtatggcagcagccagagctttgtgacagaggtgtcctttgctgtggagaatggagacagcggcagccgctactactacagcgacaacttctttgatggccagaggaagaggcccctgggggaccgggcccacgaggactaccgctactatgagtacaaccacgacctcttccagaggatgccccagaaccagggcagacatgccagcggcatcggccgggtggccgccaccagcctgggcaacctgaccaaccacggcagcgaggacctgcccctgcccccaggctggagcgtggactggaccatgaggggcaggaagtactacatcgaccacaacaccaacaccacccactggagccaccccctggagcgggagggcctgcccccaggctgggagcgggtggagagcagcgagtttggcacctactacgtggaccacaccaacaagaaggcccagtaccgccacccctgtgcccccagcgtgcccaggtatgaccagcccccacctgtgacctaccagccccagcagacagagaggaaccagagcctgctggtgcctgccaacccctaccacacagctgagatcccagactggctgcaggtgtatgcccgggcccctgtgaagtatgaccacatcctgaagtgggagctgttccagctggccgacctggacacctaccagggcatgctgaagctgctcttcatgaaggagctggagcagatcgtgaagatgtatgaggcctaccggcaggccctgctgacagagctggagaacaggaagcagaggcagcagtggtacgcccagcagcacggcaagaacttctag

SEQ ID NO: 19027 - DNA, 2376 bp, Artificial Sequence
  Description of Artificial Sequence: Synthetic coding sequence
atgagcaaccagcaggagaagtatgaggcccagaacatcgtgaacagcacagaggagagtgatgatgcctttgacacagtgaccatccctgtgcccagcgaggagccccaggagagtgaccagacagaggagcatgaaagtggcatcgagcagttcagcgagagccacgccatccacgtggaggagcagagcgaccagagcttcagcagcctggagccagacaatgagcagctgatggaggaggtgatcagcccccggcaggtgtcctacaccccccagcaccacgagaagcagtatgccatgcagaggcccaatgatgacagcctggccttcctggacaagatcaagtctgtgaaggagagcctgcaggagagcgtggaggacagcctggccaccgtgaaggtggtgctgatccctgtgggccaggagatcgtcatccccttcaaggtggacaccatcctgaagtacctgaaggaccacttcagccacctgctgggcatcccccacagcgtgctgcagatccgctacagcggcaagatcctgaagaacaatgagaccctggtgcagcacggcgtgaagccccaggagatcgtgcaggtggagatcttcagcaccaacccagacctgtaccctgtgagaagaattgatggcctgacagatgtgtcccagatcatcaccgtgacagtgcagacaggcctggaccagtaccagcaggtgcctgtggagatcgtgaagagtgacttccacaagcccttcctgggcggcttccgccacaaggtgactggagtggagtaccacaatgccggcacccagacagtgcccaagagaattcctgagcggctgagcatcttctgccgggacacccagaccgtcttccagaagaagaacctgcagcagaccaccaacaccaccagcacccagatgaccaacattggagtgtatgtgagcaacatgacagacaagctggtgaccccaggcaagtacttctctgctgctgagtaccacgcccagaggctgaaggctgtgattgtcatccagacctactaccggcagtggcacgccaagatctttgtggagaacctgcggcggcagaagagcctgcggctggagtgggagacccagcaggagctgaggaagatccgggagaaggaggagtggatcaagctggactaccacagaagacacaaccccaagaccaatgaagattttgagttcctgtacaatgccctggagttctggaggcaggaggagctgacccgcatcaaccagagcttcaccggggctgagaggaaggccgccctgtgtgagctgctggagaaggagacccagatcatcgccagcatcggccgccaccgctacatcgcctacatggccaaccaggaggccgccatccaggccttcctggacaagtgcagcgcccccaagatctggaggaccccaaatggcaagaccatcgagatggacacccagttcaccatccgggcccgggagctgcagaacatctacaagtgcatcatgctgaagaacatcagccaggatgagcggctggatgtgctgctgaccctgaagcacacagtgaaggagcacgagtgcaagctgacccaggagatcctggagctgattgaccgggaggtggacctgatgatgagaggagtgaagcaccacaacctggagggcctgaggaagagaattgccaccctcttcttccactacatcaagacccccctcttcaaccctgaggtggccaagtacctgaaggtgccccaggaccccctgaagttctacaagaagatctacttctgccacagctgccagctgtacctgcccagcacagagttctctgtgagcagcaccagccgccgcatctaccgctgcaggaactgcatcaacctgcagaatgaggcccagaagcgggagagcttcctgaagtacaagtgcctgctgcagcagctgtactacacagaggccgactatgaagatgacagcaagatcgccttcctgatgcagctgcaggacatccagtacctgacagagaacatctgggccagccagagcgtgctgagcgcctgtgacaacctgagtgacctggtgatggtgcgctggaacaagagcctggagtggagcccctggaactgcatcctgctgaccaaggatgaggccgccgcccacctgaagctgaccagcattgaggagggctatgaaagaagcttcatccacaagatcaagcacaagcacatcctggccaagaactacttcagccaggtgcctgtgctggccagcttcatcctggatgatggagaaattgatgagatccgctggaagtaccacagcgacaccacccccaagatcatcgagagccagaggcctccccactag

SEQ ID NO: 19028 - DNA, 1767 bp, Artificial Sequence
  Description of Artificial Sequence: Synthetic coding sequence
atgagcagctgtgtgagcagccagcccagcagcaacagagctgccccccaggatgagctgggcggccggggcagcagcagcagcgagagccagaagccctgtgaggccctgcggggcctgagcagcctgagcatccacctgggcatggagagcttcatcgtggtgacagaatgtgagcccggctgtgctgtggacctgggcctggcccgggaccggcccctggaggctgatggccaggaggtgcccctggacaccagcggcagccaggcccggccccacctgagcggcaggaagctgagcctgcaggagaggagccagggcggcctggccgccggcggcagcctggacatgaatggccgctgcatctgccccagcctgccctacagccctgtgagcagcccccagagcagcccccggctgccccggcggcccaccgtggagagccaccacgtgtccatcaccggcatgcaggactgtgtgcagctgaaccagtacaccctgaaggatgaaattggcaagggcagctatggagtggtgaagctggcctacaatgaaaatgacaacacctactatgccatgaaggtgctgagcaagaagaagctgatccggcaggccggcttcccccggcggcccccaccccggggcaccaggcctgcccctgggggctgcatccagccccggggccccatcgagcaggtgtaccaggagatcgccatcctgaagaagctggaccaccccaacgtggtgaagctggtggaggtgctggatgaccccaatgaagaccacctgtacatggtgtttgagctggtgaaccagggccctgtgatggaggtgcccaccctgaagcccctgtctgaggaccaggcccgcttctacttccaggacctgatcaagggcatcgagtacctgcactaccagaagatcatccaccgggacatcaagcccagcaacctgctggtgggggaggatggccacatcaagattgctgactttggagtgtccaatgagttcaagggcagtgatgccctgctgagcaacacagtgggcaccccagccttcatggcccctgagagcctgtctgagaccaggaagatcttcagcggcaaggccctggatgtgtgggccatgggcgtgaccctgtactgctttgtgtttggccagtgccccttcatggatgagcgcatcatgtgcctgcacagcaagatcaagagccaggccctggagttcccagaccagcctgacattgctgaggacctgaaggacctgatcaccaggatgctggacaagaaccctgagagcagaattgtggtgcctgagatcaagctgcacccctgggtgaccaggcatggagctgagcccctgcccagtgaagatgagaactgcaccctggtggaggtgacagaggaggaggtggagaacagcgtgaagcacatccccagcctggccaccgtcatcctggtgaagaccatgatcaggaagaggagctttggaaacccctttgagggcagccggcgggaggagaggagcctgagcgcccctggcaacctgctgaccaagaagcccacccgggagtgtgagagcctgtctgagctgaaggaggcccggcagaggcggcagcccccaggccacaggcctgccccccggggcggcggcggcagcgccctggtgcggggcagcccctgtgtggagagctgctgggccccagcccctggcagccctgccaggatgcaccccctgcggcctgaggaggccatggagcctgagtag

SEQ ID NO: 19029 - DNA, 2052 bp, Artificial Sequence
  Description of Artificial Sequence: Synthetic coding sequence
atggccctgagcaagcgggagctggatgagctgaagccctggattgagaagacagtgaagagggtgctgggcttcagcgagcccaccgtggtgacagctgccctgaactgtgtgggcaagggcatggacaagaagaaggctgctgaccacctgaagcccttcctggatgacagcaccctgcgctttgtggacaagctgtttgaagctgtggaggagggccgcagcagccgccacagcaagagcagcagtgacaggagcaggaagcgggagctgaaggaggtgtttggagatgattctgagatcagcaaggagagcagcggcgtgaagaagaggcgcatccccaggtttgaggaggtggaggaggagcctgaggtgattcctggccccccatctgagagccctggcatgctgaccaagctgcagatcaagcagatgatggaggccgccacccggcagatcgaggagaggaagaagcagctgtccttcatcagcccccccaccccccagcccaagacccccagcagcagccagcctgagcggctgcccatcggcaacaccatccagcccagccaggccgccaccttcatgaatgatgccatcgagaaggccaggaaggctgctgagctgcaggcccgcatccaggcccagctggccctgaagccaggcctgattggaaatgccaacatggtgggcctggccaacctgcacgccatgggcatcgccccacccaaggtggagctgaaggaccagaccaagcccacccccctcatcctggatgagcagggccgcacagtggatgccaccgggaaggagattgagctgacccacaggatgcccaccctgaaggccaacatccgggctgtgaagcgggagcagttcaagcagcagctgaaggagaagcccagcgaggacatggagagcaacaccttctttgacccccgggtgtccatcgcccccagccagaggcagaggaggaccttcaagttccatgacaagggcaagtttgagaagatcgcccagaggctgcggaccaaggcccagctggagaagctgcaggccgagatcagccaggccgccaggaagacaggcatccacaccagcacccggctggccctgattgcccccaagaaggagctgaaggagggggacatccctgagattgagtggtgggacagctacatcatccccaatggatttgacctgacagaggagaaccccaagcgggaggactacttcggcatcaccaacctggtggagcacccagcccagctgaacccccctgtggacaatgacacccctgtgaccctgggcgtgtacctgaccaagaaggagcagaagaagctgcggcggcagacccggcgggaggcccagaaggagctgcaggagaaggtgcggctgggcctgatgcctcctcctgagcccaaggtgcgcatcagcaacctgatgagggtgctgggcacagaagctgtgcaggaccccaccaaggtggaggcccacgtgcgggcccagatggccaagaggcagaaggcccacgaggaggccaatgctgccaggaagctgacagctgagcagaggaaggtgaagaagatcaagaagctgaaggaggacatcagccagggcgtgcacatctctgtgtacagagtgaggaacctgagcaacccagccaagaagttcaagattgaggccaatgccggccagctgtacctgactggagtggtggtgctgcacaaggatgtgaatgtggtggtggtggagggcggccccaaggcccagaagaagttcaagaggctgatgctgcaccgcatcaagtgggatgagcagaccagcaacaccaagggagatgatgatgaggagagtgatgaggaggccgtgaagaagaccaacaagtgtgtgctggtgtgggagggcacagccaaggacaggagctttggagagatgaagttcaagcagtgccccacagagaacatggcccgggagcacttcaagaagcacggggctgagcactactgggacctggccctgtctgagagcgtgctggagagcacagactag

SEQ ID NO: 19030 - DNA, 1938 bp, Artificial Sequence
  Description of Artificial Sequence: Synthetic coding sequence
atgtctgacaagagtgacctgaaggccgagctggagaggaagaagcagaggctggcccagatccgggaggagaagaagaggaaggaggaggagaggaagaagaaggaggccgacatgcagcagaagaaggagcctgtgcaggatgacagcgacctggacaggaagaggcgggagacagaggccctgctgcagagcatcggcatcagccctgagccccccctggtgcagcccctgcacttcctgacctgggacacctgctacttccactacctggtgcccacccccatgagccccagcagcaagtctgtgtccaccccatctgaggccggcagccaggacagcggggacctgggccccctgaccaggaccctgcagtgggacacagaccccagcgtgctgcagctgcagagcgacagcgagctgggccgccgcctgcacaagctgggcgtgtccaaggtgacccaggtggacttcctgccccgggaggtggtgtcctacagcaaggagacccagacccccctggccacccaccagagtgaagaagatgaggaggatgaggagatggtggagagcaaggtgggccaggacagcgagctggagaaccaggacaagaagcaggaggtgaaggaggccccaccccgggagctgacagaggaggagaagcagcagatcctgcacagcgaggagttcctgatcttctttgacaggaccatccgggtgattgagcgggccctggctgaagattctgacatcttctttgactacagcggccgggagctggaggagaaggatggagatgtgcaggccggggccaacctgtccttcaaccggcagttctatgatgagcactggagcaagcaccgggtggtgacctgcatggactggagcctgcagtacccagagctgatggtggccagctacaacaacaatgaagatgcccctcatgagccagatggagtggccctggtgtggaacatgaagttcaagaagaccaccccagaatatgtgttccactgccagagctctgtgatgtctgtgtgctttgcccgcttccaccccaacctggtggtgggcggcacctacagcggccagatcgtgctgtgggacaacagaagccacaggaggacccctgtgcagaggacccccctgtctgctgctgcccacacccaccctgtgtactgtgtgaatgtggtgggcacccagaatgcccacaacctgatcaccgtgtccacagatggcaagatgtgctcctggagcctggacatgctgagcaccccccaggagagcatggagctggtgtacaacaagagcaagcctgtggccgtgacaggcatggccttccccactggagatgtgaacaactttgtggtgggcagcgaggagggcaccgtgtacacagcctgccgccacggcagcaaggccggcatcggggaggtgtttgagggccaccagggccctgtgacaggcatcaactgccacatggctgtgggccccatcgacttcagccacctgtttgtgaccagcagctttgactggacagtgaagctgtggaccaccaagcacaacaagcccctgtacagctttgaagataatgctgactatgtgtatgatgtgatgtggagccctgtgcacccagccctgtttgcctgtgtggatggcatgggccgcctggacctgtggaacctgaacaatgacacagaggtgcccacagcctctgtggccattgaaggagccagcgccctgaacagagtgcgctgggcccaggccggcaaggaggtggccgtgggggacagcgagggccgcatctgggtgtatgatgtgggggagctggccgtgccccacaatgatgagtggaccaggtttgcccggaccctggtggagatccgggccaacagagctgacagcgaggaggagggcaccgtggagctgagcgcctag

SEQ ID NO: 19031 - DNA, 7806 bp, Artificial Sequence
  Description of Artificial Sequence: Synthetic coding sequence
atgaagaggaaggtggtgaacacccacaagctgcggctgagccccaatgaggaggccttcatcctgaaggaggactatgaaagaagaaggaagctgcggctgctgcaggtgcgggagcaggagcgggacatcgccctgcagatccgggaggacatcaagcagaggaggaaccagcagttcacccggctggccgaggagctgcgggcagagtgggaggagagccagacccagaagatccagaacctggagaagctgtacctggccagcctgcgctccatgggagagggccaccggcaggccaaggaaaatgaaccagacctggatgccctggcccagagagctgctgagaggaagaggaaggctgacctgcggcacaaggaggccctgaaggtgcagaagaaccagaaggagatcctgctgaagcagaagacctggcacatcaaggccaggaaggaggccctgctggtggagaaggagaggtctgccaagatcaccagcctgcccccacctccacccaccctgtttgagaacatcgaggtgaagaggatctctgctgtgaagaccaacagcagcacctaccaccacctgcacacctttgtgaaccgggagacagacaccaagaggccagatgcccggctggccgctgaggaggaggccaagaggctggaggagctgcagaagcaggccgcccaggagaggatggagagatttgagaaggcccacgtgcggggcttccaggccatgaagaagatccacctggcccagaaccaggagaagctgatgaaggagctgaagcagctgcagcaggaggacctggcccggcggcggcagacagtggcccagatgccaccccagctggtggagctgccctacaagaggtctgagatgaaggaggactggcagcgggagctggagtttgcctttgaggacatgtacaatgctgacaggaaggtgaagggcaacctgatcctgcacctggagcctgagcccctgcccaccgtgaccaaccagatccaggatgaggagctggacctgtccatggagcaggagaacctgggcgctgctgaggacctgcctgtgacagaagctgagatctgcagcagcgagacagatgtgcccctggtgatgaagacccagcagatccccagcaaggtgctcttcaagaagctgctgaacaagatccgcagccagaagagcctgtggaccatcaagtccatgtctgaagatgaaagtgagatgatcaccaccgtgtctgaaattgagagcaaggcccccaccgtggagagcggcaccatcgccagcaaggagaggaccctgagcagcggccaggagcaggtggtggagagtgacaccctgaccatcgagagcggccccctggccagcgaggacaagcccctgagctgtggcaccaacagcggcaaggagcaggagatcaatgagaccctgcccatcaccaccgtggcccagagctctgtgctgctgcacccccaggaggccgccgcccgcatccgcatgtctgcccggcagaagcagatcatggagattgaggagcagaagcagaagcagctggagctgctggagcagatcgagcagcagaagctgcggctggagacagactgcttccgggcccagctggaggaggagaagaggaagaagacccagcccaccggggtgggcatcgccccagccagctgccctgtgatcagtgatgaggacagccaccggcagatgatccggaactaccagcaccagctgctgcagcagaaccggctgcaccggcagagcgtggagacagccaggaagcagctgctggagtaccagaccatgctgaagggccgctgccccagcgtgtctgcccccagcctcatcacagacagcgtcatctctgtgcccagctggaagtctgagcggcccacagccatcagcgagcactgggaccagggccagaggctgaagctgagccccaacaagtaccagcccatccagcccatccagaccagcaagctggagcaggaccacttccaggtggcccggcagaaccacttcccccagaggcaggtggagaccacagagaccctgcgggccagtgacatcctgaccaaccaggccctggagagccaggagcacctgcggcagttcagccagacagagacccagcagagggactacaagctggtgcccaaggacagcgagaccctgagccgggccctgagccatgaccggcagctgatcagccaggatgccaggaagatcagcgagacctttggagccaccaccttccagagcctggagagccagcagctgttctctgaaaattctgagaacatctcctaccacctgacagagcccagcagctttgtgcccctggtgccccagcacagcttcagcagcctgcctgtgaaggtggagagcggcaagatccaggagcccttcagcgccatgagcaagagcacagtgtccaccagccacagcatcatcagccagatgcatgaccggcccctgctgcccagcgagaacatcacagcccagcagggcaacatgaaggccctgcaggagcagctggacctgcagaagaaggtgctgcaggccacccaggaggcccaggagcagctgctgctgtgcaagcagaaggaggtggagcagcagacaggcctgagcgtcttcctgcccctggtgaccccagacagcagcgccctgctgcccagcgccaaggctgacctgggccgcatccaggagagcagccccaccaagaacaacattgctgtgtccagtgaccaccacgtgatcagccagctgcaggacaagaggctgagcctgagccagcccatcctgagccagcagaacaacttcaagttcctgcaggagcagctgaacatccagaaggacagcctgcaggcccggcgggaggcccaggaggtgctgtatgtgcacaagcagagcgagctggaccggcgggtgtgcagcgagcaggccgagcccagcttccccttccaggtggcccagcacaccttcaccagcctgcccagcgctgacaccaagagcggcaagatccaggagcagcacagcagcaagtctgagaagggcctggtgtcctgccagagcgacatccccatcagccaggacggcagcctgtccttcctgcagcagttcctgcccctgcatgacagcctgaagctgctgcaggagcagctgaccaagcagagggacaccctgcaggcccggcatgaggcccaggtggagctgctgctgcaccggcagagggacctgggggacagcaagagcggcctggtgagcagcagcagcagccctgtggtggtgcagcacagcgtggccagccaggccagcgccaaggccgagccccggcgcatccaggagctgtacctgtctgagaaggaaaatgtgggccccagctgccacctgatcatccccaccttccaggacaagagcctgtccttcccccagcacagcctggcccagcaggagaacctgaccatcctgcaggagcagagccagatccagagggtcatcctgggcgccaaggagggcacccaggagtttgtgcacacagaaagtgagctggagaagaggatcagcagcgagcagacaggcaccagcagcagcctgagccaggtggatgagagcgagcgcttccaggagtgcatcagcatcaagagtgacagcaccatccccctgagccaccccaagatcccccgctgccaggagcggctgctgcgggtgtcccagcacatgctgcccctgcaggacaacctggaggagcaccaggcctggctggacacagagaaggaggccttccacttcagccagaagacccaggagaacaccagcagcgagcagacaggcagcagcagcttcatcccccagctggtgcagctgtccttcaccagcctggccagcgctgagagcggcaccatcctggagcccctcttcacagaaagtgagagcaagatcttcagcagccacctgcagatcccccagctgcaggaccggctgctgcgcatcagccagctgatccagccccagcaggacaacctgaaggccctgcaggagcagctggccacccagcgggaggccatcatcctggcccggcaggaggcccgggaggagctgctgctgcaccagagcgagtgggagggccgcatcagccctgagcaggtggacaccagcagcctgcccctggtgccccagcacagctttgccagcctgcccctgaatgaaagtgaaagaaaccaggagccctgcagcatcaacagcgacaacatcgtgagcagcggccacagcgagatccccaccctgcctgatggcctgctgggcctgagccacctggtgctgccccagcaggacaacctgattgccctggaggagcacctgcacgcccagacagacttcctgcccagcattgagaagacccagaaggagctggtgctgagcaagccctgcaagtttgaggagaaggtgagcagcgagcacttcatccagagccaccacggggacctgcaggccctgcagcagcagctggacacccagaagaaggccatccgcagcatccaggaggtgcaggaggagctgctgctgcagaggctgtctgagctggagaagagggtgtcctctgagcaggtgtgcagcagcagctttgtgtcccaggtgcctgtggccgacagcgagaggacccagaagagcttccccaccaagagcaatgacaccctgcccagcagccaccgggagatcccccggctgcaggaccggctgctgagcctgagcaagcccatcctgccccagcaggacaacatgacagcccagctggatgcccagcgggaggtgatgtacagctatgagaagccccaggaggagctgagcctgaacaagcagaggaagctgaacaagtctgagagcgctgagcacaccatccccagcctcttcctgcccaaggagacagagcacagcttcatccccctgccctttgctgaggccaagcccaagagcacctgtgagctgtacagcagccagaatgagcacgccgccccacccagcaaccctgtgattcctggcttccaggaccggctgctgtccttcagccagagcgtgctgacccagcaggacaacctgggcctgcagaagcagctggacctgcagcgggaggtgctgcactacagccagaaggcccaggagaagctgctggtgcagaggcagacagccctgcagcagcagatccagaagcatgaggagaccctgaaggacttcttcaaggacagccagatcagcaagcccaccgtggagaatgacctgaagacccagaagatgggccagctgcgggactggttccccaacacccaggacctggccggaaatgaccaggagaacatcagacatgctgacaggaacaacagtgatgacaaccacctggccagcgaggacaccagcgccaagcagagcggggagcacctggagaaggacctgggcagaagaagcagcaagccccctgtggccaaggtgaagtgtggcctggacctgaaccagcacgagctgagcgccatccaggaggtggagagccctgccatcggccgcaccagcatcctgggcaagccaggcatctatgaggaccgggaccccctgcgggtgtccatcagccgggagcagagcttcttcggcagccccctggcccatgaccccttcagctgcctgcagctggtgggccaggagaatgtgtgtggagatgattatgatgaggccgtgaagctgaaggagagcgtggtggagaaccacgctgtgctgtcctatgctgtggaggaggagcacgcctacctgggccccaccgtgaagccagatgacaaggccaagaccctgtcctatgagcccctgagcagcgccaccgtgtccacaggcagcctgctgtcctatgaaaatacagacctgagcctgacagatcctgagagcttcagcgagcacatggatgacagcaagcaggagagcaccaccagcaaggaggaggagaccaacatcatcagcagcatcgtgcccagcacccaggacatctaccagaggcagaacagcagtgatgtgcacaagagcctgctgcctgctgtggatgagaccacctgtggccacacccacttccagcagatgattgacaagtacatcaatgaggccaacctgatccctgagaagacagacctgcaggagctggagcacatcttccccaacctgcaccaccagctgttcaagcccctggagccccacccagactttgacctgagcagcagcagcagcggcatcagcccagacaacagagacttctaccagaggagtgacagcagcagcgagagccactgtgccaccggcctgagcaagagcacagtgtacttcaccgccctgcggaggacctccatgcacagcagcctgaacaccagccccaaccagcagcctgacaccaacctggcccacgtgggcgcccacagctttgccacagagaacatcattggaggcagcgagcagtgctttgagcagctgcagcctgagtacagcagccaggaggagagccagcacgccgacctgcccagcatcttcagcattgaggcccgggacagcagccagggcatgaagaaccagaactaccccagcgaggagcacacagagatcctgcagaacaagaagaagatcgtgcacttccagctgagcatcggcaacctgagctctgtgtacagcagcagtgatgaggccaacgtgtttgaccagctgaatgtgcagcacagcaccccctgtggcagcaacagcagtgaatgttccaccaagcaccagctggagagcaggaaggagagcatgggctttgaggagctgagcaagaggggcgtggtgaccatgctgcagagccagggcctgattgaggacaacaagaatgagacctgccgggtgctggacatcaacccccaggtggaggagacagacagccggctgtgtgtgaggacagtggagatgggcaccagcatccaggccccctacagcctgaccacccagaatgagaagtactttgaaaattctgctgagacagacatccccaagatcaccaagaagctgagccagctgggggagagcgagctgtttgccagcagcggcagcttcagcctgcagagcagcatccctgtgtgggagacagaaacaggccacggcatcatggaggagcctgagctgaccctcatcagcaccacagacaccagcattgctgagatggactttgccaacctgaccctggaggagaagtcagaaaatgaggccaagtgcttcttccaggtgtctgagttcctgcccctggtgtctgccacagaggccagtgactacccagctgtgtctgagctgagcattgagaagcccaggacagccagcacagagaccccccggcggctgacccctgtgcccggcagcctgcaggaggccttcatcaagaggaagaagagcttcatggagaggagccaccagaggcagaaggagatccggaacaagatccacgtgtctgagaacagccagatcaagacagtgaaggagaagcccagcatcagcagctctgtgtcccggctgaagggcgtgaacaaggtgcgggccagcttccctgaggacaggaagaccacccaggccctgcggcaccagaggggcctgcggctgtacaaccagctggccgaggtgaagcagcagaaggaggagaagaccaagcaggaggcctatgcccagaacagagcccgggccaaggagttccacaagaagaccctggagaagctgcgggccaagaacacctgctag

SEQ ID NO: 19032 - DNA, 2397 bp, Artificial Sequence
  Description of Artificial Sequence: Synthetic coding sequence
atggccgccagcctgcccggccctggcagccgcctcttccgcacctacggggctgctgatggccggcggcagaggaggcctggccgggaggccgcccagtggttccccccccaggacagaagacgcttcttcaacagcagcggcagcagtgatgccagcatcggggaccccagccagagtgatgatcctgatgatcctgatgatcctgacttccctggcagccctgtgagaagaagaagaagaagacctgggggccgggtgcccaaggaccggcccagcctgactgtgacccccaagcgctggaagctgcgggcccggcccagcctgactgtgaccccccggcggctgggcctgcgggcccggcccccccagaagtgcagcaccccctgtggccccctgcggctgccccccttccccagccgggacagcggccgcctgagcccagacctgtctgtgtgtggccagcccagagatggagatgagctgggcatcagcgccagcctcttcagcagcctggccagcccctgccccggcagccccaccccccgggacagcgtcatcagcatcggcaccagcgcctgcctggtggccgccagcgctgtgcccagcggcctgcacctgcctgaggtgtccctggaccgggccagcctgccctgcagccaggaggaggccactggaggagccaaggacaccaggatggtgcaccagacccgggccagcctgcggtctgtgctgtttggcctgatgaacagcggcaccccagaagattctgagttccgggcagatggcaagaacatgagggagagctgctgcaagaggaagctggtggtgggcaatggacctgagggccctggcctgagcagcacaggcaagaggcgggccaccggccaggacagctgccaggagcggggcctgcaggaggccgtgcggcgggagcaccaggaggcctctgtgcccaagggcagaattgtgccccggggcatcgaccggctggagaggaccaggagcagcaggaagagcaagcaccaggaggccacagagaccagcctgctgcacagccaccgcttcaagaagggccagaagctgggcaaggacagcttccccacccaggacctgacccccctgcagaatgtgtgcttctggaccaagacccgggccagcttctccttccacaagaagaagatcgtgacagatgtgtctgaggtgtgcagcatctacaccacagccaccagcctgagcggcagcctgctgtctgaatgtagcaacagacctgtgatgaacagaaccagcggggcccccagctcctggcacagcagctccatgtacctgctgagccccctgaacaccctgagcatcagcaacaagaaggccagtgatgctgagaaggtgtatggagagtgcagccagaagggccctgtgcccttcagccactgcctgcccacagagaagctgcagagatgtgagaagatcggggagggcgtgtttggagaggtgttccagaccatcgctgaccacacccctgtggccatcaagatcatcgccatcgagggccctgacctggtgaatggcagccaccagaagacctttgaggagatcctgcctgagatcatcatcagcaaggagctgagcctgctgagcggggaggtgtgcaacagaacagagggcttcatcggcctgaacagcgtgcactgtgtgcagggcagctacccacccctgctgctgaaggcctgggaccactacaacagcaccaagggcagcgccaatgacagaccagacttcttcaaggatgaccagctgttcatcgtgctggagtttgaatttggaggcatcgacctggagcagatgaggaccaagctgagcagcctggccacagccaagagcatcctgcaccagctgacagccagcctggccgtggccgaggccagcctgcgctttgagcaccgggacctgcactggggcaatgtgctgctgaagaagaccagcctgaagaagctgcactacaccctgaatggcaagagcagcaccatccccagctgtggcctgcaggtgtccatcatcgactacaccctgagccggctggagagagatggcatcgtggtgttctgtgatgtgtccatggatgaggacctcttcaccggagatggagactaccagtttgacatctaccgcctgatgaagaaggagaacaacaaccgctggggcgagtaccacccctacagcaatgtgctgtggctgcactacctgacagacaagatgctgaagcagatgaccttcaagaccaagtgcaacaccccagccatgaagcagatcaagaggaagatccaggagttccacaggaccatgctgaacttcagcagcgccacagacctgctgtgccagcacagcctcttcaagtag

SEQ ID NO: 19033 - DNA, 765 bp, Artificial Sequence
  Description of Artificial Sequence: Synthetic coding sequence
atggtgcgggaggccaacatcaagcaggccacagctgagaagcagctgaaggaggcccagggcaagattgatgtgctgcaggccgaggtggccgccctgaagaccctggtgctgagcagcagccccaccagccccacccaggagcccctgcccggcggcaagacccccttcaagaagggccacaccaggaacaagagcaccagcagcgccatgagcggcagccaccaggacctgagcgtcatccagcccatcgtgaaggactgcaaggaggccgacctgagcctgtacaatgagttccggctgtggaaggatgagcccaccatggacaggacctgccccttcctggacaagatctaccaggaggacatcttcccctgcctgaccttcagcaagtctgagctggccagcgctgtgctggaggccgtggagaacaacaccctgagcattgagcctgtgggcctgcagcccatccgctttgtgaaggccagcgctgtggagtgtggcggccccaagaagtgtgccctgaccggccagagcaagagctgcaagcaccgcatcaagctgggggacagcagcaactactactacatcagccccttctgccgctaccgcatcacctctgtgtgcaacttcttcacctacatccgctacatccagcagggcctggtgaagcagcaggatgtggaccagatgttctgggaggtgatgcagctgaggaaggagatgagcctggccaagctgggctacttcaaggaggagctgtag

SEQ ID NO: 19034 - DNA, 1077 bp, Artificial Sequence
  Description of Artificial Sequence: Synthetic coding sequence
atgtatgccagccagtggttcctgaccctcttcaccgccaagttccccctgtgcatggtgttccacatcatcgacctgctgctgtgtgagggcctgaacatcatcttccacgtggccctggccctgctgaagaccagcaaggaggacctgctgcaggccgactttgaaggagccctgaagttcttccgggtgcagctgcccaagcgctacagagctgaggagaatgcccggcggctgatggagcaggcctgcaacatcaaggtgcccaccaagaagctgaagaagtatgagaaggagtaccagaccatgagggagagccagctgcagcaggaggaccccatggaccgctacaagcgggagaacagaaggctgcaggaggcctccatgaggctggagcaggagaatgatgacctggcccacgagctggtgaccagcaagatcgccctgagaaatgacctggaccaggccgaggacaaggcagatgtgctgaacaaggagctgctgctgaccaagcagaggctggtggagacagaggaggagaagaggaagcaggaggaggagacagcccagctgaaggaggtgttcaggaagcagctggagaaggccgagtatgagatcaagaagaccacagccatcatcgccgagtacaagcagatctgcagccagctgagcacccggctggagaagcagcaggccgccagcaaggaggagctggaggtggtgaagggcaagatgatggcctgcaagcactgcagcgacatcttcagcaaggagggcgccctgaagctggccgccaccggccgggaggaccagggcattgaaacagatgatgagaaggacagcctgaagaagcagctgcgggagatggagctggagctggcccagaccaagctgcagctggtggaggccaagtgcaagatccaggagctggagcaccagagaggagccctgatgaatgagatccaggccgccaagaacagctggttcagcaagaccctgaacagcatcaagacagccaccggcacccagcccctgcagcctgcccctgtgacccagccccccaaggagagcacctag

SEQ ID NO: 19035 - DNA, 2436 bp, Artificial Sequence
  Description of Artificial Sequence: Synthetic coding sequence
atgcccctgagcagccccaatgctgctgccacagccagtgacatggacaagaacagcggcagcaacagcagcagcgccagcagcggcagcagcaagggccagcagccccccaggtctgccagcgctggccctgctggggagagcaagcccaagagtgatggcaagaacagcagcggcagcaagcgctacaacaggaagcgggagctgagctaccccaagaatgaaagcttcaacaaccagagccgccgcagcagcagccagaagagcaagaccttcaacaagatgccaccccagaggggcggcggcagcagcaagctgttcagcagcagcttcaacggcggcagaagagatgaggtggccgaggcccagagagctgagttctccccagcccagttcagcggccccaagaagatcaacctgaaccacctgctgaacttcacctttgagccccggggccagacaggccactttgagggcagcggccacggctcctggggcaagaggaacaagtggggccacaagcccttcaacaaggagctgttcctgcaggccaactgccagtttgtggtgtctgaggaccaggactacacagcccactttgctgaccctgacaccctggtgaactgggactttgtggagcaggtgcgcatctgcagccatgaggtgcccagctgccccatctgcctgtacccacccacagctgccaagatcacccgctgtggccacatcttctgctgggcctgcatcctgcactacctgagcctgtctgagaagacctggagcaagtgccccatctgctacagctctgtgcacaagaaggacctgaagtctgtggtggccacagagagccaccagtatgtggtgggggacaccatcaccatgcagctgatgaagcgggagaagggcgtgctggtggccctgcccaagagcaagtggatgaatgtggaccaccccatccacctgggagatgagcagcacagccagtacagcaagctgctgctggccagcaaggagcaggtgctgcaccgggtggtgctggaggagaaggtggccctggagcagcagctggccgaggagaagcacaccccagagagctgcttcatcgaggccgccatccaggagctgaagacccgggaggaggccctgagcggcctggccggcagcagaagagaggtgactggagtggtggccgccctggagcagctggtgctgatggcccccctggccaaggagagcgtcttccagcccaggaagggcgtgctggagtacctgagcgcctttgatgaggagaccacagaggtgtgcagcctggacacccccagccggcccctggccctgcccctggtggaggaggaggaggccgtgtctgagcctgagcctgagggcctgcctgaggcctgtgatgacctggagctggctgatgacaacctgaaggagggcaccatctgcacagagagcagccagcaggagcccatcaccaagagcggcttcacccggctgagcagcagcccctgctactacttctaccaggccgaggatggccagcacatgttcctgcaccctgtgaatgtgcgctgcctggtgcgggagtatggcagcctggagaggagccctgagaagatcagcgccaccgtggtggagattgctggctacagcatgtctgaagatgtgcggcagaggcaccgctacctgagccacctgcccctgacctgtgagttcagcatctgtgagctggccctgcagccccctgtggtgtccaaggagaccctggagatgttcagtgatgacatcgagaagaggaagaggcagaggcagaagaaggcccgggaggagaggagaagagagcggcgcatcgagattgaggagaacaagaagcagggcaagtacccagaggtgcacatccccctggagaacctgcagcagtttcctgccttcaacagctacacctgcagcagtgacagcgccctgggccccaccagcacagagggccacggggccctgagcatcagccccctgagccgcagccctggcagccacgccgacttcctgctgacccccctgagccccacagccagccagggcagccccagcttctgtgtgggcagcctggaggaggacagccccttccccagctttgcccagatgctgcgggtgggcaaggccaaggcagatgtgtggcccaagacagcccccaagaaggatgagaacagcctggtgcccccagcccctgtggacagtgatggagagagtgacaacagcgacagagtgcctgtgcccagcttccagaacagcttcagccaggccattgaagctgccttcatgaagctggacaccccagccaccagtgaccccctgtctgaggagaagggcggcaagaagaggaagaagcagaagcagaagctgctcttcagcacctctgtggtgcacaccaagtag

SEQ ID NO: 19036 - DNA, 5826 bp, Artificial Sequence
  Description of Artificial Sequence: Synthetic coding sequence
atgaagaccagtgacctggtgcccagctttggctacttcatccgcagccctgagaagcgggagcccatcgccctgatcaggaagagtgatgtgtcccggggcaacctggagaaggagatggcccacctgaaccacgacctgtacagcggggacctgaatgagcagagccaggcccagctgtctgagggcagcatcaccctgcaggtggaggccgtggagagcaccagccaggtggatgaaaatgatgtgaccctgacagctgacaagggcaagacagaggacaccttcttcatgagcaacaagccccagcgctacaaggacaagctgcctgacagcggggacagcatgctgcgcatcagcaccatcgccagcgccatcgccgaggcctctgtgaacacagaccccagccagctggccgccatgatcaaggccctgagcaacaagacccgggacaagaccttccaggaggatgagaagcagaaggactacagccacgtgcgccacttcctgcccaatgacctggagaagagcaatggcagcaatgccctggacatggagaagtacctgaagaagacagaggtgagccgctatgaaagtgccctggagaacttcagccgggcctccatgtctgacacctgggacctgagcctgcccaaggagcagaccacccaggacatccaccctgtggacctgagcgccacctctgtgtctgtgcgggccccagaagaaaatacagctgccatcgtgtatgtggagaatggagagagcgagaaccaggagagcttccgcaccatcaacagcagcaacagcgtgaccaaccgggagaacaacagcgctgtggtggatgtgaagacctgcagcattgacaacaagctgcaggatgtgggcaatgatgagaaggccaccagcatcagcacccccagcgacagctacagctctgtgaggaacccccgcatcaccagcctgtgcctgctgaaggactgtgaggagatccgggacaaccgggagaaccagaggcagaatgaatgtgtgtctgagatcagcaacagcgagaagcacgtgacctttgagaaccacagaattgtgagccccaagaacagcgacctgaagaacaccagccctgagcacggcggccggggctctgaagatgagcaggagagcttccggcccagcaccagccccctgagccacagcagccccagcgagatcagcggcaccagcagcagcggctgtgccctggagagctttggcagcgctgcccagcagcagcagcccccctgtgagcaggagctgagccccctggtgtgcagccctgctggggtgtcccggctgacctacgtgtctgagcctgagagcagctaccccaccacagccacagatgatgccctggaggacaggaagagtgacatcaccagcgagctgagcaccaccatcatccagggcagccctgctgccctggaggagcgggccatggagaagctgcgggagaaggtgcccttccagaacagaggcaagggcaccctgagcagcatcatccagaacaacagcgacaccaggaaggccacagagaccaccagcctgagcagcaagccagaatatgtgaagccagacttccgctggagcaaggaccccagcagcaagagcggcaacctgctggagaccagcgaggtgggctggaccagcaaccctgaggagctggaccccatccggctggccctgctgggcaagagcggcctgagctgccaggtgggcagcgccaccagccaccctgtgtcctgccaggagcccattgatgaggaccagaggatcagccccaaggacaagagcacagctggccgggagttcagcggccaggtgagccaccagaccaccagcgagaaccagtgcacccccatccccagcagcacagtgcacagctctgtggccgacatgcagaacatgcctgctgctgtgcacgccctgctgacccagcccagcctgtctgctgccccctttgcccagcgctacctgggcaccctgcccagcacaggcagcaccaccctgccccagtgccacgccggaaatgccaccgtgtgtggcttcagcggcggcctgccctacccagctgtggccggggagcctgtgcagaacagcgtggccgtgggcatctgcctgggcagcaacatcggcagcggctggatgggcaccagcagcctgtgcaacccctacagcaacaccctgaaccagaacctgctgagcaccaccaagcccttccctgtgcccagcgtgggcaccaactgtggcatcgagccctgggacagcggcgtgaccagcggcctgggctctgtgcgggtgcctgaggagctgaagctgccccacgcctgctgcgtgggcatcgccagccagaccctgctgtctgtgctgaaccccacagaccgctggctgcaggtgtccattggagtgctgagcatctctgtgaatggagagaaggtggacctgagcacctaccgctgcctggtgttcaagaacaaggccatcatccggccccacgccacagaggagatcaaggtgctcttcatccccagcagccctggggtcttccgctgcaccttctctgtggcctcctggccctgcagcacagatgctgagaccatcgtgcaggccgaggccctggccagcacagtgaccctgacagccatcgccgagagccctgtgattgaggtggagacagagaagaaggatgtgctggactttggagacctgacctacggcggctggaaggccctgcccctgaagctgatcaacagaactcatgccaccgtgcccatccgcctcatcatcaatgccaatgctgtggcctggcgctgcttcaccttcagcaaggagagcgtgcgggcccctgtggaggtggccccctgtgctgatgtggtgacccggctggccggccccagcgtggtgaaccacatgatgcctgccagctatgatggccaggaccctgagttcctgatgatctgggtgctcttccacagccccaagaagcagatcagcagcagtgacatcctggacagcgctgaggagttcagcgccaaggtggacatcgaggtggacagccccaaccccacccctgtgctgcggtctgtgtccctgcgggcccgggccggcatcgcccgcatccacgccccccgggacctgcagaccatgcacttcctggccaaggtggccagcagcaggaagcagcacctgcccctgaagaatgccggcaacatcgaggtgtacctggacatcaaggtgcctgagcagggcagccacttctctgtggaccccaagaacctgctgctgaagccaggagaggagcacgaggtgattgtgtccttcacccccaaggaccctgaggcctgtgaggagcgcatcctgaagatctttgtgcagcccttcggcccccagtatgaggtggtgctgaagggggaggtgatcagcagcggcagcaagcccctgagccctggcccctgcctggacatccccagcatcctgagcaacaagcagttcctggcctggggcggcgtgcccctgggccgcacccagctgcagaagctggccctgaggaacaacagcgccagcaccacccagcacctgcggctgctgatccggggccaggaccaggactgcttccagctgcagaacaccttcggcagcgagcagaggctgaccagcaactgtgagatccgcatccaccccaaggaggacatcttcatctctgtgctgtttgcccccacccggctgagctgcatgctggcccggctggagatcaagcagctgggcaacagaagccagcccggcatcaagttcaccatccccctgagcggctacggcggcaccagcaacctgatcctggagggcgtgaagaagctgagtgacagctacatggtgacagtgaatggcctggtgcctgggaaggagagcaagatcgtgttttctgtgaggaacacaggcagccgggccgcctttgtgaaggctgtgggcttcaaggacagccagaagaaggtgctgctggaccccaaggtgctgcgcatcttcccagacaagtttgtgctgaaggagaggacccaggagaatgtgaccctcatctacaaccccagcgaccggggcatcaacaacaagacagccacagagctgagcacagtgtacctgtttggaggagatgagatcagccggcagcagtacagaagagccctgctgcacaagccagagatgatcaagcagatcctgcctgagcacagcgtgctgcagaacatcaactttgtggaggccttccaggatgagctgctggtgacagaggtgtatgacctgccccagaggcccaatgatgtgcagctgttctacggctccatgtgcaagatcatcctgagcgtcatcggggagttccgggactgcatcagcagccgggagttcctgcagcccagcagcaaggccagcctggagagcaccagtgacctgggcgccagcggcaagcatggaggaaatgtgtccctggatgtgctgcctgtgaagggcccccagggcagccccctgctgagccgggccgcccggccccccctggaccagctggccagcgaggagccctggacagtgctgcctgagcacctgatcctggtggcccccagcccctgtgacatggccaagacaggccgcttccagatcgtgaacaacagcgtgcggctgctgcgctttgagctgtgctggccagcccactgcctgactgtgaccccccagcacggctgtgtggcccctgagagcaagctgcagatcctggtgagccccaacagcagcctgagcaccaagcagagcatgttcccctggagcggcctcatctacatccactgtgatgatggccagaagaagatcgtgaaggtgcagatccgggaggacctgacccaggtggagctgctgacccggctgaccagcaagcccttcggcatcctgagccctgtgtctgagcccagcgtgagccacctggtgaagcccatgaccaagccacccagcaccaaggtggagatccggaacaagagcatcaccttccccaccacagagcccggggagaccagcgagagctgcctggagctggagaaccacggcaccacagatgtgaagtggcacctgagcagcctggccccaccctacgtgaagggcgtggatgagagcggagatgtgttccgggccacctatgctgccttccgctgcagccccatcagcggcctgctggagagccacggcatccagaaggtgtccatcaccttcctgccccggggccgcggggactatgcccagttctgggatgtggagtgccaccccctgaaggagccccacatgaagcacaccctgcgcttccagctgagcggccagagcattgaagcagaaaatgaaccagaaaatgcctgcctgagcacagacagcctcatcaagattgaccacctggtgaagccccggcggcaggccgtgtctgaggccagcgcccgcatccctgagcagctggatgtgacagcccggggcgtgtatgccccagaagatgtgtaccgcttccggcccacctctgtgggggagagcaggaccctgaaggtgaacctgaggaacaacagcttcatcacccacagcctgaagttcctgagcccccgggagcccttctacgtgaagcacagcaagtacagcctgcgggcccagcactacatcaacatgcctgtgcagttcaagcccaagtctgctgggaagtttgaggccctgctggtgatccagacagatgagggcaagagcatcgccatccgcctcatcggggaggccctgggcaagaactag

SEQ ID NO: 19037 - DNA, 4167 bp, Artificial Sequence
  Description of Artificial Sequence: Synthetic coding sequence
atggcccctggctgcaagacagagctgcggtctgtgaccaacggccagagcaaccagcccagcaatgaaggagatgccatcaaggtgtttgtgcgcatccggcccccagctgagaggagcggcagcgcagatggagagcagaacctgtgcctgtctgtgctgagcagcaccagcctgcggctgcacagcaaccctgagcccaagaccttcacctttgaccacgtggctgatgtggacaccacccaggagagcgtgtttgccaccgtggccaagagcatcgtggagagctgcatgagcggctacaacggcaccatctttgcctacggccagacaggcagcggcaagaccttcaccatgatgggccccagcgagagtgacaacttcagccacaacctgcggggcgtcatccccaggagctttgagtacctgttcagcctgattgaccgggagaaggagaaggccggggccggcaagagcttcctgtgcaagtgcagcttcatcgagatctacaatgagcagatctatgacctgctggacagcgccagcgctggcctgtacctgcgggagcacatcaagaagggcgtgtttgtggtgggcgctgtggagcaggtggtgaccagcgctgctgaggcctaccaggtgctgagcggcggctggaggaacagaagagtggccagcacctccatgaaccgggagagcagccgcagccatgctgtgttcaccatcaccatcgagagcatggagaagagcaatgaaattgtgaacatccgcaccagcctgctgaacctggtggacctggccggcagcgagcggcagaaggacacccatgctgagggcatgaggctgaaggaggccggcaacatcaacagaagcctgagctgcctgggccaggtgatcacagccctggtggatgtgggcaatggcaagcagagacatgtgtgctacagagacagcaagctgaccttcctgctgcgggacagcctgggcggcaatgccaagacagccatcatcgccaacgtgcaccctggcagccgctgctttggagagaccctgagcaccctgaactttgcccagagggccaagctgatcaagaacaaggctgtggtgaatgaagacacccagggcaatgtgtcccagctgcaggccgaggtgaagaggctgaaggagcagctggccgagctggccagcggccagaccccacctgagagcttcctgacccgggacaagaagaagaccaactacatggagtacttccaggaggccatgctgttcttcaagaagtctgagcaggagaagaagagcctcatcgagaaggtgacccagctggaggacctgaccctgaagaaggagaagttcatccagagcaacaagatgattgtgaagttccgggaggaccagatcatccggctggagaagctgcacaaggagagcagaggaggcttcctgcctgaggagcaggaccggctgctgtctgagctgagaaatgagatccagaccctgcgggagcagatcgagcaccacccccgggtggccaagtatgccatggagaaccacagcctgcgggaggagaacagaaggctgcggctgctggagcctgtgaagagggcccaggagatggatgcccagaccatcgccaagctggagaaggccttcagcgagatcagcggcatggagaagagtgacaagaaccagcagggcttcagccccaaggcccagaaggagccctgcctgtttgccaacacagagaagctgaaggcccagctgctgcagatccagacagagctgaacaacagcaagcaggagtatgaggagttcaaggagctgaccaggaagaggcagctggagctggagagcgagctgcagagcctgcagaaggccaacctgaacctggagaacctgctggaggccaccaaggcctgcaagaggcaggaggtgtcccagctgaacaagatccatgctgagaccctgaagatcatcaccacccccaccaaggcctaccagctgcacagcaggcctgtgcccaagctgagccctgagatgggcagctttggcagcctgtacacccagaacagcagcatcctggacaatgacatcctgaatgaacctgtgcccccagagatgaatgagcaggcctttgaggccatcagcgaggagctgaggacagtgcaggagcagatgtctgccctgcaggccaagctggatgaggaggagcacaagaacctgaagctgcagcagcacgtggacaagctggagcaccacagcacccagatgcaggagctgttcagcagcgagagaattgactggaccaagcagcaggaggagctgctgagccagctgaatgtgctggagaagcagctgcaggagacccagaccaagaatgacttcctgaagtctgaggtgcatgacctgcgggtggtgctgcacagcgctgacaaggagctgagctctgtgaagctggagtacagcagcttcaagaccaaccaggagaaggagttcaacaagctgtctgagcggcacatgcacgtgcagctgcagctggacaacctgcggctggagaatgagaagctgctggagagcaaggcctgcctgcaggacagctatgacaacctgcaggagatcatgaagtttgaaattgaccagctgagcaggaacctgcagaacttcaagaaggaaaatgagaccctgaagagtgacctgaacaacctgatggagctgctggaggccgagaaggagaggaacaacaagctgagcctgcagtttgaggaggacaaggagaacagcagcaaggagatcctgaaggtgctggaggccgtgcggcaggagaagcagaaggagacagccaagtgtgagcagcagatggccaaggtgcagaagctggaggagagcctgctggccacagagaaggtgatcagcagcctggagaagagccgggacagcgacaagaaggtggtggccgacctgatgaaccagatccaggagctgcggacctctgtgtgtgagaagacagagaccatcgacaccctgaagcaggagctgaaggacatcaactgcaagtacaacagcgccctggtggaccgggaggagagccgggtgctgatcaagaagcaggaggtggacatcctggacctgaaggagaccctgcggctgcgcatcctgtctgaggacatcgagcgggacatgctgtgtgaggacctggcccacgccacagagcagctgaacatgctgacagaggccagcaagaagcacagcggcctgctgcagagcgcccaggaggagctgaccaagaaggaggccctgatccaggagctgcagcacaagctgaaccagaagaaggaggaggtggagcagaagaagaatgagtacaacttcaagatgaggcagctggagcacgtgatggacagcgctgctgaggacccccagagccccaagaccccaccccacttccagacccacctggccaagctgctggagacccaggagcaggagattgaagatggccgggccagcaagaccagcctggagcacctggtgaccaagctgaatgaagatcgggaggtgaagaatgctgagatcctgaggatgaaggagcagctgcgggagatggagaacctgcggctggagagccagcagctgattgagaagaactggctgctgcagggccagctggatgacatcaagaggcagaaggagaacagcgaccagaaccacccagacaaccagcagctgaagaatgagcaggaggagagcatcaaggagcggctggccaagagcaagatcgtggaggagatgctgaagatgaaggctgacctggaggaggtgcagagcgccctgtacaacaaggagatggagtgcctgaggatgacagatgaggtggagaggacccagaccctggagagcaaggccttccaggagaaggagcagctgcggagcaagctggaggagatgtatgaggagcgggagaggaccagccaggagatggagatgctgaggaagcaggtggagtgcctggccgaggagaatggcaagctggtgggccaccagaacctgcaccagaagatccagtatgtggtgcggctgaagaaggaaaatgtgcggctggccgaggagacagagaagctgcgggcagaaaatgtgttcctgaaggagaagaagaggtctgagagctag

SEQ ID NO: 19038 - DNA, 4767 bp, Artificial Sequence
  Description of Artificial Sequence: Synthetic coding sequence
atgctgccccccaagcacctgagcgccaccaagcccaagaagtcctgggcccccaacctgtatgagctggacagcgacctgaccaaggagccagatgtgatcattggagagggccccacagacagcgagttcttccaccagcgcttcaggaacctgatctacgtggagtttgtgggccccaggaagaccctcatcaagctgaggaacctgtgcctggactggctgcagcctgagaccaggaccaaggaggagatcatcgagctgctggtgctggagcagtacctgaccatcatccctgagaagctgaagccctgggtgcgggccaagaagccagagaactgtgagaagctggtgaccctgctggagaactacaaggagatgtaccagccagaagatgacaacaacagtgatgtgaccagtgatgatgacatgaccaggaacagaagagagagcagccccccccacagcgtgcacagcttcagtgaccgggactgggacagaagaggccgcagccgggacatggagccccgggaccgctggagccacaccaggaaccccaggagcaggatgccaccccgggacctgagcctgcctgtggtggccaagaccagctttgagatggaccgggaggatgaccgggacagccgggcctatgagagccgcagccaggatgctgagagctaccagaatgtggtggacctggccgaggacaggaagccccacaacaccatccaggacaacatggagaactacaggaagctgctgagcctggtgcagctggccgaggatgatggccacagccacatgacccagggccacagcagccgcagcaagaggtctgcctaccccagcaccagccggggcctgaagaccatgcctgaggccaagaagagcacccacagaagaggcatctgtgaagatgagagcagccatggagtcatcatggagaagttcatcaaggatgtgagccgcagcagcaagagcggccgggcccgggagagcagtgacaggagccagcgcttccccaggatgtctgatgacaactggaaggacatcagcctgaacaagcgggagagcgtcatccagcagagggtgtatgagggcaatgccttccggggcggcttccgcttcaacagcaccctggtgtccaggaagagggtgctggagaggaagaggcgctaccactttgacacagatggcaagggcagcatccatgaccagaagggctgccccaggaagaagccctttgaatgtggcagcgagatgaggaaggccatgtctgtgagcagcctgagcagcctgagcagccccagcttcacagagagccagcccatcgactttggagccatgccctacgtgtgtgatgaatgtggccgctccttcagcgtcatcagcgagtttgtggagcaccagatcatgcacacccgggagaacctgtatgaatatggagagagcttcatccacagcgtggccgtgtctgaggtgcagaagagccaggtgggcggcaagagatttgagtgcaaggactgtggggagaccttcaacaagtctgctgccctggccgagcacaggaagatccacgcccggggctacctggtggagtgcaagaaccaggagtgtgaggaggccttcatgcccagccccaccttcagcgagctgcagaagatctacggcaaggacaagttctatgagtgccgggtgtgcaaggagaccttcctgcacagcagcgccctgattgagcaccagaagatccactttggagatgacaaggacaatgaaagagagcacgagcgggagcgggagcgggagcggggggagaccttccggcccagccctgccctgaatgagttccagaagatgtatggcaaggagaagatgtatgagtgcaaggtgtgtggggagaccttcctgcacagcagcagcctgaaggagcaccagaagatccacacccggggcaacccctttgagaacaagggcaaggtgtgtgaggagaccttcatccctggccagagcctgaagaggcggcagaagacctacaacaaggagaagctgtgtgacttcacagatggaagagatgccttcatgcagagcagcgagctgtctgagcaccagaagatccacagcaggaagaacctgtttgagggccggggctatgagaagagcgtcatccacagcggccccttcacagagagccagaagagccacaccatcacccggcccctggagagtgatgaagatgagaaggccttcaccatcagcagcaacccctatgagaaccagaagatccccaccaaggaaaatgtgtatgaggccaagagctatgaaagaagtgtcatccacagcctggcctctgtggaggcccagaagagccacagcgtggccggccccagcaagcccaaggtgatggccgagagcaccatccagagctttgatgccatcaaccaccagagggtgcgggccggcggcaacaccagcgagggccgggagtacagccgcagcgtcatccacagcctggtggccagcaagcccccaagaagccacaatggaaatgagctggtggagagcaatgagaagggggagagcagcatctacatcagtgacctgaatgacaagaggcagaagatcccagcccgggagaacccctgtgagggcggcagcaagaacagaaattatgaggacagcgtcatccagagcgtcttccgggccaagccccagaagtctgtgcctggagagggcagcggggagttcaagaaggatggagagttctctgtgcccagcagcaatgtgcgggagtaccagaaggcccgggccaagaagaagtacatcgagcacaggagcaatgagaccagcgtcatccacagcctgccctttggagagcagaccttccggccccggggcatgctgtatgagtgccaggagtgtggggagtgctttgcccacagcagtgacctgacagagcaccagaagatccatgaccgggagaagcccagcggcagcaggaactatgagtggagcgtcatccgcagcctggcccccacagacccccagaccagctatgcccaggagcagtatgccaaggagcaggccaggaacaagtgcaaggacttccggcagttctttgccaccagcgaggacctgaacaccaaccagaagatctatgaccaggagaagagccatggagaggagagccagggcgagaacacagatggagaggagacccacagcgaggagacccacggccaggagaccattgaagatcctgtgatccagggcagtgacatggaggacccccagaaggatgatcctgatgacaagatctatgaatgtgaggactgtggcctgggctttgtggacctgacagacctgacagaccaccagaaggtgcacagcaggaagtgcctggtggacagccgggagtacacccacagcgtcatccacacccacagcatcagcgagtaccagagggactacaccggggagcagctgtatgagtgccccaagtgtggggagagcttcatccacagcagcttcctgtttgagcaccagagaattcatgagcaggaccagctgtacagcatgaagggctgtgatgatggcttcatcgccctgctgcccatgaagcccaggaggaacagagctgctgagaggaacccagccctggccggcagcgccatccgctgcctgctgtgtggccagggcttcatccacagcagcgccctgaatgagcacatgaggctgcacagagaagatgacctgctggagcagagccagatggccgaggaggccatcatccctggcctggccctgacagagttccagaggagccagacagaggagcggctgtttgaatgtgctgtgtgtggggagagctttgtgaacccagctgagctggccgaccacgtgacagtgcacaagaatgagccctatgaatatggcagcagctacacccacaccagcttcctgacagagcccctgaagggggccatccccttctatgagtgcaaggactgtgggaagagcttcatccacagcacagtgctgaccaagcacaaggagctgcacctggaggaggaggaggaggatgaagctgctgctgctgctgctgctgctgcccaggaggtggaggccaacgtgcacgtgccccaggtggtgctgcgcatccagggcctgaatgtggaggccgctgagcctgaggtggaggccgctgagcctgaggtggaggccgctgagcctgaggtggaggccgctgagcccaatggagaggccgagggcccagatggagaggccgctgagcccatcggggaggccggccagcccaacggggaggccgagcagcccaatggagatgctgatgagccagatggagctggcattgaagatcctgaggagagagctgaggagcctgagggcaaggccgaggagccagaaggagatgctgatgagccagatggagtgggcatcgaggaccctgaggagggggaggaccaggagatccaggtggaggagccctactatgactgccatgaatgtacagagaccttcaccagcagcacagccttcagcgagcacctgaagacccacgcctccatgatcatctttgagcccgccaatgcctttggagaatgttctggctacatcgagcgggccagcaccagcactggaggagccaaccaggctgatgagaagtacttcaagtgtgatgtgtgtggccagctgttcaatgaccggctgagcctggcccggcaccagaacacccacactggatag

SEQ ID NO: 19039 - DNA, 2508 bp, Artificial Sequence
  Description of Artificial Sequence: Synthetic coding sequence
atgggcaactacaagagccggcccacccagacctgcacagatgagtggaagaagaaggtgtctgagagctatgtgatcaccatcgagcggctggaggatgacctgcagatcaaggagaaggagctgacagagctgaggaacatctttggaagtgatgaggccttcagcaaggtgaacctgaactacagaacagaaaatggcctgagcctgctgcacctgtgctgcatctgtggcggcaagaagagccacatccgcaccctgatgctgaagggcctgcggcccagccggctgaccagaaatggcttcaccgccctgcacctggccgtgtacaaggacaatgctgagctgatcaccagcctgctgcacagcggggctgacatccagcaggtgggctacggcggcctgacagccctgcacatcgccaccatcgccggccacctggaggccgcagatgtgctgctgcagcacggggccaacgtgaacatccaggatgctgtgttcttcacccccctgcacatcgccgcctactacggccacgagcaggtgacccggctgctgctgaagtttggagcagatgtgaatgtgtctggagaggtgggggaccggcccctgcacctggccagcgccaagggcttcctgaacatcgccaagctgctgatggaggagggcagcaaggcagatgtgaatgcccaggacaatgaagaccacgtgcccctgcacttctgcagcagatttggccaccacgacatcgtgaagtacctgctgcagagcgacctggaggtgcagccccacgtggtgaacatctatggagacacccccctgcacctggcctgctacaacgggaagtttgaggtggccaaggagatcatccagatctctggaacagagagcctgaccaaggagaacatcttcagcgagacagccttccacagcgcctgcacctacggcaagagcattgacctggtgaagttcctgctggaccagaatgtcatcaacatcaaccaccagggcagagatggccacacaggcctgcacagcgcctgctaccacggccacatccggctggtgcagttcctgctggacaacggggctgacatgaacctggtggcctgtgaccccagccgcagcagtggagagaaggatgagcagacctgcctgatgtgggcctatgagaagggccatgatgccatcgtgaccctgctgaagcactacaagaggccccaggatgagctgccctgcaatgagtacagccagcctggaggagatggcagctatgtgtctgtgcccagccccctgggcaagatcaagtccatgaccaaggagaaggctgacatcctgctgctgcgggccggcctgcccagccacttccacctgcagctgtctgaaattgagttccacgagatcatcggcagcggcagctttgggaaggtgtacaagggccgctgcaggaacaagatcgtggccatcaagcgctaccgggccaacacctactgcagcaagagtgatgtggacatgttctgccgggaggtgtccatcctgtgccagctgaaccacccctgcgtcatccagtttgtgggcgcctgcctgaatgaccccagccagtttgccatcgtgacccagtacatcagcggcggcagcctcttcagcctgctgcacgagcagaagaggatcctggacctgcagagcaagctgatcatcgctgtggatgtggccaagggcatggagtacctgcacaacctgacccagcccatcatccaccgggacctgaacagccacaacatcctgctgtatgaagatggccatgctgtggtggccgactttggagagagccgcttcctgcagagcctggatgaggacaacatgaccaagcagcccggcaacctgcgctggatggcccctgaggtgttcacccagtgcacccgctacaccatcaaggcagatgtgttctcctatgccctgtgcctgtgggagatcctgaccggggagatcccctttgcccacctgaagccagctgctgctgctgctgacatggcctaccaccacatccggccccccatcggctacagcatccccaagcccatcagcagcctgctgatccggggctggaatgcctgcccagagggccggcctgagttcagcgaggtggtgatgaagctggaggagtgcctgtgcaacatcgagctgatgagccctgccagcagcaacagcagcggcagcctgagccccagcagcagcagtgactgcctggtgaacagaggaggccctggccgcagccacgtggccgccctgcggagcagatttgagctggagtatgccctgaatgcccggagctatgctgccctgagccagagcgctggccagtacagcagccagggcctgagcctggaggagatgaagaggagcctgcagtacacccccatcgacaagtatggctacgtgtctgaccccatgagctccatgcacttccacagctgcaggaacagcagcagctttgaggacagcagctag

SEQ ID NO: 19040 - DNA, 1767 bp, Artificial Sequence
  Description of Artificial Sequence: Synthetic coding sequence
atgaacaccagcatcccctaccagcagaacccctacaacccccggggcagcagcaatgtcatccagtgctaccgctgtggggacacctgcaagggggaggtggtgcgggtgcacaacaaccacttccacatccgctgcttcacctgccaggtgtgtggctgcggcctggcccagagcggcttcttcttcaagaaccaggagtacatctgcacccaggactaccagcagctgtatggcacccgctgtgacagctgccgggacttcatcaccggggaggtgatcagcgccctgggccgcacctaccaccccaagtgctttgtgtgcagcctgtgcaggaagcccttccccatcggggacaaggtgaccttcagcggcaaggaatgtgtgtgccagacctgcagccagagcatggccagcagcaagcccatcaagatccggggccccagccactgtgccggctgcaaggaggagatcaagcacggccagagcctgctggccctggacaagcagtggcacgtgtcctgcttcaagtgccagacctgcagcgtcatcctgaccggggagtacatcagcaaggatggagtgccctactgtgagagtgactaccacgcccagtttggcatcaagtgtgagacctgtgaccgctacatcagcggccgggtgctggaggccggcggcaagcactaccaccccacctgtgcccgctgtgtgcgctgccaccagatgttcacagaaggagaggagatgtacctgaccggcagcgaggtgtggcaccccatctgcaagcaggccgcccgggcagagaagaagctgaagcacaggaggaccagcgagaccagcatcagccccccaggcagcagcatcggcagccccaacagagtcatctgtgacatctatgagaacctggacctgcggcagaggcgggccagcagccctggctacatcgacagccccacctacagccggcagggcatgagccccaccttcagccgcagcccccaccactactacagatctgctggggacagcaacatctacaggaagccacccatctacaagagacatggagacctgagcacagccaccaagagcaagaccagcgaggacatcagccagaccagcaagtacagccccatctacagcccagacccctactatgccagcgagagcgagtactggacctaccacggcagccccaaggtgccccgggcccggcgcttcagcagtggaggagaagaagatgactttgaccgctccatgcacaagctgcagagcggcatcggccgcctcatcctgaaggaggagatgaaggcccggagcagcagctatgctgacccctggaccccacccaggagcagcaccagcagccgggaggccctgcacacagctggctatgagatgagcctgaatggcagccccaggagccactacctggccgacagcgaccccctcatcagcaagagcgccagcctgcctgcctacagaagaaatggcctgcacaggacccccagcgctgacctcttccactatgacagcatgaatgctgtgaactggggcatgagggagtacaagatctacccctatgagctgctgctggtgaccacccggggcaggaaccggctgcccaaggatgtggacaggacccggctggagcggcacctgagccaggaggagttctaccaggtgtttggcatgaccatcagcgagtttgaccggctggccctgtggaagagaaatgagctgaagaagcaggcccggctcttctag

SEQ ID NO: 19041 - DNA, 1050 bp, Artificial Sequence
  Description of Artificial Sequence: Synthetic coding sequence
atggccatccccatcaccgtgctggactgtgacctgctgctgtatggccggggccacaggaccctggaccgcttcaagctggatgatgtgacagatgagtacctgatgtccatgtatggcttcccccggcagttcatctactacctggtggagctgctgggcgccaacctgagccggcccacccagaggagccgggccatcagccctgagacccaggtgctggccgccctgggcttctacaccagcggcagcttccagaccaggatgggagatgccatcggcatcagccaggcctccatgagccgctgtgtggccaacgtgacagaggccctggtggagcgggccagccagttcatccgcttcccagcagatgaggccagcatccaggccctgaaggatgagttctacggcctggccggcatgcctggggtgatgggcgtggtggactgcatccacgtggccatcaaggccccaaatgctgaggacctgtcctatgtgaacaggaagggcctgcacagcctgaactgcctgatggtgtgtgacatccggggcaccctgatgacagtggagaccaactggccaggcagcctgcaggactgtgctgtgctgcagcagagcagcctgagcagccagtttgaggccggcatgcacaaggacagctggctgctgggggacagcagcttcttcctgcggacctggctgatgacccccctgcacatccctgagaccccagctgagtaccgctacaacatggcccacagcgccacccacagcgtcatcgagaagaccttccgcaccctgtgcagccgcttccgctgcctggatggcagcaagggggccctgcagtacagccctgagaagagcagccacatcatcctggcctgctgcgtgctgcacaacatcagcctggagcacggcatggatgtgtggagcagccccatgacaggccccatggagcagcccccagaggaggagtatgagcacatggagagcctggacctggaggccgaccgcatccggcaggagctgatgctgacccacttctcctag

SEQ ID NO: 19042 - DNA, 1794 bp, Artificial Sequence
  Description of Artificial Sequence: Synthetic coding sequence
atgagcagcaagggcagcagcacagatggccgcacagacctggccaacggcagcctgagcagcagccctgaggagatgtctggagctgaggagggccgggagaccagcagcggcatcgaggtggaggccagtgacctgagcctgagcctgactggagatgatggcggccccaacagaaccagcacagagagccggggcacagacacagagagcagcggggaggacaaggacagcgacagcatggaggacaccggccactacagcatcaatgatgagaacagagtgcatgacagaagtgaggaggaggaggaggaggaggaggaggaggaggaggagcagccccggcggcgggtgcagaggaagagggccaacagagaccaggacagcagtgatgatgagcgggccctggaggactgggtgagcagcgagaccagcgccctgccccggccccgctggcaggccctgcctgccctgcgggagcgggagctgggcagcagcgccaggtttgtgtatgaggcctgtggggcccgggtgtttgtgcagcgcttccggctgcagcacggcctggagggccacacaggctgtgtgaacaccctgcacttcaaccagaggggcacctggctggccagcggcagtgatgacctgaaggtggtggtgtgggactgggtgcggcggcagcctgtgctggactttgaaagtggccacaagagcaatgtgttccaggccaagttcctgcccaacagcggggacagcaccctggccatgtgtgccagagatggccaggtgcgggtggccgagctgagcgccacccagtgctgcaagaacaccaagagggtggcccagcacaagggggccagccacaagctggccctggagccagacagcccctgcaccttcctgtctgctggggaggatgctgtggtgttcaccatcgacctgcggcaggacaggcctgccagcaagctggtggtgaccaaggagaaggagaagaaggtgggcctgtacaccatctacgtgaacccagccaacacccaccagtttgctgtgggcggccgggaccagtttgtgcgcatctatgaccagaggaagattgatgaaaatgaaaacaacggggtgctgaagaagttctgcccccaccacctggtgaacagcgagagcaaggccaacatcacctgcctggtgtacagccatgatggaacagagctgctggccagctacaatgatgaggacatctacctgttcaacagcagccacagtgatggagcccagtatgtgaagcgctacaagggccacaggaacaatgccaccgtgaagggcgtgaacttctacggccccaagtcagaatttgtggtgtctggcagtgactgtggccacatcttcctgtgggagaagagcagctgccagatcatccagttcatggagggggacaagggcggcgtggtgaactgcctggagccccacccccacctgcctgtgctggccaccagcggcctggaccatgatgtgaagatctgggcccccacagctgaggccagcacagagctgaccggcctgaaggatgtgatcaagaagaacaagcgggagagagatgaggacagcctgcaccagacagacctgtttgacagccacatgctgtggttcctgatgcaccacctgcggcagaggaggcaccaccggcgctggagggagcccggggtgggcgccacagatgctgacagtgatgagagccccagcagcagtgacaccagtgatgaggaggagggccctgacagagtgcagtgcatgcccagctag

SEQ ID NO: 19043 - DNA, 933 bp, Artificial Sequence
  Description of Artificial Sequence: Synthetic coding sequence
atgagccagcagctgaagaagagggccaagaccaggcaccagaagggcctgggcggccgggcccccagcggggccaagccccggcagggcaagagcagccaggacctgcaggccgagattgagcctgtgtctgctgtgtgggccctgtgtgatggctacgtgtgctatgagcccggcccccaggccctgggcggagatgacttcagtgactgctacattgaatgtgtgatccggggggagttcagccagcccatcctggaggaggacagcctgtttgagagcctggagtacctgaagaagggcagcgagcagcagctgagccagaaggtgtttgaggccagcagcctggagtgcagcctggagtacatgaagaagggcgtgaagaaggagctgccccagaagatcgtgggggagaacagcctggagtacagcgagtacatgaccgggaagaagctgcccccaggcggcatccctggcatcgacctgagtgaccccaagcagctggccgagtttgccaggaagaagccacccatcaacaaggagtatgacagcctgagcgccatcgcctgcccccagagcggctgcaccaggaagctgaggaacagagctgccctgaggaagcacctgctgatccacggcccccgggaccacgtgtgtgctgaatgtgggaaggcctttgtggagagcagcaagctgaagaggcacttcctggtgcacactggagagaagcccttccgctgcacctttgagggctgtgggaagcgcttcagcctggacttcaacctgcggacccacgtgcgcatccacactggagagaagagatttgtgtgccccttccagggctgcaacagacgcttcatccagagcaacaacctgaaggcccacatcctgacccacgccaacaccaacaagaatgagcaggagggcaagtag

SEQ ID NO: 19044 - DNA, 1149 bp, Artificial Sequence
  Description of Artificial Sequence: Synthetic coding sequence
atgctgcgctggacagtgcacctggagggcggccccaggagagtgaaccacgccgctgtggccgtgggccaccgggtgtacagctttggaggctactgcagcggggaggactatgagaccctgcggcagattgatgtgcacatcttcaatgctgtgtccctgcgctggaccaagctgccccctgtgaagagcgccatccggggccaggcccctgtggtgccctacatgagatatggccacagcacagtgctgattgatgacacagtgctgctgtggggcggcagaaatgacacagagggcgcctgcaatgtgctgtatgcctttgatgtgaacacccacaagtggttcaccccccgggtgtctggaacagtgcctggggccagagatggccacagcgcctgtgtgctgggcaagatcatgtacatctttggaggctatgagcagcaggccgactgcttcagcaatgacatccacaagctggacaccagcaccatgacctggaccctcatctgcaccaagggcagccctgcccgctggagggacttccacagcgccaccatgctgggcagccacatgtatgtgtttggaggccgggctgaccgcttcggccccttccacagcaacaatgagatctactgcaaccgcatccgggtgtttgacaccaggacagaggcctggctggactgcccccccacccctgtgctgcctgagggcagaagaagccacagcgccttcggctacaacggggagctgtacatctttggaggctacaatgcccggctgaacagacacttccatgacctgtggaagttcaaccctgtgtccttcacctggaagaagattgagcccaagggcaagggcccctgcccccggcggcggcagtgctgctgcatcgtgggggacaagatcgtgctgtttggaggcaccagccccagccctgaggagggcctgggagatgaatttgacctgattgaccacagcgacctgcacatcctggacttcagccccagcctgaagaccctgtgcaagctggccgtcatccagtacaacctggaccagagctgcctgccccatgacatccgctgggagctgaatgccatgaccaccaacagcaacatcagccggcccatcgtgagcagccatggatag

SEQ ID NO: 19045 - DNA, 1827 bp, Artificial Sequence
  Description of Artificial Sequence: Synthetic coding sequence
atggctgctgctgctgctgctgtgggccctggggccggcggggccggcagcgctgtgcctgggggcgccggcccctgtgccaccgtgtctgtgtttcctggggcccggctgctgaccatcggagatgccaacggggagatccagagacatgctgagcagcaggccctgcggctggaggtgcgggccggccctgacagcgctggcatcgccctgtacagccatgaagatgtgtgtgtgttcaagtgcagcgtgtcccgggagacagaatgttcccgggtgggcaagcagagcttcatcatcaccctgggctgcaacagcgtgctgatccagtttgccaccccaaatgacttctgcagcttctacaacatcctgaagacctgccggggccacaccctggagaggtctgtgttcagcgagaggacagaggagagcagcgctgtgcagtacttccagttctacggctacctgagccagcagcagaacatgatgcaggactatgtgaggacaggcacctaccagagggccatcctgcagaaccacacagacttcaaggacaagatcgtgctggatgtgggctgcggcagcggcatcctgtccttctttgctgcccaggccggggccaggaagatctatgctgtggaggccagcaccatggcccagcacgccgaggtgctggtgaagagcaacaacctgacagacagaattgtggtgattcctgggaaggtggaggaggtgtccctgcctgagcaggtggacatcatcatcagcgagcccatgggctacatgctgttcaatgaaagaatgctggagagctacctgcacgccaagaagtacctgaagcccagcggcaacatgttccccaccatcggagatgtgcacctggcccccttcacagatgagcagctgtacatggagcagttcaccaaggccaacttctggtaccagcccagcttccatggagtggacctgagcgccctgcggggagctgctgtggatgagtacttccggcagcctgtggtggacacctttgacatccgcatcctgatggccaagtctgtgaagtacacagtgaacttcctggaggccaaggagggggacctgcaccgcatcgagatccccttcaagttccacatgctgcacagcggcctggtgcacggcctggccttctggtttgatgtggccttcatcggcagcatcatgacagtgtggctgagcacagcccccacagagcccctgacccactggtaccaggtgcgctgcctcttccagagccccctgtttgccaaggccggggacaccctgagcggcacctgcctgctgattgccaacaagaggcagagctatgacatcagcatcgtggcccaggtggaccagacaggcagcaagagcagcaacctgctggacctgaagaaccccttcttccgctacacaggcaccacccccagccccccacctggcagccactacaccagccccagcgagaacatgtggaacacaggcagcacctacaacctgagcagcggcatggctgtggccggcatgcccacagcctatgacctgagcagcgtcatcgccagcggcagctctgtgggccacaacaacctgatccccctggccaacacaggaattgtgaaccacacccacagcaggatgggcagcatcatgagcactggaattgtgcagggcagcagcggggcccagggcagcggcggcggcagcaccagcgcccactatgctgtgaacagccagttcaccatgggcggccctgccatctccatggccagccccatgagcatccccaccaacaccatgcactacggcagctag

SEQ ID NO: 19046 - DNA, 2913 bp, Artificial Sequence
  Description of Artificial Sequence: Synthetic coding sequence
atgcagagcacagacctgggcaacaaggagagcggcaagatctggcacaggaagcccagccctgccaccagagatggcatcatcgtgaacatcatccacaacaccagtgactaccaccccaaggtgctgcgcttcctgaatgtggcctttgatggcactggagactgcctgattgctggggaccaccagggcaacatctacgtgtttgacctgcacggcaaccgcttcaacctggtgcagaggacagcccaggcctgcacagccctggccttcaacctgcggaggaagtctgagttcctggtggccctggccgactacagcatcaagtgctttgacacagtgaccaaggagctggtgtcctggatgaggggccacgagagcagcgtcttcagcatctctgtgcacgccagcggcaagtatgccatcaccaccagcagtgacacagcccagctgtgggacctggacaccttccagaggaagaggaagctgaacatccggcagagcgtgggcatccagaaggtgttcttcctgcccctgagcaacaccatcctgagctgcttcaaggacaacagcatctttgcctgggagtgtgacaccctcttctgcaagtaccagctgcctgcccctcctgagagcagcagcatcctgtacaaggtgtttgctgtgaccagagatggccgcatcctggccgccggcggcaagagcaaccacctgcacctgtggtgcctggaggcccggcagctgttccgcatcatccagatgcccaccaaggtgcgggccatccgccacctggagttcctgcctgacagctttgatgctggcagcaaccaggtgctgggcgtgctgagccaggacggcatcatgaggttcatcaacatgcagacctgcaagctgctgtttgagatcggcagcctggatgagggcatcagcagcagcgccatcagcccccacggccgctacatcgccagcatcatggagaatggcagcctgaacatctacagcgtgcaggccctgacccaggagatcaacaagcccccaccacccctggtgaaggtgattgaggacctgcccaagaacaagctgagcagcagtgacctgaagatgaaggtgaccagcggccgggtgcagcagcctgccaagagccgggagagcaagatgcagacccgcatcctgaagcaggacctgaccggggactttgagagcaagaagaatgagctgcctgatggcctgaacaagaagaggctgcagatcctgctgaagggctacggggagtaccccaccaagtacaggatgttcatctggaggagcctgctgcagctgcctgagaaccacacagccttcagcaccctgattgacaagggcacccacgtggccttcctgaacctgcagaagaagtaccccatcaagagcaggaagctgctgcgggtgctgcagaggaccctgagcgccctggcccactggagcgtcatcttcagtgacaccccctacctgcccctgctggccttcccctttgtgaagctgttccagaacaaccagctgatctgctttgaggtgattgccaccctcatcatcaactggtgccagcactggtttgagtacttccccaacccccccatcaacatcctgtccatgattgaaaatgtgctggccttccatgacaaggagctgctgcagcacttcatcgaccatgacatcaccagccagctgtatgcctggcccctgctggagaccgtcttcagcgaggtgctgacccgggaggagtggctgaagctgtttgacaacatcttcagcaaccaccccagcttcctgctgatgacagtggtggcctacaacatctgcagcaggacccccctgctgagctgcaacctgaaggatgactttgagttcttcttccaccacaggaacaacctggacatcaacgtggtgatccggcaggtgtaccacctgatggagaccacccccacagacatccacccagacagcatgctgaatgtgtttgtggccctgaccaagggccagtaccctgtgttcaaccagtaccccaagttcatcgtggactaccagacccaggagcgggagcgcatcagaaatgatgagctggactacctgcgggagcggcagacagtggaggacatgcaggccaaggtggaccagcagagggtggaggatgaggcctggtaccagaagcaggagctgctgaggaaggccgaggagacccggcgggagatgctgctgcaggaggaggagaagatgatccagcagaggcagaggctggccgctgtgaagcgggagctgaaggtgaaggagatgcacctgcaggatgctgcccggcggcgcttcctgaagctgcagcaggaccagcaggagatggagctgcggcggctggatgatgaaattggaaggaagaacctgacagagaaccaggaggccctggccaaggagatgagagcagatgctgatgcctacagaaggaaggtggacctggaggagcacatgttccacaagctgattgaagctggggagacccagagccagaagacccagaagtggaaggaggccgagggcaaggagttccggctgcggagcgccaagaaggccagcgccctgagtgatgccagcaggaagtggttcctgaagcaggagatcaatgctgctgtggagcacgccgagaacccctgccacaaggaggagccccgcttccagaatgagcaggacagcagctgcctgcccaggaccagccagctgaatgacagcagcgagatggaccccagcacccagatcagcctgaacagaagagctgtggagtgggacaccaccggccagaacctgatcaagaaggtgaggaacctgcggcagaggctgacagcccgggcccggcaccgctgccagaccccccacctgctggccgcctag

SEQ ID NO: 19047 - DNA, 648 bp, Artificial Sequence
  Description of Artificial Sequence: Synthetic coding sequence
atgagctgcaccatcgagaaggccctggctgatgccaaggccctggtggagcggctgcgggaccatgatgatgctgctgagagcctcatcgagcagaccacagccctgaacaagagggtggaggccatgaagcagtaccaggaggagatccaggagctgaatgaggtggcccggcaccggcccaggagcaccctggtgatgggcatccagcaggagaaccggcagatccgggagctgcagcaggagaacaaggagctgcggaccagcctggaggagcaccagagcgccctggagctgatcatgagcaagtaccgggagcagatgttccggctgctgatggccagcaagaaggatgaccccggcatcatcatgaagctgaaggagcagcacagcaaggagctgcaggcccacgtggaccagatcacagagatggctgctgtgatgaggaaggccatcgagattgatgagcagcagggctgcaaggagcaggagcgcatcttccagctggagcaggagaacaagggcctgcgggagatcctgcagatcacccgggagagcttcctgaacctgaggaaggatgatgccagcgagagcaccagcctgagcgccctggtgaccaacagcgacctgagcctgaggaagagctag

SEQ ID NO: 19048 - DNA, 2676 bp, Artificial Sequence
  Description of Artificial Sequence: Synthetic coding sequence
atggctgtggcccgggtggatgctgccctgcccccaggagagggctctgtggtgaactggagcggccagggcctgcagaagctgggccccaacctgccctgtgaggccgacatccacaccctcatcctggacaagaaccagatcatcaagctggagaacctggagaagtgcaagaggctcatccagctgtctgtggccaacaaccggctggtgaggatgatgggcgtggccaagctgaccctgctgcgggtgctgaacctgccccacaacagcatcggctgtgtggagggcctgaaggagctggtgcacctggagtggctgaacctggccggcaacaacctgaaggccatggagcagatcaacagctgcacagccctgcagcacctggacctgagtgacaacaacatcagccagattggagacctgagcaagctggtgtccctgaagaccctgctgctgcacggcaacatcatcaccagcctgaggatggccccagcctacctgcccaggagcctggccatcctgagcctggctgaaaatgagatccgggacctgaatgagatctccttcctggccagcctgacagagctggagcagctgagcatcatgaacaacccctgtgtgatggccacccccagcatccctggctttgactaccggccctacatcgtgtcctggtgcctgaacctgcgggtgctggatggctacgtgatcagccagaaggagagcctgaaggccgagtggctgtacagccagggcaagggccgggcctaccggcccggccagcacatccagctggtgcagtacctggccaccgtgtgccccctgaccagcaccctgggcctgcagacagcagaagatgccaagctggagaagatcctgagcaagcagcgcttccaccagaggcagctgatgaaccagagccagaatgaggagctgagccccctggtgcctgtggagacccgggccagcctcatccctgagcacagcagccctgtgcaggactgccagatcagccaggagagcgagcccgtcatccaggtgaacagctgggtgggcatcaacagcaatgatgaccagctgtttgctgtgaagaacaacttccctgcctctgtgcacaccacccgctacagcagaaatgacctgcacctggaggacatccagacagatgaggacaagctgaactgcagcctgctgagcagcgagagcaccttcatgcctgtggccagcggcctgagccccctgagccccaccgtggagctgcggctgcagggcatcaacctgggcctggaggatgatggagtggctgatgaatctgtgaagggcctggagagccaggtgctggacaaggaggaggagcagcccctgtgggccgccaatgaaaattctgtgcagatgatgaggtctgagatcaacacagaggtgaatgagaaggccggcctgctgccctgcccagagcccaccatcatcagcgccatcctgaaggatgacaaccacagcctgaccttcttccctgagagcacagagcagaagcagagcgacatcaagaagccagagaacacccagcctgagaacaaggagaccatcagccaggccaccagcgagaagctgcccatgatcctgacccagaggtctgtggccctgggccaggacaaggtggccctgcagaagctgaatgatgctgccaccaagctgcaggcctgctggaggggcttctacgccaggaactacaacccccaggccaaggatgtgcgctatgagatccggctgcggaggatgcaggagcacatcgtgtgcctgacagatgagatccggcggctgaggaaggagagagatgaggagcgcatcaagaagtttgtgcaggaggaggccttccgcttcctgtggaaccagaagtggggcctggccatcctgcccaggcctgtgagcaacttctgggcccaggccgtgttccccccccagccccccaaggtgcgcagcctgcaggtgtggcagcagacagtggaccagaggctgagctcctggcacacagatgtgccccccatcagcagcaccctggtgcccagcaagcaccccctcttcacccagagccaggagagcagctgtgaccagaatgctgactggttcatcgccagtgatgtggccccccaggagaagagcctgcctgagttcccagattctggcttccacagcagcctgacagagcaggtgcacagcctgcagcacagcctggactttgagaagagcagcacagagggcagcgagagcagcatcatgggcaacagcattgacacagtgcgctatggcaaggagagtgacctgggagatgtgtctgaggagcacggggagtggaacaaggagagcagcaacaatgagcaggacaacagcctgctggagcagtacctgacctctgtgcagcagctggaggatgctgatgagaggaccaactttgacacagagacccgggacagcaagctgcacatcgcctgcttccctgtgcagctggacaccctgagtgatggagcctctgtggatgagagccacggcatcagcccccccctgcagggcgagatcagccagacccaggagaacagcaagctgaatgctgaggtgcagggccagcagccagaatgtgacagcaccttccagctgctgcacgtgggcgtgacagtgtag

SEQ ID NO: 19049 - DNA, 828 bp, Artificial Sequence
  Description of Artificial Sequence: Synthetic coding sequence
atggccgagcccgcctctgtggccgctgagagcctggccggcagccgggcccgggccgccaggacagtgctgggccaggtggtgctgcccggggaggagctgctgctgcctgagcaggaggatgctgagggccctggaggagctgtggagcggcccctgagcctgaatgcccgggcctgcagccgggtgcgggtggtgtgtggccctggcctgcggcgctgtggggaccggctgctggtgaccaagtgtggccgcctgcggcacaaggagcccggcagcggcagcggcggcggcgtgtactgggtggacagccagcagaagagatatgtgcctgtgaagggggaccacgtgattggcatcgtgacagccaagagcggggacatcttcaaggtggatgtgggcggcagcgagcccgccagcctgagctacctgagctttgagggcgccaccaagaggaaccggcccaacgtgcaggtgggggacctgatctacggccagtttgtggtggccaacaaggacatggagcctgagatggtgtgcatcgacagctgtggccgggccaacggcatgggcgtgattggccaggacggcctgctcttcaaggtgaccctgggcctcatcaggaagctgctggccccagactgtgagatcatccaggaggtgggcaagctgtaccccctggagatcgtgtttggcatgaatggccgcatctgggtgaaggccaagaccatccagcagaccctcatcctggccaacatcctggaggcctgtgagcacatgaccagtgaccagaggaagcagatcttcagccggctggccgagagctag

SEQ ID NO: 19050 - DNA, 1620 bp, Artificial Sequence
  Description of Artificial Sequence: Synthetic coding sequence
atggccaccagcgcccccctgcggagcctggaggaggaggtgacctgcagcatctgcctggactacctgcgggaccctgtgaccatcgactgtggccacgtgttctgccgcagctgcaccacagatgtgcggcccatcagcggcagcaggcctgtgtgccccctgtgcaagaagcccttcaagaaggagaacatccggcctgtgtggcagctggccagcctggtggagaacatcgagcggctgaaggtggacaagggccggcagcctggagaggtgacccgggagcagcaggatgccaagctgtgtgagcggcaccgggagaagctgcactactactgtgaagatgatggcaagctgctgtgtgtgatgtgccgggagagccgggagcaccggccccacacagctgtgctgatggagaaggccgcccagccccaccgggagaagatcctgaaccacctgagcaccctgcggcgggaccgggacaagatccagggcttccaggccaagggggaggccgacatcctggccgccctgaagaagctgcaggaccagaggcagtacatcgtggccgagtttgagcagggccaccagttcctgcgggagcgggaggagcacctgctggagcagctggccaagctggagcaggagctgacagagggccgggagaagttcaagagccggggcgtgggggagctggcccggctggccctggtgatcagcgagctggagggcaaggcccagcagcctgctgctgagctgatgcaggacacccgggacttcctgaaccgctaccccaggaagaagttctgggtgggcaagcccatcgcccgggtggtgaagaagaagacaggagagttcagtgacaagctgctgagcctgcagaggggcctgcgggagttccagggcaagctgctgcgggacctggagtacaagacagtgtctgtgaccctggacccccagagcgccagcggctacctgcagctgtctgaggactggaagtgtgtgacctacaccagcctgtacaagagcgcctacctgcacccccagcagtttgactgtgagcccggggtgctgggcagcaagggcttcacctggggcaaggtgtactgggaggtggaggtggagcgggagggctggagcgaagatgaggaggagggagatgaggaggaggagggggaggaggaggaggaggaggaggaggccggctatggagatggctatgatgactgggagacagatgaagatgaggagagcctgggagatgaggaggaggaggaggaggaggaggaggaggaggtgctggagagctgcatggtgggcgtggcccgggacagcgtgaagaggaaaggagacctgagcctgcggccagaagatggagtgtgggccctgcggctgagcagcagcggcatctgggccaacaccagccctgaggccgagctgtttcctgccctgcggcccaggagagtgggcatcgccctggactatgaaggaggcaccgtgaccttcaccaatgctgagagccaggagctgatctacaccttcaccgccaccttcacccggcggctggtgcccttcctgtggctgaagtggccaggcacccggctgctgctgcggccctag

SEQ ID NO: 19051 - DNA, 1233 bp, Artificial Sequence
  Description of Artificial Sequence: Synthetic coding sequence
atgttcaacaatgagctgatggctgatgtgcactttgtggtgggccccccaggggccaccaggacagtgcctgcccacaagtatgtgctggccgtgggcagctctgtgttctacgccatgttctacggggacctggccgaggtgaagtctgagatccacatcccagatgtggagcctgctgccttcctgatcctgctgaagtacatgtacagtgatgaaattgacctggaggccgacacagtgctggccaccctgtatgctgccaagaagtacatcgtgcctgccctggccaaggcctgtgtgaacttcctggagaccagcctggaggccaagaatgcctgtgtgctgctgagccagagccggctgtttgaggagcctgagctgacccagcgctgctgggaggtgattgatgcccaggccgagatggccctgcggtctgagggcttctgtgaaattgaccggcagaccctggagatcatcgtgacccgggaggccctgaacaccaaggaggccgtggtgtttgaggccgtgctgaactgggccgaggccgagtgcaagaggcagggcctgcccatcaccccaagaaacaagagacatgtgctgggccgggccctgtacctggtgcgcatccccaccatgaccctggaggagtttgccaacggggccgcccagagcgacatcctgaccctggaggagacccacagcatcttcctgtggtacacagccaccaacaagccccggctggacttccccctgaccaagaggaagggcctggccccccagcgctgccaccgcttccagagcagcgcctaccgcagcaaccagtggagataccggggccgctgtgacagcatccagtttgctgtggacagaagagtcttcatcgccggcctgggcctgtatggcagcagcagcggcaaggccgagtacagcgtgaagattgagctgaagaggctgggcgtggtgctggcccagaacctgaccaagttcatgtctgatggcagcagcaacaccttccctgtgtggtttgagcaccctgtgcaggtggagcaggacaccttctacacagccagcgctgtgctggatggcagcgagctgagctacttcggccaggagggcatgacagaggtgcagtgtgggaaggtggccttccagttccagtgcagcagtgacagcaccaacggcaccggggtgcagggcggccagatccctgagctgatcttctacgcctag

SEQ ID NO: 19052 - DNA, 966 bp, Artificial Sequence
  Description of Artificial Sequence: Synthetic coding sequence
atgagggccctggccgccctgagcgcccccccaaatgaaaggctgctgccccgggaccctgctgccacccgggaccctgatgctgcccggcctgccaggagatctgctgtggagcggctggccgctgaccgggccaagtatgtgcggggccggcccggcaccggccggggcgtggccagcgagggcagcggccctggggccatcaagtgccctggaaatgaccccggccccccagcccgggccccagcccctgtggcccggcgggccatcgccaggaagcccctgcggccagacagcctcatcatctaccggcagaagtgtgaatttgtgcggggcagcggggctgatggcccccgggccagcctggtgaagaagctgttccagggccctgggaaggacaaggcccctgtgcccaggactggagatgagggcaaggccggcaaccctgagaccgtgcccaccaccccaggccctgctgctgaccctgccatccctgagaccccagccccagctgcccggtctgctgcccccagctctgtgcctgctgcccctcctggccctgagccccgggtggtgagaagaagaggcctgcagaggagccagagcgacctgagcagccgctacagcgctgccctggccgagagtgacaccttcttccagtactgcggcctggaccctgaggtggtggaggccctgggccgggagaacttcaccgctggcagtgactgtgtgaccctgaaggtgcgctctgtgtctgtggccaccagcggcagcggcttcagccgccacagcggaggagatgatgagggcctgcaggaggaggagctgattgagcaggtgcccagcaccacctctgtgattgaaagaaatgcccgcatcatcaagtggctgtacacctgcaagaaggccaaggagacccccagccaggagcagagcaggacccggggcagcaagcccagcaggtag

SEQ ID NO: 19053 - DNA, 945 bp, Artificial Sequence
  Description of Artificial Sequence: Synthetic coding sequence
atgtctgaaaatgctgcccctggcctcatcagcgagctgaagctggccgtgccctggggccacatcgccgccaaggcctggggcagcctgcagggcccccctgtgctgtgcctgcacggctggctggacaatgccagcagctttgacaggctcatccccctgctgccccaggacttctactacgtggccatggactttggaggccacggcctgagcagccactacagccctggggtgccctactacctgcagacctttgtgtctgagatcagaagagtggtggccgccctgaagtggaaccgcttcagcatcctgggccacagctttggaggagtggtgggcggcatgttcttctgcaccttccctgagatggtggacaagctgatcctgctggacacccccctcttcctgctggagagtgatgagatggagaacctgctgacctacaagagaagagccatcgagcacgtgctgcaggtggaggccagccaggagcccagccacgtgttcagcctgaagcagctgctgcagaggctgctgaagagcaacagccacctgtctgaagaatgtggggagctgctgctgcagaggggcaccaccaaggtggccaccggcctggtgctgaacagagaccagaggctggcctgggccgagaacagcattgacttcatcagccgggagctgtgtgcccacagcatcaggaagctgcaggcccacgtgctgctgatcaaggctgtgcacggctactttgacagccggcagaactacagcgagaaggagagcctgtccttcatgattgacaccatgaagagcaccctgaaggagcagttccagtttgtggaggtgcccggcaaccactgtgtgcacatgtctgagccccagcacgtggccagcatcatcagcagcttcctgcagtgcacccacatgctgcctgcccagctgtag

SEQ ID NO: 19054 - DNA, 3945 bp, Artificial Sequence
  Description of Artificial Sequence: Synthetic coding sequence
atggccagcaagggggccggcatgtccttcagcaggaagagctaccgcctgaccagtgatgctgagaagagccgggtgactggaattgtgcaggagaagctgctgaatgactacctgaaccgcatcttcagcagcagcgagcacgcccccccagctgccaccagcaggaagcccctgaacttccagaacctgcctgagcacctggaccagctgctgcaggtggacaatgaggaggaggagagccagggccaggtggagggccgcctgggccccagcacagtggtgctggaccacactggaggctttgagggcctgctgctggtggatgatgacctgctgggcgtcatcggccacagcaactttggcaccatccgcagcaccacctgtgtgtacaagggcaagtggctgtatgaggtgctgatcagcagccagggcctgatgcagatcggctggtgcaccatcagctgccgcttcaaccaggaggagggcgtgggggacacccacaacagctatgcctatgatggcaacagagtgaggaagtggaatgtgaccaccaccaactacggcaaggcctgggccgccggggacatcgtgtcctgcctgattgacctggatgatggcaccctgtccttctgcctgaatggagtgtccctgggcacagcctttgagaacctgagccggggcctgggcatggcctacttccctgccatcagcctgtccttcaaggagagcgtggccttcaactttggcagccggcccctgcgctaccctgtggccggctaccggcccctgcaggaccccccatctgctgacctggtgcgggcccagaggctgctgggctgcttccgggctgtgctgtctgtggagctggaccctgtggagggccgcctgctggacaaggagagcagcaagtggaggctgcggggccagcccaccgtgctgctgaccctggcccacatcttccaccactttgcccccctgctgaggaaggtgtacctggtggaggccgtgctgatgtccttcctgctgggcatcgtggagaagggcacccccacccaggcccagagcgtggtgcaccaggtgctggacctgctgtggctgttcatggaggactatgaggtgcaggactgcctgaagcagctgatgatgagcctgctgcggctgtaccgcttcagccccatcgtgcctgacctgggcctgcagatccactacctgcggctgaccatcgccatcctgcggcatgagaagagcaggaagttcctgctgagcaatgtgctgtttgatgtgctgcggtctgtggtgttcttctacatcaagagccccctgcgggtggaggaggccggcctgcaggagctgatccccaccacctggtggccccactgcagcagccgggagggcaaggagagcacagagatgaaggaggagacagctgaggagcggctgcggcggcgggcctatgaaagaggctgccagaggctgaggaagagaattgaggtggtggaggagctgcaggtgcagatcctgaagctgctgctggacaacaaggatgacaatggaggagaggccagccgctacatcttcctgaccaagttcaggaagttcctgcaggagaatgccagcggccggggcaacatgcccatgctgtgccccccagagtacatggtgtgcttcctgcacaggctcatcagcgccctgcgctactactgggatgagtacaaggccagcaacccccacgccagcttcagcgaggaggcctacatccccccccaggtgttctacaacgggaaggtggactactttgacctgcagaggctgggcggcctgctgagccacctgaggaagaccctgaaggatgacctggccagcaaggccaacatcgtcatcgaccccctggagctgcagagcacagccatggatgacctggatgaagatgaggagcccgccccagccatggcccagaggcccatgcaggccctggccgtgggcggccccctgcccctgccccggcccggctggctgagcagccccaccctgggccgggccaaccgcttcctgagcacagctgctgtgtccctgatgaccccccggcggcccctgagcaccagcgagaaggtgaaggtgaggaccctgtctgtggagcagaggacccgggaggacatcgagggcagccactggaatgaaggcctgctgctgggccggcccccagaggagcctgagcagcccctgacagagaacagcctgctggaggtgctggatggagctgtgatgatgtacaacctgtctgtgcaccagcagctgggcaagatggtgggcgtgtctgatgatgtgaatgaatatgccatggccctgcgggacacagaggacaagctgcggcgctgccccaagaggaggaaggacatcctggccgagctgaccaagagccagaaggtgttcagcgagaagctggaccacctgagccggcggctggcctgggtgcacgccaccgtgtacagccaggagaagatgctggacatctactggctgctgcgggtgtgcctgcggaccattgaacatggagacagaacaggcagcctgtttgccttcatgcctgagttctacctgtctgtggccatcaacagctacagcgccctgaagaactactttggacctgtgcacagcatggaggagctgcccggctatgaggagaccctgacccggctggccgccatcctggccaagcactttgctgatgccagaattgtgggcacagacatccgggacagcctgatgcaggccctggccagctatgtgtgctacccccacagcctgcgggctgtggagcgcatccctgaggagcagagaattgccatggtgaggaacctgctggccccctatgagcagaggccctgggcccagaccaactggatcctggtgcggctgtggaggggctgcggcttcggctaccgctacacccggctgccccacctgctgaagaccaagctggaggatgccaacctgcccagcctgcagaagccctgccccagcaccctgctgcagcagcacatggctgacctgctgcagcagggcccagatgtggcccccagcttcctgaacagcgtgctgaaccagctgaactgggccttcagcgagttcatcggcatgatccaggagatccagcaggccgctgagcggctggagaggaactttgtggacagccggcagctgaaggtgtgtgccacctgctttgacctgtctgtgtccctgctgcgggtgctggagatgaccatcaccctggtgcctgagatcttcctggactggacccggcccaccagcgagatgctgctgcggcggctggcccagctgctgaaccaggtgctgaacagagtgacagctgagaggaacctgtttgacagagtggtgaccctgcggctgcccggcctggagagcgtggaccactaccccatcctggtggccgtgacaggcatcctggtgcagctgctggtgcggggccctgccagcgagcgggagcaggccacctctgtgctgctggccgacccctgcttccagctgcggagcatctgctacctgctgggccagcctgagcccccagcccctggaacagccctgcctgccccagacaggaagcgcttcagcctgcagagctatgctgactacatctctgcagatgagctggcccaggtggagcagatgctggcccacctgaccagcgccagcgcccaggccgctgctgccagcctgcccaccagcgaggaggacctgtgccccatctgctacgcccaccccatctctgctgtgttccagccctgtggccacaagagctgcaaggcctgcatcaaccagcacctgatgaacaacaaggactgcttcttctgcaagaccaccatcgtgtctgtggaggactgggagaagggggccaacaccagcaccaccagcagcgctgcctag

SEQ ID NO: 19055 - DNA, 2646 bp, Artificial Sequence
  Description of Artificial Sequence: Synthetic coding sequence
atggccggggccgccccccgggtgcgctacctggccggcttctgctgccccctgggcggcctggccgccggcaagccccgggtgctgtgccatgaagctgaggtgttcctgagcactggaagtgagctggtgtatgtgtatgaccaggagggcggcctgctgacagctgccttccgcttcccagaccaggtgtggcacctggagctgctggccccccggcggctgctgtatgccctgtgtgcccggcggggcctgtactgcctgagcctggaccaccctggccgcagccgcagcaccagccaggatgaccgggacagtgaagatggagaccagcccagccctgtgattcctgtggaccctgatgcctgcatcctgcctgatgctgccctgtgtgccttcaccctgctggacagcgtgctggtgaccctggtgcagggccctgcccgctggaagatgcagctgtttgagcagccctgccctggagaggaccccaggcctgggggccagatcggggaggtggagctgagcagctacaccccacctgctggggtgcctgggaagccagctgccccccacttcctgcctgtgctgtgcagcgtgagccccagcggcagccgggtgccccatgacctgctgggcggcagcggcggcttcaccctggaggatgccctgtttggcctgctgtttggagcagatgccaccctgctgcagagccctgtggtgctgtgtggcctgcctgatggccagctgtgctgcgtcatcctgaaggccctggtgaccagccgcagcgcccctggggaccccaatgccctggtgaagatcctgcaccacctggaggagcctgtgatcttcatcggggccctgaagacagagccccaggccgctgaggccgctgagaacttcctgcctgatgaagatgtgcactgtgactgcctggtggccttcggccaccacggccgcatgctggccatcaaggcctcctgggatgaaagtggcaagctggtgcctgagctgcgggagtactgcctgcccggccctgtgctgtgtgccgcctgtggcggcggcggccgggtgtaccacagcacccccagcgacctgtgtgtggtggacctgagccggggcagcacccccctgggccctgagcagcctgaggagggccctgggggcctgccccccatgctgtgcccagccagcctgaacatctgcagcgtggtgtccctgagcgccagccccaggacccatgagggcggcaccaagctgctggccctgagcgccaagggccgcctgatgacctgcagcctggacctggacagcgagatgcctggccctgccaggatgaccacagagagcgctggccagaagatcaaggagctgctgagcggcatcggcaacatcagcgagcgggtgtccttcctgaagaaggctgtggaccagaggaacaaggccctgaccagcctgaatgaggccatgaatgtgtcctgtgccctgctgagcagcggcaccggcccccggcccatcagctgcaccaccagcaccacctggagccggctgcagacccaggatgtgctgatggccacctgtgtgctggagaacagcagcagcttcagcctggaccagggctggaccctgtgcatccaggtgctgaccagcagctgtgccctggacctggacagcgcctgcagcgccatcacctacaccatccctgtggaccagctgggccctggggcccggcgggaggtgaccctgcccctgggccctggagaaaatggaggcctggacctgcctgtgacagtgtcctgcaccctcttctacagcctgcgggaggtggtgggcggggccctggcccccagcgacagcgaggaccccttcctggatgagtgccccagtgatgtgctgcctgagcaggagggcgtgtgcctgcccctgagccgccacacagtggacatgctgcagtgcctgcgcttccctggcctggccccaccccacacccgggcccccagccccctgggccccacccgggaccctgtggccaccttcctggagacctgccgggagcccggcagccagcctgctggccctgccagcctgcgggcagagtacctgccccccagcgtggccagcatcaaggtgtctgctgagctgctgcgggccgccctgaaggatggccacagcggcgtgcccctgtgctgtgccaccctgcagtggctgctggctgaaaatgctgctgtggatgtggtgcgggcccgggccctgagcagcatccagggcgtggccccagatggagccaacgtgcacctgattgtgcgggaggtggccatgacagacctgtgcccagctggccccatccaggccgtggagatccaggtggagagcagcagcctggccgacatctgccgggcccaccacgctgtggtgggccgcatgcagaccatggtgacagagcaggccacccagggcagcagcgccccagacctgcgggtgcagtacctgcggcagatccacgccaaccacgagaccctgctgcgggaggtgcagaccctgcgggaccggctgtgcacagaagatgaggccagcagctgtgccacagcccagaggctgctgcaggtgtaccggcagctgcggcaccccagcctcatcctgctgtag

SEQ ID NO: 19056 - DNA, 471 bp, Artificial Sequence
  Description of Artificial Sequence: Synthetic coding sequence
atgggagacaagaagagccccacccggcccaagaggcagcccaagcccagcagtgatgagggctactgggactgcagcgtgtgcaccttcagaaattctgctgaggccttcaagtgcatgatgtgtgatgtgaggaagggcaccagcaccaggaaggagaagaaggacaaggtggagaaggagaagtctgagaaggagaccaccagcaagaagaacagccacaagaagacccggccccggctgaagaatgtggacaggagcagcgcccagcacctggaggtgacagtgggggacctgaccgtcatcatcacagacttcaaggagaagaccaagagccccccagccagcagcgctgccagcgctgaccagcacagccagagcggcagcagcagtgacaacacagagcggggcatgagccgcagcagcagccccagaggagaggccagcagcctgaatggagagagccactag

SEQ ID NO: 19057 - DNA, 777 bp, Artificial Sequence
  Description of Artificial Sequence: Synthetic coding sequence
atgtgtgccctggagatggctgtgctggagatccagaccaacggggacaccagggtgacagaggaggccatcgcccgggcccggcacagcctgagtgaccccaacatgagggagttcatcctgtgctgcctggcccgggaccctgcccggcggcccagcgcccacagcctgctcttccaccgggtgctgtttgaggtgcacagcctgaagctgctggccgcccactgcttcatccagcaccagtacctgatgccagaaaatgtggtggaggagaagaccaaggccatggacctgcatgctgtgctggccgagctgccccggcccaggaggcctcccctgcagtggagatacagcgaggtgtccttcatggagctggacaagttcctggaggatgtgagaaatggcatctaccccctgatgaactttgctgccacccggcccctgggcctgccccgggtgctggcccctcctcctgaggaggtgcagaaggccaagacccccaccccagagccctttgacagcgagaccaggaaggtgatccagatgcagtgcaacctggagaggtctgaggacaaggcccgctggcacctgaccctgctgctggtgctggaggaccggctgcaccggcagctgacctatgacctgctgcccacagacagcgcccaggacctggccagcgagctggtgcactacggcttcctgcatgaagatgacaggatgaagctggccgccttcctggagagcaccttcctgaagtaccggggcacccaggcctag

SEQ ID NO: 19058 - DNA, 564 bp, Artificial Sequence
  Description of Artificial Sequence: Synthetic coding sequence
atgctgggccgctaccgggagtacagcaatggccaggccggggccatcgagcacctgaaggagagcctggagcagagcattgaccagctgcggagccagaggctgctgagaaattctgggggccgcagcatctctgtgaccagcctgagcgccagtgacctggatggcggcaccggcagcgagctgcaccacttcccccccaccagccccctgaaggactatggagacccccagggcatcaagaggatgaggagcaggactggagtgcgctttgtgcaggagacagatgacatgacccagctgcacggcttccaccagagcctgcgggacctgagcagcgagcagatccggctgggagatgacttcaaccgggagctgagccgccgcagcagaagtgatgctgagaccaagagggccctggaggagctgacagagaagctgaatgaggcccagaagcaggaggtgttctttgtgaagagcctgggcaaggtgaagatccagtgcctgagcagcgctgaggtggacaacgtgttccccatcaacgtgtggcagtgtggcatctag

SEQ ID NO: 19059 - DNA, 927 bp, Artificial Sequence
  Description of Artificial Sequence: Synthetic coding sequence
atgatggatgtgtctggagtgggcttccccagcaaggtgccctggaagaagatgtctgctgaggagctggagaaccagtactgccccagccgctgggtggtgcggctgggcgctgaggaggccctgcggacctacagccagatcggcatcgaggccaccacccgggcccgggccaccaggaagagcctgctgcacgtgccctatggagatggagagggggagaaggtggacatctacttcccagatgagagcagcgaggccctgcccttcttcctgttcttccatggaggctactggcagagcggcagcaaggatgaaagtgccttcatggtgcaccccctgacagcccagggcgtggccgtggtgattgtggcctacggcatcgcccccaagggcaccctggaccacatggtggaccaggtgaccaggtctgtggcctttgtgcagaagcgctaccccagcaacaagggcatctacctgtgtggccacagcgctggggcccacctggccgccatgatgctgctggccgactggaccaagcatggagtgacccccaacctgcggggcttcttcctggtgtctggagtgtttgacctggagcccatcgtgtacaccagccagaatgtggccctgcagctgaccctggaggatgcccagaggaacagcccccagctgaaggtggcccaggcccagcctgtggaccccacctgccgggtgctggtggtggtgggccagtttgacagccctgagttccaccggcagagctgggagttctaccaggtgctgcctgtgcagaccctgtgccagggcgagtggaaggccagctttgaggagctgcatgatgtggaccactttgaaattgtggagaacctgacccagaaggacaacgtgctgacccagatcatcctgaagaccatcttccagtag

SEQ ID NO: 19060 - DNA, 1461 bp, Artificial Sequence
  Description of Artificial Sequence: Synthetic coding sequence
atgagcggcagcacccccttccagatgaggctggtgcacctggacctgaagggggccccacccaaggtgtcctacctgtctgagatcttccccctcttccgggccctgggcgccaacggcctgctgattgaatatgaggacatgttcccctatgagggccccctgcggctgctgcgggccaagtatgcctacagccccagcgagatcaaggagatcctgcacctggccggcctgaatgagctggaggtgatccccctggtgcagaccttcggccacatggagtttgtgctgaagcacacagcctttgcccacctgcgggaggtgggcagcttcccctgcaccctgaacccccatgaggccgagagcctggccctggtgggcgccatgattgaccaggtgctggagctgcaccctggggcccagaggctgcacatcggctgtgatgaggtgtactacctgggggagggggaggccagccgccgctggctgcagcaggagcagaacagcacaggcaagctgtgcctgagccacatgagagctgtggccagcggcgtgaaggcccggcggcccagcgtgacccccctggtgtgggatgacatgctgcgggacctgcctgaggaccagctggccgccagcggcgtgccccagctggtggagcctgtgctgtgggactacacagctgacctggatgtgcacggcaaggtgctgctgatgcagaagtaccgccgctgtggcttcccccagctgtgggccgccagcgccttcaagggggccaccggccccagccaggccgtgccccctgtggagcaccacctgagaaatcatgtgcagtggctgcaggtggccggcagcggccccacagacagcctgcagggcatcatcctgaccggctggcagagatatgaccactacagcgtgctgtgtgagctgctgcctgctggggtgcccagcctggccgcctgcctgcagctgctgctgcggggcggctttgatgaagatgtgaaggccaaggtggagaacctgctgggcatcagcagcctggagaagacagatcctgtgcgggagggcgccggcagcttccctggcagcaacatcctggccctggtgacccaggtgtccctgcacctgcggagctctgtggatgccctgctggagggcaacagatatgtgacaggctggttcagcccctaccaccggcagaggaagctgatccaccctgtgatggtgcagcacatccagcctgctgccctgagcctgctggcccagtggagcaccctggtgcaggagctggaggccgccctgcagctggccttctacccagatgctgtggaggagtggctggaggagaatgtgcaccccagcctgcagaggctgcaggccctgctgcaggacctgtctgaggtgtctgccccacccctgccccccaccagccctggaagagatgtggcccaggacccctag

SEQ ID NO: 19061 - DNA, 240 bp, Artificial Sequence
  Description of Artificial Sequence: Synthetic coding sequence
atgagcagccagcagcagcagaggcagcagcagcagtgccccccccagagggcccagcagcagcaggtgaagcagccctgccagcccccacctgtgaagtgccaggagacctgtgcccccaagaccaaggacccctgtgccccccaggtgaagaagcagtgcccccccaagggcaccatcatcccagcccagcagaagtgccccagcgcccagcaggccagcaagagcaagcagaagtag

SEQ ID NO: 19062 - DNA, 822 bp, Artificial Sequence
  Description of Artificial Sequence: Synthetic coding sequence
atgggccagaaggtgactggaggcatcaagacagtggacatgagggaccccacctaccggcccctgaagcaggagctgcagggcctggactactgcaagcccacccggctggacctgctgctggacatgcctcctgtgtcctatgatgtgcagctgctgcacagctggaacaacaatgacaggagcctgaatgtgtttgtgaaggaggatgacaagctgatcttccaccgccaccctgtggcccagagcacagatgccatccggggcaaggtgggctacacccggggcctgcacgtgtggcagatcacctgggccatgaggcagaggggcacccatgctgtggtgggcgtggccacagcagatgcccccctgcacagcgtgggctacaccaccctggtgggcaacaaccacgagagctggggctgggacctgggcaggaacagactctaccatgatggcaagaaccagcccagcaagacctacccagccttcctggagccagatgagaccttcatcgtgcctgacagcttcctggtggccctggacatggatgatggcaccctgtccttcatcgtggatggccagtacatgggcgtggccttccggggcctgaagggcaagaagctgtaccctgtggtgtctgctgtgtggggccactgtgagatccgcatgagatacctgaatggcctggaccctgagcccctgcccctgatggacctgtgccgccgctctgtgcggctggccctgggccgggagcggctgggggagatccacaccctgcccctgcctgccagcctgaaggcctacctgctgtaccagtag

SEQ ID NO: 19063 - DNA, 3315 bp, Artificial Sequence
  Description of Artificial Sequence: Synthetic coding sequence
atgggaaatgctgctggcagcgctgagcagcctgctggccctgctgcccccccacccaagcagcctgccccacccaagcagcccatgcctgctgctggggagctggaggagcgcttcaacagagccctgaactgcatgaacctgcccccagacaaggtgcagctgctgagccagtatgacaatgagaagaagtgggagctgatctgtgaccaggagcgcttccaggtgaagaaccccccagctgcctacatccagaagctgaagagctatgtggacacaggaggagtgtccaggaaggtggccgctgactggatgagcaacctgggcttcaagagaagagtgcaggagagcacccaggtgctgcgggagctggagaccagcctgcggaccaaccacatcggctgggtgcaggagttcctgaatgaagaaaatagaggcctggatgtgctgctggagtacctggcctttgcccagtgcagcgtgacctatgacatggagagcacagacaacggggccagcaacagcgagaagaacaagcccctggagcagagcgtggaggacctgagcaagggcccccccagctctgtgcccaagagccgccacctgaccatcaagctgaccccagcccacagcaggaaggccctgaggaacagccgcatcgtgtcccagaaggatgatgtgcacgtgtgcatcatgtgcctgcgggccatcatgaactaccagagcggcttcagcctggtgatgaaccacccagcctgtgtgaatgaaattgccctgagcctgaacaacaagaaccccaggaccaaggccctggtgctggagctgctggccgctgtgtgcctggtgcggggcggccatgacatcatcctggccgcctttgacaacttcaaggaggtgtgtggggagcagcacagatttgagaagctgatggagtacttcagaaatgaagacagcaacatcgacttcatggtggcctgcatgcagttcatcaacatcgtggtgcacagcgtggagaacatgaacttccgggtcttcctgcagtatgagttcacccacctgggcctggacctgtacctggagcggctgcggctgacagaaagtgacaagctgcaggtgcagatccaggcctacctggacaacatctttgatgtgggcgccctgctggaggacacagagaccaagaatgctgtgctggagcacatggaggagctgcaggagcaggtggccctgctgacagagcggctgagagatgctgaaaatgaatccatggccaagattgctgagctggagaagcagctgagccaggccaggaaggagctggagaccctgcgggagcgcttcagcgagagcacagccatgggccccagcagaagacctcctgagcctgagaaggcccccccagctgcccccacccggcccagcgccctggagctgaaggtggaggagctggaggagaagggcctcatccgcatcctgcggggccctggagatgctgtgtccattgagatcctgcctgtggccgtggccacccccagcggaggagatgcccccaccccaggagtgcccaccggcagccccagcccagacctggccccagctgctgagcccgcccctggggccgcccctcctcctcctccacccctgcccggcctgcccagcccccaggaggccccacccagcgccccaccccaggccccacccctgcccggcagccctgagcccccaccagccccacccctgcccggggacctgcccccacctcctcctcctcctcctcctcctcctggaacagatggccctgtgcccccacctcctcctcctcctcctcctcctcctgggggccccccagatgccctgggcagaagagacagcgagctgggccctggggtgaaggccaagaagcccatccagaccaagttcaggatgcccctgctgaactgggtggccctgaagcccagccagatcaccggcaccgtcttcacagagctgaatgatgagaaggtgctgcaggagctggacatgtctgactttgaggagcagttcaagaccaagagccagggccccagcctggacctgagcgccctgaagagcaaggccgcccagaaggcccccagcaaggccaccctcatcgaggccaacagagccaagaacctggccatcaccctgaggaagggcaacctgggcgctgagcgcatctgccaggccatcgaggcctatgacctgcaggccctgggcctggacttcctggagctgctgatgaggttcctgcccacagaatatgaaagaagcctcatcaccaggtttgagcgggagcagaggcccatggaggagctgtctgaagaagatcgcttcatgctgtgcttcagccgcatcccccggctgcctgagaggatgaccaccctgaccttcctgggcaacttcccagacacagcccagctgctgatgccccagctgaatgccatcatcgccgcctccatgagcatcaagagcagtgacaagctgcggcagatcctggagatcgtgctggccttcggcaactacatgaacagcagcaagagaggagctgcctacggcttccggctgcagagcctggatgccctgctggagatgaagagcacagacaggaagcagaccctgctgcactacctggtgaaggtgattgctgagaagtacccccagctgaccggcttccacagcgacctgcacttcctggacaaggccggctctgtgtccctggacagcgtgctggctgatgtgcgcagcctgcagaggggcctggagctgacccagcgggagtttgtgcggcaggatgactgcatggtgctgaaggagttcctgcgggccaacagccccaccatggacaagctgctggccgacagcaagacagcccaggaggcctttgaatctgtggtggagtactttggagagaaccccaagaccaccagccctggcctcttcttcagcctcttcagccgcttcatcaaggcctacaagaaggccgagcaggaggtggagcagtggaagaaggaggccgccgcccaggaggccggggctgacaccccaggaaaaggagagcccccagcccccaagagcccccccaaggcccggcggccccagatggacctgatcagcgagctgaagaggcggcagcagaaggagcccctcatctatgaaagtgacagagatggagccatcgaggacatcatcacagacctgaggaaccagccctacatccgggctgacaccggccgccgcagcgccaggagaagacctcctggcccccccctgcaggtgaccagtgacctgagcctgtag

SEQ ID NO: 19064 - DNA, 603 bp, Artificial Sequence
  Description of Artificial Sequence: Synthetic coding sequence
atggaggagaagcccagcaaggtgtccctgaagagcagtgaccggcagggcagtgatgaggagagcgtgcacagcgacacccgggacctgtggaccaccaccaccctgagccaggcccagctgaacatgcccctgtctgaggtgtgtgagggctttgatgaggagggcaggaacatcagcaagacccggggctggcacagccctggccggggcagcctggatgagggctacaaggccagccacaagccagaggagctggatgaacatgccctggtggagctggagctgcaccggggcagctccatggagatcaacctgggggagaaggacacagccagccagattgaagctgagaagagcagctccatgagcagcctgaacatcgccaagcacatgccccaccgggcctactgggccgagcagcagagccggctgcccctgcccctgatggagctgatggagaatgaggccctggagatcctgaccaaggccctgcggagctaccagctgggcatcggccgggaccacttcctgaccaaggagctgcagcgctacatcgagggcctgaagaagaggaggagcaagaggctgtatgtgaactag

SEQ ID NO: 19065 - DNA, 1044 bp, Artificial Sequence
  Description of Artificial Sequence: Synthetic coding sequence
atgaagctgaccagcgagaagctgcccaagaaccccttctacgcctctgtgtcccagtatgctgccaagaaccagaagttcttccagtggaagaaggagaagacagactacacccacgccaacctggtggacaaggccctgcagctgctgaaggagcgcatcctgaagggggacaccctggcctacttcctgcggggccagctgtactttgaggagggctggtatgaggaggccctggagcagtttgaggagatcaaggagaaggaccaccaggccacctaccagctgggcgtgatgtactatgatggcctgggcaccaccctggatgctgagaagggcgtggactacatgaagaagatcctggacagcccctgccccaaggcccggcacctgaagtttgctgctgcctacaacctgggccgggcctactatgagggcaaaggagtgaagaggagcaatgaggaggccgagcggctgtggctgattgctgctgacaatggaaaccccaaggcctctgtgaaggcccagagcatgctgggcctgtactacagcaccaaggagcccaaggagctggagaaggccttctactggcacagcgaggcctgtggaaatggaaacctggagagccagggcgccctgggcctgatgtacctgtatggccagggcatccggcaggacacagaagctgccctgcagtgcctgcgggaggccgctgagagaggaaatgtgtatgcccagggcaacctggtggagtactactacaagatgaagttcttcaccaagtgtgtggccttcagcaagagaattgctgactatgatgaggtgcatgacatccccatgattgcccaggtgacagactgcctgcctgagttcatcggccggggcatggccatggccagcttctaccacgcccgctgcctgcagctgggcctgggcatcaccagagatgagaccacagccaagcactactacagcaaggcctgccgcctgaacccagccctggctgatgagctgcacagcctgctgatccggcagaggatctag

SEQ ID NO: 19066 - DNA, 3525 bp, Artificial Sequence
  Description of Artificial Sequence: Synthetic coding sequence
atgcccctgcccttcggcctgaagctgaagaggacccggcgctacacagtgagcagcaagagctgcctggtggcccgcatccagctgctgaacaatgaatttgtggagttcaccctgtctgtggagagcacaggccaggagagcctggaggccgtggcccagaggctggagctgcgggaggtgacctacttcagcctgtggtactacaacaagcagaaccagaggcgctgggtggacctggagaagcccctgaagaagcagctggacaagtatgccctggagcccaccgtgtactttggagtggtgttctacgtgcccagcgtgtcccagctgcagcaggagatcacccgctaccagtactacctgcagctgaagaaggacatcctggagggcagcatcccctgcaccctggagcaggccatccagctggccggcctggccgtgcaggccgactttggagactttgaccagtatgagagccaggacttcctgcagaagtttgccctcttccctgtgggctggctgcaggatgagaaggtgctggaggaggccacccagaaggtggccctgctgcaccagaagtaccggggcctgacagccccagatgctgagatgctgtacatgcaggaggtggagaggatggatggctatggagaggagagctacccagccaaggacagccagggcagtgacatcagcatcggggcctgcctggagggcatctttgtgaagcacaagaatggccgccaccctgtggtgttccgctggcatgacatcgccaacatgagccacaacaagagcttctttgccctggagctggccaacaaggaggagaccatccagttccagacagaggacatggagacagccaagtacatctggaggctgtgtgtggcccggcacaagttctaccgcctgaaccagtgcaacctgcagacccagacagtgacagtgaaccccatcagaagaagaagcagcagcaggatgagcctgcccaagccccagccctacgtgatgcctcctccaccccagctgcactacaacggccactacacagagccctatgccagcagccaggacaacctgtttgtgcccaaccagaatggctactactgccacagccagaccagcctggaccgggcccagattgacctgaatggccgcatcagaaatggatctgtgtacagcgcccacagcaccaacagcctgaacaacccccagccctacctgcagcccagccccatgagcagcaaccccagcatcaccggcagtgatgtgatgaggccagactacctgcccagccaccgccacagcgctgtgatcccccccagctaccggcccaccccagactatgaaacagtgatgaagcagctgaacagaggcctggtgcatgctgagcggcagagccacagcctgaggaacctgaacatcggcagcagctatgcctacagcaggcctgctgccctggtgtacagccagcctgagatccgggagcacgcccagctgcccagccctgctgctgcccactgccccttcagcctgagctacagcttccacagccccagcccctacccctacccagctgagcggcggcctgtggtgggcgctgtgtctgtgcctgagctgaccaatgcccagctgcaggcccaggactaccccagccccaacatcatgaggacccaggtgtacagacctcctccaccctaccccccacccaggcctgccaacagcaccccagacctgagccgccacctgtacatcagcagcagcaacccagacctgatcaccaggagagtgcaccacagcgtgcagaccttccaggaggacagcctgcctgtggcccacagcctgcaggaggtgtctgagcccctgacagctgcccggcatgcccagctgcacaagagaaattccattgaggtggccggcctgagccacggcctggagggcctgcggctgaaggagaggaccctgagcgccagcgctgctgaggtggcccccagggctgtgtctgtgggcagccagcccagcgtcttcacagagaggacccagcgggagggccctgaggaggccgagggcctgcgctatggccacaagaagagcctgagtgatgccaccatgctgatccacagcagcgaggaggaggaggatgaagattttgaggaggagagcggggcccgggcccccccagcccgggcccgggagcccaggcctggcctggcccaggaccccccaggctgcccccgggtgctgctggccggccccctgcacatcctggagcccaaggcccacgtgcctgatgctgagaagaggatgatggacagcagccctgtgaggaccacagctgaggcccagaggccctggagagatggcctgctgatgcccagcatgtctgagagtgacctgaccaccagcggccgctaccgggcccggcgggacagcctgaagaagaggcctgtgtctgacctgctgagcggcaagaagaacatcgtggagggcctgccccccctgggcggcatgaagaagaccagggtggatgccaagaagattggccccctgaagctggccgccctgaatggcctgagcctgagccgggtgcccctgcctgatgagggcaaggaggtggccacccgggccaccaatgatgagcgctgcaagatcctggagcagaggctggagcagggcatggtgttcacagaatatgaaagaatcctgaagaagaggctggtggatggagagtgcagcacagcccggctgcctgaaaatgctgagaggaaccgcttccaggatgtgctgccctatgatgatgtgcgggtggagctggtgcccaccaaggagaacaacacaggctacatcaatgccagccacatcaaggtgtctgtgtctggaattgagtgggactacatcgccacccagggccccctgcagaacacctgccaggacttctggcagatggtgtgggagcagggcatcgccatcatcgccatggtgacagctgaggaggagggcggccgggagaagagcttccgctactggccccggctgggcagccgccacaacacagtgacctacggccgcttcaagatcaccacccgcttcagaacagacagcggctgctacgccaccaccggcctgaagatgaagcacctgctgaccggccaggagaggacagtgtggcacctgcagtacacagactggccagagcacggctgcccagaggacctgaagggcttcctgagctacctggaggagatccagagcgtgcggcggcacaccaacagcaccagtgacccccagagccccaacccccccctgctggtgcactgcagcgctggggtgggccgcactggagtggtgatcctgtctgagatcatgattgcctgcctggagcacaatgaggtgctggacatcccccgggtgctggacatgctgcggcagcagaggatgatgctggtgcagaccctgtgccagtacacctttgtgtacagagtgctgatccagttcctgaagagcagccgcctcatctag

SEQ ID NO: 19067 - DNA, 2235 bp, Artificial Sequence
  Description of Artificial Sequence: Synthetic coding sequence
atggctgctgacaagccagctgaccagggcgctgagaagcatgagggcaccggccagagcagcggcatcacagaccaggagaaggagctgagcaccaatgccttccaggccttcaccagcggcaactatgatgcctgcctgcagcacctggcctgcctgcaggacatcaacaaggatgactacaagatcatcctgaacacagctgtggccgagttcttcaagagcaaccagaccaccacagacaacctgcggcagaccctgaaccagctgaagaaccaggtgcacagcgctgtggaggagatggatggcctggatgatgtggagaacagcatgctgtactacaaccaggccgtcatcctgtaccacctgcggcagtacacagaggccatctctgtgggggagaagctgtaccagttcatcgagccctttgaggagaagtttgcccaggccgtgtgcttcctgctggtggacctgtacatcctgacctaccaggccgagaaggccctgcacctgctggccgtgctggagaagatgatcagccagggcaacaacaacaagaatggcaagaatgagaccggcaacaacaacaacaaggatggcagcaaccacaaggccgagagcggggccctgattgaagctgccaagagcaagatccaccagtacaaggtgcgggcctacatccagatgaagagcctgaaggcctgcaagcgggagatcaagtctgtgatgaacacagctggcaacagcgcccccagcctcttcctgaagagcaactttgagtacctgcggggcaactacaggaaggctgtgaagctgctgaacagcagcaacattgctgagcaccctggcttcatgaagacaggagaatgtctgcgctgcatgttctggaacaacctgggctgcatccactttgccatgagcaagcacaacctgggcatcttctacttcaagaaggccctgcaggagaatgacaacgtgtgtgcccagctgtctgctggcagcacagatcctgggaagaagttcagcggccggcccatgtgcaccctgctgaccaacaagagatatgagctgctgtacaactgtggcatccagctgctgcacatcggccggcccctggccgcctttgagtgcctgattgaagctgtgcaggtgtaccacgccaacccccggctgtggctgcggctggccgagtgctgcatcgccgccaacaagggcaccagcgagcaggagaccaagggcctgcccagcaagaagggcatcgtgcagagcatcgtgggccagggctaccacaggaagatcgtgctggccagccagagcatccagaacacagtgtacaatgatggccagagcagcgccatccctgtggcctccatggagtttgctgccatctgcctgagaaatgccctgctgctgctgcctgaggagcagcaggaccccaagcaggagaatggagccaagaacagcaaccagctgggcggcaacacagagagcagcgagagcagcgagacctgcagcagcaagagccatgatggagacaagttcatcccagccccacccagcagccccctgaggaagcaggagctggagaacctgaagtgcagcatcctggcctgcagcgcctacgtggccctggccctgggggacaacctgatggccctgaaccacgccgacaagctgctgcagcagcccaagctgagcggcagcctgaagttcctgggccacctgtatgctgctgaggccctgatcagcctggaccgcatcagtgatgccatcacccacctgaacccagaaaatgtgacagatgtgtccctgggcatcagcagcaatgagcaggaccagggcagtgacaagggagaaaatgaggccatggagagcagcggcaagagggccccccagtgctaccccagctctgtgaacagcgccaggacagtgatgctgttcaacctgggcagcgcctactgcctgcggagtgaatatgacaaggccaggaagtgcctgcaccaggccgcctccatgatccaccccaaggaggtgcccccagaggccatcctgctggccgtgtacctggagctgcagaatggaaacacccagctggccctgcagatcatcaagaggaaccagctgctgcctgctgtgaagacccacagcgaggtgaggaagaagcctgtgttccagcctgtgcaccccatccagcccatccagatgcctgccttcaccaccgtgcagaggaagtag

SEQ ID NO: 19068 - DNA, 363 bp, Artificial Sequence
  Description of Artificial Sequence: Synthetic coding sequence
atgcaccccccacctcctgctgctgccatggacttcagccagaacagcctgtttggctacatggaggacctgcaggagctgaccatcatcgagaggcctgtgagaagaagcctgaagaccccagaggagattgaaaggctgactgtggatgaggacctgagtgacatcgagagagctgtgtacctgctgtctgctggccaggatgtgcagggcacctctgtgattgccaacctgcccttcctgatgaggcagaaccccacagagaccctgcggcgggtgctgcccaaggtgcgggtgcatgaagatgcccacctgttcatccagagggtgtggatcagccacatgtttgtgcagagggtgtag

SEQ ID NO: 19069 - DNA, 1335 bp, Artificial Sequence
  Description of Artificial Sequence: Synthetic coding sequence
atgagggagatcgtgctgacccagatcggccagtgtggcaaccagatcggggccaagttctgggaggtgatcagtgatgagcacgccatcgacagcgctggcacctaccatggagacagccacctgcagctggagcgcatcaacgtgtactacaatgaggccagcggcggccgctacgtgcccagggctgtgctggtggacctggagcccggcaccatggattctgtgcgcagcggccccttcggccaggtgttccggccagacaacttcatcttcggccagtgtggggccggcaacaactgggccaagggccactacacagaaggagctgagctgatggagagcgtgatggatgtggtgaggaaggaggccgagagctgtgactgcctgcagggcttccagctgacccacagcctgggcggcggcactggaagtggcatgggcaccctgctgctgagcaagatccgggaggagtacccagaccgcatcatcaacaccttcagcatcctgcccagccccaaggtgtctgacacagtggtggagccctacaatgccaccctgtctgtgcaccagctgattgaaaatgctgatgagaccttctgcatcgacaatgaggccctgtatgacatctgcagcaagaccctgaagctgcccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtggccgagctgacccagcagatgtttgatgccaagaacatgatggccgcctgtgaccccaggcatggccgctacctgacagctgctgccatcttccggggccgcatgcccatgagggaggtggatgagcagatgttcaacatccaggacaagaacagcagctactttgctgactggctgcccaacaacgtgaagacagctgtgtgtgacatccccccccggggcctgaagatgtctgccaccttcatcggcaacaacacagccatccaggagctgttcaagagggtgtctgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggaggaggatgaggagtatgcagaggaggaggtggcctag

SEQ ID NO: 19070 - DNA, 915 bp, Artificial Sequence
  Description of Artificial Sequence: Synthetic coding sequence
atggccaagattgagaagaatgcccccaccatggagaagaagccagagctgttcaacatcatggaggtggatggagtgcccaccctcatcctgagcaaggagtggtgggagaaggtgtgcaacttccaggccaagccagatgacctgatcctggccacctaccccaagagcggcaccacctggatgcatgagatcctggacatgatcctgaatgatggagatgtggagaagtgcaagagggcccagaccctggacagacatgccttcctggagctgaagttcccccacaaggagaagccagacctggagtttgtgctggagatgagcagcccccagctgatcaagacccacctgcccagccacctgatcccccccagcatctggaaggagaactgcaagatcgtgtatgtggccaggaaccccaaggactgcctggtgtcctactaccacttccacaggatggccagcttcatgccagacccccagaacctggaggagttctatgagaagttcatgtctgggaaggtggtgggcggctcctggtttgaccacgtgaagggctggtgggccgccaaggacatgcaccgcatcctgtacctgttctatgaggacatcaagaaggaccccaagcgggagattgagaagatcctgaagttcctggagaaggacatcagcgaggagatcctgaacaagatcatctaccacaccagctttgatgtgatgaagcagaaccccatgaccaactacaccaccctgcccaccagcatcatggaccacagcatcagccccttcatgaggaagggcatgcctggggactggaagaactacttcaccgtggcccagaatgaggagtttgacaaggactaccagaagaagatggccggcagcaccctgaccttcagaacagagatctag

SEQ ID NO: 19071 - DNA, 216 bp, Artificial Sequence
  Description of Artificial Sequence: Synthetic coding sequence
atgtgtggcagctactacggcaactactacggcaccccaggctacggcttctgtggctacggcggcctgggctacggctatggaggcctgggctgcggctacggcagctgctgcggctgcggcttccggcggctgggctgcggctacggctacggcagccgcagcctgtgtggctacggctacggctgcggcagcggcagcggctactactactag

SEQ ID NO: 19072 - DNA, 2094 bp, Artificial Sequence
  Description of Artificial Sequence: Synthetic coding sequence
atggacaagaagagcacagctgagaagctgggcaaggagctgggcctgcaggccaaggagctgtctgctgtgcacagcagccaccatgaaattggagtgaatgacagcaacctcttcagcctggagatgagggagcccctggagagcagcaacaccaagagcttccacagcgctgtggagatcaagaacagaagccagcacgagctgccctgcttccagcaccacggcatcgacacccccaccagcctgcagaagaggtctgcctgctgcccccccagcctgctgcggctggaggagacagccagcagcagccaggatggagacccccagatctgggatgacctgcccttcagcgagagcctgaacaagttcctggccgtgctggagagcgagattgctgtgacccaggctgatgtgagcagcaggaagcaccacgtggacaatgacatcgacaagttccacgccgaccacagccggctgtctgtgaccccccagaggaccaccggggccctgcacaccccacccatcgccctgcggagcagccaggtgattgtgaaggccaactgcagcaaggatgacttcctgttcaactgcaagggcaacctgagccccagcgtggagaaggagagccagcctgacaacaaggtggaggccgtgtctgtgaaccacaacggccgggacatgtctgagtacttcctgcccaacccctacctgagcgccctgagcagcagcagcaaggacctggagaccatcgtgaccctgaagaagaccatccgcatcagcccccaccgggagagtgaccacagcagcctgaacaacaagtacctgaatggctgtggggagatctctgtgtctgagatgaatgagaagctgaccaccctgtgctacaggaagtacaatgatgtgtctgacctgtgcaagctggagaacaagcagtactgccgctggagcaagaaccaggatgacagcttcaccatctgcaggaagctgacctaccccctggagaccctgtgcaacagccccaacagaagcaccaacaccctgaaggagatgccctggggccacatcaacaacaacgtgacccagagctacagcatcggctatgagggcagctatgatgccagcgctgacctgtttgatgacatcgccaaggagatggacatcgccacagagatcaccaagaagagccaggacatcctgctgaagtggggcaccagcctggccgagagccaccccagcgagagtgacttcagcctgcggagcctgtctgaggacttcatccagcccagccagaagctgagcctgcagagcctgagtgacagccgccacagcaggacctgcagccccaccccccacttccagagcgacagcgagtacaactttgagaacagccaggactttgtgccctgcagccagagcacccccatcagcggcttccaccagacccgcatccacggcatcaacagagccttcaagaagcctgtgttctacagcgacctggatggcaactatgagaagatccgcatcttcccagaaaatgacaagcagcaggccagccccagctgccccaagaacatcaagacccccagccagaagatccgcagccccatcgtgtctggagtgtcccagccagatgtgttcaaccactacccctttgctgagtgccacgagacagacagtgatgagtgggtgccccccaccacccagaagatcttccccagcgacatgctgggcttccagggcatcggcctgggcaagtgcctggccgcctaccacttcccagaccagcaggagctgcccaggaagaagctgaagcacatccggcagggcaccaacaagggcctcatcaagaagaagctgaagaacatgctggccgctgtggtgaccaagaagaagacccacaagtacaactgcaagagcagcggctggatcagcaagtgcccagacatccaggtgctggccgccccccagctgcaccccatcctgggccctgacagctgcagcgaggtgaagtgctgcctgcccttcagcgagaagggccccccatctgtgtgtgagaccaggtctgcctggagccctgagctgttctcctag

SEQ ID NO: 19073 - DNA, 306 bp, Artificial Sequence
  Description of Artificial Sequence: Synthetic coding sequence
atgagcaacacccaggccgagaggagcatcatcggcatgattgacatgttccacaagtacacaggaagagatggcaagattgagaagcccagcctgctgaccatgatgaaggagaacttccccaacttcctgagcgcctgtgacaagaagggcatccactacctggccaccgtgtttgagaagaaggacaagaatgaagacaagaagattgacttcagcgagttcctgagcctgctgggggacattgctgctgactaccacaagcagagccatggagctgccccctgcagcggcggcagccagtag

SEQ ID NO: 19074 - DNA, 678 bp, Artificial Sequence
  Description of Artificial Sequence: Synthetic coding sequence
atggctgtgcgcagcctgtgggccggccgcctgcgggtgcagaggctgctggcctggagcgctgcctgggagagcaagggctggcccctgcccttcagcacagccacccagaggacagctggggaggactgccgctcagaagatcctccagatgagctgggcccccccctggccgagcgggccctgcgggtgaaggctgtgaagctggagaaggaggtgcaggacctgactgtgcgctaccagagggccatcgctgactgtgagaacatcagaagaaggacccagagatgtgtggaggatgccaagatcttcggcatccagagcttctgcaaggacctggtggaggtggccgacatcctggagaagaccacagagtgcatcagcgaggagagcgagcctgaggaccagaagctgaccctggagaaggtgttccggggcctgctgctgctggaggccaagctgaagtctgtgtttgccaagcacggcctggagaagctgacccccatcggggacaagtatgacccccatgagcacgagctgatctgccacgtgcctgctggggtgggcgtgcagcccggcaccgtggccctggtgcggcaggacggctacaagctgcacggccgcaccatccggctggcccgggtggaggtggccgtggagagccagaggcggctgtag

SEQ ID NO: 19075 - DNA, 1203 bp, Artificial Sequence
  Description of Artificial Sequence: Synthetic coding sequence
atgaccaccaagaacctggagaccaaggtgacagtgaccagcagccccatcagaggagctggagatggcatggagacagaggagccccccaagtctgtggaggtgaccagcggcgtgcagagcaggaagcaccacagcctgcagagcccctggaagaaggctgtgcccagcgagagccctggggtgctgcagctgggcaagatgctgacagagaaggccatggaggtgaaggctgtgcgcatcctggtgcccaaggccgccatcacccatgacatccccaacaagaacaccaaggtgaagagcctgggccaccacaagggggagttcctgggccagagcgagggcgtgattgagcccaacaaggagctgtctgaggtgaagaatgtgctggagaagctgaagaacagcgagcggcggctgctgcaggacaaggagggcctgagcaaccagctgcgggtgcagacagaggtgaaccgggagctgaagaagctgctggtggcctctgtgggagatgacctgcagtaccactttgagcggctggcccgggagaagaaccagctgatcctggagaatgaggccctgggcaggaacacagcccagctgtctgagcagctggagaggatgagcatccagtgtgatgtgtggaggagcaagttcctggccagccgggtgatggctgatgagctgaccaacagccgggccgccctgcagaggcagaacagagatgcccacggggccatccaggacctgctgtctgagcgggagcagttccggcaggagatgattgccacccagaagctgctggaggagctgctggtgtccctgcagtggggccgggagcagacctacagccccagcgtgcagccccacagcacagctgagctggccctgaccaaccacaagctggccaaggctgtgaacagccacctgctgggcaatgtgggcatcaacaaccagaagaagatccccagcacagtggagttctgcagcaccccagctgagaagatggccgagaccgtgctgcgcatcctggaccctgtgacctgcaaggagagcagcccagacaaccccttctttgagagcagccccaccaccctgctggccaccaagaagaacatcggccgcttccacccctacaccaggtatgagaacatcaccttcaactgctgcaaccactgccgcggggagctgattgccctgtag

SEQ ID NO: 19076 - DNA, 735 bp, Artificial Sequence
  Description of Artificial Sequence: Synthetic coding sequence
atggaccctggagctgccctgcagaggagagctgggggcggcggcggcctgggcgccggcagccctgccctgagcggcggccagggcagaagaaggaagcagccccccaggcctgctgacttcaagctgcaggtgatcatcatcggcagccggggcgtgggcaagaccagcctgatggagcgcttcacagatgacaccttctgtgaggcctgcaagagcacagtgggcgtggacttcaagatcaagacagtggagctgcggggcaagaagatccggctgcagatctgggacacagctggccaggagcgcttcaacagcatcaccagcgcctactaccgcagcgccaagggcatcatcctggtgtatgacatcaccaagaaggagacctttgatgacctgcccaagtggatgaagatgattgacaagtatgcctctgaagatgctgagctgctgctggtgggcaacaagctggactgtgaaacagaccgggagatcacccggcagcagggcgagaagtttgcccagcagatcaccggcatgaggttctgtgaggccagcgccaaggacaacttcaacgtggatgagatcttcctgaagctggtggatgacatcctgaagaagatgcccctggacatcctgagaaatgagctgagcaacagcatcctgagcctgcagcctgagcctgagatccccccagagctgcccccaccccggccccacgtgcgctgctgctag

SEQ ID NO: 19077 - DNA, 1158 bp, Artificial Sequence
  Description of Artificial Sequence: Synthetic coding sequence
atggccctgccccatgacagcaatgagaccagctacctgctgccccccaacaatgaagactggggccggcagaccatcccagactttgtgtatggccagaaggacctgatggccgagggcatccagtggcccagaaatgcccctggcatcccagatgccctgccccagagcccctttgatgctgccctgtgcagcgcctggaagcagagggtggagctgggcctcttccgctaccgcctgcgggagctgcagacccagatcctgcctggagctgtgggctttgtggcccagctgaatgtggagcggggcgtgcagaggcggcccccccagaccatcaagtctgtgcggcaggcctttgatcctgtgcagttcaacttcaacaagatccggcctggagaggtgctcttccggctgcaccgggagccagacctgcccggcaccctgctgcaggaggacatcctggtggtgatcaacgtgagccccctggagtggggccacgtgctgctggtgcctgagcccgcccggcagctgccccagaggctgctgcccggggccctgcgggccggcatcgaggccgtgctgctgagcctgcaccctggcttccgggtgggcttcaacagcctgggcggcctggcctctgtgaaccacctgcacctgcacggctactacctggcccaccggctgcctgtggagcaggcccccagcgagcccctggaccccggcggccacctgcacctgctgcaggacctgcctgcccctggcttcctgttctacacccggggccctggccctgacctggagagcctcatcagccgggtgtgccgggccacagactacctgacagaccatgaaattgcccacaacctgtttgtgaccaggggggcccctcctgggaagaccagccccagcagcgccctgactggagtgcgggtcatcctgtgggccaggaagagcagctttggcatcaaggatggagaggccttcaacgtggccctgtgtgagctggccggccacctgcctgtgaagaccagccaggacttcagcagcctgacagaagctgctgctgtggccctgatccaggactgccgcctgccccccagccaggccgaggatgtgcaggccgccctggtggccctgatgagccaggaggagcagtag

SEQ ID NO: 19078 - DNA, 192 bp, Artificial Sequence
  Description of Artificial Sequence: Synthetic coding sequence
atgctgtgtgacaacttccctggagctgtgtttcctggctgctactggggcagctatggctaccccctgggctacagcgtgggctgcggctacggcagcacctacagccctgtgggctacggcttcggctacggctacaacggctgtggggccttcggctaccgccgctacagcccctttgccctgtactag

SEQ ID NO: 19079 - DNA, 1083 bp, Artificial Sequence
  Description of Artificial Sequence: Synthetic coding sequence
atgctgggcagcggcttcaaggccgagcggctgcgggtgaacctgcggctggtgatcaaccggctgaagctgctggagaagaagaagacagagctggcccagaaggccaggaaggagattgctgactacctggccgccggcaaggatgagcgggcccgcatccgggtggagcacatcatccgggaggactacctggtggaggccatggagatcctggagctgtactgtgacctgctgctggccaggtttggcctcatccagagcatgaaggagctggacagcggcctggccgagagcgtgtccaccctcatctgggccgccccccggctgcagagcgaggtggccgagctgaagatcgtggccgaccagctgtgtgccaagtacagcaaggagtatggcaagctgtgcaggaccaaccagattggaacagtgaatgaccggctgatgcacaagctgtctgtggaggccccacccaagatcctggtggagcgctacctgattgaaattgccaagaactacaacgtgccctatgagccagattctgtggtgatggccgaggcccctcctggggtggagacagacctgattgatgtgggcttcacagatgatgtgaagaagggcggccctggccggggcggcagcggcggcttcaccgcccctgtgggcggcccagatggcaccgtgcccatgcccatgcccatgcccatgcccatgcccagcgccaacacccccttctcctaccccctgcccaagggccccagcgacttcaacggcctgcccatgggcacctaccaggccttccccaacatccaccccccccagatcccagccaccccacccagctatgagagcatgaccctgatgctgatccgcatcagcctgctgcaccggctgctggtgctggaccccagccagaagcccctgcagagcttcctgcctgacctgcagatcaccatgaccaccctgagctaccagagctgccacctgtgccagacccactaccagctgcacctgctggtgcctgccccccagcacctgaagaccctgaccctgatgatcttccctgggggcctgaagagctag

SEQ ID NO: 19080 - DNA, 528 bp, Artificial Sequence
  Description of Artificial Sequence: Synthetic coding sequence
atgcccaagaggagctgcccctttgctgatgtggcccccctgcagctgaaggtgcgggtgtcccagcgggagctgagccggggcgtgtgtgccgagcgctacagccaggaggtgtttgagaagaccaagaggctgctcttcctgggcgcccaggcctacctggaccacgtgtgggatgagggctgtgctgtggtgcacctgcctgagagccccaagccaggccccaccggggcccccagggctgcccggggccagatgctgattggaccagatggccgcctcatccgcagcctgggccaggccagcgaggccgaccccagcggcgtggccagcatcgcctgcagcagctgtgtgcgggctgtggatggcaaggctgtgtgtggccagtgtgagcgggccctgtgtggccagtgtgtgaggacctgctggggctgcggctctgtggcctgcaccctgtgtggcctggtggactgcagcgacatgtatgagaaggtgctgtgcaccagctgtgccatgtttgagacctag

SEQ ID NO: 19081 - DNA, 366 bp, Artificial Sequence
  Description of Artificial Sequence: Synthetic coding sequence
atggaggccgaggtggacaagctggagctgatgttccagaaggccgagagtgacctggactacatccagtaccgcctggagtatgagatcaagaccaaccacccagattctgccagcgagaagaaccctgtgaccctgctgaaggagctgagcgtcatcaagagccgctaccagaccctgtatgcccgcttcaagcctgtggccgtggagcagaaggagagcaagagccgcatctgtgccaccgtgaagaagaccatgaacatgatccagaagctgcagaagcagacagacctggagctgagccccctgaccaaggaggagaagacagctgctgagcagttcaagttccacatgccagacctgtag

SEQ ID NO: 19082 - DNA, 1968 bp, Artificial Sequence
  Description of Artificial Sequence: Synthetic coding sequence
atggtgaccaccctgggccccaagatggctgctgagtggggcggcggcgtgggctacagcggcagcggccctggccgcagccgctggcgctggagcggctctgtgtgggtgcgctctgtgctgctgctgctgggcggcctgcgggccagcgccaccagcacccctgtgtccctgggcagcagccccccctgccgccaccacgtgcccagcgacacagaggtgatcaacaaggtgcacctgaaggccaaccacgtggtgaagagagatgtggatgagcacctgcgcatcaagacagtgtatgacaagtctgtggaggagctgctgcctgagaagaagaacctggtgaagaacaagctgttcccccaggccatctcctacctggagaagaccttccaggtgcggcggcctgctggcaccatcctgctgagccggcagtgtgccaccaaccagtacctgaggaaagaaaatgacccccaccgctactgcacaggagaatgtgccgcccacaccaagtgtggccctgtgattgtgcctgaggagcacctgcagcagtgccgggtgtaccggggcggcaagtggccccatggagctgtgggcgtgcctgaccaggagggcatcagtgatgctgactttgtgctgtatgtgggcgccctggccacagagcgctgcagccatgagaacatcatctcctatgctgcctactgccagcaggaggccaacatggaccggcccatcgccggctacgccaacctgtgccccaacatgatcagcacccagccccaggagtttgtgggcatgctgagcacagtgaagcatgaggtgatccacgccctgggcttctctgctggcctgtttgccttctaccatgacaaggatggcaaccccctgaccagcagatttgctgatggcctgccccccttcaactacagcctgggcctgtaccagtggagcgacaaggtggtgaggaaggtggagcggctgtgggatgtgcgggacaacaagatcgtgcgccacacagtgtacctgctggtgaccccccgggtggtggaggaggccaggaagcactttgactgccctgtgctggagggcatggagctggagaaccagggcggcgtgggcacagagctgaaccactgggagaagaggctgctggagaatgaggccatgacaggcagccacacccagaacagagtgctgagccgcatcaccctggccctgatggaggacaccggccggcagatgctgagcccctactgtgacaccctgcggagcaaccccctgcagctgacctgccggcaggaccagagagctgtggccgtgtgcaacctgcagaagttccccaagcccctgccccaggagtaccagtactttgatgagctgagcggcatcccagctgaggacctgccctactatggaggctctgtggagattgctgactactgccccttcagccaggagttctcctggcacctgagcggggagtaccagaggagcagtgactgccgcatcctggagaaccagcctgagatcttcaagaactacggggctgagaagtatggcccccacagcgtgtgcctgatccagaagagcgcctttgtgatggagaagtgtgagaggaagctgagctacccagactggggcagcggctgctaccaggtgtcctgcagcccccagggcctgaaggtgtgggtgcaggacaccagctacctgtgcagccgggccggccaggtgctgcctgtgtccatccagatgaatggctggattcatgatggcaacctgctgtgccccagctgctgggacttctgtgagctgtgccccccagagacagatcctccagccaccaacctgacccgggccctgcccctggacctgtgcagctgcagcagcagcctggtggtgaccctgtggctgctgctgggcaacctcttccccctgctggccggcttcctgctgtgcatctggcactag

SEQ ID NO: 19083 - DNA, 408 bp, Artificial Sequence
  Description of Artificial Sequence: Synthetic coding sequence
atgggccgggtgaggaccaagacagtgaagaaggccgcccgggtcatcatcgagaagtactacacccggctgggcaatgacttccacaccaacaagagggtgtgtgaggagatcgccatcatccccagcaagaagctgaggaacaagattgctggctacgtgacccacctgatgaagaggatccagaggggccctgtgcggggcatcagcatcaagctgcaggaggaggagcgggagcggcgggacaactacgtgcctgaggtgtctgccctggaccaggagatcatcgaggtggaccctgacaccaaggagatgctgaagctgctggactttggcagcctgagcaacctgcaggtgacccagcccaccgtgggcatgaacttcaagaccccccggggccctgtgtag

SEQ ID NO: 19084 - DNA, 1119 bp, Artificial Sequence
  Description of Artificial Sequence: Synthetic coding sequence
atgaaccactgccagctgcctgtggtgattgacaatggcagcggcatgatcaaggccggcgtggccggctgccgggagccccagttcatctaccccaacatcatcggccgggccaagggccagagccgggccgcccagggcggcctggagctgtgtgtgggggaccaggcccaggactggaggagcagcctcttcatctcctaccctgtggagcggggcctcatcacctcctgggaggacatggagatcatgtggaagcacatctatgactacaacctgaagctgaagccctgtgatggccctgtgctgatcacagagcccgccctgaaccccctggccaaccggcagcagatcacagagatgttctttgagcacctgggcgtgcctgccttctacatgagcatccaggccgtgctggccctgtttgctgctggcttcaccaccggcctggtgctgaacagcggggccggcgtgacccagagcgtgcccatctttgagggctactgcctgccccacggcgtgcagcagctggacctggccggcctggacctgaccaactacctgatggtgctgatgaagaaccacggcatcatgctgctgagcgccagtgacaggaagatcgtggaggacatcaaggagagcttctgctacgtggccatgaactatgaggaggagatggccaagaagccagactgcctggagaaggtgtaccagctgcctgatggcaaggtgatccagctgcatgaccagctgttcagctgcccagaggccctcttcagcccctgccacatgaacctggaggcccctggcatcgacaagatctgcttcagcagcatcatgaagtgtgacaccggcctgagaaattccttcttcagcaacatcatcctggccggcggcagcaccagcttccctggcctggacaagaggctggtgaaggacatcgccaaggtggccccagccaacacagctgtgcaggtgattgcccctcctgagaggaagatctctgtgtggatgggcggcagcatcctggccagcctgagcgccttccaggacatgtggatcacagctgctgagttcaaggaggtgggccccaacatcgtgcaccagcgctgcttctag

SEQ ID NO: 19085 - DNA, 3072 bp, Artificial Sequence
  Description of Artificial Sequence: Synthetic coding sequence
atggatgccaacagcaaggacaagcccccagagaccaaggagagcgccatgaacaatgctggaaatgccagcttcatcctgggcaccgggaagatcgtgaccccccagaagcatgctgagctgccccccaacccctgcaccccagacaccttcaagagccccctgaacttcagcacagtgacagtggagcagctgggcatcaccccagagagctttgtgaggaacagcgctgggaagagcagcagctacctgaagaagtgcagaagaagatctgctgtgggcgcccggggcagccctgagaccaaccacctgatccgcttcatcgcccggcagcagaacatcaagaatgccaggaagagccccctggcccaggacagccccagccagggcagccctgccctgtacagaaatgtgaacaccctgcgggagcgcatcagcgccttccagagcgccttccacagcatcaaggaaaatgagaagatgacaggctgcctggagttcagcgaggccggcaaggagagcgagatgacagacctgaccaggaaggagggcctgagcgcctgccagcagagcggcttccctgctgtgctgagcagcaagagaagacgcatctcctaccagagggacagtgatgagaacctgacagatgctgagggcaaggtgattggcctgcagatcttcaacatcgacacagaccgggcctgtgctgtggagacctctgtggacctgtctgagatcagcagcaagctgggcagcacccagagcggcttcctggtggaggagagcctgcccctgtctgagctgacagagaccagcaatgccctgaaggtggccgactgtgtggtgggcaagggcagcagtgatgctgtgtccccagacaccttcaccgctgaggtgtccagtgatgctgtgcctgatgtgcgcagccctgccaccccagcctgccggcgggacctgcccacccccaagacctttgtgctgcggtctgtgctgaagaagcccagcgtgaagatgtgcctggagagcctgcaggagcactgcaacaacctgtatgatgatgatggcacccaccccagcctcatcagcaacctgcccaactgctgcaaggagaaggaggccgaggatgaagaaaattttgaggccccagccttcctgaacatgaggaagaggaagagggtgacctttggagaggacctgagccctgaggtgtttgatgagagcctgcctgccaacacccccctgaggaagggcggcacccctgtgtgcaagaaggacttcagcggcctgagcagcctgctgctggagcagagccctgtgcctgagcccctgccccagcctgactttgatgacaagggggagaacctggagaacatcgagcccctgcaggtgtcctttgctgtgctgagcagccccaacaagagcagcatcagcgagaccctgtctggaacagacaccttcagcagcagcaacaaccacgagaagatcagcagccccaaggtgggccgcatcaccaggaccagcaacagaagaaaccagctggtgtctgtggtggaggagagcgtgtgcaacctgctgaacacagaggtgcagccctgcaaggagaagaagatcaacagaaggaagagccaggagaccaagtgcaccaagagggccctgcccaagaagagccaggtgctgaagagctgcaggaagaagaagggcaagggcaagaagtctgtgcagaagagcctgtatggagagcgggacatcgccagcaagaagcccctgctgagccccatccctgagctgcctgaggtgcctgagatgacccccagcatccccagcatccggcggctgggcagcggctacttcagcagcaatggcaagctggaggaggtgaagacccccaagaaccctgtgaagaggaaggacctgctgcggcatgaccctgacctgcacatgcaccagggctatgacaagtatgatgtgtctgagttctgcagctacatcaagagcagcagcagcctgggcaatgccaccagtgatgaggaccccaacaccaacatcatgaacatcaatgaaaacaagaacatccccaaggccaagaacaagtctgagagtgaaaatgagcccaaggccggcacagacagccctgtgtcctgtgcctctgtgacagaggagcgggtggccagtgacagccccaagccagccctgaccctgcagcagggccaggagttctctgctgggggccagaatgctgagaacctgtgccagttcttcaagatcagcccagacctgaacatcaagtgtgagaggaaggatgacttcctgggcgctgctgagggcaagctgcagtgcaaccggctgatgcccaacagccagaaggactgccactgcctgggagatgtgctgattgagaacaccaaggagagcaagagccagagcgaggacctgggcaggaagcccatggagagcagctctgtggtgtcctgccgggacaggaaggacagaagaagatccatgtgctacagtgatggccgcagcctgcacctggagaagaatggaaaccacacccccagcagctctgtgggcagctctgtggagatcagcctggagaacagcgagctgttcaaggacctgagtgatgccatcgagcagaccttccagaggaggaacagcgagaccaaggtgagaagaagcacccggctgcagaaggacctggagaatgaaggcctggtgtggatcagcctgcccctgcccagcaccagccagaaggccaagaggaggaccatctgcacctttgacagcagcggctttgagagcatgagccccatcaaggagaccgtgagcagccggcagaagccccagatggcccctcctgtgtctgaccctgagaacagccagggccctgctgctggcagcagtgatgagcccgggaagaggaggaagagcttctgcatcagcaccctggccaacaccaaggccaccagccagttcaagggctacagaagaagaagcagcctgaatggcaagggggagagcagcctgacagccctggagagaattgagcacaacggggagaggaagcagtag

SEQ ID NO: 19086 - DNA, 963 bp, Artificial Sequence
  Description of Artificial Sequence: Synthetic coding sequence
atgagcaagtctgagagccccaaggagcctgagcagctgaggaagctgttcatcggcggcctgagctttgagaccacagatgagagcctgcggagccactttgagcagtggggcaccctgacagactgtgtggtgatgagggaccccaacaccaagaggagccggggctttggatttgtgacctacgccaccgtggaggaggtggatgctgccatgaatgcccggccccacaaggtggatggccgggtggtggagcccaagagagctgtgtcccgggaggacagccagaggcctggggcccacctgactgtgaagaagatctttgtgggcggcatcaaggaggacacagaggagcaccacctgcgggactactttgagcagtatggcaagattgaagtcatcgagatcatgacagaccggggcagcggcaagaagaggggctttgcctttgtgacctttgatgaccatgacagcgtggacaagatcgtcatccagaagtaccacacagtgaatggccacaactgtgaggtgaggaaggccctgagcaagcaggagatggccagcgccagcagcagccagaggggccgcagcggcagcggcaactttggaggcggccggggcggcggctttggaggaaatgacaactttggccggggcggcaacttcagcggccggggcggctttggaggcagcagaggaggcggcggctatggaggcagcggagatggctacaatggatttggaaatgatggcaacaactttggaggcggcggcagctacaatgactttggaaactacaacaaccagagcagcaactttggccccatgaagggcggcaactttggaggccgcagcagcggcccctatggaggcggcggccagtactttgccaagcccaggaaccagggcggctatggaggcagcagcagcagcagcagctatggcagcggccgccgcttctag

SEQ ID NO: 19087 - DNA, 141 bp, Artificial Sequence
  Description of Artificial Sequence: Synthetic coding sequence
atgtgcagcctggccagcggggccaccggctacagccacctgctgaagaagcacttccacacagtgtccctgagcatcagcctcatcctgacagcctggttcatcaacatggacctgaacttcatggacaccctgtcctag

SEQ ID NO: 19088 - DNA, 198 bp, Artificial Sequence
  Description of Artificial Sequence: Synthetic coding sequence
atgtgctactacagcaactactacggcggcctgcgctatggctatggagtgctgggcggcggctacggctgcggctgcggctacggccacggctacggcggcctgggctgcggctacggccggggctatggaggctacggctacggctgctgccggcccagctgctacggccgctactggagctgtggcttctactag

SEQ ID NO: 19089 - DNA, 7059 bp, Artificial Sequence
  Description of Artificial Sequence: Synthetic coding sequence
atggagaaggccaccgtgcctgtggccgccgccacagctgctgagggggagggcagccccccagctgtggccgctgtggccggccccccagctgctgctgaggtgggcggcggcgtgggcggcagcagccgggcccggagcgccagcagcccccggggcatggtgcgggtgtgtgacctgctgctgaagaagaagccaccccagcagcagcaccacaaggccaagaggaacagaacctgccggccccccagcagcagcgagagcagcagtgacagcgacaacagcggcggcggcggcggcggcggcggcggcggcggcggcggcggcggcaccagcagcaacaacagcgaggaggaggaggatgatgatgatgaggaggaggaggtgtctgaggtggagagcttcatcctggaccaggatgacctggagaaccccatgctggagacagccagcaagctgctgctgagcggcacagcagatggagctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaagctgctgctgccctgaccaggatgagagctgagagcacagccaatgccggccagagcgacaacagaagcctggccgaggcctgcagtgaaggagatgtgaatgctgtgaggaagctgctgattgagggccgctctgtgaatgagcacacagaggagggggagagcctgctgtgcctggcctgcagcgctggctactatgagctggcccaggtgctgctggccatgcacgccaacgtggaggaccggggcatcaagggggacatcacccccctgatggccgccgccaacggcggccacgtgaagatcgtgaagctgctgctggcccacaaggcagatgtgaatgcccagagcagcactggaaacacagccctgacctacgcctgtgccggcggctacgtggatgtggtgaaggtgctgctggagagcggggccagcattgaggaccacaatgaaaatggccacacccccctgatggaggccggcagcgctggccacgtggaggtggcccggctgctgctggagaatggagctggcatcaacacccacagcaatgagttcaaggagagcgccctgaccctggcctgctacaagggccacctggagatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgagcggggggccagcctggaggaggtgaatgatgagggctacacccccctgatggaggccgcccgggagggccacgaggagatggtggccctgctgctgggccagggcgccaacatcaatgcccagacagaggagacccaggagacagccctgaccctggcctgctgcggcggcttcctggaggtggccgacttcctgatcaaggccggggctgacatcgagctgggctgcagcacccccctgatggaggccgcccaggagggccacctggagctggtgaagtacctgctggccgccggggccaacgtgcacgccaccacagccaccggggacacagccctgacctacgcctgtgaaaatggccacacagatgtggctgatgtgctgctgcaggccggggctgacctggagcatgaaagtgaaggaggccgcacccccctgatgaaggccgcccgggccggccacgtgtgcaccgtgcagttcctgatcagcaagggggccaacgtgaacagaaccacagccaacaatgaccacacagtgctgagcctggcctgtgccggcggccacctggccgtggtggagctgctgctggcccacggggctgaccccacccaccggctgaaggatggcagcaccatgctgattgaggccgccaagggcggccacacctctgtggtgtgctacctgctggactaccccaacaacctgctgagcgcccctcctccagatgtgacccagctgaccccacccagccatgacctgaacagagccccccgggtgcctgtgcaggccctgcccatggtggtgcccccccaggagccagacaagcccccagccaacgtggccaccaccctgcccatccggaacaaggctgtgtctggccgggccagcgccatgagcaacacccccacccacagcattgctgccagcatcagccagccccagacccccacccccagccccatcatcagccccagcgccatgctgcccatctacccagccatcgacattgatgcccagacagagagcaaccacgacacagccctgaccctggcctgtgccggcggccacgaggagctggtgcagaccctgctggagcggggggccagcattgagcaccgggacaagaagggcttcacccccctcatcctggccgccacagctggccacgtgggcgtggtggagatcctgctggacaatggagctgacatcgaggcccagagcgagaggaccaaggacacccccctgagcctggcctgcagcggcggccggcaggaggtggtggagctgctgctggcccggggggccaacaaggagcacagaaatgtgtctgactacacccccctgagcctggccgccagcggcggctacgtgaacatcatcaagatcctgctgaatgctggagctgagatcaacagcaggacaggcagcaagctgggcatcagccccctgatgctggccgccatgaatggccacacagctgctgtgaagctgctgctggacatgggcagtgacatcaatgcccagatcgagaccaacagaaacacagccctgaccctggcctgcttccagggccgcacagaggtggtgtccctgctgctggacaggaaggccaacgtggagcaccgggccaagacaggcctgacccccctgatggaggccgccagcggcggctatgcagaggtgggccgggtgctgctggacaagggagcagatgtgaatgcccctcctgtgcccagcagccgggacacagccctgaccatcgctgctgacaagggccactacaagttctgtgagctgctgattggccgcggggcccacattgatgtgaggaacaagaagggcaacacccccctgtggctggccgccaatggaggccacctggatgtggtgcagctgctggtgcaggccggggctgatgtggatgctgctgacaacaggaagatcacccccctgatggccgccttcagaaaaggacatgtgaaggtggtgcgctacctggtgaaggaggtgaaccagttccccagcgacagcgagtgcatgagatacatcgccaccatcacagacaaggagatgctgaagaagtgccacctgtgcatggagagcatcgtgcaggccaaggaccggcaggccgctgaggccaacaagaatgccagcatcctgctggaggagctggacctggagaagctgcgggaggagagccggcggctggccctggccgccaagcgggagaagaggaaggagaagaggaggaagaagaaggaggagcagaggaggaagctggaggagattgaggccaagaacaaggaaaattttgagctgcaggccgcccaggagaaggagaagctgaaggtggaggatgagcctgaggtgctgacagagccccccagcgccaccaccaccaccaccatcggcatcagcgccacctggaccaccctggccggcagccacggcaagaggaacaacaccatcaccaccaccagcagcaagaggaagaacaggaagaacaagatcaccccagaaaatgtgcagatcatctttgatgaccccctgcccatctcctacagccagcctgagaaggtgaatggagagagcaagagcagcagcaccagcgagagcggggacagcgacaacatgaggatcagcagctgcagtgatgagagcagcaacagcaacagcagcaggaagagtgacaaccacagccctgctgtggtgaccaccaccgtgagcagcaagaagcagcccagcgtgctggtgaccttccccaaggaggagaggaagtctgtgtctgggaaggccagcatcaagctgtctgagaccatcagcgagggcaccagcaacagcctgagcacctgcaccaagagcggccccagccccctgagcagccccaacgggaagctgactgtggccagccccaagaggggccagaagcgggaggagggctggaaggaggtggtgcggcgcagcaagaaggtgtctgtgcccagcaccgtcatcagcagggtcatcggccggggcggctgcaacatcaatgccatccgggagttcaccggggcccacatcgacatcgacaagcagaaggacaagacaggagaccgcatcatcaccatccggggcggcacagagagcacccggcaggccacccagctgatcaatgccctgatcaaggaccctgacaaggagattgatgagctgatccccaagaaccggctgaagagcagcagcgccaacagcaagattggcagcagcgcccccaccaccacagctgccaacaccagcctgatgggcatcaagatgaccaccgtggccctgagcagcaccagccagacagccacagccctgactgtgcctgccatcagcagcgccagcacccacaagaccatcaagaaccctgtgaacaacgtgcggcccggcttccctgtgtccctgcccctggcctaccccccaccccagtttgcccacgccctgctggccgcccagaccttccagcagatccggcccccccggctgcccatgacccactttggaggcaccttccccccagcccagagcacctggggccccttccctgtgcggcccctgagccctgcccgggccaccaacagccccaagccccacatggtgcccaggcacagcaaccagaacagcagcggcagccaggtgaacagcgctggcagcctgaccagcagccccaccaccaccaccagcagcagcgccagcacagtgcccggcaccagcaccaacggcagccccagcagccccagcgtgcggcggcagctgtttgtgacagtggtgaagaccagcaatgccaccaccaccaccgtgaccaccacagccagcaacaacaacacagcccccaccaatgccacctaccccatgcccacagccaaggagcactaccctgtgagcagccccagcagccccagccccccagcccagcctggaggagtgtccaggaacagccccctggactgtggcagcgccagccccaacaaggtggccagcagcagcgagcaggaggccggcagcccccctgtggtggagaccaccaacaccaggcctcccaacagcagcagcagcagcggcagcagcagcgcccacagcaaccagcagcagcccccaggctctgtgtcccaggagccccggccccccctgcagcagagccaggtgcccccacctgaggtgaggatgacagtgccccccctggccaccagcagcgcccctgtggccgtgcccagcacagcccctgtgacctaccccatgccccagacccccatgggctgcccccagcccacccccaagatggagaccccagccatccggcccccaccccacggcaccacagccccccacaagaacagcgcctctgtgcagaacagctctgtggccgtgctgtctgtgaaccacatcaagaggccccacagcgtgcccagctctgtgcagctgcccagcaccctgagcacccagagcgcctgccagaacagcgtgcacccagccaacaagcccatcgcccccaacttcagcgcccccctgcccttcggccccttcagcaccctgtttgagaacagccccaccagcgcccacgccttctggggcggctctgtggtgagcagccagagcaccccagagagcatgctgagcggcaagagcagctacctgcccaacagcgaccccctgcaccagagcgacaccagcaaggcccctggcttccggccccccctgcagaggcctgcccccagccccagcggcatcgtgaacatggacagcccctacggctctgtgacccccagcagcacccacctgggcaactttgccagcaacatcagcggcggccagatgtatggccctggggcccccctgggcggggccccagctgctgccaacttcaaccggcagcacttcagccccctgagcctgctgaccccctgcagcagcgccagcaatgacagcagcgcccagagcgtgagcagcggcgtgcgggcccccagccctgcccccagctctgtgcccctgggcagcgagaagcccagcaatgtgtcccaggacaggaaggtgcctgtgcccatcggcacagagaggtctgcccgcatccggcagacaggcaccagcgcccccagcgtgattggcagcaacctgagcacctctgtgggccacagcggcatctggagctttgagggcatcggcggcaaccaggacaaggtggactggtgcaaccctggcatgggcaaccccatgatccaccggcccatgtctgaccccggggtcttcagccagcaccaggccatggagcgggacagcacaggcatcgtgacccccagcggcaccttccaccagcacgtgcctgctggctacatggacttccccaaggtgggcggcatgcccttctctgtgtatggaaatgccatgatcccccctgtggcccccatcccagatggagctgggggccccatcttcaacggcccccacgccgctgaccccagctggaacagcctcatcaagatggtgagcagcagcacagaaaataatggcccccagacagtgtggacaggcccctgggccccccacatgaacagcgtgcacatgaaccagctgggctag

SEQ ID NO: 19090 - DNA, 1374 bp, Artificial Sequence
  Description of Artificial Sequence: Synthetic coding sequence
atgagcggcacccgggccagcaatgacaggcctcctggggccggcggcgtgaagaggggccgcctgcagcaggaggccgccgccaccggcagccgggtgacagtggtgctgggcgcccagtggggagatgagggcaagggcaaggtggtggacctgctggccacagatgctgacatcatcagccgctgccagggcggcaacaatgccggccacacagtggtggtggatggcaaggagtatgacttccacctgctgcccagcggcatcatcaacaccaaggctgtgtccttcatcggaaatggagtggtgatccacctgcccggcctgtttgaggaggccgagaagaatgagaagaagggcctgaaggactgggagaagaggctcatcatcagtgaccgggcccacctggtgtttgacttccaccaggccgtggatggcctgcaggaggtgcagaggcaggcccaggagggcaagaacatcggcaccaccaagaagggcatcggccccacctacagcagcaaggccgccaggacaggcctgcgcatctgtgacctgctgagtgactttgatgagttcagcagccgcttcaagaacctggcccaccagcaccagagcatgttccccaccctggagattgacatcgagggccagctgaagaggctgaagggctttgctgagcgcatccggcccatggtgagagatggagtgtacttcatgtatgaggccctgcacggcccccccaagaagatcctggtggagggcgccaatgctgccctgctggacatcgactttggcacctacccctttgtgaccagcagcaactgcaccgtgggcggcgtgtgcaccggcctgggcatccccccccagaacattggagatgtgtatggagtggtgaaggcctacaccaccagggtgggcattggagccttccccacagagcagatcaatgagatcggcggcctgctgcagacccggggccacgagtggggcgtgaccactggaaggaagagaagatgtggctggctggacctgatgatcctgcgctatgcccacatggtgaatggcttcaccgccctggccctgaccaagctggacatcctggatgtgctgggggaggtgaaggtgggcgtgtcctacaagctgaatggcaagaggatcccctacttccctgccaaccaggagatgctgcagaaggtggaggtggagtatgagaccctgcccggctggaaggctgacaccaccggggcccggcgctgggaggacctgcccccccaggcccagaactacatccgctttgtggagaaccacgtgggcgtggccgtgaagtgggtgggcgtgggcaagagccgggagagcatgatccagctgttctag

SEQ ID NO: 19091 - DNA, 1596 bp, Artificial Sequence
  Description of Artificial Sequence: Synthetic coding sequence
atgtgcagcctggccagcggggccactggaggccgcggggctgtggagaatgaggaggacctgcctgagctgagtgacagcggagatgaagctgcctgggaggatgaagatgatgctgacctgccccacggcaagcagcagaccccctgcctcttctgcaacagactcttcaccagcgctgaggagaccttcagccactgcaagtctgagcaccagttcaacatcgacagcatggtgcacaagcacggcctggagttctacggctacatcaagctgatcaacttcatccggctgaagaaccccaccgtggagtacatgaacagcatctacaaccctgtgccctgggagaaggaggagtacctgaagcctgtgctggaggatgacctgctgctgcagtttgatgtggaggacctgtatgagcctgtgtctgtgcccttctcctaccccaacggcctgtctgagaacacctctgtggtggagaagctgaagcacatggaggcccgggccctgtctgctgaggccgccctggcccgggcccgggaggacctgcagaagatgaagcagtttgcccaggactttgtgatgcacacagatgtgaggacctgcagcagcagcacctctgtgattgctgacctgcaggaggatgaagatggagtgtacttcagcagctatggccactacggcatccacgaggagatgctgaaggacaagatcagaacagagagctacagagacttcatctaccagaacccccacatcttcaaggacaaggtggtgctggatgtgggctgcggcaccggcatcctgtccatgtttgctgccaaggccggggccaagaaggtgctgggcgtggaccagagcgagatcctgtaccaggccatggacatcatccggctgaacaagctggaggacaccatcaccctcatcaagggcaagattgaggaggtgcacctgcctgtggagaaggtggatgtgatcatcagcgagtggatgggctacttcctgctgtttgagagcatgctggacagcgtgctgtatgccaagaacaagtacctggccaagggcggctctgtgtacccagacatctgcaccatcagcctggtggccgtgtctgatgtgaacaagcatgctgaccgcatcgccttctgggatgatgtgtatggcttcaagatgagctgcatgaagaaggctgtgattcctgaggccgtggtggaggtgctggaccccaagaccctcatcagcgagccctgtggcatcaagcacatcgactgccacaccaccagcatcagtgacctggagttcagcagtgacttcaccctgaagatcaccaggacctccatgtgcacagccatcgccggctactttgacatctactttgagaagaactgccacaacagagtggtgttcagcacaggcccccagagcaccaagacccactggaagcagacagtgttcctgctggagaagcccttctctgtgaaggccggggaggccctgaagggcaaggtgacagtgcacaagagcaagaaggaccccaggagcctgactgtgaccctgaccctgaacaacagcacccagacctacggcctgcagtag

SEQ ID NO: 19092 - DNA, 1659 bp, Artificial Sequence
  Description of Artificial Sequence: Synthetic coding sequence
atgtctgtgctgagccctggggacctgaagcccaagaggggcagcccccaccggggcagcctggacagaacagatgccagcacagacctggccatgaggtcctggcccagcgagctgggcagcaggacctgcagcaccagcgccaccaccacagcccccagcaacagcacccccatcgcccggcaccctggccgcaccaagggctacaacagtgatgacaacctgtgtgagcccagcctggagtttgaggtgcccaaccaccggcagtatgtgtcccggcccagcagcctggagagcagcaggaacaccagcagcaacagcagccccctgaacctgaagggcagcagcgagcagctgcacggccgctctgagagcttcagcagtgaagatctcatccccagccgggacctggccaccctgccccgggaggccagcaccccaggaagaaatgccctgggcagacatgagtaccccctgcccagaaatggccccctgccccaggagggcgcccagaagaggggcacagccccaccctacgtgggcgtgcggccctgcagcgccagccccagcagcgagatggtgaccctggaggagttcctggaggagagcaacagaagcagccccacccatgacacccccagctgcagagatgacctgctgagtgactacttcaggaaggccagtgaccccccagccatcggcggccagcccggccccccagccaagaaggagggcgccaagatgcccaccaactttgtggcccccaccgtgaagatggccgcccccaccagcgagggccggcccctgaagccaggccagtatgtgaagcccaacttccggctgacagaggccgaggcccctccttctgtggccccccggcaggcccagcccccccagagcctgagcctgggccggccccggcaggcccctgtgcccccagccagccacgccccagccagccgcagcgccagcctgagccgggccttcagcctggccagcgctgacctgctgcgggccagcggccctgaggcctgcaagcaggagagcccccagaagctgggcgcccctgaggccctgggcggccgggagaccggcagccacaccctgcagagccctgccccacccagcagccacagcctggcccgggagaggacccccctggtgggcaaggccggcagcagctgccagggccctggccccaggagccggcccctggacacccggcgcttcagcctggccccacccaaggaggagcggctggcccccctgcaccagagcgccacagccccagccatcgccacagctggagctggagctgctgctgctggcagcggcagcaacagccagctgctgcacttctccccagctgctgccccagctgcccggaccaagcccaaggccccacccaggtctggagaggtggccaccatcacccctgtgcgggccggcctgagcctgtctgaaggagatggagtgcccggccagggctgcagcgagggcctgcctgccaagagccctggccgcagcccagacctggccccccacctgggccgggccctggaggactgcagccggggctctgtgtccaagagcagccctgccagccctgagcccggcggggacccccagacagtgtggtatgaatatggctgtgtgtag

SEQ ID NO: 19093 - DNA, 774 bp, Artificial Sequence
  Description of Artificial Sequence: Synthetic coding sequence
atggctgacaagatggacatgagcctggatgacatcatcaagctgaacagaagccagagaggaggccggggcggcggccggggccggggccgggccggcagccagggcggccggggcggcggggcccaggccgccgcccgggtgaacagaggaggcggccccatccggaacagacctgccatcgcccggggagctgctgggggcggcggcaggaacagacctgccccctacagccggcccaagcagctgcctgacaagtggcagcacgacctgtttgacagcggctttggaggaggagctggggtggagaccggcggcaagctgctggtgagcaacctggactttggagtgtctgatgctgacatccaggagctgtttgctgagtttggcaccctgaagaaggctgctgtgcactatgacaggagcggccgcagcctgggcacagcagatgtgcactttgagaggaaggcagatgccctgaaggccatgaagcagtacaatggagtgcccctggatggccggcccatgaacatccagctggtgaccagccagattgatgcccagaggaggcctgcccagagcgtgaacagaggaggcatgaccaggaacagaggagctgggggctttggaggcggcggcggcacccggcggggcacccggggcggggcccggggccggggccgcggggccggcaggaacagcaagcagcagctgtctgctgaggagctggatgcccagctggatgcctacaatgccaggatggacaccagctag

SEQ ID NO: 19094 - DNA, 876 bp, Artificial Sequence
  Description of Artificial Sequence: Synthetic coding sequence
atgggcgtggccgcccggcccccagccctgcggcactggttcagccacagcatccccctggccatctttgccctgctgctgctgtacctgtctgtgcgcagcctgggcgcccggagcggctgcggcccccgggcccagccctgtgtgcctggagaaacagcccccttccaggtgcggcaggagagcggcaccctggaggcccctgagaggaagcagcccccctgcctgggcccccggggcatgctgggccgcatgatgaggcgcttccacgccagcctgaagccagaaggagatgtgggcctgagcccctacctggccggctggagggccctggtggagttcctgacccccctgggctctgtgtttgcctttgccacccgggaggccttcaccaaggtgacagacctggaggcccgggtgcacggcccagatgctgagcactactggagcctggtggccatggccgcctgggagaggagagctggcctgctggagcagcctggagctgccccccgggaccccaccaggagcagcggcagcaggaccctgctgctgctgcaccgggccctgcgctggagccagctgtgcctgcaccgggtggccaccggggccctgggcggcccagatgctggggtgcagtgcagtgatgcctaccgggccgccctgggcccccaccacccctggctggtgcggcagacagcccggctggccttcctggccttccctggaagaagaaggctgctggagctggcctgccctggggccacagaggccgaggcccgggccgccctggtgcgggccgccggcaccctggaggatgtgtacaacagaacccagagcctgctggccgagcggggcctgctgcagctggcctag

SEQ ID NO: 19095 - DNA, 3303 bp, Artificial Sequence
  Description of Artificial Sequence: Synthetic coding sequence
atgggaaatgctgctggcagcgctgagcagcctgctggccctgctgcccccccacccaagcagcctgccccacccaagcagcccatgcctgctgctggggagctggaggagcgcttcaacagagccctgaactgcatgaacctgcccccagacaaggtgcagctgctgagccagtatgacaatgagaagaagtgggagctgatctgtgaccaggagcgcttccaggtgaagaaccccccagctgcctacatccagaagctgaagagctatgtggacacaggaggagtgtccaggaaggtggccgctgactggatgagcaacctgggcttcaagagaagagtgcaggagagcacccaggtgctgcgggagctggagaccagcctgcggaccaaccacatcggctgggtgcaggagttcctgaatgaagaaaatagaggcctggatgtgctgctggagtacctggcctttgcccagtgcagcgtgacctatgacatggagagcacagacaacggggccagcaacagcgagaagaacaagcccctggagcagagcgtggaggacctgagcaagggcccccccagctctgtgcccaagagccgccacctgaccatcaagctgaccccagcccacagcaggaaggccctgaggaacagccgcatcgtgtcccagaaggatgatgtgcacgtgtgcatcatgtgcctgcgggccatcatgaactaccagagcggcttcagcctggtgatgaaccacccagcctgtgtgaatgaaattgccctgagcctgaacaacaagaaccccaggaccaaggccctggtgctggagctgctggccgctgtgtgcctggtgcggggcggccatgacatcatcctggccgcctttgacaacttcaaggaggtgtgtggggagcagcacagatttgagaagctgatggagtacttcagaaatgaagacagcaacatcgacttcatggtggcctgcatgcagttcatcaacatcgtggtgcacagcgtggagaacatgaacttccgggtcttcctgcagtatgagttcacccacctgggcctggacctgtacctggagcggctgcggctgacagaaagtgacaagctgcaggtgcagatccaggcctacctggacaacatctttgatgtgggcgccctgctggaggacacagagaccaagaatgctgtgctggagcacatggaggagctgcaggagcaggtggccctgctgacagagcggctgagagatgctgaaaatgaatccatggccaagattgctgagctggagaagcagctgagccaggccaggaaggagctggagaccctgcgggagcgcttcagcgagagcacagccatgggccccagcagaagacctcctgagcctgagaaggcccccccagctgcccccacccggcccagcgccctggagctgaaggtggaggagctggaggagaagggcctcatccgcatcctgcggggccctggagatgctgtgtccattgagatcctgcctgtggccgtggccacccccagcggaggagatgcccccaccccaggagtgcccaccggcagccccagcccagacctggccccagctgctgagcccgcccctggggccgcccctcctcctcctccacccctgcccggcctgcccagcccccaggaggccccacccagcgccccaccccaggccccacccctgcccggcagccctgagcccccaccagccccacccctgcccggggacctgcccccacctcctcctcctcctcctcctcctcctggaacagatggccctgtgcccccacctcctcctcctcctcctcctcctcctgggggccccccagatgccctgggcagaagagacagcgagctgggccctggggtgaaggccaagaagcccatccagaccaagttcaggatgcccctgctgaactgggtggccctgaagcccagccagatcaccggcaccgtcttcacagagctgaatgatgagaaggtgctgcaggagctggacatgtctgactttgaggagcagttcaagaccaagagccagggccccagcctggacctgagcgccctgaagagcaaggccgcccagaaggcccccagcaaggccaccctcatcgaggccaacagagccaagaacctggccatcaccctgaggaagggcaacctgggcgctgagcgcatctgccaggccatcgaggcctatgacctgcaggccctgggcctggacttcctggagctgctgatgaggttcctgcccacagaatatgaaagaagcctcatcaccaggtttgagcgggagcagaggcccatggaggagctgtctgaagaagatcgcttcatgctgtgcttcagccgcatcccccggctgcctgagaggatgaccaccctgaccttcctgggcaacttcccagacacagcccagctgctgatgccccagctgaatgccatcatcgccgcctccatgagcatcaagagcagtgacaagctgcggcagatcctggagatcgtgctggccttcggcaactacatgaacagcagcaagagaggagctgcctacggcttccggctgcagagcctggatgccctgctggagatgaagagcacagacaggaagcagaccctgctgcactacctggtgaaggtgattgctgagaagtacccccagctgaccggcttccacagcgacctgcacttcctggacaaggccggctctgtgtccctggacagcgtgctggctgatgtgcgcagcctgcagaggggcctggagctgacccagcgggagtttgtgcggcaggatgactgcatggtgctgaaggagttcctgcgggccaacagccccaccatggacaagctgctggccgacagcaagacagcccaggaggcctttgaatctgtggtggagtactttggagagaaccccaagaccaccagccctggcctcttcttcagcctcttcagccgcttcatcaaggcctacaagaaggccgagcaggaggtggagcagtggaagaaggaggccgccgcccaggaggccggggctgacaccccaggaaaaggagagcccccagcccccaagagcccccccaaggcccggcggccccagatggacctgatcagcgagctgaagaggcggcagcagaaggagcccctcatctatgaaagtgacagagatggagccatcgaggacatcatcaccgtcatcaagacagtgcccttcaccgccaggacaggcaagaggaccagccggctgctgtgtgaggccagcctgggggaggagatgcccctgtag

SEQ ID NO: 19096 - DNA, 1839 bp, Artificial Sequence
  Description of Artificial Sequence: Synthetic coding sequence
atggagaaccagctggccaagagcacagaggagaggaccttccagtaccaggacagcctgcccagcctgcctgtgcccagcctggaggagagcctgaagaagtacctggagagcgtgaagccctttgccaaccaggaggagtacaagaagacagaggagatcgtgcagaagttccagagcggcatcggggagaagctgcaccagaagctgctggagcgggccaagggcaagaggaactggctggaggagtggtggctgaatgtggcctacctggatgtgcgcatccccagccagctgaatgtgaactttgctggccctgctgcccactttgagcactactggccacccaaggagggcacccagctggagcggggcagcatcaccctgtggcacaacctgaactactggcagctgctgaggaaggagaaggtgcctgtgcacaaggtgggcaacacccccctggacatgaaccagttcaggatgctgttcagcacctgcaaggtgcccggcatcacccgggacagcatcatgaactacttcagaacagagagcgagggccgcagccccaaccacatcgtggtgctgtgccggggccgggcctttgtgtttgatgtgattcatgagggctgcctggtgaccccacctgagctgctgcggcagctgacctacatccacaagaagtgccacagcgagccagatggccctggcattgctgccctgaccagcgaggagaggacccgctgggccaaggcccgggagtacctgattggcctggaccctgagaacctggccctgctggagaagatccagagcagcctgctggtgtacagcatggaggacagcagcccccacgtgaccccagaggactacagcgagatcatcgccgccatcctgattggagaccccaccgtgcgctggggagacaagagctacaacctgatctccttcagcaatggagtgtttggctgcaactgtgaccacgccccctttgatgccatgatcatggtgaacatctcctactacgtggatgagaagatcttccagaatgaaggccgctggaagggcagcgagaaggtgcgggacatccccctgcctgaggagctgatcttcatcgtggatgagaaggtgctgaatgacatcaaccaggccaaggcccagtacctgcgggaggccagtgacctgcagattgctgcctatgccttcaccagctttgggaagaagctgaccaagaacaagatgctgcacccagacaccttcatccagctggccctgcagctggcctactaccgcctgcacggccaccctggctgctgctatgaaacagccatgaccaggcacttctaccacggccgcacagagaccatgaggagctgcaccgtggaggccgtgcgctggtgccagagcatgcaggaccccagcgtgaacctgcgggagcggcagcagaagatgctgcaggcctttgccaagcacaacaagatgatgaaggactgcagcgctggaaaaggatttgacagacacctgctgggcctgctgctgattgccaaggaggagggcctgcctgtgcctgagctgttcacagaccccctcttcagcaagagcggcggcggcggcaactttgtgctgagcaccagcctggtgggctacctgcgggtgcagggcgtggtggtgcccatggtgcacaacggctacggcttcttctaccacatcagagatgacagatttgtggtggcctgcagcgcctggaagagctgcccagagacagatgctgagaagctggtgcagctgaccttctgtgccttccatgacatgatccagctgatgaacagcacccacctgtag

SEQ ID NO: 19097 - DNA, 1773 bp, Artificial Sequence
  Description of Artificial Sequence: Synthetic coding sequence
atgtctgacagccctgctggcagcaaccccaggaccccagagagcagcggcagcggcagcggcggcggcggcaagaggcctgctgtgcctgctgctgtgtccctgctgcccccagctgaccccctgcggcaggccaaccggctgcccatccgggtgctgaagatgctgagcgcccacacaggccacctgctgcaccctgagtacctgcagcccctgagcagcacccctgtgagccccatcgagctggatgccaagaagagccccctggccctgctggcccagacctgcagccagatcggcaagccagaccccccacccagcagcaagctgaacagcgtggccgccgccgccaacggcctgggcgctgagaaggaccccggccgcagcgcccctggagctgccagcgctgctgctgccctgaagcagctgggggacagccctgctgaggacaagagcagcttcaagccctacagcaaaggaagtggcggcggggacagcaggaaggacagcggcagcagctctgtgagcagcaccagcagcagcagcagcagcagccctggggacaaggccggcttccgggtgcccagcgctgcctgcccccccttcccccctcatggagcccctgtgtctgccagcagcagcagcagcagccctgggggcagcagaggaggcagcccccaccacagcgactgcaagaatggaggcggcgtgggcggcggggagctggacaagaaggaccaggagcccaagcccagccctgagcctgctgctgtgtccagaggaggcggcggggagcccggggcccatggaggagctgagagcggggccagcggcaggaagtctgagcccccatctgccctggtgggcgccggccacgtggcccctgtgagcccctacaagccaggccacagcgtcttccccctgccccccagcagcatcggctaccacggcagcatcgtgggcgcctatgccggctaccccagccagtttgtgcccggcctggaccccagcaagagcggcctggtgggcggccagctgagcggcggcctgggcctgcccccaggcaagccacccagcagcagccccctgaccggggccagcccccccagcttcctgcagggcctgtgccgggacccctactgcctgggcggctaccacggggccagccacctgggcggcagcagctgcagcacctgcagcgcccatgaccctgctggccccagcctgaaggccggcggctaccccctggtgtacccaggccaccccctgcagcctgctgccctgagcagcagcgctgcccaggccgccctgcccggccaccccctgtacacctacggcttcatgctgcagaatgagcccctgccccacagctgcaactgggtggccgccagcggcccctgtgacaagagatttgccaccagcgaggagctgctgagccacctgcggacccacacagccctgcccggggctgagaagctgctggccgcctacccaggggccagcggcctgggcagcgctgctgctgctgctgctgctgctgccagctgccacctgcacctgcccccacctgctgcccctggcagccctggcagcctgagcctgaggaacccccacaccctgggcctgagccgctaccacccctacggcaagagccacctgagcacagctgggggcctggccgtgcccagcctgcccacagctggcccctactacagcccctatgccctgtatggccagaggctggccagcgccagcgccctgggctaccagtag

SEQ ID NO: 19098 - DNA, 1020 bp, Artificial Sequence
  Description of Artificial Sequence: Synthetic coding sequence
atgtggacagcccggggccccttcagaagagaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcctggagagttcaacagcggcaaccagcccagcaaccgggagaagaaccgctacagagacatcctgccctatgacagcaccagggtgcccctgggcaagagcaaggactacatcaatgccagctacatcagaattgtgaactgtggggaggagtacttctacatcgccacccagggccccctgctgagcaccattgatgacttctggcagatggtgctggagaacaacagcaatgtcatcgccatgatcacccgggagattgaaggaggcatcatcaagtgctaccactactggcccatcagcctgaagaagcccctggagctgaagcacttccgggtcttcctggagaactaccagatcctgcagtacttcatcatccgcatgttccaggtggtggagaagagcacaggcaccagccacagcgtgaagcagctgcagttcaccaagtggccagaccacggcaccccagccagcgctgacagcttcatcaagtacatccgctatgccaggaagagccacctgaccggccccatggtggtgcactgcagcgctggcatcggccgcactggagtcttcctgtgtgtggatgtggtgttctgtgccatcgtgaagaactgcagcttcaacatcatggacatcgtggcccagatgagggagcagaggagcggcatggtgcagaccaaggagcagtaccacttctgctatgacatcgtgctggaggtgctgaggaagctgctgaccctggactag

SEQ ID NO: 19099 - DNA, 1917 bp, Artificial Sequence
  Description of Artificial Sequence: Synthetic coding sequence
atgtctgccctggccggagaagatgtgtggcgctgccccggctgtggggaccacatcgcccccagccagatctggtacagaacagtgaatgagacctggcacggcagctgcttccgctgcagcgagtgccaggacagcctgaccaactggtactatgagaaggatggcaagctgtactgccccaaggactactggggcaagtttggagagttctgccacggctgcagcctgctgatgacaggccccttcatggtggccggggagttcaagtaccaccctgagtgctttgcctgcatgagctgcaaggtgatcattgaagatggagatgcctatgccctggtgcagcacgccaccctgtactgtgggaagtgccacaatgaggtggtgctggcccccatgtttgagcggctgagcacagaatctgtgcaggagcagctgccctacagcgtgaccctcatctccatgcctgccaccacagagggccggcggggcttctctgtgtctgtggagagcgcctgcagcaactatgccaccaccgtgcaggtgaaggaggtgaacaggatgcacatcagccccaacaacagaaatgccatccaccctggggaccgcatcctggagatcaatggcacccctgtgaggaccctgcgggtggaggaggtggaggatgccatcagccagaccagccagaccctgcagctgctgattgaacatgaccctgtgtcccagaggctggaccagctgcggctggaggcccggctggccccccacatgcagaatgccggccacccccacgccctgagcaccctggacaccaaggagaacctggagggcaccctgcggcggcgcagcctgcggcgcagcaacagcatcagcaagagccctggccccagcagccccaaggagcccctgctcttcagccgggacatcagccgctctgagagcctgcgctgcagcagcagctacagccagcagatcttccggccctgtgacctgattcatggagaggtgctgggcaagggcttcttcggccaggccatcaaggtgacccacaaggccaccgggaaggtgatggtgatgaaggagctgatccgctgtgatgaggagacccagaagaccttcctgacagaggtgaaggtgatgaggagcctggaccaccccaacgtgctgaagttcatcggcgtgctgtacaaggacaagaagctgaacctgctgacagagtacatcgagggcggcaccctgaaggacttcctgcgctccatggaccccttcccctggcagcagaaggtgcgctttgccaagggcatcgccagcggcatggcctacctgcacagcatgtgcatcatccaccgggacctgaacagccacaactgcctgatcaagctggacaagacagtggtggtggccgactttggcctgagccgcctcatcgtggaggagaggaagagggcccccatggagaaggccaccaccaagaagaggaccctgaggaagaatgacaggaagaagcgctacacagtggtgggcaacccctactggatggcccctgagatgctgaatggcaagagctatgatgagaccgtggacatcttctcctttggcatcgtgctgtgtgagatcatcggccaggtgtatgctgaccctgactgcctgcccaggaccctggactttggcctgaatgtgaagctgttctgggagaagtttgtgcccacagactgccccccagccttcttccccctggccgccatctgctgccgcctggagcctgagagcaggcctgccttcagcaagctggaggacagctttgaggccctgagcctgtacctgggggagctgggcatccccctgcctgctgagctggaggagctggaccacacagtgtccatgcagtatggcctgacccgggacagccccccatag

SEQ ID NO: 19100 - DNA, 606 bp, Artificial Sequence
  Description of Artificial Sequence: Synthetic coding sequence
atggctgctgccaaggacacccatgaagatcatgacaccagcacagagaacacagatgagagcaaccacgacccccagtttgagcccatcgtgtccctgcctgagcaggagatcaagaccctggaggaggatgaggaggagctgttcaagatgagggccaagctgttccgctttgcctctgaaaatgacctgcctgagtggaaggagcggggcactggagatgtgaagctgctgaagcacaaggagaagggggccatccggctgctgatgagaagagacaagaccctgaagatctgtgccaaccactacatcacccccatgatggagctgaagcccaatgccggcagtgaccgggcctgggtgtggaacacccacgccgactttgctgatgaatgtcccaagccagagctgctggccatccgcttcctgaatgcagaaaatgcccagaagttcaagaccaagtttgaagaatgtaggaaggagattgaggagcgggagaagaaggccggcagcggcaagaatgaccatgctgagaaggtggccgagaagctggaggccctgtctgtgaaggaggagaccaaggaggatgctgaggagaagcagtag

SEQ ID NO: 19101 - DNA, 2154 bp, Artificial Sequence
  Description of Artificial Sequence: Synthetic coding sequence
atggctgctgacaagccagctgaccagggcgctgagaagcatgagggcaccggccagagcagcggcatcacagaccaggagaaggagctgagcaccaatgccttccaggccttcaccagcggcaactatgatgcctgcctgcagcacctggcctgcctgcaggacatcaacaaggatgactacaagatcatcctgaacacagctgtggccgagttcttcaagagcaaccagaccaccacagacaacctgcggcagaccctgaaccagctgaagaaccaggtgcacagcgctgtggaggagatggatggcctggatgatgtggagaacagcatgctgtactacaaccaggccgtcatcctgtaccacctgcggcagtacacagaggccatctctgtgggggagaagctgtaccagttcatcgagccctttgaggagaagtttgcccaggccgtgtgcttcctgctggtggacctgtacatcctgacctaccaggccgagaaggccctgcacctgctggccgtgctggagaagatgatcagccagggcaacaacaacaagaatggcaagaatgagaccggcaacaacaacaacaaggatggcagcaaccacaaggccgagagcggggccctgattgaagctgccaagagcaagatccaccagtacaaggtgcgggcctacatccagatgaagagcctgaaggcctgcaagcgggagatcaagtctgtgatgaacacagctggcaacagcgcccccagcctcttcctgaagagcaactttgagtacctgcggggcaactacaggaaggctgtgaagctgctgaacagcagcaacattgctgagcaccctggcttcatgaagacaggagaatgtctgcgctgcatgttctggaacaacctgggctgcatccactttgccatgagcaagcacaacctgggcatcttctacttcaagaaggccctgcaggagaatgacaacgtgtgtgcccagctgtctgctggcagcacagatcctgggaagaagttcagcggccggcccatgtgcaccctgctgaccaacaagagatatgagctgctgtacaactgtggcatccagctgctgcacatcggccggcccctggccgcctttgagtgcctgattgaagctgtgcaggtgtaccacgccaacccccggctgtggctgcggctggccgagtgctgcatcgccgccaacaagggcaccagcgagcaggagaccaagggcctgcccagcaagaagggcatcgtgcagagcatcgtgggccagggctaccacaggaagatcgtgctggccagccagagcatccagaacacagtgtacaatgatggccagagcagcgccatccctgtggcctccatggagtttgctgccatctgcctgagaaatgccctgctgctgctgcctgaggagcagcaggaccccaagcaggagaatggagccaagaacagcaaccagctgggcggcaacacagagagcagcgagagcagcgagacctgccgctgcagcatcctggcctgcagcgcctacgtggccctggccctgggggacaacctgatggccctgaaccacgccgacaagctgctgcagcagcccaagctgagcggcagcctgaagttcctgggccacctgtatgctgctgaggccctgatcagcctggaccgcatcagtgatgccatcacccacctgaacccagaaaatgtgacagatgtgtccctgggcatcagcagcaatgagcaggaccagggcagtgacaagggggagaatgaggccatggagagcagcggcaagagggccccccagtgctaccccagctctgtgaacagcgccaggacagtgatgctgttcaacctgggcagcgcctactgcctgcggagtgaatatgacaaggccaggaagtgcctgcaccaggccgcctccatgatccaccccaaggaggtgcccccagaggccatcctgctggccgtgtacctggagctgcagaatggaaacacccagctggccctgcagatcatcaagaggaaccagctgctgcctgctgtgaagacccacagcgaggtgaggaagaagcctgtgttccagcctgtgcaccccatccagcccatccagatgcctgccttcaccaccgtgcagaggaagtag

SEQ ID NO: 19102 - DNA, 1488 bp, Artificial Sequence
  Description of Artificial Sequence: Synthetic coding sequence
atggaggccctgctggagggcatccagaacagaggacatggaggcggcttcctgaccagctgtgaggccgagctgcaggagctgatgaagcagattgacatcatggtggcccacaagaagtctgagtgggagggccgcacccacgccctggagacctgcctgaagatccgggagcaggagctgaagagcctgcggagccagctggatgtgacccacaaggaggtgggcatgctgcaccagcaggtggaggagcacgagaagatcaagcaggagatgaccatggagtacaagcaggagctgaagaagctgcacgaggagctgtgcatcctgaagaggagctatgagaagctgcagaagaagcagatgagggagttccggggcaacaccaagaaccaccgggaggacagaagtgaaattgagcggctgacagccaagattgaggagttccggcagaagagcctggactgggagaagcagaggctcatctaccagcagcaggtgagcagcctggaggcccagaggaaggccctggccgagcagagcgagatcatccaggcccagctggtgaacaggaagcagaagctggagagcgtggagctgagcagccagagcgagatccagcacctgagcagcaagctggagcgggccaatgacaccatctgtgccaatgagctggagattgagcggctgaccatgagggtgaatgacctggtgggcacctccatgacagtgctgcaggagcagcagcagaaggaggagaagctgcgggagagcgagaagctgctggaggccctgcaggaggagaagcgggagctgaaggccgccctgcagagccaggagaacctgatccacgaggcccgcatccagaaggagaagctgcaggagaaggtgaaggccaccaacacccagcacgctgtggaggccatcagcctggagagcgtgtctgccacctgcaagcagctgagccaggagctgatggagaagtatgaggagctgaagaggatggaggcccacaacaatgagtacaaggccgagatcaagaagctgaaggagcagatcctgcagggcgagcagagctacagcagcgccctggagggcatgaagatggagatcagccacctgacccaggagctgcaccagagggacatcaccatcgccagcaccaagggcagcagcagtgacatggagaagaggctgcgggcagagatgcagaaggccgaggacaaggctgtggagcacaaggagatcctggaccagctggagagcctgaagctggagaacagacacctgtctgagatggtgatgaagctggagctgggcctgcatgaatgttccctgcctgtgagccccctgggcagcatcgccacccgcttcctggaggaggaggagctgcggagccaccacatcctggagcggctggatgcccacatcgaggagctgaagcgggagagcgagaagacagtgcggcagttcaccgccctgaagtag

SEQ ID NO: 19103 - DNA, 1962 bp, Artificial Sequence
  Description of Artificial Sequence: Synthetic coding sequence
atgatccccccccaggaggccagcgccaggagaagagaaattgaggacaagctgaagcaggaggaggagaccctgtccttcatccgggacagcctggagaagagtgaccagctgaccaagaacatggtgtccatcctgagcagctttgagagccggctgatgaagctggagaacagcatcatccctgtgcacaagcagacagagaacctgcagaggctgcaggagaatgtggagaagaccctgagctgcctggaccacgtgatctcctactaccacgtggccagtgacacagagaagatcatccgggagggccccaccggccgcctggaggagtacctgggctccatggccaagatccagaaggctgtggagtacttccaggacaacagcccagacagccctgagctgaacaaggtgaagctgctgtttgagcggggcaaggaggccctggagagcgagttccgcagcctgatgaccaggcacagcaaggtggtgtcccctgtgctgatcctggacctgatctctggagatgatgacctggaggcccaggaggatgtgaccctggagcacctgcctgagagcgtgctgcaggacgtcatccgcatcagccgctggctggtggagtatggaagaaaccaggacttcatgaatgtgtactaccagatccgcagcagccagctggacaggagcatcaagggcctgaaggagcacttccacaagagcagcagcagcagtggagtgccctacagccctgccatccccaacaagaggaaggacacccccaccaagaagcctgtgaagaggcctggaagagatgacatgctggatgtggagacagatgcctacatccactgtgtgtctgcctttgtgaagctggcccagagcgagtaccagctgctggccgacatcatccctgagcaccaccagaagaagacctttgacagcctcatccaggatgccctggatggcctgatgctggagggagaaaatattgtgtctgctgccaggaaggccatcgtgagacatgacttcagcacagtgctgactgtgttccccatcctgcggcacctgaagcagaccaagccagagtttgaccaggtgctgcagggcacagctgccagcaccaagaacaagctgcccggcctcatcacctccatggagaccatcggggccaaggccctggaggactttgctgacaacatcaagaatgaccctgacaaggagtacaacatgcccaaggatggcaccgtgcatgagctgaccagcaatgccatcctcttcctgcagcagctgctggacttccaggagacagctggggccatgctggccagccaggagaccagcagcagcgccaccagctacagcagcgagttcagcaagaggctgctgagcacctacatctgcaaggtgctgggcaacctgcagctgaacctgctgagcaagagcaaggtgtatgaggaccctgccctgagcgccatcttcctgcacaacaactacaactacatcctgaagagcctggagaagtctgagctgatccagctggtggccgtgacccagaagacagctgagaggagctaccgggagcacatcgagcagcagatccagacctaccagaggtcctggctgaaggtgacagactacatcgccgagaagaacctgcccgtcttccagcccggggtgaagctgcgggacaaggagcggcagatcatcaaggagcgcttcaagggcttcaatgatggcctggaggagctgtgcaagatccagaaggcctgggccatcccagacacagagcagagggaccgcatccggcaggcccagaagaccatcgtgaaggagacctacggggccttcctgcagaagtttggatctgtgcccttcaccaagaaccctgagaagtacatcaagtatggagtggagcaggtgggggacatgattgaccggctgtttgacaccagcgcctag

SEQ ID NO: 19104 - DNA, 735 bp, Artificial Sequence
  Description of Artificial Sequence: Synthetic coding sequence
atggagctgaccatcttcatcctgcggctggccatctacatcctgaccttccccctgtacctgctgaacttcctgggcctgtggagctggatctgcaagaagtggttcccctacttcctggtgcgcttcaccgtcatctacaatgagcagatggccagcaagaagcgggagctgttcagcaacctgcaggagtttgctggccccagcggcaagctgagcctgctggaggtgggctgcggcactggagccaacttcaagttctacccacctggctgccgggtgacctgcatcgaccccaaccccaactttgagaagttcctgatcaagagcattgctgaaaatagacacctgcagtttgaaagatttgtggtggccgccggggagaacatgcaccaggtggctgatggctctgtggatgtggtggtgtgcaccctggtgctgtgcagcgtgaagaaccaggagcgcatcctgcgggaggtgtgccgggtgctgcggcctgggggcgccttctacttcatggagcacgtggccgcagaatgttccacctggaactacttctggcagcaggtgctggaccctgcctggcacctgctgtttgatggctgcaacctgacccgggagagctggaaggccctggagcgggccagcttcagcaagctgaagctgcagcacatccaggcccccctgtcctgggagctggtgcggccccacatctacggctatgctgtgaagtag

SEQ ID NO: 19105 - DNA, 3522 bp, Artificial Sequence
  Description of Artificial Sequence: Synthetic coding sequence
atggctgtggagaccctgagcccagactgggagtttgacagagtggatgatggcagccagaagatccacgccgaggtgcagctgaagaactacggcaagttcctggaggagtacaccagccagctgcggagaattgaagatgccctggatgacagcattggagatgtgtgggacttcaacctggaccccatcgccctgaagctgctgccctatgagcagagcagcctgctggagctgatcaagacagagaacaaggtgctgaacaaggtgatcaccgtgtatgctgccctgtgctgtgagatcaagaagctgaagtatgaggccgagaccaagttctacaacggcctgctcttctatggagagggcgccacagatgcctccatggtggagggggactgccagatccagatgggccgcttcatctccttcctgcaggagctgagctgctttgtgacccgctgctatgaggtggtgatgaatgtggtgcaccagctggccgccctgtacatcagcaacaagatcgcccccaagatcatcgagaccaccggggtgcacttccagaccatgtatgagcacctgggggagctgctgactgtgctgctgaccctggatgagatcatcgacaaccacatcaccctgaaggaccactggaccatgtacaagaggctgctgaagtctgtgcaccacaaccccagcaagtttggcatccaggaggagaagctgaagccctttgagaagttcctgctgaagctggagggccagctgctggatggcatgatcttccaggcctgcatcgagcagcagtttgacagcctgaatggaggagtgtctgtgtccaagaacagcacctttgctgaggagtttgcccacagcatccgcagcatctttgccaacgtggaggccaagctgggggagcccagcgagattgaccagagggacaagtatgtgggcatctgtggcctgtttgtgctgcacttccagatcttccgcaccatcgacaagaagttctacaagagcctgctggacatctgcaagaaggtgcctgccatcaccctgacagccaacatcatctggttcccagacaacttcctgatccagaagatcccagctgctgccaagctgctggacaggaagagcctgcaggccatcaagatccaccgggacaccttcctgcagcagaaggcccagagcctgaccaaggatgtgcagagctactacgtgtttgtgtcctcctggatgatgaagatggagagcatcctgagcaaggagcagaggatggacaagtttgctgaggacctgaccaaccgctgcaatgtgttcatccagggcttcctgtatgcctacagcatcagcaccatcatcaagaccaccatgaacctgtacatgtccatgcagaagcccatgaccaagacctctgtgaaggccctgtgccgcctggtggagctgctgaaggccatcgagcacatgttctaccgccgctccatggtggtggccgacagcgtgagccacatcacccagcacctgcagcaccaggccctgcacagcatctctgtggccaagaagagggtcatcagtgacaagaagtacagcgagcagaggctggatgtgctgagcgccctggtgctggccgagaacaccctgaatggccccagcaccaagcagaggaggctcatcgtgtccctggccctgtctgtgggcacccagatgaagaccttcaaggatgaggagctgttccccctgcaggtggtgatgaagaagctggacctgatcagcgagctgcgggagcgggtgcagacccagtgtgactgctgcttcctgtactggcacagagctgtgttccccatctacctggatgatgtgtatgaaaatgctgtggatgctgcccggctgcactacatgttttctgccctgcgggactgtgtgcctgccatgatgcacgcccggcacctggagagctatgagatcctgctggactgctatgacaaggagatcatggagatcctgaatgagcacctgctggacaagctgtgcaaggagattgagaaggacctgcggctgtctgtgcacacccacctgaagctggatgacaggaaccccttcaaggtgggcatgaaggacctggccctcttcttcagcctgaaccccatccgcttcttcaaccgcttcatcgacatccgggcctacgtgacccactacctggacaagaccttctacaacctgaccaccgtggccctgcatgactgggccacctacagcgagatgaggaacctggccacccagagatatggcctggtgatgacagaggcccacctgcccagccagaccctggagcagggcctggatgtgctggagatcatgaggaacatccacatctttgtgagccgctacctgtacaacctgaacaaccagatcttcatcgagaggaccagcaacaacaagcacctgaacaccatcaacatccgccacatcgccaacagcatccgcacccacggcaccggcatcatgaacaccaccgtgaacttcacctaccagttcctgaagaagaagttctacatcttcagccagttcatgtatgatgagcacatcaagagccgcctcatcaaggacatccgcttcttccgggagatcaaggaccagaatgaccacaagtacccctttgacagagctgagaagttcaacagaggcatcaggaagctgggcgtgaccccagagggccagagctacctggaccagttccggcagctgatcagccagattggaaatgccatgggctacgtgaggatgatccgcagcggcggcctgcactgcagcagcaatgccatccgctttgtgcctgacctggaggacatcgtgaactttgaggagctggtgaaggaggagggcctggccgaggagaccctgaaggccgcccggcacctggacagcgtgctgagtgaccacaccaggaacagcgctgagggcacagagtacttcaagatgctggtggatgtgtttgcccctgagttcagaagacccaagaacatccacctgaggaacttctacatcatcgtgccccccctgaccctgaactttgtggagcacagcatcagctgcaaggagaagctgaacaagaagaacaagattggagctgccttcacagatgatggctttgccatgggcgtggcctacatcctgaagctgctggaccagtaccgggagtttgacagcctgcactggttccagagcgtgcgggagaagtacctgaaggagatccgggctgtggccaagcagcagaatgtgcagagcgccagccaggatgagaagctgctgcagaccatgaacctgacccagaagaggctggatgtgtacctgcaggagtttgagctgctgtacttcagcctgagcagcgcccgcatcttcttccgggctgacaagacagctgctgaggagaaccaggagaagaaggagaaggaggaggagaccaagaccagcaatggagacctgagtgacagcacagtgtctgctgaccctgtggtgaagtag

SEQ ID NO: 19106 - DNA, 972 bp, Artificial Sequence
  Description of Artificial Sequence: Synthetic coding sequence
atgctgcgctggacagtgcacctggagggcggccccaggagagtgaaccacgccgctgtggccgtgggccaccgggtgtacagctttggaggctactgcagcggggaggactatgagaccctgcggcagattgatgtgcacatcttcaatgctgacacccacaagtggttcaccccccgggtgtctggcaccgtgcctggggccagagatggccacagcgcctgtgtgctgggcaagatcatgtacatctttggaggctatgagcagcaggccgactgcttcagcaatgacatccacaagctggacaccagcaccatgacctggaccctcatctgcaccaagggcagccctgcccgctggagggacttccacagcgccaccatgctgggcagccacatgtatgtgtttggaggccgggctgacagatttggccccttccacagcaacaatgagatctactgcaaccgcatccgggtgtttgacaccaggacagaggcctggctggactgcccccccacccctgtgctgcctgagggccgccgcagccacagcgccttcggctacaatggagagctgtacatctttggaggctacaatgcccggctgaacagacacttccatgacctgtggaagttcaaccctgtgtccttcacctggaagaagattgagcccaagggcaagggcccctgcccccggcggcggcagtgctgctgcatcgtgggggacaagatcgtgctgtttggaggcaccagccccagccctgaggagggcctgggagatgaatttgacctgattgaccacagcgacctgcacatcctggacttcagccccagcctgaagaccctgtgcaagctggccgtcatccagtacaacctggaccagagctgcctgccccatgacatccgctgggagctgaatgccatgaccaccaacagcaacatcagccggcccatcgtgagcagccacggctag

SEQ ID NO: 19107 - DNA, 2517 bp, Artificial Sequence
  Description of Artificial Sequence: Synthetic coding sequence
atgaccggggctgagattgagcccagcgcccaggccaagccagagaagaaggccggggaggaggtgattgctggccctgagagagaaaatgatgtgcccctggtggtgcggcccaaggtgaggacccaggccaccaccggggcccggcccaagacagagaccaagtctgtgcctgctgcccggcccaagacagaggcccaggccatgtctggggcccggcccaagacagaggtgcaggtgatgggcggggcccggcccaagacagaggcccagggcatcaccggggcccggcccaagacagatgcccgggctgtgggcggggcccggagcaagacagatgccaaggccatccctggggcccggcccaaggatgaggcccaggcctgggcccagagcgagtttggaacagaggccgtgtcccaggccgagggcgtgtcccagaccaatgctgtggcctggcccctggccacagctgagagcggctctgtgaccaagagcaagggcctgtccatggaccgggagctggtgaatgtggatgctgagaccttccctggcacccagggccagaagggcatccagccctggtttggacctggagaggagaccaacatgggctcctggtgctacagccggccccgggcccgggaggaggccagcaatgaaagtggcttctggagcgcagatgagaccagcacagccagcagcttctggacaggagaggagacctctgtgcgctcctggccccgggaggagagcaacaccaggagccgccaccgggccaagcaccagaccaaccccaggagccggcccaggagcaagcaggaggcctacgtggacagctggagcggctctgaagatgaggccagcaaccccttctccttctgggtgggggagaacaccaacaacctcttccggccccgggtgcgggaggaggccaacatccgcagcaagctgcggaccaaccgggaggactgctttgagagcgagagtgaagatgagttctacaagcagagctgggtgctgcccggggaggaggccaacagccgcttccgccaccgggacaaggaggaccccaacacagccctgaagctgcgggcccagaaggatgtggacagcgacagagtgaagcaggagcccaggtttgaggaggaggtgatcatcggctcctggttctgggccgagaaggaggccagcctggagggcggggccagcgccatctgtgagagcgagcctggaacagaggagggcgccatcggcggcagcgcctactgggccgaggagaagagcagcctgggcgctgtggcccgggaggaggccaagccagagagcgaggaggaggccatcttcggctcctggttctgggacagagatgaggcctgctttgacctgaacccctgccctgtgtacaaggtgtctgaccgcttcagagatgctgctgaggagctgaatgccagcagccggccccagacctgggatgaggtgacagtggagttcaagccaggcctcttccacggcgtgggcttccgcagcaccagccccttcggcatccctgaggaggccagcgagatgctggaggccaagcccaagaacctggagctgagccctgagggggaggagcaggagagcctgctgcagcctgaccagcccagccctgagttcaccttccagtatgaccccagctacagatctgtgcgggagatccgggagcacctgcgggcccgggagagcgctgagagcgagagctggagctgcagctgcatccagtgtgagctgaagattggcagcgaggagtttgaggagttcctgctgctgatggacaagatccgggaccccttcatccacgagatcagcaagatcgccatgggcatgaggtctgccagccagttcacccgggacttcatccgggacagcggcgtggtgtccctgattgagaccctgctgaactaccccagcagccgggtgaggaccagcttcctggagaacatgatccacatggccccaccctaccccaacctgaacatgattgagaccttcatctgccaggtgtgtgaggagaccctggcccacagcgtggacagcctggagcagctgaccggcatccgcatgctgcggcacctgaccatgaccatcgactaccacaccctcatcgccaactacatgagcggcttcctgagcctgctgaccacagccaatgcccggaccaagttccacgtgctgaagatgctgctgaacctgtctgaaaatcctgctgtggccaagaagctgttcagcgccaaggccctgagcatctttgtgggcctcttcaacatcgaggagaccaatgacaacatccagatcgtcatcaagatgttccagaacatcagcaacatcatcaagagcggcaagatgagcctgattgatgatgacttcagcctggagcccctcatcagcgccttccgggagtttgaggagctggccaagcagctgcaggcccagattgacaaccagaatgaccctgaggtgggccagcagagctag

SEQ ID NO: 19108 - DNA, 2649 bp, Artificial Sequence
  Description of Artificial Sequence: Synthetic coding sequence
atgcctggccgggcccggacccgggcccggggccgggccaggagaagagagagctaccagcaggaggcccctgggggcccccgggcccctggcagcgccaccacccaggagcccccccagctgcagagcaccccccggcccctgcaggaggaggtgcctgtggtgcggcccctgcagccccgggccgcccggggcggggccggcggcggggcccagagccagggcgtgaaggagcccggccctgaggccggcctgcacacagcccccctgcaggagaggagaattggaggagtcttccaggacctggtggtgaacacccggcaggacatgaagcacgtgaaggacagcaagacaggcagcgagggcaccgtggtgcagctgctggccaaccacttccgggtcatcagccggccccagtgggtggcctacaagtacaacgtggactacaagccagacattgaagatggcaacctgcggaccatcctgctggaccagcacaggaggaagtttggagagcggcacatctttgatggcaacagcctgctgctgagccggcccctgaaggagcggcgggtggagtggctgagcaccaccaaggacaagaacatcgtgaagatcaccgtggagttcagcaaggagctgacccccaccagcccagactgcctgcgctactacaacatcctcttccggaggaccttcaagctgctggactttgagcaggtgggcaggaactactacaccaagaagaaggccatccagctgtacagacatggcaccagcctggagatctggctgggctacgtgacctctgtgctgcagtatgaaaattccatcaccctgtgtgctgatgtgagccacaagctgctgagaattgaaacagcctatgacttcatcaagaggaccagcgcccaggcccagacaggcaacatccgggaggaggtgaccaacaagctgattggcagcatcgtgctgaccaagtacaacaacaagacctacagagtggatgacatcgactggaagcagaaccctgaggacaccttcaacaagagtgatggcagcaagatcacctacatcgactactaccggcagcagcacaaggagatcgtgacagtgaagaagcagcccctgctggtgtcccagggccgctggaagaagggcctgaccggcacccagcgggagcccatcctgctgatcccccagctgtgccacatgacaggcctgacagatgagatctgcaaggactacagcatcgtgaaggagctggccaagcacacccggctgagccccaggagaagacaccacaccctgaaggagttcatcaacaccctgcaggacaacaagaaggtgcgggagctgctgcagctgtgggacctgaagtttgacaccaacttcctgtctgtgcccggccgggtgctgaagaatgccaacatcgtgcagggccgcaggatggtgaaggccaacagccagggcgactggagccgggagatccgggagctgcccctgctgaatgccatgcccctgcacagctggctgatcctgtacagccgcagcagccaccgggaggccatgagcctgaagggccacctgcagagcgtgacagcccccatgggcatcaccatgaagccagctgagatgattgaggtggatggagatgccaacagctacatcgacaccctgaggaagtacacccggcccaccctgcagatgggcatgagctgcctgctggtgttcaaggtgatctgcatcctgcccaatgatgacaagagaagatatgacagcatcaagcgctacctgtgcaccaagtgccccatccccagccagtgtgtggtgaagaagaccctggagaaggtgcaggcccggaccatcgtgaccaagatcgcccagcagatgaactgcaagatgggcggggccctgtggaaggtggagacagatgtgcagaggaccatgtttgtgggcatcgactgcttccatgacatcgtgaaccggcagaagagcattgctggctttgtggccagcaccaatgctgagctgaccaagtggtacagccagtgtgtgatccagaagacaggagaggagctggtgaaggagctggagatctgcctgaaggccgccctggatgtgtggtgcaagaatgaaagctccatgccccacagcgtcatcgtgtacagagatggagtgggagatggccagctgcaggccctgctggaccacgaggccaagaagatgagcacctacctgaagaccatcagccccaacaacttcaccctggccttcatcgtggtgaagaagaggatcaacacccgcttcttcctgaagcacggcagcaacttccagaaccccccacctggcaccgtgattgatgtggagctgaccagaaatgagtggtatgacttcttcatcgtgtcccagagcgtgcaggacggcaccgtgacccccacccactacaacgtcatctatgacaccatcggcctgagcccagacacagtgcagaggctgacctactgcctgtgccacatgtactacaacctgcccggcatcatccgggtgcctgccccctgccactacgcccacaagctggcctacctggtgggccagagcatccaccaggagcccaacagaagcctgagcaccaggctcttctacctgtag

SEQ ID NO: 19109 - DNA, 1917 bp, Artificial Sequence
  Description of Artificial Sequence: Synthetic coding sequence
atgaaccggcaggtgtgcaagaagagcttcagcggccgcagccagggcttcagcggccgctctgctgtggtgtctggcagcagcaggatgagctgtgtggcccggagcggcggggccggcggcggggcctgtggcttccgcagcggggccggcagctttggcagccgcagcctgtacaacctgggcagcaacaagagcatcagcatctctgtggccgccggcagcagccgggccggcggctttggaggcggccgcagcagctgtggctttgctgggggctacggcggcggctttggaggcagctatggaggcggctttggaggcggccggggcgtgggcagcggctttggaggagctgggggctttggaggagctgggggctttggaggccctggggtgtttggaggccctggcagctttggaggccctgggggcttcggccctgggggcttccctgggggcatccaggaggtgattgtgaaccagagcctgctgcagcccctgaatgtggagattgacccccagatcggccaggtgaaggcccaggagcgggagcagatcaagaccctgaacaacaagtttgccagcttcatcgacaaggtgcgcttcctggagcagcagaacaaggtgctggagaccaagtgggagctgctgcagcagcagaccactggaagtggccccagcagcctggagccctgctttgagagctacatctccttcctgtgcaagcagctggacagcctgctgggggagcggggcaacctggagggggagctgaagtccatgcaggacctggtggaggacttcaagaagaagtatgaagatgagatcaacaagaggacagctgctgaaaatgaatttgtgggcctgaagaaggatgtggatgctgccttcatgaacaaggtggagctgcaggccaaggtggacagcctgacagatgaggtgtccttcctgcggaccctgtatgagatggagctgagccagatgcagagccacgccagtgacacctctgtggtgctgtccatggacaacaaccgctgcctggacctgggcagcatcatcgccgaggtgcgggcccagtatgaggagatcgcccagaggagcaagtctgaggccgaggccctgtaccagaccaagctgggggagctgcagaccacagctggaagacatggagatgacctgaggaacaccaagtctgagatcatggagctgaacaggatgatccagaggctgcgggcagaaattgaaaatgtgaagaagcagaatgccaacctgcagacagccatcgccgaggccgagcagagaggagagatggccctgaaggatgccaatgccaagctgcaggacctgcagacagccctgcagaaggccaaggatgacctggcccggctgctgcgggactaccaggagctgatgaatgtgaagctggccctggatgtggagatcgccacctacaggaagctgctggagggggaggagtgcaggatgtctggagagtgccagagcgctgtgtgcatctctgtggtgtccaatgtgaccagcaccagcggcagcagcggcagcagccggggcgtgtttggaggagtgtctggcagcggcagcggcggctacaagggcggcagcagcagcagcagcagcagcggctatggagtgtctgggggcagcggcagcggctatggaggagtgagcagcggcagcactggaggccggggcagcagcggcagctaccagagcagcagcagcggcagccggctgggcggggccggcagcatctctgtgagccacagcggcatgggcagcagcagcggcagcatccagaccagcggcggcagcggctacaagagcggcggcggcggcagcaccagcatccgcttcagccagaccaccagcagcagccagcacagcagcaccaagtag

SEQ ID NO: 19110 - DNA, 1080 bp, Artificial Sequence
  Description of Artificial Sequence: Synthetic coding sequence
atggccgagcccttcctgtctgagtaccagcaccagccccagaccagcaactgcacaggagctgctgctgtgcaggaggagctgaaccctgagaggcctcctggagctgaggagcgggtgcctgaggaggacagccgctggcagagccgggccttcccccagctgggcggccggcccggccctgagggggagggcagcctggagagccagcccccacccctgcagacccaggcctgcccagagagcagctgcctgcgggagggggagaagggccagaatggagatgacagcagcgctggaggagacttccccccacctgctgaggtggagcccaccccagaggccgagctgctggcccagccctgccatgattctgaggccagcaagctgggcgccccagctgctggaggagaggaggagtggggccagcagcagaggcagctgggcaagaagaagcacagaagaagacccagcaagaagaagaggcactggaagccctactacaagctgacctgggaggagaagaagaagtttgatgagaagcagagcctgcgggccagccgcatccgggcagagatgtttgccaagggccagcctgtggccccctacaacaccacccagttcctgatggatgaccatgaccaggaggagccagacctgaagacaggcctgtacagcaagagagctgctgccaagagtgatgacaccagtgatgatgacttcatggaggagggcggggaggaggatggcggcagtgatggcatgggaggagatggcagcgagttcctgcagagggacttcagcgagacctatgagcgctaccacacagagagcctgcagaacatgagcaagcaggagctgatcaaggagtacctggagctggagaagtgcctgagcaggatggaggatgagaacaaccggctgcggctggagagcaagaggctgggcggagatgatgcccgggtgcgggagctggagctggagctggaccggctgcgggcagagaacctgcagctgctgacagaaaatgagctgcaccggcagcaggagcgggcccccctgagcaagtttggagactag

SEQ ID NO: 19111 - DNA, 2889 bp, Artificial Sequence
  Description of Artificial Sequence: Synthetic coding sequence
atggatgagcaggccctgctgggcctgaaccccaatgctgacagcgacttccggcagagggccctggcctactttgagcagctgaagatcagcccagatgcctggcaggtgtgtgccgaggccctggcccagaggacctacagtgatgaccacgtgaagttcttctgcttccaggtgctggagcaccaggtgaagtacaagtacagcgagctgaccaccgtgcagcagcagctgatccgggagaccctcatctcctggctgcaggcccagatgctgaacccccagcctgagaagaccttcatccggaacaaggccgcccaggtgtttgccctgctgtttgtgacagagtacctgaccaagtggcccaagttcttctttgacatcctgtctgtggtggacctgaacccccggggcgtggacctgtacctgcgcatcctgatggccattgattctgagctggtggacagagatgtggtgcacaccagcgaggaggcccggaggaacaccctcatcaaggacaccatgagggagcagtgcatccccaacctggtggagagctggtaccagatcctgcagaactaccagttcaccaacagcgaggtgacctgccagtgcctggaggtggtgggcgcctacgtgtcctggattgacctgagcctgattgccaatgaccgcttcatcaacatgctgctgggccacatgagcattgaggtgctgcgggaggaggcctgtgactgcctgtttgaggtggtgaacaagggcatggaccctgtggacaagatgaagctggtggagagcctgtgccaggtgctgcagagcgctggcttcttcagcattgaccaggaggaggatgtggacttcctggcccgcttcagcaagctggtgaatggcatgggccagagcctgattgtgtcctggagcaagctgatcaagaatggagacatcaagaatgcccaggaggccctgcaggccatcgagaccaaggtggccctgatgctgcagctgctgattcatgaagatgatgacatcagcagcaacatcatcggcttctgctatgactacctgcacatcctgaagcagctgactgtgctgagtgaccagcagaaggccaacgtggaggccatcatgctggccgtgatgaagaagctgacctatgatgaggagtacaactttgaaaatgaaggagaagatgaggccatgtttgtggagtacaggaagcagctgaagctgctgctggaccggctggcccaggtgtccccagagctgctgctggcctctgtgcggcgggtcttcagcagcaccctgcagaactggcagaccacccgcttcatggaggtggaggtggccatccggctgctgtacatgctggccgaggccctgcctgtgagccacggggcccacttctctggagatgtgtccaaggccagcgccctgcaggacatgatgaggaccctggtgaccagcggcgtgagcagctaccagcacacctctgtgaccctggagttctttgaaacagtggtgcgctatgagaagttcttcaccgtggagccccagcacatcccctgtgtgctgatggccttcctggaccaccggggcctgcggcacagcagcgccaaggtgcgcagcaggacagcctacctgttcagcagatttgtgaagagcctgaacaagcagatgaaccccttcatcgaggacatcctgaaccgcatccaggacctgctggagctgagccccccagaaaatggccaccagagcctgctgagcagtgatgaccagctgttcatctatgaaacagctggggtgctgattgtgaacagcgagtacccagctgagaggaagcaggccctgatgaggaacctgctgacccccctgatggagaagttcaagatcctgctggagaagctgatgctggcccaggatgaggagcggcaggccagcctggccgactgcctgaaccacgctgtgggctttgccagcaggaccagcaaggccttcagcaacaagcagacagtgaagcagtgtggctgcagcgaggtgtacctggactgcctgcagaccttcctgcctgccctgagctgccccctgcagaaggacatcctgcggtctggagtgaggaccttcctgcacaggatgatcatctgcctggaggaggaggtgctgcccttcatccccagcgccagcgagcacatgctgaaggactgtgaggccaaggacctgcaggagttcatccccctcatcaaccagatcacagccaagttcaagatccaggtgagccccttcctgcagcagatgttcatgcccctgctgcacgccatctttgaggtgctgctgcggcctgctgaggagaatgaccagagcgctgccctggagaagcagatgctgcggcgcagctactttgccttcctgcagacagtgacaggcagcggcatgtctgaggtgattgccaaccagggcgcagaaaatgtggagcgggtgctggtgaccgtcatccagggcgctgtggagtacccagaccccatcgcccagaagacctgcttcatcatcctgagcaagctggtggagctgtggggcggcaaggatggccctgtgggctttgctgactttgtgtacaagcacatcgtgcctgcctgcttcctggcccccctgaagcagacctttgacctggctgatgcccagacagtgctggccctgtctgaatgtgctgtgaccctgaagaccatccacctgaagaggggcccagaatgtgtgcagtacctgcagcaggagtacctgcccagcctgcaggtggcccctgagatcatccaggagttctgccaggccctgcagcagccagatgccaaggtgttcaagaactacctgaaggtgttcttccagagggccaagccctag

SEQ ID NO: 19112 - DNA, 2976 bp, Artificial Sequence
  Description of Artificial Sequence: Synthetic coding sequence
atggccgagagcttcttcagtgactttggcctgctgtggtacctgaaggagctgaggaaggaggagttctggaagttcaaggagctgctgaagcagcccctggagaagtttgagctgaagcccatcccctgggccgagctgaagaaggccagcaaagaagatgtggccaagctgctggacaagcactacccaggcaagcaggcctgggaggtgaccctgaacctcttcctgcagatcaacaggaaggacctgtggaccaaggcccaggaggagatgaggaacaagctgaacccctacaggaagcacatgaaggagaccttccagctgatctgggagaaggagacctgcctgcacgtgcctgagcacttctacaaggagaccatgaagaatgagtacaaggagctgaatgatgcctacacagctgctgcccggcggcacacagtggtgctggagggcccagatggcatcggcaagaccaccctgctgaggaaggtgatgctggactgggccgagggcaacctgtggaaggaccgcttcacctttgtgttcttcctgaatgtgtgtgagatgaatggaattgctgagaccagcctgctggagctgctgagccgggactggccagagagcagcgagaagattgaggacatcttcagccagcctgagcgcatcctcttcatcatggatggctttgagcagctgaagttcaacctgcagctgaaggctgacctgagtgatgactggaggcagaggcagcccatgcccatcatcctgagcagcctgctgcagaagaagatgctgcctgagagcagcctgctgattgccctgggcaagctggccatgcagaagcactacttcatgctgcggcaccccaagctgatcaagctgctgggcttcagcgagagcgagaagaagagctacttctcctacttctttggagagaagagcaaggccctgaaggtgttcaactttgtgcgggacaatggccccctcttcatcctgtgccacaaccccttcacctgctggctggtgtgcacctgtgtgaagcagaggctggagagaggagaggacctggagatcaacagccagaacaccacctacctgtatgccagcttcctgaccaccgtcttcaaggccggcagccagagcttcccccccaaggtgaacagagcccggctgaagagcctgtgtgccctggccgctgagggcatctggacctacacctttgtgttcagccacggggacctgcggagaaatggcctgtctgagagcgagggcgtgatgtgggtgggcatgaggctgctgcagaggagaggagactgctttgccttcatgcacctgtgcatccaggagttctgtgccgccatgttctacctgctgaagaggcccaaggatgaccccaacccagccatcggcagcatcacccagctggtgcgggcctctgtggtgcagccccagaccctgctgacccaggtgggcatcttcatgtttggcatcagcacagaggagatcgtgtccatgctggagaccagctttggcttccccctgagcaaggacctgaagcaggagatcacccagtgcctggagagcctgagccagtgtgaggccgaccgggaggccatcgccttccaggagctgttcatcggcctgtttgagacccaggagaaggagtttgtgaccaaggtgatgaacttctttgaggaggtgttcatctacatcggcaacatcgagcacctggtgattgccagcttctgcctgaagcactgccagcacctgaccaccctgaggatgtgtgtggagaacatcttcccagatgacagcggctgcatcagtgactacaatgagaagctggtgtactggagggagctgtgcagcatgttcatcaccaacaagaacttccagatcctggacatggagaacaccagcctggatgaccccagcctggccatcctgtgcaaggccctggcccagcctgtgtgcaagctgaggaagctgatcttcacctctgtgtactttggacatgattctgagctgttcaaggctgtgctgcacaacccccacctgaagctgctgagcctgtatggcaccagcctgagccagagcgacatccgccacctgtgtgagaccctgaagcaccccatgtgcaagattgaggagctgatcctgggcaaatgtgacatcagcagcgaggtgtgtgaggacatcgcctctgtgctggcctgcaacagcaagctgaagcacctgagcctggtggagaaccccctgagagatgagggcatgaccctgctgtgtgaggccctgaagcacagccactgtgccctggagcggctgatgctgatgtactgctgcctgacctctgtgtcctgtgacagcatcagcgaggtgctgctgtgcagcaagagcctgagcctgctggacctgggcagcaatgccctggaggacaacggggtggccagcctgtgtgccgccctgaagcaccctggctgcagcatccgggagctgtggctgatgggctgcttcctgaccagtgacagctgcaaggacattgctgctgtgctgatctgcaatggcaagctgaagaccctgaagctgggccacaatgagatcggggacacaggagtgcggcagctgtgtgccgccctgcagcacccccactgcaagctggagtgcctgggcctgcagacctgccccatcacccgggcctgctgtgatgacattgctgctgccctgattgcctgcaagaccctgcggagcctgaacctggactggatcgccctggatgctgatgctgtggtggtgctgtgtgaggccctgagccacccagactgtgccctgcagatgctgggcctgcacaagagcggctttgatgaggagacccagaagatcctgatgtctgtggaggagaagatcccccacctgaccatcagccacggcccctggattgatgaggagtacaagatccggggcgtgctgctgtag

SEQ ID NO: 19113 - DNA, 534 bp, Artificial Sequence
  Description of Artificial Sequence: Synthetic coding sequence
atggctgctgtgaaggccagcaccagcaaggccacccggccctggtacagccaccctgtgtatgcccgctactggcagcactaccaccaggccatggcctggatgcagagccaccacaatgcctacaggaaggctgtggagagctgcttcaacctgccctggtacctgcccagcgccctgctgccccagagcagctatgacaatgaggccgcctacccccagagcttctatgaccaccacgtggcctggcaggactacccctgcagcagcagccacttccgccgcagcggccagcacccccgctacagcagccgcatccaggccagcaccaaggaggaccaggccctgagcaaggaggaggagatggagacagaaagtgatgctgaggtggagtgtgacctgagcaacatggagatcacagaggagctgcggcagtactttgctgagacagagcggcaccgggaggagcggcggcggcagcagcagctggatgctgagcggctggacagctatgtgaatgctgaccatgactag

SEQ ID NO: 19114 - DNA, 1503 bp, Artificial Sequence
  Description of Artificial Sequence: Synthetic coding sequence
atggtgggccgcagctgtggggtggccacccagaggcagggcggcggccagaggcccaccaacctggccctgaccctgagcagcagccctgcccacagcacagccctgccctggctgccccccaggagcctgcagctgctgagcggccacagcgtgcctgcccagcccaccccccacctgcccagcgcctgtggcggccccaccagggtgaccctgggggaggagcgggcctggaggagccacggcagcaatgccggcggccacacctgcctgcccaggagaacagctggggccggcagcctgaccccaggaggagagcggggcggcaacaatgccggccacacagtggtggtggatggcaaggagtatgacttccacctgctgcccagcggcatcatcaacaccaaggctgtgtccttcatcggaaatggagtggtgatccacctgcccggcctgtttgaggaggccgagaagaatgagaagaagggcctgaaggactgggagaagaggctcatcatcagtgaccgggcccacctggtgtttgacttccaccaggccgtggatggcctgcaggaggtgcagaggcaggcccaggagggcaagaacatcggcaccaccaagaagggcatcggccccacctacagcagcaaggccgccaggacaggcctgcgcatctgtgacctgctgagtgactttgatgagttcagcagccgcttcaagaacctggcccaccagcaccagagcatgttccccaccctggagattgatattgagggccagctgaagaggctgaagggctttgctgagcgcatccggcccatggtgagagatggagtgtacttcatgtatgaggccctgcacggcccccccaagaagatcctggtggagggcgccaatgctgccctgctggacatcgactttggcacctacccctttgtgaccagcagcaactgcaccgtgggcggcgtgtgcaccggcctgggcatccccccccagaacattggagatgtgtatggagtggtgaaggcctacaccaccagggtgggcatcggggccttccccacagagcagatcaatgaaattggaggcctgctgcagacccggggccacgagtggggcgtgaccaccggcaggaagaggcgctgtggctggctggacctgatgatcctgcgctatgcccacatggtgaatggcttcaccgccctggccctgaccaagctggacatcctggatgtgctgggggaggtgaaggtgggcgtgtcctacaagctgaatggcaagaggatcccctacttccctgccaaccaggagatgctgcagaaggtggaggtggagtatgagaccctgcccggctggaaggctgacaccactggagcccggcgctgggaggacctgcccccccaggcccagaactacatccgctttgtggagaaccacgtgggcgtggccgtgaagtgggtgggcgtgggcaagagccgggagagcatgatccagctgttctag

SEQ ID NO: 19115 - DNA, 468 bp, Artificial Sequence
  Description of Artificial Sequence: Synthetic coding sequence
atggtgaacagctgctgcggctctgtgtgcagcgaccagggctgcggccaggacctgtgccaggagacctgctgctgccccagctgctgccagaccacctgctgcaggaccacctgctaccggcccagctacagcgtgtcctgctgctgccggccccagtgctgccagagcgtgtgctgccagcccacctgctgccggcccagctgctgcgtgcccacctgctgccaccccagctgctgcatcagcagctgctgccggcccagctgctgcgtgagcagctgctgcaagccccagtgctgccagagcgtgtgctgccagcccaactgctgccggcccagctgctgccggccctgctgctgcctgcggcctgtgtgtggccgggtgtcctgccacaccacctgctacagacctgcctgtgtgatcagcacctgccccaggcctgtgtgctgtgccagcagctgctgctag

SEQ ID NO: 19116 - DNA, 2124 bp, Artificial Sequence
  Description of Artificial Sequence: Synthetic coding sequence
atggctgctgaggccctggccgctgaggccgtggccagccggctggagcggcaggaggaggacatccgctggctgtggagcgaggtggagcggctgagagatgagcagctgaatgccccctacagctgccaggccgagggcccctgcctgacccgggaggtggcccagctgcgggcagagaactgtgacctgcggcaccggctgtgcagcctgcggctgtgcctggccgaggagaggagccggcaggccaccctggagagcgctgagctggaggccgcccaggaggccggggcccagcccccacccagccagagccaggacaaggacatgaagaagaagaagatgaaggagagcgaggccgacagcgaggtgaagcaccagcccatcttcatcaaggagcggctgaagctgtttgagatcctgaagaaggaccaccagctgctgctggccatctacggcaagaagggggacaccagcaacatcatcaccgtgcgggtggctgatggccagacagtgcagggcgaggtgtggaagaccaccccctaccaggtggccgctgagatcagccaggagctggccgagagcaccgtcatcgccaaggtgaatggagagctgtgggacctggaccggcccctggagggggacagcagcctggagctgctgacctttgacaatgagaaggtgaacacagccaccaccaccgtgtaccgctgtggccccctgattgacctgtgcaagggcccccacgtgcgccacacaggcaagatcaagaccatcaagatcttcaagaacagcagcacctactgggagggcaaccctgagatggagaccctgcagaggatctacggcatctccttcccagacaacaagatgatgagggactgggagaagttccaggaggaggccaagaacagagaccacaggaagattggcaaggagcaggagctgttcttcttccatgacctgagccctggcagctgcttcttcctgcccaggggggccttcatctacaacaccctgacagacttcatccgggaggagtaccacaagagggacttcacagaggtgctgagccccaacatgtacaacagcaagctgtgggaggccagcggccactggcagcactacagcgagaacatgttcacctttgaaattgagaaggacacctttgccctgaagcccatgaactgccccggccactgcctgatgtttgcccaccggcccaggtcctggagggagatgcccatccgctttgctgactttggagtgctgcacagaaatgagctgagcggcaccctgagcggcctgaccagggtgcggcgcttccagcaggatgatgcccacatcttctgcaccgtggagcagatcgaggaggagatcaagggctgcctgcagttcctgcagagcgtgtacagcaccttcggcttctccttccagctgaacctgagcaccaggcctgagaacttcctgggggagattgagatgtggaatgaagctgagaagcagctgcagaacagcctgatggactttggagagccctggaagatgaaccctggagatggagccttctacggccccaagattgacatcaagatcaaggatgccatcggccgctaccaccagtgtgccaccatccagctggacttccagctgcccatccgcttcaacctgacctacgtgtccaaggatggagatgacaagaagaggcctgtgatcatccaccgggccatcctgggctctgtggagaggatgattgccatcctgtctgagaactacggcggcaagtggcccttctggctgagcccccggcaggtgatggtgattcctgtgggccccacctgtgagaagtatgccctgcaggtgtcctctgagttctttgaggagggcttcatggctgatgtggacctggaccacagctgcaccctgaacaagaagatcagaaatgcccagctggcccagtacaacttcatcctggtggtgggggagaaggagaagattgacaatgctgtgaatgtgaggacccgggacaacaagatccacggggagatcctggtgaccagcgccatcgacaagctgaagaacctgaggaagaccaggaccctgaatgctgaggaggccttctag

SEQ ID NO: 19117 - DNA, 816 bp, Artificial Sequence
  Description of Artificial Sequence: Synthetic coding sequence
atggccggcctggaggtgctgtttgccagcgctgccccagccatcacctgccggcaggatgccctggtgtgcttcctgcactgggaggtggtgacccacggctacttcggcctgggcgtgggggaccagcccggccccaatgacaagaagtctgagctgctgcctgctggctggaacaacaacaaggacctgtatgtgctgcgctatgagtacaaggatggcagcaggaagctgctggtgaaggccatcaccgtggagagctccatgatcctgaatgtgctggagtatggcagccagcaggtggccgacctgaccctgaacctggatgactacattgatgctgagcacctgggggacttccacaggacctacaagaacagcgaggagctgcggagccgcatcgtgtctggcatcatcacccccatccacgagcagtgggagaaggccaacgtgagcagcccccaccgggagttccccccagccacagcccgggaggtggaccccctgcgcatccccccccaccacccccacaccagccggcagcccccctggtgtgaccccctgggcccctttgtggtgggcggggaggacctggaccccttcggcccccggcggggcggcatgattgtggaccccctgcggagcggcttcccccgggccctgattgaccccagcagcggcctgcccaaccggctgcccccaggagctgtgcccccaggggccaggtttgaccccttcggccccatcggcaccagccccccaggccccaacccagaccacctgcccccacctggctatgatgacatgtacctgtag

SEQ ID NO: 19118 - DNA, 474 bp, Artificial Sequence
  Description of Artificial Sequence: Synthetic coding sequence
atggccaccccacccaagagaagagctgtggaggccactggagagaaggtgctgcgctatgagaccttcatcagtgatgtgctgcagagggacctgaggaaggtgctggaccaccgggacaaggtgtatgagcagctggccaagtacctgcagctgagaaatgtcatcgagcggctgcaggaggccaagcacagcgagctgtacatgcaggtggacctgggctgcaacttctttgtggacacagtggtgcctgacaccagccgcatctacgtggccctgggctacggcttcttcctggagctgaccctggccgaggccctgaagttcatcgacaggaagagcagcctgctgacagagctgagcaacagcctgaccaaggacagcatgaacatcaaggcccacatccacatgctgctggagggcctgcgggagctgcagggcctgcagaacttccctgagaagccccaccactag

SEQ ID NO: 19119 - DNA, 543 bp, Artificial Sequence
  Description of Artificial Sequence: Synthetic coding sequence
atgcaggccgagggccggggcaccggcggcagcactggagatgctgatggccctgggggccctggcatcccagatggccctggaggaaatgccggcggccctggagaggccggggccaccggcggccggggccccaggggggccggggccgcccgggccagcggccctgggggcggggccccccggggcccccatggaggagctgccagcggcctgaatggctgctgccgctgtggggcccggggccctgagagccggctgctggagttctacctggccatgccctttgccacccccatggaggccgagctggcccggcgcagcctggcccaggatgccccacccctgcctgtgcctggggtgctgctgaaggagttcaccgtgtctggcaacatcctgaccatccggctgacagctgctgaccaccggcagctgcagctgagcatcagcagctgcctgcagcagctgagcctgctgatgtggatcacccagtgcttcctgcccgtcttcctggcccagccccccagcggccagaggaggtag

SEQ ID NO: 19120 - DNA, 621 bp, Artificial Sequence
  Description of Artificial Sequence: Synthetic coding sequence
atgacagcctctgtgctgcggagcatcagcctggccctgcggcccaccagcggcctgctgggcacctggcagacccagctgcgggagacccaccagagggccagcctgctgtccttctgggagctgatccccatgaggtctgagcccctgaggaagaagaagaaggtggaccccaagaaggaccaggaggccaaggagcggctgaagaggaagatcaggaagctggagaaggccacccaggagctgatccccatcgaggacttcatcacccccctgaagttcctggacaaggcccgggagcggccccaggtggagctgacctttgaggagacagaaagaagagccctgctgctgaagaagtggagcctgtacaagcagcaggagaggaagatggagcgggacaccatccgggccatgctggaggcccagcaggaggccctggaggagctgcagctggagagccccaagctgcatgctgaggccatcaagagggaccccaacctcttcccctttgagaaggagggcccccactacaccccacccatccccaactaccagcccccagagggccgctacaatgacatcaccaaggtgtacacccaggtggagttcaagaggtag

SEQ ID NO: 19121 - DNA, 6963 bp, Artificial Sequence
  Description of Artificial Sequence: Synthetic coding sequence
atggccgagcccagcagcgcccggcggcctgtgcccctcatcgagagcgagctgtacttcctgattgcccgctacctgtctgctggcccctgccggcgggccgcccaggtgctggtgcaggagctggagcagtaccagctgctgcccaagaggctggactgggagggcaatgagcacaacagaagctatgaggagctggtgctgagcaacaagcacgtggccccagaccacctgctgcagatctgccagagaattggccccatgctggacaaggagatcccccccagcatcagccgggtgaccagcctgctgggcgccggccggcagagcctgctgaggacagccaaggactgccgccacacagtgtggaagggcagcgcctttgctgccctgcaccggggccggcccccagagatgcctgtgaactacggcagcccccccaacctggtggagatccaccggggcaagcagctgaccggctgcagcaccttcagcacagccttccctggcaccatgtaccagcacatcaagatgcaccggcgcatcctgggccacctgtctgctgtgtactgtgtggcctttgacagaacaggccaccgcatcttcaccggcagtgatgactgcctggtgaagatctggagcacccacaacggccgcctgctgagcaccctgcggggccacagcgctgagatcagtgacatggctgtgaactatgagaacaccatgattgctgctggcagctgtgacaagatcatccgggtgtggtgcctgcggacctgtgcccctgtggccgtgctgcagggccacacaggcagcatcaccagcctgcagttcagccccatggccaagggcagccagcgctacatggtgtccactggagcagatggcaccgtgtgcttctggcagtgggacctggagagcctgaagttcagcccccggcccctgaagttcacagagaagcccaggcctggggtgcagatgctgtgcagcagcttctctgtgggcggcatgttcctggccaccggcagcacagaccacgtgatccgcatgtacttcctgggctttgaggcccctgagaagattgctgagctggagagccacacagacaaggtggacagcatccagttctgcaacaatggagaccgcttcctgagcggcagcagagatggaacagcccgcatctggaggtttgagcagctggagtggaggagcatcctgctggacatggccacccgcatcagcggggacctgagcagcgaggaggagcgcttcatgaagcccaaggtgaccatgattgcctggaaccagaatgacagcatcgtggtgacagctgtgaatgaccacgtgctgaaggtgtggaacagctacacaggccagctgctgcacaacctgatgggccacgcagatgaggtgtttgtgctggagacccacccctttgacagccgcatcatgctgtctgctggccatgatggcagcatcttcatctgggacatcaccaagggcaccaagatgaagcactacttcaacatgattgagggccagggccacggggctgtgtttgactgcaagttcagccaggacggccagcactttgcctgcacagacagccacggccacctgctgatctttggatttggctgcagcaagccctatgagaagatcccagaccagatgttcttccacacagactaccggcccctcatccgggacagcaacaactacgtgctggatgagcagacccagcaggccccccacctgatgcccccacccttcctggtggatgtggatggcaacccccaccccaccaagtaccagaggctggtgcccggccgggagaacagcgcagatgagcacctgatcccccagctgggctacgtggccaccagtgatggagaggtgattgagcagatcatcagcctgcagaccaatgacaatgatgagaggagccctgagagcagcatcctggatggcatgatccggcagctgcagcagcagcaggaccagaggatgggcgctgaccaggacaccatcccccggggcctgagcaatggagaggagaccccaagaagaggcttccggcggctgagcctggacatccagagcccccccaacatcggcctgcggcgcagcggccaggtggagggcgtgcggcagatgcaccagaatgcccccaggagccagatcgccacagagcgggacctgcaggcctggaagagaagagtggtggtgcctgaggtgcccctgggcatcttcaggaagctggaggacttccggctggagaagggggaggaggagaggaacctgtacatcattggaaggaagaggaagaccctgcagctgagccacaagagtgacagcgtggtgctggtgtcccagagccggcagaggacctgcaggaggaagtaccccaactatggaagaagaaacagatcctggagggagctgagcagtggaaatgaaagcagcagctctgtgagacatgagaccagctgtgaccagagcgagggcagcggcagcagcgaggaggatgagtggaggagtgacaggaagtctgagagctacagcgagagcagcagtgacagcagcagccgctacagcgactggacagcagatgctggcatcaacctgcagccccccctgcggaccagctgcagaagacgcatcacccgcttctgcagcagcagtgaagatgagatcagcacagagaacctgagcccccccaagagaagaaggaagaggaagaaggagaacaagcccaagaaggagaacctgcggaggatgaccccagctgagctggccaacatggagcacctgtatgagttccacccccctgtgtggatcacagacaccaccctgaggaagagcccctttgtgccccagatgggagatgaagtcatctacttccggcagggccacgaggcctacatcgaggccgtgagaagaaacaacatctatgagctgaaccccaacaaggagccctggaggaagatggacctgcgggaccaggagctggtgaagatcgtgggcatccgctatgaggtgggcccccccaccctgtgctgcctgaagctggccttcattgatcctgccaccgggaagctgatggacaagagcttcagcatccgctaccatgacatgccagatgtgattgacttcctggtgctgcggcagttctatgatgaggcccggcagaggaactggcagagctgtgaccgcttccgcagcatcattgatgatgcctggtggtttggaacagtgctgagccaggagccctaccagccccagtacccagacagccacttccagtgctacatcgtgcgctgggacaacacagaaattgagaagctgagcccctgggacatggagcccatcccagacaacgtggaccccccagaggagctgggcgccagcatctctgtgaccacagatgagctggagaagctgctgtacaagccccaggccggggagtggggccagaagagcagagatgaagaatgtgaccgcatcatctctggaattgaccagctgctgaacctggacattgctgctgcctttgctggccctgtggacctgtgcacctaccccaagtactgcaccgtggtggcctaccccacagacctgtacaccatccgcatgaggctggtgaaccgcttctaccgccgcctgagcgccctggtgtgggaggtgcgctacatcgagcacaatgcccggaccttcaatgaacctgagagcgtcatcgcccggagcgccaagaagatcacagaccagctgctgaagttcatcaagaaccagcactgcaccaacatcagcgagctgagcaacaccagtgaaaatgatgagcagaatgctgaggacctggatgacagcgacctgcccaagaccagcagcggcagaagaagagtgcatgatggcaagaagagcatccgggccaccaactacgtggagagcaactggaagaagcagtgcaaggagctggtgaacctgatcttccagtgtgaagattctgagcccttccggcagcctgtggacctggtggagtacccagactacagagacatcatcgacacccccatggactttggcaccgtgcgggagaccctggatgctggcaactatgacagccccctggagttctgcaaggacatccgcctcatcttcagcaatgccaaggcctacacccccaacaagaggagcaagatctacagcatgaccctgcggctgagcgccctgtttgaggagaagatgaagaagatcagcagtgacttcaagattggccagaagttcaatgagaagctgcggcgcagccagcgcttcaagcagaggcagaactgcaagggggacagccagcccaacaagagcatccggaacctgaagcccaagaggctgaagagccagaccaagatcatccctgagctggtgggcagccccacccagagcaccagcagcaggacagcctacctgggcacccacaagaccagcgctggcatcagcagcggcgtgaccagcggggacagcagtgacagcgctgagagcagcgagaggaggaagaggaaccggcccatcaccaacggcagcaccctgtctgagagcgaggtggaggacagcctggccaccagcctgagcagcagcgccagcagcagcagcgaggagagcaaggagagcagccgggcccgggagagcagcagccgcagcggcctgagccgcagcagcaacctgcgggtgaccaggaccagggctgcccagaggaagacaggccctgtgtccctggccaacggctgcggcaggaaggccaccaggaagagggtgtacctgagtgacagcgacaacaacagcctggagaccggggagatcctgaaggcccgggccggcaacaacaggaaggtgctgaggaaatgtgccgctgtggccgccaacaagatcaagctgatgtctgatgtggaggagaacagcagcagcgagagcgtgtgcagcggcaggaagctgccccacagaaatgccagcgctgtggccaggaagaagctgctgcacaacagtgaagatgagcagagcctgaagtcagaaattgaggaggaggagctgaaggatgagaaccagctgctgcctgtgagcagcagccacacagcccagagcaatgtggatgaaagtgagaacagagacagcgagagcgagagtgacctgcgggtggccaggaagaactggcacgccaacggctacaagagccacaccccagcccccagcaagaccaagttcctgaagattgagagcagcgaggaggacagcaagagccatgacagcgaccacgcctgcaacagaacagctggccccagcacctctgtgcagaagctgaaggccgagagcatcagcgaggaggccgacagcgagcccggccgcagcggcggcaggaagtacaacaccttccacaagaatgccagcttcttcaagaagaccaagatcctgagtgacagtgaagattctgagagcgaggagcaggacagagaagatggcaagtgccacaagatggagatgaaccccatcagcggcaacctgaactgtgaccccatcgccatgagccagtgcagcagtgaccacggctgtgaaacagacctggacagtgatgatgacaagattgagaagcccaacaacttcatgaaggacagcgccagccaggacaatggcctgagcaggaagatcagcaggaagagggtgtgcagcagtgacagcgacagcagcctgcaggtggtgaagaagagcagcaaggccaggacaggcctgctgcgcatcacccggcgctgtgccgccacagctgccaacaagatcaagctgatgtctgatgtggaggatgtgtccctggagaatgtgcacaccaggagcaagaatggaaggaagaagcccctgcacctggcctgcaccacagccaagaagaagctgagtgactgtgagggctctgtgcactgtgaggtgcccagcgagcagtatgcctgtgagggcaagcccccagaccctgattctgagggcagcaccaaggtgctgagccaggccctgaatggagacagcgacagcgaggacatgctgaacagcgagcacaagcaccgccacaccaacatccacaagattgatgcccccagcaagaggaagagcagctctgtgaccagcagcggggaggacagcaagagccacatccctggcagcgagacagacaggaccttcagcagcgagagcaccctggcccagaaggccacagctgagaacaactttgaggtggagctgaactacggcctgcggcgctggaatggaagaaggctgcggacctacggcaaggcccccttcagcaagaccaaggtgattcatgacagccaggagacagctgagaaggaggtgaagaggaagaggagccaccctgagctggagaatgtgaagatcagcgagaccaccggcaacagcaagttccggccagacaccagcagcaagagcagtgacctgggctctgtgacagaaagtgacatcgactgcacagacaacaccaagaccaagaggaggaagaccaagggcaaggccaaggtggtgaggaaggagtttgtgccccgggaccgggagcccaacaccaaggtgaggacctgcatgcacaaccagaaggatgctgtgcagatgcccagcgagaccctgaaggccaagatggtgcctgagaaggtgccccggcgctgtgccaccgtggccgccaacaagatcaagatcatgagcaacctgaaggagaccatcagcggcccagaaaatgtgtggatcaggaagagcagcaggaagctgccccacagaaatgccagcgctgctgccaagaagaagctgctgaatgtgtacaaggaggatgacaccaccatcaacagcgagagcgagaaggagctggaggacatcaacaggaagatgctgttcctgcggggcttccgctcctggaaggaaaatgcccagtag

SEQ ID NO: 19122 - DNA, 2961 bp, Artificial Sequence
  Description of Artificial Sequence: Synthetic coding sequence
atggccgagagcttcttcagtgactttggcctgctgtggtacctgaaggagctgaggaaggaggagttctggaagttcaaggagctgctgaagcagcccctggagaagtttgagctgaagcccatcccctgggccgagctgaagaaggccagcaaagaagatgtggccaagctgctggacaagcactacccaggcaagcaggcctgggaggtgaccctgaacctcttcctgcagatcaacaggaaggacctgtggaccaaggcccaggaggagatgaggaacaagctgaacccctacaggaagcacatgaaggagaccttccagctgatctgggagaaggagacctgcctgcacgtgcctgagcacttctacaaggagaccatgaagaatgagtacaaggagctgaatgatgcctacacagctgctgcccggcggcacacagtggtgctggagggcccagatggcatcggcaagaccaccctgctgaggaaggtgatgctggactgggccgagggcaacctgtggaaggaccgcttcacctttgtgttcttcctgaatgtgtgtgagatgaatggaattgctgagaccagcctgctggagctgctgagccgggactggccagagagcagcgagaagattgaggacatcttcagccagcctgagcgcatcctcttcatcatggatggctttgagcagctgaagttcaacctgcagctgaaggctgacctgagtgatgactggaggcagaggcagcccatgcccatcatcctgagcagcctgctgcagaagaagatgctgcctgagagcagcctgctgattgccctgggcaagctggccatgcagaagcactacttcatgctgcggcaccccaagctgatcaagctgctgggcttcagcgagagcgagaagaagagctacttctcctacttctttggagagaagagcaaggccctgaaggtgttcaactttgtgcgggacaatggccccctcttcatcctgtgccacaaccccttcacctgctggctggtgtgcacctgtgtgaagcagaggctggagagaggagaggacctggagatcaacagccagaacaccacctacctgtatgccagcttcctgaccaccgtcttcaaggccggcagccagagcttcccccccaaggtgaacagagcccggctgaagagcctgtgtgccctggccgctgagggcatctggacctacacctttgtgttcagccacggggacctgcggagaaatggcctgtctgagagcgagggcgtgatgtgggtgggcatgaggctgctgcagaggagaggagactgctttgccttcatgcacctgtgcatccaggagttctgtgccgccatgttctacctgctgaagaggcccaaggatgaccccaacccagccatcggcagcatcacccagctggtgcgggcctctgtggtgcagccccagaccctgctgacccaggtgggcatcttcatgtttggcatcagcacagaggagatcgtgtccatgctggagaccagctttggcttccccctgagcaaggacctgaagcaggagatcacccagtgcctggagagcctgagccagtgtgaggccgaccgggaggccatcgccttccaggagctgttcatcggcctgtttgagacccaggagaaggagtttgtgaccaaggtgatgaacttctttgaggaggtgttcatctacatcggcaacatcgagcacctggtgattgccagcttctgcctgaagcactgccagcacctgaccaccctgaggatgtgtgtggagaacatcttcccagatgacagcggctgcatcagtgactacaatgagaagctggtgtactggagggagctgtgcagcatgttcatcaccaacaagaacttccagatcctggacatggagaacaccagcctggatgaccccagcctggccatcctgtgcaaggccctggcccagcctgtgtgcaagctgaggaagctgatcttcacctctgtgtactttggacatgattctgagctgttcaaggctgtgctgcacaacccccacctgaagctgctgagcctgtatggcaccagcctgagccagagcgacatccgccacctgtgtgagaccctgaagcaccccatgtgcaagattgaggagctgatcctgggcaaatgtgacatcagcagcgaggtgtgtgaggacatcgcctctgtgctggcctgcaacagcaagctgaagcacctgagcctggtggagaaccccctgagagatgagggcatgaccctgctgtgtgaggccctgaagcacagccactgtgccctggagcggctgatgctgatgtactgctgcctgacctctgtgtcctgtgacagcatcagcgaggtgctgctgtgcagcaagagcctgagcctgctggacctgggcagcaatgccctggaggacaacggggtggccagcctgtgtgccgccctgaagcaccctggctgcagcatccgggagctgtggctgatgggctgcttcctgaccagtgacagctgcaaggacattgctgctgtgctgatctgcaatggcaagctgaagaccctgaagctgggccacaatgagatcggggacacaggagtgcggcagctgtgtgccgccctgcagcacccccactgcaagctggagtgcctgggcctgcagacctgccccatcacccgggcctgctgtgatgacattgctgctgccctgattgcctgcaagaccctgcggagcctgaacctggactggatcgccctggatgctgatgctgtggtggtgctgtgtgaggccctgagccacccagactgtgccctgcagatgctgggcaactgccagaagagcctgggggacacagtggcccctggagagaaccactgcagcatcaagcacctgctgctgaccctgcccatcaacatgcagaggcagctgcggctgcagaagtag

SEQ ID NO: 19123 - DNA, 3039 bp, Artificial Sequence
  Description of Artificial Sequence: Synthetic coding sequence
atggatgccctggatgccagcaagctgctggatgaggagctgtacagccggcagctgtatgtgctgggcagccctgccatgcagaggatccagggcgcccgggtgctggtgtctggcctgcagggcctgggcgctgaggtggccaagaacctggtgctgatgggcgtgggcagcctgaccctgcatgacccccaccccacctgctggagcgacctggccgcccagttcctgctgtctgagcaggacctggagaggagcagagctgaggccagccaggagctgctggcccagctgaacagagctgtgcaggtggtggtgcacactggagacatcacagaggacctgctgctggacttccaggtggtggtgctgacagctgccaagctggaggagcagctgaaggtgggcaccctgtgccacaagcacggcgtgtgcttcctggccgctgacacccggggcctggtgggccagctgttctgtgactttggagaggacttcaccgtgcaggaccccacagaggccgagcccctgacagctgccatccagcacatcagccagggcagccctggcatcctgaccctgaggaagggggccaacacccactacttcagagatggagacctggtgaccttcagcggcatcgagggcatggtggagctgaatgactgtgaccccaggagcatccacgtgcgggaggatggcagcctggagatcggggacaccaccaccttcagccgctacctgcggggcggggccatcacagaggtgaagaggcccaagacagtgcgccacaagagcctggacacagccctgctgcagccccacgtggtggcccagagcagccaggaggtgcaccacgcccactgcctgcaccaggccttctgtgccctgcacaagttccagcacctgcacggccggcccccccagccctgggaccctgtggatgctgagaccgtggtgggcctggcccgggacctggagcccctgaagaggacagaggaggagcccctggaggagcccctggatgaggccctggtgaggacagtggccctgagcagcgctggggtgctgagccccatggtggccatgctgggcgctgtggccgcccaggaggtgctgaaggccatcagcaggaagttcatgcccctggaccagtggctgtactttgatgccctggactgcctgcctgaagatggagagctgctgcccagccctgaggactgtgccctgcggggcagccgctatgatggccagattgctgtgtttggagctggcttccaggagaagctgcggcggcagcactacctgctggtgggcgctggggccatcggctgtgagctgctgaaggtgtttgccctggtgggcctgggcgccggcaacagcggcggcctgactgtggtggacatggaccacatcgagaggagcaacctgagccggcagttcctgttccgcagccaggatgtgggccggcccaaggccgaggtggccgctgctgctgcccggggcctgaacccagacctgcaggtgatccccctgacctaccccctggaccccaccacagagcacatctacggggacaacttcttcagccgggtggatggagtggccgccgccctggacagcttccaggccaggagatatgtggccgcccgctgcacccactacctgaagcccctgctggaggccggcaccagcggcacctggggcagcgccaccgtcttcatgcctcatgtgacagaggcctaccgggccccagccagcgctgctgcctctgaagatgccccctaccctgtgtgcaccgtgcgctacttccccagcacagctgagcacaccctgcagtgggcccggcatgaatttgaggagctgttccggctgtctgctgagaccatcaaccaccaccagcaggcccacaccagcctggccgacatggatgagccccagaccctgaccctgctgaagcctgtgctgggcgtgctgcgggtgcggccccagaactggcaggactgtgtggcctgggccctgggccactggaagctgtgcttccactacggcatcaagcagctgctgcggcacttcccccccaacaaggtgctggaggatggcacccccttctggagcggccccaagcagtgcccccagcccctggagtttgacaccaaccaggacacccacctgctgtatgtgctggccgccgccaacctgtatgcccagatgcacggcctgcccggcagccaggactggacagccctgcgggagctgctgaagctgctgccccagcctgacccccagcagatggcccccatctttgccagcaacctggagctggccagcgccagcgctgagtttggacctgagcagcagaaggagctgaacaaggccctggaggtgtggagcgtgggcccccccctgaagcccctgatgtttgagaaggatgatgacagcaacttccacgtggactttgtggtggccgccgccagcctgcgctgccagaactacggcatcccccctgtgaacagagcccagagcaagagaattgtgggccagatcatcccagccatcgccaccaccacagctgctgtggccggcctgctgggcctggagctgtacaaggtggtgtctggcccccggcccaggtctgccttccgccacagctacctgcacctggccgagaactacctgatccgctacatgccctttgccccagccatccagaccttccaccacctgaagtggacctcctgggaccggctgaaggtgcctgctggccagcctgagaggaccctggagagcctgctggcccacctgcaggagcagcacggcctgcgggtgcgcatcctgctgcacggcagcgccctgctgtatgctgctggctggagccctgagaagcaggcccagcacctgcccctgcgggtgacagagctggtgcagcagctgaccggccaggccccagcccctggccagagggtgctggtgctggagctgagctgtgaaggagatgatgaggacacagccttcccccccctgcactatgagctgtag

SEQ ID NO: 19124 - DNA, 360 bp, Artificial Sequence
  Description of Artificial Sequence: Synthetic coding sequence
atggtgaggaccaagacctggaccctgaagaagcactttgtgggctaccccaccaacagcgactttgagctgaagacagctgagctgccccccctgaagaatggagaggtgctgctggaggccctcttcctgactgtggacccctacatgagggtggtggagagcaagaatgtggccctgcccaagggcaccatcgtgctggccagccctggctggaccacccacagcatcagtgatggcaaggacctggagaagctgctgacagagtggccagacaccatccccctgagcctggccctgggcaccgtgggcatgcctggcctgacagcctacttcggcctgctggagatctgtggctag

SEQ ID NO: 19125 - DNA, 1797 bp, Artificial Sequence
  Description of Artificial Sequence: Synthetic coding sequence
atgggcggctgcttcagcaagcccaagcctgtggagctgaagattgaggtggtgctgcctgagaaggagcggggcaaggaggagctgagcgccagcggcaagggcagcccccgggcctaccagggcaatggaacagcccggcacttccacacagaggagcggctgagcaccccccacccctaccccagcccccaggactgtgtggaggccgctgtgtgccacgtgaaggacctggagaatggccagatgagggaggtggagctgggctggggcaaggtgctgctggtgaaggacaatggagagttccacgccctgggccacaagtgcccccactacggggcccccctggtgaagggcgtgctgagccggggccgggtgcgctgcccctggcatggagcctgcttcaacatcagcactggagacctggaggacttccctggcctggacagcctgcacaagttccaggtgaagattgagaaggagaaggtgtatgtgcgggccagcaagcaggccctgcagctgcagaggaggaccaaggtgatggccaagtgcatcagccccagcgctggctacagcagcagcaccaacgtgctgattgtgggcgctggagctgctggcctggtgtgtgccgagaccctgcggcaggagggcttcagtgaccgcatcgtgctgtgcaccctggacagacacctgccctatgaccggcccaagctgagcaagagcctggacacccagcctgagcagctggccctgcggcccaaggagttcttccgggcctacggcatcgaggtgctgacagaggcccaggtggtgacagtggatgtgaggaccaagaaggtggtgttcaaggatggcttcaagctggagtacagcaagctgctgctggcccctggcagcagccccaagaccctgagctgcaagggcaaggaggtggagaatgtgttcaccatccgcaccccagaagatgccaacagagtggtgcggctggcccggggcagaaatgtggtggtggtgggcgccggcttcctgggcatggaggtggccgcctacctgacagagaaggcccacagcgtgtctgtggtggagctggaggagacccccttccgccgcttcctgggggagcgggtgggccgggccctgatgaagatgtttgagaacaacagagtgaagttctacatgcagacagaggtgtctgagctgcggggccaggagggcaagctgaaggaggtggtgctgaagagcagcaaggtggtgcgggcagatgtgtgtgtggtgggcattggagctgtgcctgccaccggcttcctgcggcagagcggcatcggcctggacagccggggcttcatccctgtgaacaagatgatgcagaccaacgtgcctggggtgtttgctgctggagatgctgtgaccttccccctggcctggaggaacaacaggaaggtgaacatcccccactggcagatggcccacgcccagggccgggtggccgcccagaacatgctggcccaggaggccgagatgagcacagtgccctacctgtggacagccatgtttgggaagagcctgcgctatgccggctatggagagggctttgatgatgtgatcatccagggcgacctggaggagctgaagtttgtggccttctacaccaagggagatgaggtgattgctgtggcctccatgaactatgaccccatcgtgtccaaggtggccgaggtgctggccagcggccgggccatcaggaagcgggaggtggagactggagacatgtcctggctgaccgggaagggcagctag

SEQ ID NO: 19126 - DNA, 1854 bp, Artificial Sequence
  Description of Artificial Sequence: Synthetic coding sequence
atgggcagctacctgtctgtgcctgcctacttcaccagccgggacctcttccgctgcagcgagtgccaggacagcctgaccaactggtactatgagaaggatggcaagctgtactgccccaaggactactggggcaagtttggagagttctgccacggctgcagcctgctgatgacaggccccttcatggtggccggggagttcaagtaccacccagaatgttttgcctgcatgagctgcaaggtgatcattgaagatggagatgcctatgccctggtgcagcacgccaccctgtactgtgggaagtgccacaatgaggtggtgctggcccccatgtttgagcggctgagcacagagagcgtgcaggagcagctgccctacagcgtgaccctcatctccatgcctgccaccacagagggcagaagaggcttctctgtgtctgtggagagcgcctgcagcaactatgccaccaccgtgcaggtgaaggaggtgaacaggatgcacatcagccccaacaacagaaatgccatccaccctggggaccgcatcctggagatcaatggcacccctgtgaggaccctgcgggtggaggaggtggaggatgccatcagccagaccagccagaccctgcagctgctgattgaacatgaccctgtgtcccagaggctggaccagctgcggctggaggcccggctggccccccacatgcagaatgccggccacccccacgccctgagcaccctggacaccaaggagaacctggagggcaccctgcggcggcgcagcctgcggcgcagcaacagcatcagcaagagccctggccccagcagccccaaggagcccctgctcttcagccgggacatcagccgctctgagagcctgcgctgcagcagcagctacagccagcagatcttccggccctgtgacctgatccacggggaggtgctgggcaagggcttcttcggccaggccatcaaggtgacccacaaggccaccgggaaggtgatggtgatgaaggagctgatccgctgtgatgaggagacccagaagaccttcctgacagaggtgaaggtgatgaggagcctggaccaccccaacgtgctgaagttcatcggcgtgctgtacaaggacaagaagctgaacctgctgacagagtacattgaaggaggcaccctgaaggacttcctgcgctccatggaccccttcccctggcagcagaaggtgcgctttgccaagggcatcgccagcggcatggcctacctgcacagcatgtgcatcatccaccgggacctgaacagccacaactgcctgatcaagctggacaagacagtggtggtggccgactttggcctgagccggctgattgtggaggagaggaagagggcccccatggagaaggccaccaccaagaagaggaccctgaggaagaatgacaggaagaagcgctacacagtggtgggcaacccctactggatggcccctgagatgctgaatggcaagagctatgatgaaacagtggacatcttctcctttggaattgtgctgtgtgagatcatcggccaggtgtatgctgaccctgactgcctgcccaggaccctggactttggcctgaatgtgaagctgttctgggagaagtttgtgcccacagactgccccccagccttcttccccctggccgccatctgctgccgcctggagcctgagagcaggcctgccttcagcaagctggaggacagctttgaggccctgagcctgtacctgggggagctgggcatccccctgcctgctgagctggaggagctggaccacacagtgtccatgcagtatggcctgacccgggacagccccccatag

SEQ ID NO: 19127 - DNA, 1338 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccaccggcagctaccatggagacagcgacctgcagctggagcgcatcaacgtgtactacaatgaggccgccggcaacaagtatgtgccccgggccatcctggtggacctggagcccggcaccatggattctgtgcgcagcggccccttcggccagatcttccggccagacaactttgtgtttggccagagcggggccggcaacaactgggccaagggccactacacagaaggagctgagctggtggacagcgtgctggatgtggtgaggaaggagagcgagagctgtgactgcctgcagggcttccagctgacccacagcctgggcggcggcactggaagtggcatgggcaccctgctgatcagcaagatccgggaggagtacccagaccgcatcatgaacaccttctctgtgatgcccagccccaaggtgtctgacacagtggtggagccctacaatgccaccctgtctgtgcaccagctggtggagaacacagatgagacctacagcattgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcagatgtttgacagcaagaacatgatggccgcctgtgaccccaggcatggccgctacctgactgtggccgccatcttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatgtctgccaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagcagatgagcagggcgagtttgaggaggaggagggggaggatgaggcctag

SEQ ID NO: 19128 - DNA, 2028 bp, Artificial Sequence
  Description of Artificial Sequence: Synthetic coding sequence
atggccaagcacggggctgatgagcccagcagccgcagcggcagcccagaccgggagggccgggccagcgaggacaggagcctgctgcaccagaggctggccgtgcgggagctgattgacacagaggtgtcctacctgcacatgctgcagctgtgtgccagtgacatccgcagccggctgcagcagctgccccagggcgacctggatgtgctcttcagcaacattgatgacatcatcaaggtgaacagccgcttcctgcatgacctgcaggagacagccagcaaggaggaggagcaggtgcagctggtgggcaacatcttcctggagttccaggaggagctggagcaggtgtacaaggtgtactgtgccagctatgaccaggccctgctgctggtggacacctacaggaaggagcctgagctgcagaggcacatccagggcatcgtggaggccgtggtgccccaggccggcagcagcggcctgtccttcctgctggtgatccccctgcagaggatcacccgctaccccctgctgctgcagaagatcctggagaacacagtgcctgatgccagcgcctaccctgtgctgcagagagctgtgtctgccctgcaggatgtgaacaccaacatcaatgagtacaagatgaggaaggaggtggccagcaagtacaccaaggtggagcagctgaccctgcgggagcggctggcccgcatcaacacccacaccctgagcaagaagaccacccggctgagccagctgctgaagcaggaggccggcctcatccccaggacagaggacaaggagtttgatgacctggaggagcgcttccagtgggtgtccctgtgtgtgacagagctgaagaacaacgtggccgcctacctggacaacctgcaggccttcctgtacttccggccccatgagtacaacctggacatccctgagggccctgctgtgcagtactgcaacctggcccgggacctgcacctggaggccttcctgaagttcaagcagaggctggagggcctggtgtggcagcccctgtgcagcctggccaaggccctgctgggcccccagaacctgatcaagaagaggctggacaagctgctggactttgagcgggtggaggagaagctgctggaggtgggctctgtgacctaccaggaggaggccgcccggcacacctaccaggccctgaacagcctgctggtggccgagctgccccagttcaaccagctggtgatgcagtggctgggccagatcatgtgcacctttgtgaccctgcagagggacctggccaagcaggtgctgcagagagctgagggctccatggcccagctgccccaccaccacgtgcctgagcccgccttcaggaagctggtggaggatgccctgggccgcaccagcaaccagctgcgctccttccaggagacctttgagaaggtgcagcccccacccaccacccagcccctgctgcccggcagcgagcggcaggtgcaggccctgctgagccgctatggccctgggaagctgtaccaggtgaccagcaacatcagcggcaccggcaccctggacctgaccctgccccggggccagatcgtggccatcctgcagaacaaggacaccaagggcaacagcggccgctggctggtggacaccggcggccaccggggctacgtgcctgctgggaagctgcagctgtaccacgtggtgcccagcgctgaggagctgcggcggcaggccggcctgaacaaggacccccgctgcctgaccccagagcccagccctgccctggtgcccagcatccccaccatgaaccaggtgattgctgcctacccctttgtggcccggagcagccatgaggtgtccctgcaggccggccagcctgtgaccatcctggaggcccaggacaagaagggcaaccctgagtggagcctggtggaggtgaatggccagaggggctacgtgcccagcggcttcctggcccgggcccggagccctgtgctgtggggctggagcctgcccagctag

SEQ ID NO: 19129 - DNA, 3399 bp, Artificial Sequence
  Description of Artificial Sequence: Synthetic coding sequence
atggccagtgatggagccagcgccctgcccggccctgacatgtccatgaagcccagcgctgcccccagccccagccctgccctgcccttcctgccccccaccagtgaccccccagaccaccccccccgggagcccccaccccagcccatcatgcccagcgtcttctccccagacaaccccctgatgctgagcgccttccccagcagcctgctggtgactggagatggcggcccctgcctgtctggagctggagctgggaaggtgattgtgaaggtgaagacagagggcggcagcgctgagcccagccagacccagaacttcatcctgacccagacagccctgaacagcacagcccctggcaccccctgtggcggcctggagggccctgcccccccatttgtgacagccagcaatgtgaagaccatcctgcccagcaaggctgtgggcgtgtcccaggagggccccccaggcctgcccccccagcccccacctcctgtggcccagctggtgcccatcgtgcccctggagaaggcctggccaggcccccacggcaccaccggggagggcggccctgtggccaccctgagcaagcccagcctgggggacaggagcaagatcagcaaggatgtgtatgagaacttccggcagtggcagcgctacaaggccctggcccggcggcacctgagccagagcccagacacagaggccctgagctgcttcctgatccctgtgctgcggagcctggcccggctgaagcccaccatgaccctggaggagggcctgcccctggccgtgcaggagtgggagcacaccagcaactttgacaggatgatcttctatgagatggccgagcgcttcatggagtttgaagctgaggagatgcagatccagaacacccagctgatgaatggcagccagggcctgagccctgccacccccctgaagctggaccccctgggccccctggccagcgaggtgtgccagcagcctgtgtacatccccaagaaggccgccagcaagacccgggccccccggcggcggcagaggaaggcccagaggcccccagcccctgaggcccccaaggagatccccccagaggccgtgaaggagtatgtggacatcatggagtggctggtgggcacccacctggccactggagagagtgatggcaagcaggaggaggagggccagcagcaggaggaggagggcatgtacccagaccccggcctgctgagctacatcaatgagctgtgcagccagaaggtgtttgtgtccaaggtggaggccgtcatccacccccagttcctggccgacctgctgagccctgagaagcagagggaccccctggccctgattgaggagctggagcaggaggagggcctgaccctggcccagctggtgcagaagaggctgatggccctggaggaggaggaggatgctgaggcccctccttccttcagcggggcccagctggacagcagccccagcggctctgtggaggatgaagatggagatggccgcctgcggcccagccctggcctgcagggcgccggcggggccgcctgcctgggcaaggtgagcagcagcggcaagagggcccgggaggtgcatggaggccaggagcaggccctggacagcccccggggcatgcacagagatggcaacaccctgcccagccccagctcctgggacctgcagcctgagctggccgccccccagggcaccccaggccccctgggcgtggagcggcggggcagcggcaaggtgatcaaccaggtgtccctgcaccaggacggccacctgggcggggccggccccccaggccactgcctggtggccgacaggaccagcgaggccctgcccctgtgctggcagggcggcttccagcctgagagcacccccagcctggatgctggcctggccgagctggcccccctgcagggccagggcctggagaagcaggtgctgggcctgcagaagggccagcagacaggaggccggggcgtgctgccccagggcaaggagcccctggccgtgccctgggagggcagcagcggggccatgtggggagatgaccggggcacccccatggcccagagctatgaccagaaccccagccccagggctgctggggagagagatgatgtgtgcctgagccctggggtgtggctgagcagcgagatggatgctgtgggcctggagctgcctgtgcagatcgaggaggtgattgagagcttccaggtggagaagtgtgtgacagagtaccaggagggctgccagggcctgggcagccggggcaacatcagcctgggccctggagagaccctggtgcctggggacacagagagcagcgtcatcccctgtggcggcaccgtggccgctgctgccctggagaagaggaactactgcagcctgcccggccccctgcgggccaacagcccccccctgcggagcaaggagaaccaggagcagagctgtgagaccgtgggccaccccagcgacctgtgggccgagggctgcttccccctgctggagagcggggacagcaccctgggcagcagcaaggagaccctgccccccacctgccagggcaacctgctgatcatgggcacagaagatgccagcagcctgcctgaggccagccaggaggccggcagccggggcaacagcttcagccccctgctggagaccatcgagcctgtgaacatcctggatgtgaaggatgactgtggcctgcagctgcgggtgtctgaggacacctgccccctgaatgtgcacagctatgacccccagggcgagggccgggtggaccctgacctgagcaagcccaagaacctggcccccctgcaggagagccaggagagctacaccaccggcacccccaaggccaccagcagccaccagggcctgggcagcaccctgccccggcggggcaccagaaatgccatcgtgccccgggagacctctgtgtccaagacccacaggtctgctgaccgggccaagggcaaggagaagaagaagaaggaggccgaggaggaggatgaggagctgagcaactttgcctacctgctggccagcaagctgagcctgagcccccgggagcaccccctgagcccccaccacgccagcggcggccagggcagccagagggccagccacctgctgcctgctggggccaagggccccagcaagctgccctaccctgtggccaagagcggcaagagggccctggccggcggccctgcccccacagagaagaccccccacagcggggcccagctgggcgtgccccgggagaagcccctggccctgggcgtggtgcggcccagccagcccaggaagagaagatgtgacagctttgtgacaggccgcaggaagaagagaagaagaagccagtag

SEQ ID NO: 19130 - DNA, 522 bp, Artificial Sequence
  Description of Artificial Sequence: Synthetic coding sequence
atggctgtggccgtgggcgtgcgggccgcccctgtgctgggcctggcccgggccctggtgctgggcctgcggggcagccaggccgcccgctggaggggctggggcacagctgcccctggcagcctgtgggccctgtgtgaatgtcctgctggctgccgggagctgtggttccggggccgggccgcctgggccgcccggtctgagcggctgctgcacccagcccaggacagtgatggagagcgggaggacagcgctgctgagcgggcccggcagcagctggaggccctgctgaacaagaccatgaggatccgcatgacagatggccgcaccctggtgggctgcttcctgtgcacagaccgggactgcaacgtcatcctgggcagcgcccaggagttcctgaagcccagcgacagcttctctgctggggagccccgggtgctgggcctggccatggtgcccggccaccacatcgtgtccattgaggtgcagcgggagagcctgaccggccccccctacctgtag

SEQ ID NO: 19131 - DNA, 558 bp, Artificial Sequence
  Description of Artificial Sequence: Synthetic coding sequence
atggtgaacagctgctgcggctctgtgtgcagcgaccagggctgcggccaggacctgtgccaggagacctgctgctgccccagctgctgccagaccacctgctgcaggaccacctgctaccggcccagctacagcgtgtcctgctgctgccggccccagtgctgccagagcgtgtgctgccagcccacctgctgccggcccagctgctgcgtgagcagctgctgcaagccccagtgctgccagagcgtgtgctgccagcccacctgctgccaccccagctgctgcatcagcagctgctgccggcccagctgctgcgtgagcagctgctgcaagccccagtgctgccagagcgtgtgctgccagcccaactgctgccggcccagctgcagcatcagcagctgctgccggcccagctgctgtgagagcagctgctgccggccctgctgctgcctgcggcctgtgtgtggccgggtgtcctgccacaccacctgctacagacctgcctgtgtgatcagcacctgccccaggcctgtgtgctgtgccagcagctgctgctag

SEQ ID NO: 19132 - DNA, 252 bp, Artificial Sequence
  Description of Artificial Sequence: Synthetic coding sequence
atgtgctgcaactactacagaaactgctgcggcggctgcggctacggcagcggctggagcagcggctgcggctacggctgcggctacggctgcggctacggcagcggctgccgctatggcagcggctatggaacaggctgcggctacggctgcggctacggcagcggctgcggctacggctgcggctacagcagcagctgctgcggctaccggcccctgtgctaccgccgctgctacagcagctgctactag

SEQ ID NO: 19133 - DNA, 993 bp, Artificial Sequence
  Description of Artificial Sequence: Synthetic coding sequence
atgggcagcaggaagaaggagatcgccctgcaggtgaacatcagcacccaggagctgtgggaggagatgctgagcagcaagggcctgactgtggtggatgtgtaccagggctggtgtggcccctgcaagcctgtggtgtccctcttccagaagatgagaattgaggtgggcctggacctgctgcactttgccctggccgaggccgaccggctggatgtgctggagaagtaccggggcaaatgtgagcccaccttcctgttctacgccggcggggagctggtggccgtggtgcggggggccaatgcccccctgctgcagaagaccatcctggaccagctggaggccgagaagaaggtgctggccgagggccgggagaggaaggtgatcaaggatgaggccctgagtgatgaagatgaatgtgtgagccacggcaagaacaatggagaagatgaggacatggtgagcagcgagaggacctgcaccctggccatcatcaagccagatgctgtggcccacggcaagacagatgagatcatcatgaagatccaggaggccggctttgagatcctgaccaatgaggagaggaccatgacagaggccgaggtgcggctcttctaccagcacaaggccggggaggaggcctttgagaagctggtgcaccacatgtgcagcggccccagccacctgctgatcctgaccaggacagagggctttgaagatgtggtgaccacctggaggacagtgatgggcccccgggaccccaacgtggcccggcgggagcagcctgagagcctgcgggcccagtatggaacagagatgcccttcaatgctgtgcacggcagccgggacagagaagatgctgaccgggagctggccctgctcttccccagcctgaagttcagtgacaaggacacagaggccccccagggcggggaggccgaggccacagctggccccacagaggccctgtgcttcccagaagatgtggactag

SEQ ID NO: 19134 - DNA, 606 bp, Artificial Sequence
  Description of Artificial Sequence: Synthetic coding sequence
atggtgagcagctgctgcggctctgtgtgcagcgaccagggctgcggccaggacctgtgccaggagacctgctgccggcccagctgctgtgagaccacctgctgcaggaccacctgctgccggcccagctgctgcgtgagcagctgctgccggccccagtgctgccagagcgtgtgctgccagcccacctgcagccggcccagctgctgccagaccacctgctgcaggaccacctgctaccggcccagctgctgcgtgagcagctgctgccggccccagtgctgccagcctgcctgctgccagcccacctgctgcaggcctccccgctgctgcatcagcagctgctgccggcccagctgctgcgtgagcagctgctgcaagccccagtgctgccagagcgtgtgctgccagcccaactgctgccggcccagctgcagcatcagcagctgctgccggcccagctgctgtgagagcagctgctgccggccctgctgctgcgtgcggcctgtgtgtggccgggtgtcctgccacaccacctgctaccggcccacctgtgtgatcagcagctgcccccggcccctgtgctgtgccagcagctgctgctag

SEQ ID NO: 19135 - DNA, 792 bp, Artificial Sequence
  Description of Artificial Sequence: Synthetic coding sequence
atgggagacatcccagctgtgggcctgagctcctggaaggccagccctgggaaggtgacagaggccgtgaaggaggccattgatgctggctaccgccactttgactgtgcctacttctaccacaatgaaagagaggtgggcgccggcatccgctgcaagatcaaggagggcgctgtgcggcgggaggacctcttcatcgccaccaagctgtggtgcacctgccacaagaagagcctggtggagacagcctgcaggaagagcctgaaggccctgaagctgaactacctggacctgtacctgatccactggcccatgggcttcaagccaccccaccctgagtggatcatgagctgcagcgagctgtccttctgcctgagccacccccgggtgcaggacctgcccctggatgagagcaacatggtgatccccagcgacacagacttcctggacacctgggaggccatggaggacctggtgatcaccggcctggtgaagaacattggagtgagcaacttcaaccacgagcagctggagcggctgctgaacaagccaggcctgcgcttcaagcccctgaccaaccagatcctgatccgcttccagatccagagaaatgtcatcgtcatccctggcagcatcacccccagccacatcaaggagaacatccaggtgtttgattttgagctgacccagcacgacatggacaacatcctgagcctgaacagaaacctgcggctggccatgttccccatcaccaagaaccacaaggactaccccttccacatcgagtactag

SEQ ID NO: 19136 - DNA, 177 bp, Artificial Sequence
  Description of Artificial Sequence: Synthetic coding sequence
atgagatactacggcagctactaccggggcctgggctacggctgcggcggctttggaggcctgggctacggctgcggctgcggcggctaccgctatggcagcggctacggcggctaccgctatggctgctgccggcccagctgccgggagggctacggcttcagcggcttctactag

SEQ ID NO: 19137 - DNA, 159 bp, Artificial Sequence
  Description of Artificial Sequence: Synthetic coding sequence
atgtgctacggctacggctgcggctgcggcagcttctgccgcctgggctacggctgcggctatgagggctgccgctatggctgcggccaccggggctgtggagatggctgctgctgccccagctgctaccgccgctaccgcttcaccggcttctactag

SEQ ID NO: 19138 - DNA, 255 bp, Artificial Sequence
  Description of Artificial Sequence: Synthetic coding sequence
atgagctactacggcagctactaccggggcctgggctacggctgcggcggctttggaggcctgggctacggctacggctgcggctgcggcagcttccggcggctgggctacggctgcggctttggaggaaatggctacggctactgccggcccagctgctacggcggctacggcttcagcatcctgctgaagagctacccagaggacaccatcagcgaggtgatccgccgctccttcaacctgaccaagtactag

SEQ ID NO: 19139 - DNA, 246 bp, Artificial Sequence
  Description of Artificial Sequence: Synthetic coding sequence
atgagctactacggcagctactacggcggcctgggctacggctgcggcggctttggaggcctgggctacggctacggctgcggctgcggcagcttccggcggctgggcagcggctgcggctatggaggctacggctacggcagcggctttggaggctacggctacggcagcggctttggaggctacggctacggctgctaccggcccagctactacggcggctacggcttcagcggcttctactag

SEQ ID NO: 19140 - DNA, 414 bp, Artificial Sequence
  Description of Artificial Sequence: Synthetic coding sequence
atgagctacaactgcagcagcggcaacttcagcagctgctgcttcggcagctacctgcgctaccctgtgtccacctacaacctcttctaccccagcaatgccatctacagccccaacacctgccagctgggcagcagcctgtacaacggctgccaggagacctactgtgagcccaccagctgccagaccagctgcaccctggcccggagctaccagaccagctgctactgccccaagaacagcatcttctgcagcccccggcagaccaactacatccgcagcctgggctgcggcaacacaggcctgggcagcctgggctgcggcagcacaggcttccagagcctggactgtggcagcagcttctaccaccccaccaccttcagcagcaggaacttccaggccacctgctactag

SEQ ID NO: 19141 - DNA, 483 bp, Artificial Sequence
  Description of Artificial Sequence: Synthetic coding sequence
atgagctacaactgctgcagcaggaacttcagcagccgcagctttggaggctacctgtactacccaggcagctaccccagcagcctggtgtacagcacagccctgtgcagccccagcacctgccagctgcggagcagcctgtacagagactgccagaagacctgctgggagcccgccagctgccagaagagctgctaccggcccaggaccagcatcctgtgctgcccctgccagaccacctgcagcggcagcctgggcttccgcagcagcagctgccgcagccagggctacggcagccgctgctgctacagcctgggcaatggcagcagcggcttccgcttcctgaagtatggaggctgcggcttccccagcctgtcctatggcagccgcttctgctaccccaactacctggccagcggggcctggcagagcagctgctaccggcccatctgtggcagccgcttctaccagttcacctgctag

SEQ ID NO: 19142 - DNA, 684 bp, Artificial Sequence
  Description of Artificial Sequence: Synthetic coding sequence
atgctgaacccagatggagtgtacctgggcaactaccgctgcagcctgatgggctttgacctgaacagacactggctggaccccagcccctgggtgcaccccaccctgcatggagtgaagcagctgattgtgcagatgtacaatgaccccaagaccagcctggagttctacatcgacatccacgcccacagcaccatgatgaatggcttcatgtatggcaacatctttgaagatgaggagcgcttccagaggcaggccatcttccccaagctgctgtgccagaatgctgaggacttctcctacagcagcaccagcttcaacagagatgctgtgaaggccggcactggaagacgcttcctgggcggcctgctggaccacaccagctactgctacaccctggaggtgtccttctacagctacatcatcagcggcaccacagctgctgtgccctacacagaggaggcctacatgaagctgggcagaaatgtggcccggaccttcctggactactaccgcctgaaccctgtggtggagaaggtggccatccccatgccccggctgaggaaggagaagagccccccctacaagcaccccctgctgcggggccctgccagcaactaccccaacagcaaaggagacaagaagagctctgtgaaccacaaggaccccagcacccccttctag

SEQ ID NO: 19143 - DNA, 465 bp, Artificial Sequence
  Description of Artificial Sequence: Synthetic coding sequence
atgacccactgctgcagcccctgctgccagcccacctgctgcaggaccacctgctgcaggaccacctgctggaagcccaccaccgtgaccacctgcagcagcaccccctgctgccagcccagctgctgcgtgagcagctgctgccagccctgctgccggcccacctgctgccagaacacctgctgccagcccacctgtgtgaccagctgctgccagcccagctgctgcagcaccccctgctgccagcccacctgctgcggcagcagctgtgaccagagcagcagctgtgcccctgtgtactgcaggaggacctgctactaccccaccaccgtgtgcctgcccggctgcctgaaccagagctgtggcagcaactgctgccagccctgctgcaggcctgcctgctgtgagaccacctgcttccagcccacctgtgtgagcagctgctgccagcccttctgctgctag

SEQ ID NO: 19144 - DNA, 7062 bp, Artificial Sequence
  Description of Artificial Sequence: Synthetic coding sequence
atgaagcagaggaagggccagggcagcggcggcagccggggcaggaagaagaggggcctgagtgacatcagccccagcaccagcctgccccccctggtggagggccagctgcgctgcttcctgaagctgactgtgaacagagtcatctggaagatcgccaagccacccacctgtgtgctggtgcgggtgcgctggtggggcgagaccagtgatggcaccctcttctgccccagagatgccctgcagacagagcccaaggctgtgaggaccaccaccaggtatgccatccgctgtggccccaagcagttcaccagctacctgacagacatggctgtgctggtgctggaggtgatcaccaagctggatggcctgcccatcggccgggtgcagatcaatggcctggcccagctgagccccacccaccagatcaatggcttcttcaccatcgtgagcagcaccagcaagaagctgggggagctgcaggtgtccctggccctggagcccctgtctgagacctatgacagctaccaccccctgcccaccacagacatgacagaaaatgtgctgctgagcaagcagggcttcagagaaaatacagagcccagcagcacccagttccaggtgcccagccggccccgggacatccacaccatcaagattgatggcaaggagctggccgccaacagcagccgcagcaccaccccccggggcaaggaccacgtgtgctttgctgaaaatccagacaccatcaaggacagcagctttggcctgcagcacagcctgaacagcggccagagcctggagagcgtgaccctgaagggccgggcccccaggaagcagatgagcctgctgaacagcagcgagttccagccccagatcagaacagtggccaagagccacagcgacagctgcatcctgagcagcaacaacctgcccaccaaggacctgctgagcgccctgctggagcagggcaacaagctgagaaatgccatggtgatcagcgccatgaagagcagccctgagacctccatgctgctggaccaggtgcacccccccatcaatgaagacagcctgcgggccagcacccagatccgggccttcagcaggaaccgcttcaaggaccacatcgaggaccacctgctgcccagcacagagaacaccttctggaggcatgacaccaaggctgacacccgggccatccagctgctgctgggcagcgctgagctgagccagggcaacttctgggatggcctgggcagccccccagacagccccagccctggcagtgatgtgtactgcatcagcgagctgaatgacccccagtatgaccagagcctgctggagaacctcttctacacagcccccaagagtgacaccagcatcagtgacttcctgtctgaggaggatgacatcgtgcccagcaagaagatcagccagagcacagccctggcccggagcagcaaggtgctggagagcagtgaccacaagctgaagaagaggtctgctgggaagaggaacagaaacctggtggagcagcagatgctgtctgagaccccagaagatgcccagaccatgaccctgtctgtggaccggctggccctgctgggccgcacccacagcgtgcgcatcatcatcgagaccatgggcgtgcccccagacagcccccagatgaccccaggcaagaagagctatgccggccccccacccaaggtgaccacagccaagaagaggaccttctttgtggagtaccacttccctgtgggcttcagcgagagcggcctgggcaagacagccctgatcacagaggtggtgcggctggccagcagcaagatcacagatggcaaggtgaagttccagcagagatttgtgtttcctgtgcagtttggaggccccatgattgagcactggtggaacagcaacctgaccttccagatctacgtgaagaagaccccccagaagaagccagaggtgattggctctgtgtccctgagcctgcgggctgtgatccagagcgagctgctgtccttcagtgaccagctgcctgtgcagcaggagaatggccagagccccttcggccccctgaaggtgaccatggagctgatcacagacaacaaggacttcaccggcatcaacaccaagctgagcggcaacacccactacacccccctgtgtgcccccaccagccccaacaaggccctgcctgagctgaaccaggacatgacctgcaccaagaacccccagaacctgaaccagatccacgaggagacagccaagaaggcccagaacctggtgctgcccaacaggaagagccccagccctgtggccccccaccccagcacctttgtggccaccccagccagccacaacctggtgaaccagaccaacggcaccaccaaggagagcgccctgctgctgcacgtgctgctgatggtgcctgatggcaaggacttcatctctggagagagcgagaagcagagcccctgcaatgtgtacctgaactgcaagctgttcagcacagaggaggtgaccaggtctgtgattgcctggggcaccacccagcccgtcttcaacttcagccaggtgattcctgtgtccctgagcagcaagtacctggagcggctgaagaacaacgtgatggtgattgagacctggaacaaggtgcgcagccctggccaggacaagctgctgggcctggtgaagctgcccctgcaccagttctacatgtccttcaaggatgccaagatcagccggctgctgctggatgcccagtaccctgtggtggccgtggacagctacatgcctgtgattgatgtgttcagcggccaccagaatggcagcctgcgggtcttcctggccatgggcagcagcaaccagatcatggccctgcagaggctgaagaatgaggagggcaccctgccccccttcagccccaggcctgcccacttcctggaccagcccacagctgcctctgtggccatggctgaagatagaggaaatggcctgatggagcactgctttgagatccacatcgagatggtgaagggcctggcccccctgcaggccaccgtgtggggcgaggccgactgctacgtgcagtactacttccctgtgcagcacagccagagctctgtgctgaagggccctgagttcctggagaatggcatcaccctgaagcccttcagaacagccaccaccctgtgtgtgcctgaccccatcttcaacagcgagcaccaccacagcctgctgctgcctgctgaggtgcctgtgcagaggctgctgctgagcgccttcagcgcccagggcctggtgcctgggggcggcgtgcagtttgagatctggtgccgctactactaccccaacgtgcgggaccagaaggtggccaagggcaccctgcccctgagccgcatctgtgccatggtgaccacccagcaccgggaggatgtgggcatccagaccttcaacctgcccctgaccccaagaattgagaacaggaaggagctgaggaaccagagcagcggcctgctggatgtgggcctgcgctaccgccgcagccccaggacagctgagggcgtgctggccgccaggacagtgtccatctctgtgcagatcatccgggcctgtggcctgcaggccgccgccaaggccctggccgagcgggagcccgccctgcagttcagcgccaccgtgggcgtgaatgcctctgtgaccacccacctgtccttcctgccccagggcgagcagaggaggacccaccctgtggcctgcagcttctgcccagagttcagccaccacgtggagttcacctgcaacctggtgacccagcactgcagcggggaggcctgcttcctggccgagctgctggagtttgctgaggtgatctttgctgtgtaccacgagaacaccaagagcgccagtgacatcatcagcattgagagctgcaaggagtacctgctgggcgtggtgaaggtgcccaccaaggagctgctgatcaagaggagcggcatcaccggctggtaccccatcatcctgcctgaagatggcggcctgccccacggcctggagctgatgcagaagatcgtgggcggcctggagctgagcatctccttcacccacagaggagaccgggagcgggtgctggaggccgctgagcacctgggctggagctttgagaacagcctgaaggactttgtgaggatggatgaaggagagcccgccaccgtgaccatcagcaccccccggctgtggctgcccatccactgtgtgctgctggccggccacaaccacatccacaagaacacctactgctacctgcgctacaagttctatgaccacgaggccttctggacccccctgaagaagcccaaggagagcgtgaacaagaagcagatcatggtgaccttcaaggccagcaagagagctgaggtgacccggggccccagcctgctgtggtacttccgggaggagcggctggagatccaggtgtggagggcctatggaaatgacagcgtggagcggccccaccagacagacagctggattggcagcgcctacgtggacctggcccggctgggggagaggtctgcccggaccctgactgtgtctggagtgtaccccctgtttggaagaaatgccagcaacctgagcggggccgccctgcgggtgcacgtggtgctgagcagcctgagcagccacctggagcccacccatgagctggacagcatggactgcagcagccacagcgagagcgagcagctgcccaggagaaatgatgaggtgcagctgagccccccagaggtgatcagctgccaccagaagagccctgccagcacccaggtgccctgcagcagcaccacagctgaggtgcggctgacccaggagggccctgctgacctggatggcacctttgctgtgtccatcctggtggagcgggccatgcacctgagcctgaagggcagccccctgacagagaggaaggtgtccatccccagctgctgcgtgtcctttgccacagcagatgagagcagccctgtgtacacccaggtggtggagaacacagacagccccatctggaacttccagcagcagagccggctgagcaaggagctgctgctggacccccagcagaccctggtgttcaaggtgtggcacaagggagatgaggagagggtcatcggctttgcctctgtggacctgagccccctgctgagcggcttccagtttgtgtgtggctggtacaacatcacagacttctctggagagtgccagggccagatcaaggtggccgtgagccccctggagagcctcatccacttcaaggaggagcggcaggcccggcggggcgtggagaccagcaagagcctcatccccatctacagccccttctccttccctgccagtgacacctatgctgccttcagcagccacatggcccggcagaccctggaccagctggcccacgccagcagcaaggagctggacttcagcagccctggccgcagtgacaccaccaggagccaggccagcagacatgaggagcacgtgcagaacatccgccgcttccacgagagcctgcacctgcagggcgaggcccccctgccctgtgatgacaagctgaccaccagccccctgagcagccagaccagcatcctgaccagcctgaggaagaacctgtctgagctggaccagatccagcgctacttccggcagaagctgaccaagcccttcctgcccctgagcccccagacccagacagccatcagccagcaccaggagagctgccgggaccacctgggccctggggccagcagcctggaccccggcagccagtgcatcctggagaagagcagcaacctggtgctgcaggtgagcagcctcatcacagacctgcagaccatcacccgggacagccaggccgccctgagcagccaccgggcccggagccgcagcaacaaggccaccaccctgcctgatgcccaggacacagaggccctgcaggagcgctgcaccatgccagatgagcccctggtgcgggccccagacaagggcacagacagccccagccccccacccctggaggagaccagcaatggaggccgcatgctgcacgagagcctgcggcatgctgtgcccatcaccaggatgcagagcagcgaggacacagaagctggccctgcctacagtgatgaggactatgaggaggacatcatcgagcccaggaccctgaatgagatcaccaccgtgacagacaagaccagcccctggagcagcgtcatcagtgacaccagcgaggtgatcagcccccagccagatgaggtgcagcgggagggccccagctgccccagccctggccccttctgccgggaggagctgatggtgaagagcagcttcctgagcagccctgagagagctgtgaacccccacctgccccggcagggcagccccagccagagcctggtggcctgtgaatgtgaggccagcaaggcccgggtgggcggggagagcgccagcgccaacccccagcccatcccctgccccaccctgagcggggcccagcagagcagcacctttgtgggctggagcagcccccagacagaccagaacaaggagcccaagtctgaggccccagcagaaaatgaagctgccaccagcgagctgggggacagcgctgacagcttcaagaagctgcccctgaacctggccagccagagcagaagagagaaccacaagggcccccccatcgacagcagtgacatccggcagaggcaggtgaccaccggcagcgagaccagcaccaagcagagcctgctgctgcccggccccatcgtggtgcccaacttcttcctgcccccccagcagctggaggccagcctgaggatgctgagcctgagcgccaccctgcccccagctgccaccacagaccaggacaagtctgaggccaccaggggggccctgagccagaggccctgccggccccggcccaacagcctgcccctgaacctgcctgaggaggagaccctgagaattgcccgcatcttcagcagccagtacagccagaaggactag

SEQ ID NO: 19145 - DNA, 219 bp, Artificial Sequence
  Description of Artificial Sequence: Synthetic coding sequence
atgaactactacggcaactactacggcggcctgggctacggctatggaggctttgatgacctgggctacggctacggctgcggctgcggcagcttccggcggctgggctatggaggcggctatggaggctacggctacggcagcggctttggaggctacggctaccgcagctgccggcccagctgctatggaggctacggcttcagcggcttctactag

SEQ ID NO: 19146 - DNA, 198 bp, Artificial Sequence
  Description of Artificial Sequence: Synthetic coding sequence
atgagctacaactgctgctgcggcaacttcagcagccacagctgtgagggctacctgtgctacagcggctacagcagaggaggcagcagctaccccagcaacctggtgtacagcacagagcccctcatcagccagcacctgcctgctggcttcctgagcctgcagggcctgagcggggacctgctgggcaacccctag

SEQ ID NO: 19147 - DNA, 384 bp, Artificial Sequence
  Description of Artificial Sequence: Synthetic coding sequence
atggtgaacagctgctgcggctctgtgtgcagcgaccagggctgtgaccagggcctgtgccaggagacctgctgccggcccagctgctgccagaccacctgctgctgccccagctgtgtggtgagcagctgctgccggcccagctgcagccagaccacctgctgccagaccacctgctgccggcccagctgctgccaccctgtgtgctgccagaccacctgccggcccagctgtggggtgagcagctgctgccggcccctgtgctgccagaccacctgccggcccagctgtggggtgagcagctgctgccggcccctgtgctgccagaccacctgctgccgggccacctgctgccggcccagctgctgcggcagcagctgctag

SEQ ID NO: 19148 - DNA, 318 bp, Artificial Sequence
  Description of Artificial Sequence: Synthetic coding sequence
atgggctgctgccctggggactgcttcacctgctgcacccaggagcagaactgctgtgaggagtgctgctgccagcccggctgctgcggctgctgcggcagctgctgcggctgcggcggcagcggctgcggcggcagcggctgcggcggcagctgctgcggcagcagctgctgcggcagcggctgcggcggctgcggcggctgcggcggctgcggcggcggctgctgcggcagcagctgctgcggcagcagctgctgcggcagcggctgctgcggccctgtgtgctgccagcccacccccatctgtgacaccaagtag

SEQ ID NO: 19149 - DNA, 3915 bp, Artificial Sequence
  Description of Artificial Sequence: Synthetic coding sequence
atggaggagatccctgtgaaggtggccgtgcgcatccggcccctgctgtgcaaggaggccctgcacaaccaccaggtgtgtgtgcgggtcatccccaacagccagcaggtgatcatcggccgggacagagtcttcacctttgattttgtgtttgggaagaacagcacccaggatgaggtgtacaacacctgcatcaagcccctggtgctgagcctgattgagggctacaatgccaccgtgtttgcctacggccagacaggcagcggcaagacctacaccatcggcggcggccacatcgcctctgtggtggagggccagaagggcatcatcccccgggccatccaggagatcttccagagcatcagcgagcaccccagcattgacttcaacgtgaaggtgtcctacatcgaggtgtacaaggaggacctgcgggacctgctggagctggagacctccatgaaggacctgcacatccgggaggatgagaagggcaacacagtcatcgtgggcgccaaggaatgtcatgtggagagcgctggggaggtgatgagcctgctggagatgggaaatgctgcccggcacacaggcaccacccagatgaatgagcacagcagccgcagccacgccatcttcaccatcagcatctgccaggtgcacaagaacatggaggccgcagaagatggctcctggtacagccccaggcacatcgtgtccaagttccactttgtggacctggccggcagcgagcgggtgaccaagacaggcaacacaggagagcgcttcaaggagagcatccagatcaacagcggcctgctggccctgggcaatgtcatcagcgccctgggggaccccaggaggaagagcagccacatcccctacagagatgccaagatcacccggctgctgaaggacagcctgggcggcagcgccaagacagtgatgatcacctgtgtgagccccagcagcagcaactttgatgagagcctgaacagcctgaagtatgccaacagagccaggaacatccggaacaagcccaccgtgaacttcagccctgagagtgacagaattgatgagatggagtttgagatcaagctgctgcgggaggccctgcagagccagcaggccggcgtgtcccagaccacccagatcaaccgggagggcagcccagacaccaaccgcatccacagcctggaggagcaggtggcccagctgcagggagaatgtctgggctaccagtgctgcgtggaggaggccttcaccttcctggtggacctgaaggacacagtgcggctgaatgagaagcagcagcacaagctgcaggagtggttcaacatgatccaggaggtgaggaaggctgtgctgaccagcttccggggcatcggcggcacagccagcctggaggagggcccccagcacgtgacagtgctgcagctgaagcgggagctgaagaagtgccagtgtgtgctggccgcagatgaggtggtgttcaaccagaaggagctggaggtgaaggagctgaagaaccaggtgcagatgatggtgcaggagaacaagggccatgctgtgtccctgaaggaggcccagaaggtgaaccggctgcagaatgagaagatcatcgagcagcagctgctggtggaccagctgtctgaggagctgaccaagctgaacctgtctgtgaccagcagcgccaaggagaactgtggagatggcccagatgcccgcatccctgagcggcggccctacacagtgccctttgacacccacctgggccactacatctacatccccagccggcaggacagcaggaaggtgcacaccagcccccccatgtacagcctggaccgcatctttgctggcttccgcaccaggagccagatgctgctgggccacatcgaggagcaggacaaggtgctgcactgccagttcagtgacaacagtgatgatgaggagagcgagggccaggagaagagcggcacccgctgccgcagccgctcctggatccagaagccagacagcgtgtgcagcctggtggagctgagtgacacccaggatgagacccagaagagtgacctggagaatgaagacctgaagattgactgcctgcaggagagccaggagctgaacctgcagaagctgaagaacagcgagcgcatcctgacagaggccaagcagaagatgagggagctgaccatcaacatcaagatgaaggaggacctgatcaaggagctgatcaagacaggaaatgatgccaagtctgtgtccaagcagtacagcctgaaggtgaccaagctggagcatgatgctgagcaggccaaggtggagctgattgagacccagaagcagctgcaggagctggagaacaaggacctgagtgatgtggccatgaaggtgaagctgcagaaggagttcaggaagaagatggatgctgccaagctgcgggtgcaggtgctgcagaagaagcagcaggacagcaagaagctggccagcctgagcatccagaatgagaagagggccaatgagctggagcagagcgtggaccacatgaagtaccagaagatccagctgcagaggaagctgcgggaggagaatgagaagaggaagcagctggatgctgtgatcaagagggaccagcagaagatcaaggccctgaacacagacagcctgaagatcagcacccggctgaacctgctggagcaggagctgtctgagaagaatgtgcagctgcagaccagcacagctgaggagaagaccaagatcagcgagcaggtggaggtgctgcagaaggagaaggaccagctgcagaagaggaggcacaacgtggatgagaagctgaagaatggccgggtgctgagccctgaggaggagcacgtgctcttccagctggaggagggcatcgaggccctggaggccgccatcgagtacagaaatgaaagcatccagaaccggcagaagagcctgcgggccagcttccacaacctgagcagaggagaggccaacgtgctggagaagctggcctgcctgagccctgtggagatccgcaccatcctcttccgctacttcaacaaggtggtgaacctgcgggaggccgagaggaagcagcagctgtacaatgaggagatgaagatgaaggtgctggagcgggacaacatggtgcgggagctggagagcgccctggaccacctgaagctgcagtgtgaccggcggctgaccctgcagcagaaggagcacgagcagaagatgcagctgctgctgcaccacttcaaggagcaggatggagagggcatcatggagaccttcaagacctatgaggacaagatccagcagctggagaaggacctgtacttctacaagaagaccagccgggaccacaagaagaagctgaaggagctggtgggggaggccatccggcggcagctggcccccagcgagtaccaggaggccggagatggagtgctgaagccagagggcggcggcatgctgtctgaggagctgaagtgggccagcaggcctgagagcatgaagctgagcggccgggagcgggagatggacagcagcgccagcagcctgcggacccagcccaacccccagaagctgtgggaggacatccctgagctgccccccatccacagcagcctggccccacccagcggccacatgctgggcaatgaaaacaagacagaaacagatgacaaccagttcaccaagagccacagccggctgagcagccagatccaggtggtgggcaatgtgggccgcctgcacggcgtgacccctgtgaagctgtgcaggaaggagctgcggcagatcagcgccctggagctgagcctgcggcgcagcagcctgggcgtgggcatcggctccatggctgctgacagcattgaggtgtccaggaagccccgggacctgaagacctag

SEQ ID NO: 19150 - DNA, 903 bp, Artificial Sequence
  Description of Artificial Sequence: Synthetic coding sequence
atggaggaggaggccagcagccctggcctgggctgcagcaagccccacctggagaagctgaccctgggcatcacccgcatcctggagagcagccctggggtgacagaggtgaccatcatcgagaagcccccagctgagcggcacatgatcagctcctgggagcagaagaacaactgtgtgatgccagaagatgtgaagaacttctacctgatgaccaacggcttccacatgacctggagcgtgaagctggatgagcacatcatccccctgggctccatggccatcaacagcatcagcaagctgacccagctgacccagagctccatgtacagcctgcccaatgcccccaccctggccgacctggaggatgacacccatgaggccagtgatgaccagcctgagaagccccactttgacagccgcagcgtcatctttgagctggacagctgcaatggaagtggcaaggtgtgcctggtgtacaagagcggcaagccagccctggccgaggacacagagatctggttcctggaccgggccctgtactggcacttcctgacagacaccttcaccgcctactaccgcctgctgatcacccacctgggcctgccccagtggcagtatgccttcaccagctatggcatcagcccccaggccaagcagtggttctccatgtacaagcccatcacctacaacaccaacctgctgacagaggagacagacagctttgtgaacaagctggaccccagcaaggtgttcaagagcaagaacaagatcgtcatccccaagaagaagggccctgtgcagcctgctgggggccagaagggccccagcggccccagcggccccagcaccagcagcaccagcaagagcagcagcggcagcggcaaccccaccaggaagtag

SEQ ID NO: 19151 - DNA, 390 bp, Artificial Sequence
  Description of Artificial Sequence: Synthetic coding sequence
atgatgacagacctgaagcagagccacagcgtgcggctgaatgatggccccttcatgcctgtgctgggcttcggcacctacgccccagaccacacccccaagagccaggccgctgaggccaccaaggtggccattgatgtgggcttccgccacatcgacagcgcctacctgtaccagaatgaggaggaggtgggccaggccatctgggagaagattgctgatggcaccgtgaagcgggaggagatcttctacaccatcaagctgtgggccaccttcttccgggcagagctggtgcacccagccctggagaggagcctgaagaagctgggccctgactatgtggacctcttcatcatccacgtgccctttgccatgaagggcagcagctag

SEQ ID NO: 19152 - DNA, 1257 bp, Artificial Sequence
  Description of Artificial Sequence: Synthetic coding sequence
atgcaccctgagcccagcgagcccgccaccggcggcgctgctgagctggactgtgcccaggagcccggggtggaggagagcgctggggaccacggcagcgctggccggggcggctgcaaggaggagatcaatgaccccaaggagatctgtgtgggcagcagtgacaccagctaccacagccagcagaagcagagcggggacaatggcagcggcggccactttgcccaccccagagaagatcgggaggaccggggccccaggatgaccaagagcagcctgcagaagctgtgcaagcagcacaagctgtacatcaccccagccctgaatgacaccctgtacctgcacttcaagggctttgacagaattgagaacctggaggagtacacaggcctgcgctgcctgtggctgcagagcaatggcatccagaagattgagaacctggaggcccagacagagctgcgctgcctcttcctgcagatgaacctgctgaggaagattgagaacctggagcccctgcagaagctggatgccctgaacctgagcaacaactacatcaagaccatcgagaacctgagctgcctgcctgtgctgaacaccctgcagatggcccacaaccacctggagaccgtggaggacatccagcacctgcaggagtgcctgcggctgtgtgtgctggacctgagccacaacaagctgagtgaccctgagatcctgagcatcctggagagcatgccagacctgcgggtgctgaacctgatgggcaaccctgtgatccggcagatccccaactacagaagaacagtgacagtgcggctgaagcacctgacctacctggatgacaggcctgtgttccccaaggaccgggcctgtgccgaggcctgggcccggggcggctacgccgctgagaaggaggagcggcagcagtgggagagccgggagaggaagaagatcacagacagcattgaggccctggccatgatcaagcagagagctgaggagaggaagaggcagcgggagagccaggagcggggggagatgaccagcagtgatgatggagaaaatgtgcctgccagcgctgagggcaaggaggagcccccaggggaccgggagacccggcagaagatggagctgtttgtgaaggagagctttgaggccaaggatgagctgtgcccagagaagcccagcggggaggagccccctgtggaggccaagcgggaggatggagaccctgccaccgtgacagcctgtgagggctag

SEQ ID NO: 19153 - DNA, 2472 bp, Artificial Sequence
  Description of Artificial Sequence: Synthetic coding sequence
atgggcaagaagaggaccaagggcaagacagtgcccattgatgacagcagcgagaccctggagcctgtgtgccgccacatcaggaagggcctggagcagggcaacctgaagaaggccctggtgaatgtggagtggaacatctgccaggactgcaagacagacaacaaggtgaaggacaaggccgaggaggagacagaggagaagcccagcgtgtggctgtgcctgaagtgtggccaccagggctgcggcaggaacagccaggagcagcacgccctgaagcactacctgacccccaggtctgagccccactgcctggtgctgagcctggacaactggagcgtgtggtgctacgtgtgtgacaatgaggtgcagtactgcagcagcaaccagctgggccaggtggtggactatgtgaggaagcaggccagcatcaccacccccaagccagctgagaaggacaatggaaatattgagctggagaacaagaagctggagaaggagagcaagaatgagcaggagcgggagaagaaggagaacatggccaaggaaaatccacccatgaacagcccctgccagatcaccgtgaagggcctgagcaacctgggcaacacctgcttcttcaatgctgtgatgcagaacctgagccagacccctgtgctgcgggagctgctgaaggaggtgaagatgagcggcaccatcgtgaagattgagcccccagacctggccctgacagagcccctggagatcaacctggagcccccaggccccctgaccctggccatgagccagttcctgaatgagatgcaggagaccaagaagggcgtggtgacccccaaggagctgttcagccaggtgtgcaagaaggctgtgcgcttcaagggctaccagcagcaggacagccaggagctgctgcgctacctgctggatggcatgagagctgaggagcaccagagggtgtccaagggcatcctgaaggcctttggaaacagcacagagaagctggatgaggagctgaagaacaaggtgaaggactatgagaagaagaagtccatgcccagctttgtggaccgcatctttggaggagagctgacctccatgatcatgtgtgaccagtgcaggacagtgtccctggtgcatgagagcttcctggacctgagcctgcctgtgctggatgaccagagcggcaagaagtctgtgaatgacaagaacctgaagaagacagtggaggatgaggaccaggacagcgaggaggagaaggacaatgacagctacatcaaggagaggagtgacatccccagcggcaccagcaagcacctgcagaagaaggccaagaagcaggccaagaagcaggccaagaaccagaggcggcagcagaagatccagggcaaggtgctgcacctgaatgacatctgcaccatcgaccacccagaagattctgaatatgaagctgagatgagcctgcagggcgaggtgaacatcaagagcaaccacatcagccaggagggcgtgatgcacaaggagtactgtgtgaaccagaaggacctgaatggccaggccaagatgattgagagcgtgacagacaaccagaagagcacagaggaggtggacatgaagaacatcaacatggacaatgacctggaggtgctgaccagcagccccaccaggaacctgaatggagcctacctgacagagggcagcaatggagaggtggacatcagcaatggcttcaagaacctgaacctgaatgctgccctgcacccagatgagatcaacatcgagatcctgaatgacagccacaccccaggcaccaaggtgtatgaggtggtgaatgaagatcctgagacagccttctgcaccctggccaaccgggaggtgttcaacacagatgagtgcagcatccagcactgcctgtaccagttcaccagaaatgagaagctgagagatgccaacaagctgctgtgtgaggtgtgcacccggcggcagtgcaatggccccaaggccaacatcaagggggagaggaagcacgtgtacaccaatgccaagaagcagatgctgatcagcctggcccctcctgtgctgaccctgcacctgaagcgcttccagcaggccggcttcaacctgaggaaggtgaacaagcacatcaagtttcctgagatcctggacctggcccccttctgcaccctgaagtgcaagaatgtggccgaggagaacaccagggtgctgtacagcctgtatggagtggtggagcacagcggcaccatgaggagcggccactacacagcctatgccaaggccaggacagccaacagccacctgagcaacctggtgctgcacggggacatcccccaggactttgagatggagagcaagggccagtggttccacatcagtgacacccacgtgcaggccgtgcccaccaccaaggtgctgaacagccaggcctacctgctcttctatgagcgcatcctgtag

SEQ ID NO: 19154 - DNA, 3204 bp, Artificial Sequence
  Description of Artificial Sequence: Synthetic coding sequence
atgaacagcatggacagacacatccagcagaccaatgaccggctgcagtgcatcaagcagcacctgcagaacccagccaacttccacaatgctgccacagagctgctggactggtgtggggacccccgggccttccagaggccctttgagcagagcctgatgggctgcctgactgtggtgtcccgggtggccgcccagcagggctttgacctggacctgggctaccgcctgctggccgtgtgtgccgccaacagagacaagttcacccccaagtctgctgccctgctgagctcctggtgtgaggagctgggccgcctgctgctgctgcggcaccagaagagccggcagagcgaccccccaggcaagctgcccatgcagccccccctgagctccatgagctccatgaagcccaccctgagccacagtgatggcagcttcccctatgacagcgtgccctggcagcagaacaccaaccagcccccaggcagcctgtctgtggtgaccaccgtgtggggcgtgaccaacaccagccagagccaggtgctgggcaaccccatggccaatgccaacaaccccatgaaccctgggggcaaccccatggccagcggcatgaccaccagcaaccctggcctgaacagcccccagtttgctggccagcagcagcagttcagcgccaaggccggccctgcccagccctacatccagcagagcatgtatggccggcccaactacccaggcagcggcggctttggagccagctacccaggcggccccaatgccccagctggcatgggcatccccccccacacccggcccccagctgacttcacccagcctgctgctgctgctgctgctgctgctgtggccgctgctgctgccacagccacagccacagccacagccaccgtggccgccctgcaggagacccagaacaaggacatcaaccagtatggccccatgggccccacccaggcctacaacagccagttcatgaaccagcccggcccccggggccctgcctccatgggcggctccatgaacccagcctccatggctgctggcatgacccccagcggcatgagcggcccccccatgggcatgaaccagccccggcccccaggcatcagccccttcggcacccacggccagaggatgccccagcagacctacccaggcccccggccccagagcctgcccatccagaacatcaagaggccctacccaggagagcccaactacggcaaccagcagtatggccccaacagccagttccccacccagcccggccagtacccagcccccaaccccccccggcccctgaccagccccaactacccaggccagaggatgcccagccagcccagcagcggccagtaccccccacccaccgtgaacatgggccagtactacaagccagagcagttcaacggccagaacaacaccttcagcggcagcagctacagcaactacagccagggcaatgtgaaccggccccccaggcctgtgcctgtggccaactacccccacagccctgtgcccggcaaccccaccccacccatgaccccaggcagcagcatccccccctacctgagccccagccaggatgtgaagccacccttccccccagacatcaagcccaacatgtctgccctgcccccacctccagccaaccacaatgatgagctgcggctgaccttccctgtgagagatggagtggtgctggagcccttccggctggagcacaacctggccgtgagcaaccacgtgttccacctgcggcccaccgtgcaccagaccctgatgtggaggagtgacctggagctgcagttcaagtgctaccaccacgaggaccggcagatgaacaccaactggccagcctctgtgcaggtgtctgtgaatgccacccccctgaccatcgagcggggggacaacaagaccagccacaagcccctgcacctgaagcacgtgtgccagcctggaagaaacaccatccagatcaccgtgacagcctgctgctgcagccacctgtttgtgctgcagctggtgcaccggcccagcgtgcgctctgtgctgcagggcctgctgaagaagaggctgctgcctgctgagcactgcatcaccaagatcaagaggaacttcagctctgtggccgccagcagcggcaacaccaccctgaatggagaagatggagtggagcagacagccatcaaggtgtccctgaagtgccccatcaccttccgccgcatccagctgcctgcccggggccatgactgcaagcacgtgcagtgctttgacctggagagctacctgcagctgaactgtgagcggggcacctggcgctgccctgtgtgcaacaagacagccctgctggagggcctggaggtggaccagtacatgtggggcatcctgaatgccatccagcacagcgagtttgaggaggtgaccatcgaccccacctgctcctggaggcctgtgcccatcaagagtgacctgcacatcaaggatgatcctgatggcatccccagcaagcgcttcaagaccatgagccccagccagatgatcatgcccaacgtgatggagatgattgctgccctgggccctggccccagcccctaccccctgcccccacctcctgggggcaccaacagcaatgactacagcagccagggcaacaactaccagggccacggcaactttgacttcccccacggcaaccctgggggcacctccatgaatgacttcatgcacggccccccccagctgagccaccccccagacatgcccaacaacatggccgccctggagaagcccctgagccaccccatgcaggagaccatgcctcatgctggcagcagtgaccagccccaccccagcatccagcagggcctgcacgtgccccaccccagcagccagagcggcccccccctgcaccacagcggggcccctcctcctccacccagccagcccccccggcagcccccccaggccgcccccagcagccacccccacagcgacctgaccttcaaccccagcagcgccctggagggccaggccggggcccagggcgccagtgacatgcctgagcccagcctggacctgctgcctgagctgaccaacccagatgagctgctgagctacctggaccccccagacctgcccagcaacagcaatgatgacctgctgagcctgtttgagaacaactag

SEQ ID NO: 19155 - DNA, 1038 bp, Artificial Sequence
  Description of Artificial Sequence: Synthetic coding sequence
atggatggagaggacatcccagacttcagcagcctgaaggaggagacagcctactggaaggagctgagcctgaagtacaagcagagcttccaggaggccagagatgagctggtggagttccaggagggcagccgggagctggaggccgagctggaggcccagctggtgcaggccgagcagaggaacagagacctgcaggccgacaaccagaggctgaagtatgaggtggaggccctgaaggagaagctggagcaccagtatgcccagagctacaagcaggtgtctgtgctggaggatgacctgagccagacccgggccatcaaggagcagctgcacaagtatgtgcgggagctggagcaggccaatgatgacctggagcgggccaagagggccaccatcgtgtccctggaggactttgagcagaggctgaaccaggccattgaaagaaatgccttcctggagagcgagctggatgagaaggagagcctgctggtgtctgtgcagaggctgaaggatgaggcccgggacctgcggcaggagctggccgtgcgggagcggcagcaggaggtgaccaggaagagcgcccccagcagccccaccctggactgtgagaagatggacagcgctgtgcaggccagcctgagcctgcctgccacccctgtgggcaaaggaacagagaacaccttccccagccccaaggccatccccaatggatttggcaccagccccctgaccccatctgcccgcatcagcgccctgaacatcgtgggggacctgctgaggaaggtgggcgccctggagagcaagctggccgcctgcaggaactttgccaaggaccaggccagcaggaagagctacatctctggaaatgtgaactgtggggtgctgaatggaaatggcaccaagttcagccgcagcggccacaccagcttctttgacaagggagctgtgaatggatttgatcctgcccctcctcctcctggcctgggcagcagccggcccagcagcgcccctggcatgctgcccctgtctgtgtag

SEQ ID NO: 19156 - DNA, 588 bp, Artificial Sequence
  Description of Artificial Sequence: Synthetic coding sequence
atgggcagccgggccagcaccctgctgagagatgaggagctggaggagatcaagaaggagaccggcttcagccacagccagatcacccggctgtacagccgcttcaccagcctggacaagggggagaatggcaccctgagccgggaggacttccagagaattcctgagctggccatcaaccccctgggggaccgcatcatcaatgccttcttcccagaaggagaggaccaggtgaacttccggggcttcatgaggaccctggcccacttccggcccatcgaggacaatgagaagagcaaggatgtgaatggacctgagcccctgaacagccgcagcaacaagctgcactttgccttccggctgtatgacctggacaaggatgagaagatcagcagagatgagctgctgcaggtgctgaggatgatggtgggcgtgaacatcagtgatgagcagctgggcagcattgctgacaggaccatccaggaggccgaccaggatggagacagcgccatctccttcacagaatttgtgaaggtgctggagaaggtggatgtggagcagaagatgagcatccgcttcctgcactag

SEQ ID NO: 19157 - DNA, 780 bp, Artificial Sequence
  Description of Artificial Sequence: Synthetic coding sequence
atggctgatgcctgctgcaccaggacctacgtgattgctgccagcaccatgtctgtgtgcagcagtgatgtgggccacgtgtcccgggtgagcagccccagcacctgcaccggcagctcctggcaggtggacaactgccaggagagctgctgtgagcccaggagctgtgccagcagctgctgcacccccagctgctgtgccccagccccctgcctggccctggtgtgtgcccctgtgtcctgtgagcccagcccctgccagagcggctgcacagacagctgcacccccagctgctgccagcagagcagctgccagcctgcctgctgcaccagcagcccctgccagcaggcctgctgcgtgcctgtgtgctgcaagagcaactgctgcaagcctgtgtgctgcgtgtccatctgcagcggggccagcagcccctgctgccagcagagcagctgccagagcgcctgctgcaccttcagcccctgccagcaggcctgctgcgtgcccatctgctgcaagcccatctgctgcgtgcctgtgtgcagcggggccagcagcctgtgctgccagaagagcagctgccagcctgcctgctgcaccaccagctgctgccggcccagcagctctgtgtccctgctgtgcaggcctgtgtgcaggcctgcctgctgcgtgcctgtgcccagctgctgcgtgcctgccagcagctgccagcccagctgctgccacccagccagctgcctgtccttcctgtgcaggcctgcctgcagccggctggcctgctag

SEQ ID NO: 19158 - DNA, 171 bp, Artificial Sequence
  Description of Artificial Sequence: Synthetic coding sequence
atgatctactacagcaactactacggcggctacggctatggaggcctgggctgcggctacggctgcggctaccggggctacggctgcggctatggaggctacggcggctatggaaatggctactactgccccagctgctacggccgctactggagctatggcttctactag

SEQ ID NO: 19159 - DNA, 897 bp, Artificial Sequence
  Description of Artificial Sequence: Synthetic coding sequence
atggccgccagcaccatgtctgtgtgcagcagcgcctacagcgacagctggcaggtggatgactgcccagagagctgctgtgagcccccctgcagcgcccccagctgctgtgccccagcccccagcctgagcctggtgtgcacccctgtgtcctgtgtgagcagcccctgctgccaggccgcctgtgagcccagcgcctgccagagcggctgcaccagcagctgcacccccagctgctgccagcagagcagctgccagcctgcctgctgcaccagcagcccctgccagcaggcctgctgcgtgcctgtgtgctgcaagacagtgtgctgcaagcctgtgtgctgcgtgcctgtgtgctgcggggccgccagcagctgctgccggcagagcagctgccagcctgcctgctgtgccagcagcagctgccagcctgcctgctgcgtgcctgtgtgctgcaagcctgtgtgctgcgtgtccacctgcagcgaggacagcagcagctgctgccagcagagcagctgccagcctgcctgctgcaccagcagcagctaccagcaggcctgctgcgtgcctgtgtgctgcaagacagtgtactgcaagcccatctgctgcgtgcctgtgtgcagccgggccagcagcagccgctgccagcagcccagctgccagcctgcctgctgcaccaccagctgctgccggcccagcagctctgtgtccctgctgtgccaccctgtgtgccgcagcacctgctgcgtgcctgtgagcagctgctgtgcccccaccagcagctgccagagcagctgctgcaggcctgccagctgtgtgtccctgctgtgcaggcctgccagcagccggctggcctgctacagcctgtgcagcggcaagaagagcagctgctag

SEQ ID NO: 19160 - DNA, 567 bp, Artificial Sequence
  Description of Artificial Sequence: Synthetic coding sequence
atgacagcccccagctgtgccttccctgtgcagttccggcagcccagcgtgtctggcctgagccagatcaccaagagcctgtacatcagcaatggagtggccgccaacaacaagctgatgctgagcagcaaccagatcaccatggtgatcaacgtgtctgtggaggtggtgaacaccctgtatgaggacatccagtacatgcaggtgcctgtggccgacagccccaacagccggctgtgtgacttctttgaccccatcgctgaccacatccacagcgtggagatgaagcagggccgcaccctgctgcactgtgccgccggcgtgagccgctctgctgccctgtgcctggcctacctgatgaagtaccacgccatgagcctgctggatgcccacacctggaccaagagctgccggcccatcatccggcccaacagcggcttctgggagcagctgatccactatgagttccagctgtttgggaagaacacagtgcacatggtgagcagccctgtgggcatgatcccagacatctatgagaaggaggtgcggctgatgatccccctgtag

SEQ ID NO: 19161 - DNA, 147 bp, Artificial Sequence
  Description of Artificial Sequence: Synthetic coding sequence
atgagctttgacaacaactaccacggcggccagggctacgccaagggcggcctgggctgcagctatggctgcggcctgagcggctacggctacgcctgctactgcccctggtgctatgaaagatcctggttcagcggctgcttctag

SEQ ID NO: 19162 - DNA, 192 bp, Artificial Sequence
  Description of Artificial Sequence: Synthetic coding sequence
atgagctacagcggcagctactacggcggcctgggctacggctgcggcggctttggaggcctgggctacggctacagctgtggctgcggcagcttccggcggctgggctacggctgcggctatggaggctaccgctacagctgctgccaccccagctgctacggcggctactggagcagcggcttctactag

SEQ ID NO: 19163 - DNA, 189 bp, Artificial Sequence
  Description of Artificial Sequence: Synthetic coding sequence
atgtgtggcagctactacggcaactactacggggaccacggctacggctgctgcggctatgagggcctgggctacggctacggcagcctgcgctgtggctacagcagctgctgcggctacggccacggctacggcagccgcttcttctgtggctgcggctacggctgcggcagcggctactactactag

SEQ ID NO: 19164 - DNA, 4227 bp, Artificial Sequence
  Description of Artificial Sequence: Synthetic coding sequence
atgtggagcctgacagccagcgagggggagagcaccacagcccacttcttcctgggcgctggagatgagggcctgggcacccggggcatcggcatgaggcctgaggagagtgacagcgagctgctggaggatgaggaggatgaggtgcccccagagccccagatcatcgtgggcatctgtgccatgaccaagaagagcaagagcaagcccatgacccagatcctggagcggctgtgccgctttgactacctgactgtggtgatcctgggagaagatgtgatcctgaatgaacctgtggagaactggcccagctgccactgcctgatctccttccacagcaagggcttccccctggacaaggctgtggcctacagcaagctgaggaaccccttcctgatcaatgacctggccatgcagtactacatccaggacagaagagaggtgtaccgcatcctgcaggaggagggcatcgacctgcccaggtatgctgtgctgaacagagatcctgcccggcctgaggagtgcaacctgattgaaggagaggaccaggtggaggtgaatggagctgtgttccccaagccctttgtggagaagcctgtgtctgctgaggaccacaacgtgtacatctactaccccagcagcgctgggggcggcagccagaggctcttcaggaagattggcagccgcagctctgtgtacagccctgagagctctgtgaggaagacaggcagctacatctatgaggagttcatgcccacagatggaacagatgtgaaggtgtacacagtgggccctgactatgcccacgccgaggccaggaagagccctgccctggatggcaaggtggagcgggacagcgagggcaaggagatccgctaccctgtgatgctgacagccatggagaagctggtggccaggaaggtgtgtgtggccttcaagcagacagtgtgtggctttgacctgctgcgggccaacggccacagctttgtgtgtgatgtgaatggcttctcctttgtgaagaacagcatgaagtactatgatgactgtgccaagatcctgggcaacaccatcatgagggagctggccccccagttccagatcccctggagcatccccacagaagctgaggacatccccatcgtgcccaccaccagcggcaccatgatggagctgcgctgtgtgattgccatcatccgccacggggacaggacccccaagcagaagatgaagatggaggtgaagcacccccgcttctttgccctgtttgagaagcatggaggctacaagacaggcaagctgaagctgaagaggcctgagcagctgcaggaggtgctggacatcacccggctgctgctggccgagctggagaaggagcctggaggagaaattgaggagaagacaggcaagctggagcagctgaagtctgtgctggagatgtatggccacttcagcggcatcaacaggaaggtgcagctgacctactacccccatggagtgaaggccagcaatgaaggccaggacccccagcgggagaccctggcccccagcctgctgctggtgctgaagtggggcggggagctgaccccagctggccgggtgcaggccgaggagctgggccgggccttccgctgcatgtacccaggcggccagggcgactatgccggcttccctggctgcggcctgctgcggctgcacagcaccttcagacatgacctgaagatctatgccagtgatgagggccgggtgcagatgacagctgctgcctttgccaagggcctgctggccctggagggggagctgacccccatcctggtgcagatggtgaagagcgccaacatgaatggcctgctggacagtgatggagacagcctgagcagctgccagcaccgggtgaaggcccggctgcaccacatcctgcagcaggatgccccctttggacctgaggactatgaccagctggcccccaccaggagcaccagcctgctgaacagcatgaccatcatccagaaccctgtgaaggtgtgtgaccaggtgtttgccctgattgagaacctgacccaccagatccgggagaggatgcaggaccccaggtctgtggacctgcagctgtaccacagcgagaccctggagctgatgctgcagcgctggagcaagctggagcgggacttccggcagaagagcggccgctatgacatcagcaagatcccagacatctatgactgtgtgaagtatgatgtgcagcacaacggcagcctgggcctgcagggcacagctgagctgctgcggctgagcaaggccctggctgatgtggtgatcccccaggagtatggcatcagccgggaggagaagctggagattgctgtgggcttctgcctgcccctgctgaggaagatcctgctggacctgcagaggacccatgaagatgagagcgtgaacaagctgcaccccctgtacagcagaggagtgctgagccctggccgccacgtgaggacccggctgtacttcaccagcgagagccacgtgcacagcctgctgagcgtcttccgctatggaggcctgctggatgagacccaggatgcccagtggcagagggccctggactacctgagcgccatcagcgagctgaactacatgacccagatcgtcatcatgctgtatgaggacaacacccaggaccccctgtctgaggagcgcttccacgtggagctgcacttcagccctggggtgaagggcgtggaggaggagggcagcgccccagctggctgcggcttccggcctgccagcagtgaaaatgaggagatgaagaccaaccagggctccatggagaacctgtgccctgggaaggccagtgatgagccagaccgggccctgcagaccagcccccagcccccagagggccctggcctgcccaggaggagccccctcatccggaacaggaaggccggctccatggaggtgctgtctgagaccagcagcagcaggcctgggggctaccgcctcttcagcagcagccggcccccaacagagatgaagcagagcggcctgggcagccagtgcaccggcctcttcagcaccaccgtgctgggcggcagcagcagcgcccccaacctgcaggactatgcccggagccacggcaagaagctgcccccagccagcctgaagcacagagatggctttgagggctgcagcatggtgcccaccatctaccccctggagaccctgcacaatgccctgagcctgcggcaggtgtctgagttcctgagccgggtgtgccagaggcacacagatgcccaggcccaggccagcgctgccctgtttgacagcatgcacagcagccaggccagtgacaaccccttcagcccccccaggaccctgcacagcccccccctgcagctgcagcagaggtctgagaagccaccctggtacagcagcggccccagcagcacagtgagcagcgctggccccagcagccccaccaccgtggatggcaacagccagtttggcttcagtgaccagcccagcctgaacagccacgtggccgaggagcaccagggcctgggcctgctgcaggagaccccaggcagcggggcccaggagctgagcattgaaggagagcaggagctgtttgagcccaaccagagcccccaggtgccccccatggagaccagccagccctatgaggaggtgtcccagccctgccaggaggtgcctgacatcagccagccctgccaggacatcagcgaggccctgagccagccctgccagaaggtgcctgacatcagccagcagtgccaggagaaccacgacaatggaaaccacacctgccaggaggtgccccacatcagccagccctgccagaagagcagccagctgtgccagaaggtgtctgaggaggtgtgccagctgtgcctggagaacagcgaggaggtgtcccagccctgccagggcgtgtctgtggaggtgggcaagctggtgcacaagttccacgtgggcgtgggcagcctggtgcaggagaccctggtggaggtgggcagccctgctgaggagatccctgaggaggtgatccagccctaccaggagttctctgtggaggtgggccgcctggcccaggagaccagcgccatcaacctgctgagccagggcatccctgagattgacaagcccagccaggagttccctgaggagattgacctgcaggcccaggaggtgcctgaggagatcaactag

SEQ ID NO: 19165 - DNA, 705 bp, Artificial Sequence
  Description of Artificial Sequence: Synthetic coding sequence
atggagggcgccagcaggaacctggccagcaccccccgggtgcacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggccatcgccaaggccatggaggagatggtggaggacagcgtggactgctactggatcaccaggagatttgtgaaccagctgaacaccaagtacagagacagcctgccccagctgcccaaggcctttgagcagtacctgaacctggaggatggccgcctgctgacccacctgaggatgtgcagcgctgcccccaagctgccctatgacctgtggttcaagcgctgctttgctggctgcctgcctgagagcagcctgcagagggtgtgggacaaggtggtgtctggcagctgcaagatcctggtgtttgtggccgtggagatcctgctgaccttcaagatcaaggtgatggccctgaacagcgctgagaagatcaccaagttcctggagaacatcccccaggacagcagtgatgccatcgtgtccaaggccatcgacctgtggcacaagcactgcggcacccctgtgcacagcagctag

SEQ ID NO: 19166 - DNA, 537 bp, Artificial Sequence
  Description of Artificial Sequence: Synthetic coding sequence
atgaccaccctgcgggccttcacctgtgatgacctcttccgcttcaacaacatcaacctggaccccctgacagagacctacggcatccccttctacctgcagtacctggcccactggccagagtacttcatcgtggccgaggcccctggaggagagctgatgggctacatcatgggcaaggccgagggctctgtggcccgggaggagtggcacggccacgtgacagccctgtctgtggcccctgagttccggcggctgggcctggccgccaagctgatggagctgctggaggagatcagcgagaggaaaggaggcttctttgtggacctgtttgtgcgggtgagcaaccaggtggccgtgaacatgtacaagcagctgggctacagcgtgtacagaacagtgattgagtactacagcgccagcaatggagagccagatgaagatgcctatgacatgaggaaggccctgagccgggacacagagaagaagagcatcatccccctgccccaccctgtgcggccagaagatattgaatag

SEQ ID NO: 19167 - DNA, 2373 bp, Artificial Sequence; identical to SEQ ID NO: 18522
  Description of Artificial Sequence: Synthetic coding sequence

SEQ ID NO: 19168 - DNA, 3588 bp, Artificial Sequence
  Description of Artificial Sequence: Synthetic coding sequence
atgtggagcctgacagccagcgagggggagagcaccacagcccacttcttcctgggcgctggagatgagggcctgggcacccggggcatcggcatgaggcctgaggagagtgacagcgagctgctggaggatgaggaggatgaggtgcccccagagccccagatcatcgtgggcatctgtgccatgaccaagaagagcaagagcaagcccatgacccagatcctggagcggctgtgccgctttgactacctgactgtggtgatcctgggagaagatgtgatcctgaatgaacctgtggagaactggcccagctgccactgcctgatctccttccacagcaagggcttccccctggacaaggctgtggcctacagcaagctgaggaaccccttcctgatcaatgacctggccatgcagtactacatccagggcgaccggcgggaggtgtaccgcatcctgcaggaggagggcatcgacctgcccaggtatgctgtgctgaacagagatcctgcccggcctgaggagtgcaacctgattgaaggagaggaccaggtggaggtgaatggagctgtgttccccaagccctttgtggagaagcctgtgtctgctgaggaccacaacgtgtacatctactaccccagcagcgctgggggcggcagccagaggctcttcaggaagattggcagccgcagctctgtgtacagccctgagagctctgtgaggaagacaggcagctacatctatgaggagttcatgcccacagatggaacagatgtgaaggtgtacacagtgggccctgactatgcccatgctgaggccaggaagagccctgccctggatggcaaggtggagcgggacagcgagggcaaggagatccgctaccctgtgatgctgacagccatggagaagctggtggccaggaaggtgtgtgtggccttcaagcagacagtgtgtggctttgacctgctgcgggccaacggccacagctttgtgtgtgatgtgaatggcttctcctttgtgaagaacagcatgaagtactatgatgactgtgccaagatcctgggcaacaccatcatgagggagctggccccccagttccagatcccctggagcatccccacagaagctgaggacatccccatcgtgcccaccaccagcggcaccatgatggagctgcgctgcgtcatcgccatcatcagacatggagacaggacccccaagcagaagatgaagatggaggtgaagcacccccgcttctttgccctgtttgagaagcacggcggctacaagacaggcaagctgaagctgaagaggcctgagcagctgcaggaggtgctggacatcacccggctgctgctggccgagctggagaaggagcccggcggggagattgaggagaagacaggcaagctggagcagctgaagtctgtgctggagatgtatggccacttcagcggcatcaacaggaaggtgcagctgacctactacccccacggcgtgaaggccagcaatgaaggccaggacccccagcgggagaccctggcccccagcctgctgctggtgctgaagtggggcggggagctgaccccagctggccgggtgcaggccgaggagctgggccgggccttccgctgcatgtacccaggcggccagggcgactatgccggcttccctggctgcggcctgctgcggctgcacagcaccttcagacatgacctgaagatctatgccagtgatgagggccgggtgcagatgacagctgctgcctttgccaagggcctgctggccctggagggggagctgacccccatcctggtgcagatggtgaagagcgccaacatgaatggcctgctggacagtgatggagacagcctgagcagctgccagcaccgggtgaaggcccggctgcaccacatcctgcagcaggatgcccccttcggcccagaagattatgaccagctggcccccaccaggagcaccagcctgctgaacagcatgaccatcatccagaaccctgtgaaggtgtgtgaccaggtgtttgccctgattgagaacctgacccaccagatccgggagaggatgcaggaccccaggtctgtggacctgcagctgtaccacagcgagaccctggagctgatgctgcagcgctggagcaagctggagcgggacttccggcagaagagcggccgctatgacatcagcaagatcccagacatctatgactgtgtgaagtatgatgtgcagcacaacggcagcctgggcctgcagggcacagctgagctgctgcggctgagcaaggccctggctgatgtggtgatcccccaggagtatggcatcagccgggaggagaagctggagattgctgtgggcttctgcctgcccctgctgaggaagatcctgctggacctgcagaggacccatgaagatgagtacagccggggcgtgctgagccctggaagacatgtgaggacccggctgtacttcaccagcgagagccacgtgcacagcctgctgtctgtgttccgctatggaggcctgctggatgagacccaggatgctgaccgggccctgcagaccagcccccagcccccagagggccctggcctgcccaggaggagccccctcatccggaacaggaaggccggctccatggaggtgctgtctgagaccagcagcagcaggcctgggggctaccgcctcttcagcagcagccggcccccaacagagatgaagcagagcggcctgggcagccagtgcaccggcctcttcagcaccaccgtgctgggcggcagcagcagcgcccccaacctgcaggactatgcccggagccacggcaagaagctgcccccagccagcctgaagcacagagatgagctgctgtttgtgcctgctgtgaagcgcttctctgtgtcctttgccaagcaccccaccaacggctttgagggctgcagcatggtgcccaccatctaccccctggagaccctgcacaatgccctgagcctgcggcaggtgccccccatggagaccagccagccctatgaggaggtgtcccagccctgccaggaggtgcctgacatcagccagccctgccaggacatcagcgaggccctgagccagccctgccagaaggtgcctgacatcagccagcagtgccaggagaaccacgacaatggaaaccacacctgccaggaggtgccccacatcagccagccctgccagaagagcagccagctgtgccagaaggtgtctgaggaggtgtgccagctgtgcctggagaacagcgaggaggtgtcccagccctgccagggcgtgtctgtggaggtgggcaagctggtgcacaagttccacgtgggcgtgggcagcctggtgcaggagaccctggtggaggtgggcagccctgctgaggagatccctgaggaggtgatccagccctaccaggagttctctgtggaggtgggccgcctggcccaggagaccagcgccatcaacctgctgagccagggcatccctgagattgacaagcccagccaggagttccctgaggagattgacctgcaggcccaggaggtgcctgaggagatcaactag

SEQ ID NO: 19169 - DNA, 240 bp, Artificial Sequence
  Description of Artificial Sequence: Synthetic coding sequence
atgtgctgcaactactacggcaacagctgtggctacggcagcggctgcggctgcggctacggcagcggcagcggctgcggctgcggctacggcaccggctacggctgcggctacggctgcggcttcggcagccactacggctgcggctacggcaccggctacggctgcggctacggcagcggcagcggctactgcggctaccggcccttctgcttccgccgctgctacagcagctgctag

SEQ ID NO: 19170 - DNA, 1767 bp, Artificial Sequence
  Description of Artificial Sequence: Synthetic coding sequence
atgaagctggagttcacagagaagaactacaacagctttgtgctgcagaacctgaaccggcagaggaagaggaaggagtactgggacatggccctgtctgtggacaaccacgtgttctttgcccacagaaatgtgctggccgctgtgagccccctggtgcgcagcctcatcagcagcaatgacatgaagacagcagatgagctgttcatcaccatcgacaccagctacctgagccctgtgacagtggaccagctgctggactacttctacagcggcaaggtggtgatcagcgagcagaatgtggaggagctgctgcggggggcccagtacttcaacaccccccggctgcgggtgcactgcaatgacttcctgatcaagagcatctgccgggccaactgcctgcgctacctgttcctggccgagctgtttgagctgaaggaggtgtctgatgtggcctacagcggcatccgggacaacttccactactgggccagccctgagggctccatgcacttcatgcgctgcccccctgtgatcttcggccgcctgctgagagatgagaacctgcacgtgctgaatgaagaccaggccctgagcgccctgatcaactgggtgtacttcaggaaggaggaccgggagaagtacttcaagaagttcttcaactacatcaacctgaatgctgtgagcaacaagaccctggtgtttgccagcaacaagctggtgggcatggagaacaccagcagccacaccaccctgattgaatctgtgctgatggacaggaagcaggagcggccctgcagcctgctggtgtaccagaggaagggggccctgctggacagcgtggtgatcctgggcggccagaaggcccacggccagttcaatgatggagtgtttgcctacatcatccaggagaacctgtggatgaagctgagtgacatgccctacagagctgctgccctgagcgccaccagcgctggccgctacatctacatcagcggcggcaccacagagcagatcagcggcctgaagacagcctggaggtatgacatggatgacaacagctggaccaagctgcctgacctgcccatcggcctggtgttccacaccatggtgacctgtggcggcaccgtgtacagcgtgggcggcagcatcgcccccaggagatatgtgagcaacatctaccgctatgatgagaggaaggaggtgtggtgcctggccggcaagatgagcatccccatggatggaacagctgtgatcaccaagggggacagacacctgtacatcgtgacaggccgctgcctggtgaagggctacatcagccgggtgggcgtggtggactgctttgacaccagcactggagatgtggtgcagtgcatcaccttccccatcgagttcaaccaccggcccctgctgtccttccagcaggacaacatcctgtgtgtgcacagccaccggcagagcgtggagatcaacctgcagaaggtgaaggccagcaagaccaccacctctgtgcctgtgctgcccaacagctgccccctggatgtgtcccatgccatctgcagcatcggggacagcaaggtgtttgtgtgtggcggcgtgaccacagccagtgatgtgcagaccaaggactacaccatcaaccccaatgccttcctgctggaccagaagacaggcaagtggaagaccctggcccctcctcctgaggccctggactgcccagcctgctgcctggccaagctgccctgcaagatcctgcagaggatctag

SEQ ID NO: 19171 - DNA, 2208 bp, Artificial Sequence
  Description of Artificial Sequence: Synthetic coding sequence
atgatccccccccaggaggccagcgccaggagaagagaaattgaggacaagctgaagcaggaggaggagaccctgtccttcatccgggacagcctggagaagagtgaccagctgaccaagaacatggtgtccatcctgagcagctttgagagccggctgatgaagctggagaacagcatcatccctgtgcacaagcagacagagaacctgcagaggctgcaggagaatgtggagaagaccctgagctgcctggaccacgtgatctcctactaccacgtggccagtgacacagagaagatcatccgggagggccccaccggccgcctggaggagtacctgggctccatggccaagatccagaaggctgtggagtacttccaggacaacagcccagacagccctgagctgaacaaggtgaagctgctgtttgagcggggcaaggaggccctggagagcgagttccgcagcctgatgaccaggcacagcaaggtggtgtcccctgtgctgatcctggacctgatctctggagatgatgacctggaggcccaggaggatgtgaccctggagcacctgcctgagagcgtgctgcaggacgtcatccgcatcagccgctggctggtggagtatggaagaaaccaggacttcatgaatgtgtactaccagatccgcagcagccagctggacaggagcatcaagggcctgaaggagcacttccacaagagcagcagcagcagtggagtgccctacagccctgccatccccaacaagaggaaggacacccccaccaagaagcctgtgaagaggcctggcaccatcaggaaggcccagaacctgctgaagcagtacagccagcacggcctggatggcaagaagggcggcagcaacctgatccccctggagggcctgctgccctgcaccccccggggcggcctgcccggcccctggatcaatgctgcctgtgtgtgtgccgctgacatcagccctggccacgagcatgacttccgggtgaagcacctgtctgaggccctgaatgacaagcacggccccctggccggcagagatgacatgctggatgtggagacagatgcctacatccactgtgtgtctgcctttgtgaagctggcccagagcgagtaccagctgctggccgacatcatccctgagcaccaccagaagaagacctttgacagcctcatccaggatgccctggatggcctgatgctggagggagaaaatattgtgtctgctgccaggaaggccatcgtgagacatgacttcagcacagtgctgactgtgttccccatcctgcggcacctgaagcagaccaagccagagtttgaccaggtgctgcagggcacagctgccagcaccaagaacaagctgcccggcctcatcacctccatggagaccatcggggccaaggccctggaggactttgctgacaacatcaagaatgaccctgacaaggagtacaacatgcccaaggatggcaccgtgcatgagctgaccagcaatgccatcctcttcctgcagcagctgctggacttccaggagacagctggggccatgctggccagccaggagaccagcagcagcgccaccagctacagcagcgagttcagcaagaggctgctgagcacctacatctgcaaggtgctgggcaacctgcagctgaacctgctgagcaagagcaaggtgtatgaggaccctgccctgagcgccatcttcctgcacaacaactacaactacatcctgaagagcctggagaagtctgagctgatccagctggtggccgtgacccagaagacagctgagaggagctaccgggagcacatcgagcagcagatccagacctaccagaggtcctggctgaaggtgacagactacatcgccgagaagaacctgcccgtcttccagcccggggtgaagctgcgggacaaggagcggcagatcatcaaggagcgcttcaagggcttcaatgatggcctggaggagctgtgcaagatccagaaggcctgggccatcccagacacagagcagagggaccgcatccggcaggcccagaagaccatcgtgaaggagacctacggggccttcctgcagaagtttggatctgtgcccttcaccaagaaccctgagaagtacatcaagtatggagtggagcaggtgggggacatgattgaccggctgtttgacaccagcgcctag

SEQ ID NO: 19172 - DNA, 378 bp, Artificial Sequence
  Description of Artificial Sequence: Synthetic coding sequence
atggccggggccggccccaccatgctgctgcgggaggagaatggctgctgcagccggcggcagagcagcagcagcgctggggacagtgatggagagcgggaggacagcgctgctgagcgggcccggcagcagctggaggccctgctgaacaagaccatgaggatccgcatgacagatggccgcaccctggtgggctgcttcctgtgcacagaccgggactgcaacgtcatcctgggcagcgcccaggagttcctgaagcccagcgacagcttctctgctggggagccccgggtgctgggcctggccatggtgcccggccaccacatcgtgtccattgaggtgcagcgggagagcctgaccggccccccctacctgtag

SEQ ID NO: 19173 - DNA, 477 bp, Artificial Sequence
  Description of Artificial Sequence: Synthetic coding sequence
atgctgctgctggactgcaaccctgaggtggatggcctgaagcacctgctggagactggagcctctgtgaatgcccccccagacccctgcaagcagagccctgtgcacctggccgccggcagcggcctggcctgcttcctgctgtggcagctgcagacaggagctgacctgaaccagcaggatgtgctgggggaggcccccctgcacaaggccgccaaggtgggcagcctggagtgcctgagcctgctggtggccagtgatgcccagattgacctgtgcaacaagaatggccagacagctgaggacctggcctggagctgtggcttcccagactgtgccaagttcctgaccaccatcaagtgcatgcagaccatcaaggccagcgagcacccagacagaaatgactgtgtggccgtgctgcggcagaagaggagcctgggctctgtggagaacaccagcggcaagaggaaatgttag

SEQ ID NO: 19174 - DNA, 8712 bp, Artificial Sequence
  Description of Artificial Sequence: Synthetic coding sequence
atgaggggccggcggggccggccccccaagcagcctgctgccccagctgctgagcgctgtgccccagcccctcctcctcctcctcctccacccaccagcggccccatcggcggcctgcggagccgccaccggggcagcagccggggccgctgggccgccgcccaggccgaggtggcccccaagacccggctgagcagcccccggggcggcagcagcagcaggaggaagcccccacctcctcctccagccccacccagcaccagcgcccctggccggggcggccggggcggcggcggcggccgcactggaggcggcggcggcggcggccacctggcccggaccacagctgcccggcgggctgtgaacaaggtggtgtatgatgaccatgaaagtgaggaggaggaggaggaggaggacatggtgtctgaggaggaggaggaggaggatggagatgctgaggagacccaggacagtgaagatgatgaagaagatgagatggaggaggatgatgatgacagcgactacccagaggagatggaggatgatgatgatgatgccagctactgcacagagagcagcttccgcagccacagcacctacagcagcaccccaggccgcaggaagccccgggtgcaccggcccaggagccccatcctggaggagaaggacatcccccccctggagttccccaagagcagcgaggacctgatggtgcccaatgagcacatcatgaatgtgattgccatctatgaggtgctgaggaactttggcaccgtgctgcggctgagccccttccgctttgaggacttctgtgccgccctggtgtcccaggagcagtgcaccctgatggccgagatgcacgtggtgctgctgaaggctgtgctgcgggaggaggacaccagcaacaccacctttggacctgctgacctgaaggacagcgtgaacagcaccctgtacttcattgatggcatgacctggccagaggtgctgcgggtgtactgtgagagtgacaaggagtaccaccacgtgctgccctaccaggaggccgaggactacccctacggccctgtggagaacaagatcaaggtgctgcagttcctggtggaccagttcctgaccaccaacatcgcccgggaggagctgatgtctgaaggagtcatccagtatgatgaccactgccgggtgtgccacaagctgggggacctgctgtgctgtgagacctgcagcgctgtgtaccacctggagtgtgtgaagccacccctggaggaggtgcctgaagatgagtggcagtgtgaggtgtgtgtggcccacaaggtgcctggggtgacagactgtgtggccgagatccagaagaacaagccctacatcagacatgagcccatcggctatgacaggagcaggaggaagtactggttcctgaacagaagactcatcatcgaggaggacacagaaaatgaaaatgagaagaagatctggtactacagcaccaaggtgcagctggccgagctgattgactgcctggacaaggactactgggaggccgagctgtgcaagatcctggaggagatgagggaggagatccaccgccacatggacatcacagaggacctgaccaacaaggcccggggcagcaacaagagcttcctggccgccgccaatgaggagatcctggagagcatccgggccaagaagggggacatcgacaacgtgaagagccctgaggagacagagaaggacaagaatgaaacagaaaatgacagcaaggatgctgagaagaaccgggaggagtttgaggaccagagcctggagaaggacagtgatgacaagaccccagatgatgatcctgagcagggcaagtctgaggagcccacagaggtgggggacaagggcaacagcgtgtctgccaacctgggggacaacaccaccaatgccaccagcgaggagaccagccccagcgagggccgcagccctgtgggctgcctgtctgagaccccagacagcagcaacatggccgagaagaaggtggccagcgagctgccccaggatgtgcctgaggagcccaacaagacctgtgagagcagcaacaccagcgccaccaccaccagcatccagcccaacctggagaacagcaacagcagcagcgagctgaacagcagccagagcgagagcgccaaggctgctgatgatcctgaaaatggagagcgggagagccacacccctgtgtccatccaggaggagatcgtgggggacttcaagtctgagaagagcaatggagagctgtctgagagccctggggccggcaagggggccagcggcagcacccgcatcatcacccggctgagaaatccagacagcaagctgagccagctgaagagccagcaggtggccgccgccgcccacgaggccaacaagctgttcaaggagggcaaggaggtgctggtggtgaacagccagggcgagatcagccggctgagcaccaagaaggaggtgatcatgaagggcaacatcaacaactacttcaagctgggccaggagggcaagtacagagtgtaccacaaccagtacagcaccaacagctttgccctgaacaagcaccagcacagagaagatcatgacaagaggaggcacctggcccacaagttctgcctgaccccagctggggagttcaagtggaatggatctgtgcacggcagcaaggtgctgaccatcagcaccctgcggctgaccatcacccagctggagaacaacatccccagcagcttcctgcaccccaactgggccagccaccgggccaactggatcaaggctgtgcagatgtgcagcaagccccgggagtttgccctggccctggccatcctggagtgtgctgtgaagcctgtggtgatgctgcccatctggagggagagcctgggccacacccggctgcacaggatgaccagcattgagcgggaggagaaggagaaggtgaagaagaaggagaagaagcaggaggaggaggagaccatgcagcaggccacctgggtgaagtacaccttccctgtgaagcaccaggtgtggaagcagaagggggaggagtacagagtgacaggctatggaggctggagctggatcagcaagacccacgtgtacagatttgtgcccaagctgcccggcaacaccaacgtgaactacaggaagagcctggagggcaccaagaacaacatggatgagaacatggatgaaagtgacaagaggaagtgcagccgcagccccaagaagatcaagattgaaccagattctgagaaggatgaggtgaagggcagtgatgctgccaagggagctgaccagaatgagatggacatcagcaagatcacagagaagaaggaccaggatgtgaaggagctgctggacagcgacagcgacaagccctgcaaggaggagcccatggaggtggatgatgacatgaagacagagagccacgtgaactgccaggagagcagccaggtggatgtggtgaatgtgtctgagggcttccacctgcggaccagctacaagaagaagaccaagagcagcaagctggatggcctgctggagcggcgcatcaagcagttcaccctggaggagaagcagaggctggagaagatcaagctggagggcggcatcaagggcatcggcaagaccagcaccaacagcagcaagaacctgtctgagagccctgtgatcaccaaggccaaggagggctgccagagcgacagcatgaggcaggagcagagccccaatgccaacaatgaccagcctgaggacctgatccagggctgcagcgagagtgacagctctgtgctgaggatgtctgaccccagccacaccaccaacaagctgtaccccaaggacagagtgctggatgatgtgtccatccgcagccctgagaccaagtgccccaagcagaacagcattgaaaatgacatcgaggagaaggtgtctgacctggccagccggggccaggagcccagcaagagcaagaccaagggaaatgacttcttcattgatgacagcaagctggccagcgcagatgacatcggcaccctcatctgcaagaacaagaagcccctcatccaggaggagagtgacaccatcgtgagcagcagcaagagcgccctgcacagctctgtgcccaagagcaccaatgacagagatgccacccccctgagccgggccatggactttgagggcaagctgggctgtgacagcgagagcaacagcaccctggagaacagcagtgacacagtgtccatccaggacagcagcgaggaggacatgattgtgcagaacagcaatgaaagcatcagcgagcagttccgcacccgggagcaggatgtggaggtgctggagcccctgaagtgtgagctggtgtctggagagagcacaggcaactgtgaggaccggctgcctgtgaagggcacagaggccaacgggaagaagcccagccagcagaagaagctggaggagaggcctgtgaacaagtgcagcgaccagatcaagctgaagaacaccacagacaagaagaacaatgaaaatcgggagagcgagaagaagggccagaggaccagcaccttccagatcaacgggaaggacaacaagcccaagatctacctgaagggagaatgtctgaaggagatcagcgagagccgggtggtgtctggaaatgtggagcccaaggtgaacaacatcaacaagatcatcccagaaaatgacatcaagagcctgactgtgaaggagagcgccatccggcccttcatcaatggagatgtgatcatggaggacttcaatgaaagaaacagcagcgagaccaagagccacctgctgagcagcagtgatgctgagggcaactacagagacagcctggagaccctgcccagcaccaaggagagtgacagcacccagaccaccaccccatctgccagctgcccagagagcaacagcgtgaaccaggtggaggacatggagattgagaccagcgaggtgaagaaggtgaccagcagccccatcaccagcgaggaggagagcaacctgagcaatgacttcattgatgaaaatggcctgcccatcaacaagaatgaaaatgtgaatggagagagcaagaggaagacagtcatcacagaggtgaccaccatgaccagcacagtggccacagagagcaagacagtcatcaaggtggagaagggggacaagcagacagtggtgagcagcacagagaactgtgccaagagcacagtgaccaccaccaccaccaccgtgaccaagctgagcacccccagcactggaggctctgtggacatcatctctgtgaaggagcagagcaagacagtggtgaccaccaccgtgacagacagcctgaccaccaccggcggcaccctggtgacctccatgacagtgtccaaggagtacagcacccgggacaaggtgaagctgatgaagttcagccggcccaagaagaccaggtctggaacagccctgcccagctacaggaagtttgtgaccaagagcagcaagaagagcatctttgtgctgcccaatgatgacctgaagaagctggccaggaagggcggcatccgggaggtgccctacttcaactacaatgccaagccagccctggacatctggccctaccccagcccccggcccaccttcggcatcacctggagataccgcctgcagacagtgaagagcctggccggcgtgtccctgatgctgcggctgctgtgggccagcctgcgctgggatgacatggccgccaaggcccctcctgggggcggcaccaccaggacagagaccagcgagacagagatcaccaccacagagatcatcaagagaagagatgtgggcccctacggcatccgctctgagtactgcatcaggaagatcatctgccccatcggcgtgcctgagacccccaaggagacccccaccccccagaggaagggcctgcggagcagcgccctgcggcccaagaggcctgagacccccaagcagacaggccctgtgatcatcgagacctgggtggccgaggaggagctggagctgtgggagatccgggcctttgctgagcgggtggagaaggagaaggcccaggccgtggagcagcaggccaagaagaggctggagcagcagaagcccaccgtcatcgccaccagcaccaccagccccaccagcagcaccaccagcaccatcagccctgcccagaaggtgatggtggcccccatcagcggctctgtgaccaccggcaccaagatggtgctgaccaccaaggtgggcagccctgccaccgtgaccttccagcagaacaagaacttccaccagacctttgccacctgggtgaagcagggccagagcaacagcggcgtggtgcaggtgcagcagaaggtgctgggcatcatccccagcagcacaggcaccagccagcagaccttcaccagcttccagcccaggacagccaccgtgaccatccggcccaacaccagcggcagcggcggcaccaccagcaacagccaggtgatcaccggcccccagatccggcccggcatgaccgtcatccgcacccccctgcagcagagcaccctgggcaaggccatcatccgcacccctgtgatggtgcagcccggggccccccagcaggtgatgacccagatcatccggggccagcctgtgtccacagctgtgtctgcccccaacacagtgagcagcaccccaggccagaagagcctgaccagcgccaccagcaccagcaacatccagagcagcgccagccagcccccccggccccagcagggccaggtgaagctgaccatggcccagctgacccagctgacccagggccatggaggcaaccagggcctgactgtggtgatccagggccagggccagaccaccggccagctgcagctgatcccccagggcgtgacagtgctgcccggccctggccagcagctgatgcaggccgccatgcccaatggaacagtgcagcgcttcctgttcacccccctggccaccacagccaccacagccagcaccaccaccaccaccgtgtccaccacagctgctggcactggagagcagaggcagagcaagctgagcccccagatgcaggtgcaccaggacaagaccctgcccccagcccagagcagctctgtgggccctgctgaggcccagccccagacagcccagcccagcgcccagccccagccccagacccagccccagagccctgcccagcctgaggtgcagacccagcctgaggtgcagacccagaccaccgtgagcagccacgtgcccagcgaggcccagcccacccacgcccagagcagcaagccccaggtggccgcccagagccagccccagagcaatgtgcagggccagagccctgtgcgggtgcagagccccagccagacccgcatccggcccagcacccccagccagctgagccctggccagcagagccaggtgcagaccaccaccagccagcccatccccatccagccccacaccagcctgcagatccccagccagggccagccccagagccagccccaggtggtgatgaagcacaatgctgtgattgagcacctgaagcagaagaagtccatgaccccagctgagcgggaggagaaccagaggatgattgtgtgcaaccaggtgatgaagtacatcctggacaagattgacaaggaggagaagcaggccgccaagaagaggaagcgggaggagagcgtggagcagaagaggagcaagcagaatgccaccaagctgagcgccctgctcttcaagcacaaggagcagctgcgggcagagatcctgaagaagagggccctgctggacaaggacctgcagatcgaggtgcaggaggagctgaagagggacctgaagatcaagaaggagaaggacctgatgcagctggcccaggccacagctgtggccgccccctgcccccctgtgaccccagcccccccagcccccccagcccccccacccagccccccacctcctcctgctgtgcagcacacaggcctgctgagcacccccaccctgcctgctgccagccagaagaggaagcgggaggaggagaaggacagcagcagcaagagcaagaagaagaagatgatcagcaccaccagcaaggagaccaagaaggacaccaagctgtactgcatctgcaagaccccctatgatgagagcaagttctacatcggctgtgaccgctgccagaactggtaccacggccgctgtgtgggcatcctgcagagcgaggccgagctgattgatgaatatgtgtgcccccagtgccagagcacagaagatgccatgacagtgctgacccccctgacagagaaggactatgagggcctgaagagggtgctgcggagcctgcaggcccacaagatggcctggcccttcctggagcctgtggaccccaatgatgccccagactactacggcgtcatcaaggagcccatggacctggccaccatggaggagcgggtgcagaggcgctactatgagaagctgacagaatttgtggccgacatgaccaagatctttgacaactgccgctactacaaccccagcgacagccccttctaccagtgtgccgaggtgctggagagcttctttgtgcagaagctgaagggcttcaaggccagccgcagccacaacaacaagctgcagagcacagccagctag

SEQ ID NO: 19175 - DNA, 2628 bp, Artificial Sequence
  Description of Artificial Sequence: Synthetic coding sequence
atgaacttccaggccggcggcggccagagcccccagcagcagcagcagctggccggcggccccccccagcagtttgccctgagcaacagcgctgccatccgggcagagatccagagatttgagagcgtgcaccccaacatctatgccatctatgacctgattgaaagaattgaggacctggccctgcagaaccagatccgggagcacgtgatcagcattgaggacagctttgtgaacagccaggagtggaccctgagccgctctgtgcctgagctgaaggtgggcatcgtgggcaacctgagcagcggcaagagcgccctggtgcaccgctacctgaccggcacctacgtgcaggaggagagccctgagggcggccgcttcaagaaggagatcgtggtggatggccagagctacctgctgctgatcagagatgagggcggccccccagagctgcagtttgctgcctgggtggatgctgtggtgtttgtgttcagcctggaggatgagatctccttccagacagtgtacaactacttcctgcggctgtgcagcttcagaaatgccagcgaggtgcccatggtgctggtgggcacccaggatgccatctctgctgccaacccccgggtgattgatgacagccgggccaggaagctgagcacagacctgaagcgctgcacctactatgagacctgtgccacctacggcctgaatgtggagagggtcttccaggatgtggcccagaaggtggtggccctgaggaagaagcagcagctggccatcggcccctgcaagagcctgcccaacagccccagccacagcgctgtgtctgctgccagcatcccagctgtgcacatcaaccaggccaccaacggcggcggcagcgccttcagtgactacagcagctctgtgcccagcacccccagcatcagccagcgggagctgcgcatcgagaccatcgccgccagcagcacccccacccccatcaggaagcagagcaagaggaggagcaacatcttcaccagcaggaaaggagctgacctggaccgggagaagaaggctgctgagtgcaaggtggacagcatcggcagcggccgggccatccccatcaagcagggcatcctgctgaagaggtctgggaagagcctgaacaaggagtggaagaagaagtatgtgaccctgtgtgacaatggcctgctgacctaccaccccagcctgcatgactacatgcagaacatccacggcaaggagattgacctgctgcggaccaccgtgaaggtgcctgggaagaggctgccccgggccaccccagccacagcccctggcaccagcccccgggccaacggcctgtctgtggagaggagcaacacccagctgggcggcggcaccggggccccccacagcgccagcagcgccagcctgcacagcgagcggcccctgagcagcagcgcctgggccggccccaggcctgagggcctgcaccagaggagctgcagcgtgtcctctgctgaccagtggagcgaggccaccaccagcctgcccccaggcatgcagcacccagccagcggccctgctgaggtgctgagcagcagccccaagctggaccccccacccagcccccacagcaacaggaagaagcacaggaggaagaagagcacaggcacccccaggccagatggccccagcagcgccacagaggaggccgaggagagctttgaatttgtggtggtgtccctgaccggccagacctggcactttgaggccagcacagctgaggagcgggagctgtgggtgcagagcgtgcaggcccagatcctggccagcctgcagggctgccgcagcgccaaggacaagacccggctgggcaaccagaatgctgccctggccgtgcaggccgtgaggacagtgcggggcaacagcttctgcatcgactgtgatgcccccaacccagactgggccagcctgaacctgggcgccctgatgtgcattgaatgttctggcatccaccgccacctgggcgcccacctgagccgggtgcgcagcctggacctggatgactggcccccagagctgctggccgtgatgacagccatgggaaatgccctggccaacagcgtgtgggagggcgccctgggcggctacagcaagccaggcccagatgcctgccgggaggagaaggagcgctggatccgggccaagtatgagcagaagctgttcctggcccccctgcccagcagtgatgtgcccctgggccagcagctgctgcgggctgtggtggaggatgacctgcggctgctggtgatgctgctggcccacggcagcaaggaggaggtgaatgagacctatggagatggagatggccgcacagccctgcacctgagcagcgccatggccaacgtggtgttcacccagctgctgatctggtacggcgtggatgtgcgcagcagagatgcccggggcctgacccccctggcctatgccaggagagctggcagccaggagtgtgccgacatcctgatccagcacggctgccctggagagggctgcggcctggcccccacccccaaccgggagcccgccaacggcaccaaccccagcgctgagctgcacaggagccccagcctgctgtag

SEQ ID NO: 19176 - DNA, 1761 bp, Artificial Sequence
  Description of Artificial Sequence: Synthetic coding sequence
atgggcggggccctgggcctgcggcagctgcccatctgtgccccagcctgccggcccagcagcggccacagcccctgggccgccgccagccccaaccccaaccagtggagcagccgcagccgctggtgctgcctgcggcgctctgaggcccggcgcagctgcaggcctgtgggccgggccgcccctggccccacccgggccatggcccggcctgccaccagcacccggcgcagcgcctgcccccccctgacccccaccccagccctgagaattgcctggaggctgctgagcgccaccagcaggaccagcaggatggcctctgtgctgagccggggccgggtgcgctgcccctggcatggagcctgcttcaacatcagcactggagacctggaggacttccctggcctggacagcctgcacaagttccaggtgaagattgagaaggagaaggtgtatgtgcgggccagcaagcaggccctgcagctgcagaggaggaccaaggtgatggccaagtgcatcagccccagcgctggctacagcagcagcaccaacgtgctgattgtgggcgctggagctgctggcctggtgtgtgccgagaccctgcggcaggagggcttcagtgaccgcatcgtgctgtgcaccctggacagacacctgccctatgaccggcccaagctgagcaagagcctggacacccagcctgagcagctggccctgcggcccaaggagttcttccgggcctacggcatcgaggtgctgacagaggcccaggtggtgacagtggatgtgaggaccaagaaggtggtgttcaaggatggcttcaagctggagtacagcaagctgctgctggcccctggcagcagccccaagaccctgagctgcaagggcaaggaggtggagaatgtgttcaccatccgcaccccagaagatgccaacagagtggtgcggctggcccggggcagaaatgtggtggtggtgggcgccggcttcctgggcatggaggtggccgcctacctgacagagaaggcccacagcgtgtctgtggtggagctggaggagacccccttccgccgcttcctgggggagcgggtgggccgggccctgatgaagatgtttgagaacaacagagtgaagttctacatgcagacagaggtgtctgagctgcggggccaggagggcaagctgaaggaggtggtgctgaagagcagcaaggtggtgcgggcagatgtgtgtgtggtgggcattggagctgtgcctgccaccggcttcctgcggcagagcggcatcggcctggacagccggggcttcatccctgtgaacaagatgatgcagaccaacgtgcctggggtgtttgctgctggagatgctgtgaccttccccctggcctggaggaacaacaggaaggtgaacatcccccactggcagatggcccacgcccagggccgggtggccgcccagaacatgctggcccaggaggccgagatgagcacagtgccctacctgtggacagccatgtttgggaagagcctgcgctatgccggctatggagagggctttgatgatgtgatcatccagggcgacctggaggagctgaagtttgtggccttctacaccaagggagatgaggtgattgctgtggcctccatgaactatgaccccatcgtgtccaaggtggccgaggtgctggccagcggccgggccatcaggaagcgggaggtggagactggagacatgtcctggctgaccgggaagggcagctag

SEQ ID NO: 19177 - DNA, 1521 bp, Artificial Sequence
  Description of Artificial Sequence: Synthetic coding sequence
atgcctgtgcaggccgcccagtggacagagttcctgagctgccccatctgctacaatgaatttgatgaaaatgtgcacaagcccatcagcctgggctgcagccacacagtgtgcaagacctgcctgaacaagctgcacaggaaggcctgcccctttgaccagacagccatcaacacagacattgatgtgctgcctgtgaactttgccctgctgcagctggtgggcgcccaggtgcctgaccaccagagcatcaagctgagcaacctgggggagaacaagcactatgaggtggccaagaagtgtgtggaggacctggccctgtacctgaagcccctgagcggcggcaagggcgtggccagcctgaaccagagcgccctgagccggcccatgcagaggaagctggtgaccctggtgaactgccagctggtggaggaggagggccgggtgcgggccatgagagctgcccggagcctgggggagaggacagtgacagagctgatcctgcagcaccagaacccccagcagctgagcgccaacctgtgggccgctgtgcgggcccggggctgccagttcctgggccctgccatgcaggaggaggccctgaagctggtgctgctggccctggaggatggcagcgccctgagcaggaaggtgctggtgctgtttgtggtgcagaggctggagccccgcttcccccaggccagcaagaccagcattggacatgtggtgcagctgctgtaccgggccagctgcttcaaggtgaccaagagagatgaggacagcagcctgatgcagctgaaggaggagttccgctcctatgaggccctgcggcgggagcatgatgcccagatcgtgcacatcgccatggaggccggcctgcgcatcagccctgagcagtggagcagcctgctgtatggagacctggcccacaagagccacatgcagagcatcatcgacaagctgcagagccctgagagctttgccaagtctgtgcaggagctgaccatcgtgctgcagaggactggagaccctgccaacctgaaccggctgcggccccacctggagctgctggccaacatcgaccccaacccagatgctgtgagccccacctgggagcagctggagaatgccatggtggccgtgaagacagtggtgcacggcctggtggacttcatccagaactacagcaggaagggccacgagaccccccagccccagcccaacagcaagtacaagacctccatgtgccgggacctgcggcagcagggcggctgcccccggggcaccaactgcacctttgcccacagccaggaggagctggagaagtgcaacccccggggcctgtacctgcactgctgcctgctgagctctgtggccagcctgggcaccgtgcacaatgagctgtacaagcagcagcactgtgaccgggagaagatctctgtgtgtgctgtgaagagagctgagacctgcttcagcagccagttcttcagccccctggaggtgccccgggaggaggactag

SEQ ID NO: 19178 - DNA, 783 bp, Artificial Sequence
  Description of Artificial Sequence: Synthetic coding sequence
atgccccgggcccggagcggccgccgcagcagaggagctgggggccgggaggagaccttcctgcgggtgcgggccaaccggcagacccggctgaatgccagaattggcaagatgaagaggaggaagcaggatgagggccaggtgtgccccctgtgcaaccggcccctggccggcagcgagcaggagatgagccgccacgtggagcactgcctgagcaagcgggagggcagctgcatggctgaagatgatgctgtggacattgaacatgagaacaacaacagatttgaggagtatgagtggtgtggccagaagaggatccgggccaccaccctgctggagggcggcttccggggcagcggcttcatcatgtgcagcggcaaggagaacccagacagtgatgctgacctggatgtggatggagatgacaccctggagtatggcaagccccagtacacagaagcagatgtgatcccctgcaccggggaggagcccggggaggccaaggagcgggaggccctgcggggagctgtgctgaatggaggcccccccagcacccgcatcaccccagagttcagcaagtgggccagtgatgagatgcccagcaccagcaatggagagagcagcaagcaggaggccatgcagaagacctgcaagaacagcgacatcgagaagatcacagaagattctgctgtgaccacctttgaggccctgaaggcccgggtgcgggagctggagcggcagctgagcagaggagaccgctacaagtgcctgatctgcatgtag

SEQ ID NO: 19179 - DNA, 1461 bp, Artificial Sequence
  Description of Artificial Sequence: Synthetic coding sequence
atggctgctgtgaagaccctgaaccccaaggccgaggtggcccgggcccaggccgccctggccgtgaacatctctgctgcccggggcctgcaggatgtgctgcggaccaacctgggccccaagggcaccatgaagatgctggtgtctggagctggggacatcaagctgaccaaggatggaaatgtgctgctgcacgagatgggcctgcacccccgcatcatcacagagggctttgaggccgccaaggagaaggccctgcagttcctggaggaggtgaaggtgtcccgggagatggaccgggagaccctgattgatgtggcccggaccagcctgcggaccaaggtgcatgctgagctggctgatgtgctgacagaggccgtggtggacagcatcctggccatcaagaagcaggatgagcccatcgacctcttcatgattgagatcatggagatgaagcacaagtcagaaacagacaccagcctcatccggggcctggtgctggaccatggagcccggcacccagacatgaagaagagggtggaggatgcctacatcctgacctgcaatgtgtccctggagtatgagaagacagaggtgaacagcggcttcttctacaagtctgctgaggagcgggagaagctggtgaaggccgagaggaagttcattgaagatagagtgaagaagatcatcgagctgaagaggaaggtgtgtggggacagcgacaagggctttgtggtgatcaaccagaagggcatcgaccccttcagcctggatgccctgagcaaggagggcatcgtggccctgcggcgggccaagagaagaaacatggagcggctgaccctggcctgtggcggcgtggccctgaacagctttgatgacctgagcccagactgcctgggccacgccggcctggtgtatgagtacaccctgggggaggagaagttcaccttcatcgagaagtgcaacaaccccaggtctgtgaccctgctgatcaagggccccaacaagcacaccctgacccagatcaaggatgctgtgagagatggcctgcgggctgtgaagaatgccattgatgatggctgtgtggtgcctggggccggggctgtggaggtggccatggccgaggccctgatcaagcacaagcccagcgtgaagggccgggcccagctgggcgtgcaggcctttgctgatgccctgctgatcatccccaaggtgctggcccagaacagcggctttgacctgcaggagaccctggtgaagatccaggccgagcacagcgagagcggccagctggtgggcgtggacctgaacacaggagagcccatggtggccgctgaggtgggcgtgtgggacaactactgtgtgaagaagcagctgctgcacagctgcaccgtcatcgccaccaacatcctgctggtggatgagatcatgagagctggcatgagcagcctgaagggctag

SEQ ID NO: 19180 - DNA, 1407 bp, Artificial Sequence
  Description of Artificial Sequence: Synthetic coding sequence
atgtccttccggctgagcggcggcagccgccgcatctgcagcaggacaggcagcggccgcctgagcggcggcggcaccggctttgtggccggaaatgtgtgtgtgggcagcggggcccggagcagcttcagctgcaccctggagggcatcagcagcggcggcagcttctgcaacagcggcggcggcctgggcagcggggcctgtgccggcttcctgggcaatgagcacagcctgctgtctggaaatgagaaggtgaccatgcagaacctgaatgaccggctggccagctacctggaccacgtgcacgccctggaggaggccaatgctgacctggagcagaagatcaagggctggtatgaaaaatgtgagcccggcagcagccgggagcatgaccatgactacagccgctacttctctgtgattgaggacctgaagaggcagatcatcagcgccaccatctgcaatgccagcatcgtgctgcagaatgacaatgcccggctgacagcagatgacttccggctgaagtatgaaaatgagctggccctgcaccacagcgtggaggccgacaccagcggcctgcggcgggtgctggatgagctgaccctgtgcaccacagacctggagatccagtgtgagaccctgtctgaggagctgacctacctgaagaagagccatgaggaggagatggaggtgctgcagtacacagctggaggaaatgtgaatgtggagatgaatgccaccccaggagtggacctgactgtgctgctgaacaacatgagagcagaatatgaggacctggccgagcagaacaggaaggatgctgaggcctggttcaatgaaagaagtgccaccctgcagcagcagatcagtgaccacgagggcgccgccacagctgccagaaatgagctgacagagctgaagaggaacctgcagaccctggagattgagctgcagagcctgatggctgtgaagcacagctatgagtgcagcctggccgagacagagggcaactactgcaaccagctgcagcagatccaggaccagattggagtgatggaggagcagctgcagcagatcagaacagaaacagagggccagaagctggagtatgagcagctgctggatgtgaagatcttcctggagaaggagattgacatctactgcaacctgctggatggagaggagaggaagagcaagagcacctgctacaagagcaagggctacagacctgtgaacagcggcaaccaggccaaggacagcacagaggagaccatcgtgaagacagtggtggaggagctggaccagatcggcaacctgctgagcctgcgggtgcacagcgtggaggagaagagcagcaagatcagcaacatcaccgtggagcagagggtgcccagcaaggccccctag

SEQ ID NO: 19181 - DNA, 816 bp, Artificial Sequence; identical to SEQ ID NO: 19117
  Description of Artificial Sequence: Synthetic coding sequence

SEQ ID NO: 19182 - DNA, 753 bp, Artificial Sequence
  Description of Artificial Sequence: Synthetic coding sequence
atgtctgaaaatgctgccccagacttctactacgtggccatggactttggaggccacggcctgagcagccactacagccctggggtgccctactacctgcagacctttgtgtctgagatcagaagagtggtggccggcggcgtggtgggcggcatgttcttctgcaccttccctgagatggtggacaagctgatcctgctggacacccccctcttcctgctggagagtgatgagatggagaacctgctgacctacaagagaagagccatcgagcacgtgctgcaggtggaggccagccaggagcccagccacgtgttcagcctgaagcagctgctgcagaggctgctgaagagcaacagccacctgtctgaagaatgtggggagctgctgctgcagaggggcaccaccaaggtggccaccggcctggtgctgaacagagaccagaggctggcctgggccgagaacagcattgacttcatcagccgggagctgtgtgcccacagcatcaggaagctgcaggcccacgtgctgctgatcaaggctgtgcacggctactttgacagccggcagaactacagcgagaaggagagcctgtccttcatgattgacaccatgaagagcaccctgaaggagcagttccagtttgtggaggtgcccggcaaccactgtgtgcacatgtctgagccccagcacgtggccagcatcatcagcagcttcctgcagtgcacccacatgctgcctgcccagctgtag

SEQ ID NO: 19183 - DNA, 510 bp, Artificial Sequence
  Description of Artificial Sequence: Synthetic coding sequence
atggtgttccccctgcccaccccccaggagcccatcatggccaccccacccaagagaagagctgtggaggccactggagagaaggtgctgcgctatgagaccttcatcagtgatgtgctgcagagggacctgaggaaggtgctggaccaccgggacaaggtgtatgagcagctggccaagtacctgcagctgagaaatgtcatcgagcggctgcaggaggccaagcacagcgagctgtacatgcaggtggacctgggctgcaacttctttgtggacacagtggtgcctgacaccagccgcatctacgtggccctgggctacggcttcttcctggagctgaccctggccgaggccctgaagttcatcgacaggaagagcagcctgctgacagagctgagcaacagcctgaccaaggacagcatgaacatcaaggcccacatccacatgctgctggagggcctgcgggagctgcagggcctgcagaacttccctgagaagccccaccactag

SEQ ID NO: 19184 - DNA, 3177 bp, Artificial Sequence
  Description of Artificial Sequence: Synthetic coding sequence
atgaccaccgtggtggtgcacgtggacagcaaggccgagctgaccaccctgctggagcagtgggagaaggagcacggcagcggccaggacatggtgcccatcctgaccaggatgagccagctgattgagaaggagacagaggagtacagaaaaggagaccctgacccctttgatgacagacaccctggccgggctgaccctgagtgcatgctgggccacctgctgcgcatcctcttcaagaatgatgacttcatgaatgccctggtgaatgcctacgtgatgaccagccgggagccccccctgaacacagctgcctgccgcctgctgctggacatcatgcctggcctggagacagctgtggtgttccaggagaaggagggcatcgtggagaacctcttcaagtgggcccgggaggccgaccagcccctgcggacctacagcacaggcctgctgggcggggccatggagaaccaggacattgctgccaactacagagatgagaacagccagctggtggccatcgtgctgcggcggctgcgggagctgcagctgcaggaggtggccctgcggcaggagaacaagaggcccagccccaggaagctgagcagcgagcccctgctgcccctggatgaggaggccgtggacatggactatggagacatggctgtggatgatgctgagatccagaagagcgccctgcagatcatcatcaactgtgtgtgtggccctgacaaccgcatcagcagcatcggcaagttcatcagcggcacccccaggaggaagctgccccagaaccccaagagcagcgagcacaccctggccaagatgtggaatgtggtgcagagcaacaacggcatcaaggtgctgctgagcctgctgagcatcaagatgcccatcacagatgctgaccagatccgggccctggcctgcaaggccctggtgggcctgagccgcagcagcacagtgcggcagatcatcagcaagctgcccctcttcagcagctgccagatccagcagctgatgaaggagcctgtgctgcaggacaagagaagtgaccacgtgaagttctgcaagtatgctgctgagctgattgaaagagtgtctgggaagcccctgctgattggaacagatgtgtccctggcccggctgcagaaggcagatgtggtggcccagagccgcatctccttccctgagaaggagctgctgctgctgatccggaaccacctgatcagcaagggcctgggggagacagccaccgtgctgaccaaggaggccgacctgcccatgacagctgccagccacagcagcgccttcacccctgtgacagctgctgccagccctgtgtccctgcccaggaccccccgcatcgccaacggcatcgccacccggctgggcagccacgccgctgtgggcgccagcgcccccagcgcccccacagcccacccccagccccggcccccccagggccccctggccctgcccggccccagctatgccggcaacagccccctgattggccgcatctccttcatccgggagcggcccagcccctgcaatggaaggaagatccgggtgctgcggcagaagagtgaccacggggcctacagccagagccctgccatcaagaagcagctggacagacacctgcccagcccccccaccctggacagcatcatcacagagtacctgcgggagcagcacgcccgctgcaagaaccctgtggccacctgcccccccttcagcctcttcaccccccaccagtgcccagagcccaagcagaggcggcaggcccccatcaacttcaccagccggctgaacagaagagccagcttccccaagtatggaggagtggatggcggctgctttgacagacacctgatcttcagccgcttccggcccatctctgtgttccgggaggccaatgaagatgaaagtggcttcacctgctgtgccttcagcgcccgggagcgcttcctgatgctgggcacctgcaccggccagctgaagctgtacaacgtgttttctggccaggaggaggccagctacaactgccacaacagcgccatcacccacctggagcccagcagagatggcagcctgctgctgaccagcgccacctggagccagcccctgagcgccctgtggggcatgaagtctgtgtttgacatgaagcacagcttcacagaggaccactacgtggagttcagcaagcacagccaggacagagtcatcggcaccaagggggacatcgcccacatctatgacatccagacaggcaacaagctgctgaccctcttcaacccagacctggccaacaactacaagaggaactgtgccaccttcaaccccacagatgacctggtgctgaatgatggagtgctgtgggatgtgcgcagcgcccaggccatccacaagtttgacaagttcaacatgaacatcagcggggtcttccaccccaacggcctggaggtgatcatcaacacagagatctgggacctgcggaccttccacctgctgcacacagtgcctgccctggaccagtgccgggtggtgttcaaccacactggaacagtgatgtacggggccatgctgcaggctgatgatgaagatgacctgatggaggagaggatgaagagccccttcggcagcagcttccgcaccttcaatgccacagactacaagcccatcgccaccattgatgtgaagaggaacatctttgacctgtgcacagacaccaaggactgctacctggccgtgattgagaaccagggctccatggatgccctgaacatggacacagtgtgccgcctgtatgaggtgggccggcagaggctggctgaagatgaagatgaggaggaggaccaggaggaggaggagcaggaggaggaggatgatgatgaagatgatgatgacacagatgacctggatgagctggacacagaccagctgctggaggccgagctggaggaggatgacaacaatgaaaatgctggagaagatggagacaatgacttcagccccagtgatgaggagctggccaacctgctggaggagggggaggatggagaagatgaagattctgatgctgatgaggaggtggagctgatcctgggggacacagacagcagtgacaacagcgacctggaggatgacatcatcctgagcctgaatgaatag

SEQ ID NO: 19185 - DNA, 2409 bp, Artificial Sequence
  Description of Artificial Sequence: Synthetic coding sequence
atggctgctgaggccctggccgctgaggccgtggccagccggctggagcggcaggaggaggacatccgctggctgtggagcgaggtggagcggctgagagatgagcagctgaatgccccctacagctgccaggccgagggcccctgcctgacccgggaggtggcccagctgcgggcagagaactgtgacctgcggcaccggctgtgcagcctgcggctgtgcctggccgaggagaggagccggcaggccaccctggagagcgctgagctggaggccgcccaggaggccggggcccagcccccacccagccagagccaggacaaggacatgaagaagaagaagatgaaggagagcgaggccgacagcgaggtgaagcaccagcccatcttcatcaaggagcggctgaagctgtttgagatcctgaagaaggaccaccagctgctgctggccatctacggcaagaagggggacaccagcaacatcatcaccgtgcgggtggctgatggccagacagtgcagggcgaggtgtggaagaccaccccctaccaggtggccgctgagatcagccaggagctggccgagagcaccgtcatcgccaaggtgaatggagagctgtgggacctggaccggcccctggagggggacagcagcctggagctgctgacctttgacaatgaggaggcccaggccgtgtactggcacagcagcgcccacatcctgggggaggccatggagctgtactacggcggccacctgtgctacggcccccccattgaaaatggcttctactatgacatgtttattgaagatagagctgtgagcagcacagagctgagcgccctggagaacatctgcaaggccatcatcaaggagaagcagccctttgagcggctggaggtgtccaaggagatcctgctggagatgttcaagtacaacaagttcaagtgccgcatcctgaatgagaaggtgaacacagccaccaccaccgtgtaccgctgtggccccctgattgacctgtgcaagggcccccacgtgcgccacacaggcaagatcaagaccatcaagatcttcaagaacagcagcacctactgggagggcaaccctgagatggagaccctgcagaggatctacggcatctccttcccagacaacaagatgatgagggactgggagaagttccaggaggaggccaagaacagagaccacaggaagattggcaaggagcaggagctgttcttcttccatgacctgagccctggcagctgcttcttcctgcccaggggggccttcatctacaacaccctgacagacttcatccgggaggagtaccacaagagggacttcacagaggtgctgagccccaacatgtacaacagcaagctgtgggaggccagcggccactggcagcactacagcgagaacatgttcacctttgaaattgagaaggacacctttgccctgaagcccatgaactgccccggccactgcctgatgtttgcccaccggcccaggtcctggagggagatgcccatccgctttgctgactttggagtgctgcacagaaatgagctgagcggcaccctgagcggcctgaccagggtgcggcgcttccagcaggatgatgcccacatcttctgcaccgtggagcagatcgaggaggagatcaagggctgcctgcagttcctgcagagcgtgtacagcaccttcggcttctccttccagctgaacctgagcaccaggcctgagaacttcctgggggagattgagatgtggaatgaggccgagaagcagctgcagaacagcctgatggactttggagagccctggaagatgaaccctggagatggagccttctacggccccaagattgacatcaagatcaaggatgccatcggccgctaccaccagtgtgccaccatccagctggacttccagctgcccatccgcttcaacctgacctacgtgtccaaggatggagatgacaagaagaggcctgtgatcatccaccgggccatcctgggctctgtggagaggatgattgccatcctgtctgaaaattatggaggcaagtggcccttctggctgagcccccggcaggtgatggtgattcctgtgggccccacctgtgagaagtatgccctgcaggtgagcagcgagttctttgaggagggcttcatggctgatgtggacctggaccacagctgcaccctgaacaagaagatcagaaatgcccagctggcccagtacaacttcatcctggtggtgggggagaaggagaagattgacaatgctgtgaatgtgaggacccgggacaacaagatccatggagagatcctggtgaccagcgccatcgacaagctgaagaacctgaggaagaccaggaccctgaatgctgaggaggccttctag

SEQ ID NO: 19186 - DNA, 1149 bp, Artificial Sequence
  Description of Artificial Sequence: Synthetic coding sequence
atgttcaagatccagctggagcccctgaagctgcgggcctggaccctgaatggatttgtgaagttcaggaacaaggagaccagcgctggccctgtggccgtgatgggcaaggactactacaagatcctgggcatccccagcggggccaatgaagatgagatcaagaaggcctacaggaagatggccctgaagtaccacccagacaagaacaaggagcccaatgctgaggagaagttcaaggagattgctgaggcctatgatgtgctgagtgaccccaagaagaggggcctgtatgaccagtatggagaggagggcctgaagacaggaggcggcaccagcggcggcagcagcggcagcttccactacaccttccatggagacccccacgccacctttgccagcttcttcggcggcagcaacccctttgacatcttctttgccagcagccgcagcacccggcccttcagcggctttgatcctgatgacatggatgtggatgaagatgaggacccctttggagccttcggccgcttcggcttcaacggcctgagccggggcccccggcgggcccctgagcccctgtaccccaggaggaaggtgcaggacccccctgtggtgcatgagctgcgggtgtccctggaggagatctaccacggcagcaccaagaggatgaagatcacccggcggcggctgaacccagatggccgcacagtgaggacagaggacaagatcctgcacatcgtcatcaagaggggctggaaggagggcaccaagatcaccttccccaaggagggagatgccaccccagacaacatcccagctgacatcgtgtttgtgctgaaggacaagccccacgcccacttcagaagagatggcaccaacgtgctgtacagcgccctgatcagcctgaaggaggccctgtgtggctgcaccgtgaacatccccaccattgatggccgggtcatccccctgccctgcaatgatgtgatcaagccaggcaccgtgaagaggctgcggggggagggcctgcccttccccaaggtgcccacccagagaggagacctgattgtggagttcaaggtgcgcttcccagaccggctgaccccccagacccggcagatcctgaagcagcacctgccctgcagctag
